United States Patent 11,096,956 (ANTISENSE OLIGOMERS AND USES THEREOF) - sequence listing, part 2

SEQ ID NO: 6276 - DNA, 131606 bp, Homo sapiens
gacttctcaggcaccaccagcagcgccaccgagagttattattattttttgaccaagcagcacatttcctggttcagtggcttgagctctgtgagcagctgactagtcaccccgggtctggctcaggatcagctggtgacgctgggctggagtctatgacttcttccttcagattgtcatgaagaaggggagttaagaggaaactgggggtcctccggaaggcgatctgagcactcaggctgatctagaggaagagtagaagtcatactttttttctcttgcttggtgaattccccagcagagtctggatccagcagtgctgttttccctgagggaatgtggagcagctcggcttgagtctgttgccagcttcaggaagggttcagactgaaaagggggtttgaggagaagatgctttggctgcctgaggtcctgcttgcgttcttagaagtcagatccagggagaaagtgaactgggacaattgacaagctccaagggtctggcagaagcttcctccgagactgggcatttcatcctccctggaggtgggtaagaaatttgctctaattcacaaattaaacagcagtatattttctaaggaggatgagaaagccagatctagggcctttgcactgggggaggatattgggtcttcgttttcttggccaggtagcatttttggtggccctgcgaccccttttgccttttctatgctgattagaaagctcgattacaaagtgttatgtcacagctctagggagtcctgaagaaacgcttaaatcttgatgcttaagaagaagcagcgtttctctaaaagtgtagctttctttaaaaaaccataataatatggggaaaggggctaacagaccaaatacctgatagcgttcatgtacagtagtcatttcaacacatgatgtcagaaaccattaggggatctgaggaacaaggactcagctgagacttccaggtaaagaaatggctttcaaattatttaggtttaattttagacactgctttcagattagaaatggtgacagagcttcagaatatgactgcatagcctggctgaacacatgattcggtttgccctctatgctgggtttcttgagggagtgatcatagttagttctcctcactcttggcttctcgaaaaccaatcatagcattactaatttgccatgggggtcttgcaatgaaatacagatttttaatcccatggttttttgttatgtggtcttggactatgctggggtccagtgggacttttatgaatcataaataatccaggctgggccaaatcacactgaggttagcgatccataccagatgtgatgccatccgctggtccaaatgtggctcttgtctaacttaggcacatagattatttccccagtgagagagttctgcttcccatatcaatgcatgtatgagcacagtcaggggagggctccagtgtgccatgaatatgtagacatagactgccgtgtactgaatctgcagctggtaaggctgtgatttgctttgcctgcacatctcttcccaaagagtgttttaaaccatctcagtgagacttaaactaaatgaagcagccttgcctctttgctagaggccaaattggctgctgtaatcctgctcctcagaaggcttactgcctgctgatggctttcacagatgggtcaggatgagggtccccaagggctccagagtaagtcacaactttgacataattaccatattttggaaatttggattttaatgccttgagtgcttataaaggttttgcctttccatcaaatgctccttccccttgggaattctgtttttcatgtgaaaattaaaacatactggctccatcgggcatctcagtctataaagattcacggggcagccagaaagagtaaaatagcattgtttgaaatggtgtgtttataaagatttacccatgaaatgtgagggaataaaatagaaatagaggaagaaagatgcatttatggaagcttaaagaatgagaagggaacttagaggttagatagtatgagatgatatttatccagggctcagactctggagctggaaagagctgaagatacttaaagctacccattcctgccagtaaagtggagagagcaatggaatctatagttagggtgataggtgtaaggatttaatgagatgacctatgcagagcacagtggcagccacatagtaaatattcagtaaatattagctgctattgttgttgttgttgttgtcattgttaccattttgtcattatcattataagtgttgttgctaaaaaacagtattgaaaaggcaacatgttcacatccatttgcctgcagaaaggttttgctagcagaaaagatgccatctctggtactgttatatccaaatgattcccactcaaagaaactttccaccctattgattgagttgacagaataaagtatattatccagaactactgtatttcacagaactgaaagtgaccagctggtataatgaaaatcatttagaactaactggggcttaggcagccttaaagaaggcatcctgttttggcagctgacaagtcacatgtagaaagctgcggggtcccagttggaatcaatgcatttctagatttctcttctgcttcacctatgcatgtgagagacagtccttttctttcttaattcttttcagtgcagatattgagcattttcttctctatccagggaggccattgaatatgtgcttaacctgctggttggctcctcagaagttccaaggctgaatttttgccaccatctgggtgccttcagcttatgggttggctgctaagggaaaggaatagccctcccctgcctgcctgcctaccatggcccagtctgtctgcttttgttttgtgtcactgctatggcacaattttgccaggctcgtggtctgcctccttcatgccggtgggcctacttctgtcacacaagtggactgctgtttctccctttcctcccaagatctttctttttaattttggggaattagaactctgacacagggatctgaaagacaaaagtgaattacaagagtgagaggagtctgccataaaattctttcccaagaaactcggaactgggagttggtcgttcctggttgctactgatctttagtagagttgtgttttgcacggagaataatatttataccttaaccacagcccacctcccttacttcctgatgggaggtatgatctcaggagagttgcctgacctctctgaactttggcttcctcatatgaatattggaaataaagtcccctgaatgcatgggattgctgtgaagatagcggctataatgcccttgcccaattcctggtactgactggatgttgagcatatttcccagttaatcccgatctgtgaacaacagggggcagtaattttaatatttatttaacggagaaactgaaggccaatagaattaaattagaaatcaataacaacaaggtatttgggaaatccaagtaaaatgacatagcagatgacaaaccgtggtacccgtctagtgcttcttttaataaacatcagttccaaacactctgaatttgagaagggctcaatgacccaactgcactgcctgcctcgaattagcagaaacctctttatttagtagcccccaggctgtggtcatttcttctgtgctgtctgtaagcacacaagagtcaaaaggctctgtccctcagataggaattctgggtggcaattggataaagactttcttttgtgcttaaagatccactgaaacctttctctgttcattccctccatgactgtggtgcttataaacagggaactgctggtgaccatgagctatttgcaaactaagaagcttgaggatgagatattggccaaatctgttttctttgttgatgcttttgagtgacatttgcccctttgctctgtcttaacctgtaaacatttaaaatgaaatgttctggtttttatgctgtgtgtgtgcgtgtgtgtgtgtgtgtgtgtgtgtgtgtgtgtgtgtgtatgaatcaagcaggggtgaagatctcttttggggattgagtcagtcgagtttggagacttcgttttcttttttctttggcctattgtctgagcagtttattatttggcatctgaaaaccataggcttgcttgttgtgttatttccctggggataaggcagaggagaaaaaagcaaggctggagagaggggagagagtgtgtgagtttggatggagctttaagaggaggggagggaaaggaagacagaatggagaagcagctgggagaatatcagagcaattgccaatccaccacgaaagtgcaaagctgaaggttccctttgggtgaagttgcaactcagaaggcaactctgttctcctttagctaaaaactcctctccccatctgtcctacaaaactcacagcgaagccattttaaatccgaaaaccctccttatgactaagcactgcacatgttttccactagagcaccatggaccatttctaaaagtacattaattaaaaggagcagattttcaagtacaatatgagcctgcctttccctggtgggtgtagggggtaaactttagcgcatgtttggctatgaagtctataaagatcaaattggctgaaccaagcactcagatatgagtgttgacttggaagatgaaacctaacactccagggggcacagaatccagagatgtcgctggttggaactggaggcatgaagaaaatcagggctggcctcgtttgacaaagcattgccagagtcatgctcactcagaacagcagagtgaacctacaggaggaagcaatagtcgggggttctctgatagctcccttcttcctggtgctagtgtttgagctgctgtatgtgtttgagctgctgtatgtaagtgtttgagtgctgtatcctggggcactgaaggcagcacaggagccctttctttatctctttggacatggagcaagagccacttccggttggtatgttttccaacccagcacccagcctgcctcgagtgataggtggctgacttgagttgcctcgattcctctcacactgggagtgctattgtcttcaagtcaccctcctctcctcgactccttaaaatcaaaccttgtaaatattttccagccccatccagggttaagggtagccagggcagaaattcttagcatttcatttcaactgggcaagatgccaatttttccagctcttttcttggcatccattcatcagttatgagtccttagagatgcctgctcatgaaagttccaagacttaactaagaaacagcctattttctatggtcacaaaatctggtaaggttttaaggtaactgttaatatagaaggcaatgtatgttttgggtgtctatgtgtctgtgtatagtctatggttaatgttgatgtggatgtatgataactgtcacagactgagcgcctactgagtgtttgctacgaaagatgctttatgtaaacttgtcttgttaattcttacagcaatcatgcagctagatattattggttctatttagtaattgagaaatcaggactcctggaagttaagtaactcgttcaagcttacacagagagtaaagagtaatgctgggattcgaacccaggataattagagtccaaatcctgtccaccattctaggcttctttatacttttcattataatgtcccctggggatgtgtttgtttctcttatatagctcctttatgaatccctcatttgagaaacacctcattatttagccattgaattaaaatctcgttggttgatctttggtaaagttggaaacacacaagagaatatgtcagacttgaaacagaacataggggtgtcttcaccttctgcttttaatgtggcttttggaatgaaagtgtgagattgcttggaaagtcagaagacaccctgagatgagaagtaaaaactgcaggcaggtggaagaagtcctttgctggactacagggaacatagggaattcttctggtctaaacttgtggctgtgggcagagagatgggagttcggagagagggaagccaagcttgttgctcttgatcgccagttgtgtgcacatcaggttctaactaaaatgtatgtttccgttttctgagcctcagttctttcatcttgaacatgaaggtcctaaatcaggtgatctatatgttgtcttccagccatgaccttgatgagtgcaaactttcagaatgaattcagcctcatcagggaaggagtgtaatttgcactgttggccactcttggcggggaactaaaaggtcaagttttagatcaggacctgacttctctgtgttgtgaatatgtgctggaatatgagaagtggtagccccccagagaatggcgggaagcttcctggaagaacgtctgacctttggatgctttccactagtgaagagggggtgtcagtgggcagtgtgttggtgttgctcgttcactttcagaagctctccagggctttgttatgtatgcaagcatcctacagagtgctagagaccaaggcttctcaagtttaatgtgcatctacctgggggcgttgctgaaatgcagattctgaatttttaacaagctcccctgggatgctgatgctactccttctaaactacctttataataggcatagaggaaagaaaatttgactaaattcagaaagtccagagtctagttccaattgtcacttatttgagtaaacctcaaataaatccctcagctgcaccatgactcagtttctccatctgcagagtaataaaataatatttaatatttaatgattactgcgtgccaggcactgtgttcactaggtgttcactgttttatgtgctgtattttacttgatccttgaattaggaggaagggtttgttaccatctgcattctgcagtaactaagcacagagaggttgaataacttgaccgaggtcacacagctagttagtggccaacttgggatttgaattcatatcacctgactctggaaccgtcacaacttacagacataagagatgtgaaatatcttgggacttactgtgtgaatgtgtgtgtaattatattatatgtacaattacaaatatttcaggtacttgagattataagaagtagatgtttcccagatgaggttttattgtttttaagtaaaaaatgttctgatttatataaattaaggtaaaaggcattgtgaagtttcaaagagcacaggtgtttgctctgttgtcacctggggtggggaggaagtggtacatgaaaggagtattctggggaatgaggggttctggttaactgaggttttggctattttaaattaaatcccagttcattatccgtcttggttttgtaaatttgtacagtatgacagatactttttctgccttaataggaaaagcagggttagcccaactgagtatatcttgtgattcaggctgtggcagccatgcagattattgtcctgaaaatgaatcccagtgatcctattttgtaaggaagcccgaagaggttgattgtgaacattatctgagtttgatatttgtcacctcactagacaccaggctgtttggactttactcttataaatgtcctgaccatatgattagtatgtcaaatatgtggcacctgtatcaccatgctccagtctccttagtccacttcagacctcacaaataatcgacacgtttttttctgtccagccccaatgcatccccagagtccttctcaacacagcactggaggcagcctgtacccatgagttacagttggcccaggagatttacactacatgctaacccaacccttggataccccctggaagttgattctctttccagtttagtaaatacgtattgaacacctaccaatagcctaagtgtgctggaatgaaaccctattttccatttactctgtattttattcgttcttacgaatgtgaatgttctgcaggcttactgaaagttttagttaattacttaatgggtacaatgtacactatttacgtgatggatatactaaaagcccagacttcatcactatgcagtatatccatgtatcaaaactgcacttgtaccccctaaatttatacaaattaaaaagaaagtttaatttttggtaaattaaagttttaatagtctttttttctttctttctctgtaatatacatccttttattctgattaataccttagggctcctgtcccttttcagtaccagtgatgtagggtctttctccaggtctcctgctgtgatgctgtcagaggaatacctcctttacaaggggctgttttctgtaggcatcctcctggcagtccagccattggttaggtagtcaggggatatgaagtgcgtgctcctggcacagcaactgcatagccctcagctacagctctccccttcccctgacagcttatccagcaagagtcagaacttcatttaaatcgctgcctgagtctattacttgcttttgagttcatcatctcagaagttgccaggaaagcctgtcaagactagaagcttgccacggactggaaagatgacacccccacccttgcatcctgtggaggttgggccactccgaagtgcctgcctcattaggaaggagggtgaaaatgcacagcaaagaattcacgtgctcctctctcaacaggagcttcgattcttgctagactggcttctgaaaggggaataagtagaaagcagcataatcacagggcctgactgatcagaaagcttgaacctgccttcttttcactgtgtcagtttggctgcctaaccagctgcctaaacactcacgttgtttgcccttgtaatgcttaaaaatggttttaaatcctgcaccactgaattgctaagatgcagcatcctaaatggtaactatgatatcatgtgctattttgaatttttaaaagaatgttacagagagtgagaaatagcaattgagcatctgcgagatgtaaggcgctgactttggccctgtgggtagtttaaaatatcacagccggtcttttgcacttaaccagttttccaaaccagatgtttttagcttaggatccctggacagcaaaggactggacagaattgatgaactttctgaaatttaatgcaaaattttctgtgaatgtgcatatgtccattttttaagggagaggatcccagctttcatcagattttaagggcatcaagtcacccgaaaggtttaaaactgctaagttggctggtaggttgttgtaaactcatccagagaaatctctacaggttaatgtgagactggaaaaaataatgtttttctgccccagagcagatagcccagagaaatgcagcatttttctacatgattacccaggagctaatgttaaaccctgcggagctagaaggagagagttacctgattttcttccattctgtagatgagtaaattgacggtcgtggtctcagatgccaaggccataggagttcttgttccttctatctctcagatagtttttattgttcactcaacagtttaacaaccttttgaacatttgctgtgtgctaggccagagtttttcagtatttctgtacttgaggcgttctttcaaatacttgacattttgcagtacagtaacagaattaaattactacactatagttatggtacattgtcagctgtaatatatttttctctacctcatcttaagcttttgcatactttcatttaattgaggacaaaggcagtctttctttaatgtgatcttggccaaacactactcgtcatgtagttgaatcacattctacatttttgacatcattgtagcaatatacattttcagttattgtaaaaaaataaatatgaaaaataaaatttacgctttggtcatatcttgttagtagctcactggttgcagttagatttcagactaagtattagtcaaaatttcaaagagctacttattgaatgcttattattctagataaaggattttaaaatttacattacaatgggaaaaggtattttagacacaccaacaaataaaatggcgtctgatgttaaggaaaagatgtctttggttgatgatgggaatagtgaaaagcagaccagctcctgaagtactgagggaagggtgttttgggccgaggagcagctgctgcaaagatcctaagagagggaaagccttggcaaattcaaaggacaaataaagactgctgaggctggaacaagatggggaatagagtagaacaaaataaatttggggagagaggaacagaccaggttatatagggtcttgtaggctatggttaaggagtttgtgcttcattctcactgttgtcagaagttaatggcacattttaagcaggagagctgagtgttatcatcattgtttaaaaaacaaacggtggtggaaattagattctagaagggcaggcatggaggcaggaaattaagaagtaggctattgtagtagctcaagcaggaggtaatggtgagttggagtaggatagtaaagatagaggtggtaaaaagagataatgaataaatgactaagactcatcccgtgcaccaaggaagtccacggtcccggctcctccttgttcgtttcgtcaactatgctaaaagtgtgtaggcgttgctacatctagcaggcttgggacgcagtgcgggggctgggatggaggaggggtacatccttcaaccagcaccttgtcaaatcggagtaaaacaaattttttaatattttcaaaaccttactcctgtagacatgtgaatccaattcatcaagggcttctttccaaaaaatcatgaaaccaggaaatgatattttctttctgtgtactttcctccttcctttcactgctgtaagaatgaggaagcgagttgtagctcagaacaaaaccacaaaaacctttccatagatccagctcaaatcagggaaatcagcatctcacttttgctgcctgtccctcctgtagaaaaccctgagaattttgtttgttttgtttctttcttcggacttgactaaagccaggtctctcctgaaaataatgtctttccctgttgtgtctaactcaatctgaattgaggggctttacatccagcattggtgtctggtaaacctccaatcgctcgattctcttgtttcgcaagtccactggggtcgtccggagcctctggcctcctttgctgagcaacatggatttctgggaagtttttccctccagcacttcagcacagatattaaagggcccctgtcaagttttgaagggtgtgaccattgccagaatcaccacaagccaagcccctgagggattccgctgccagctggctcacgtccataccagagatggctgaatttctgtggttctctgtgcatggagctggcccagttcccctggatgaaaggcggcctaatataaactgaaaatgttattaataagcagccacttaagaatttcctatgacttgccagtgatttgggggcctctctgtgaacaggggaaaaagcacatcttgttttacatggattaagggaccagtgcagccagtctggaggggctgccaaaaggtattcaggtgtttggtgaagggctttgggtaagttccacaaactcgttgagccttggttgtcctatctgtaacatgagaaggataacaataattttcttctcatagtgtggtttgaggattaataagaaaagcgtggaaagcgtttgacacagagcttggcacatactcagaaaatgttttctgaaaaaagttggagaaatcacacccccaaaatgaagccaaactgaccttatgcccctgggctcaggggaaaatgagtaaacttggggttccagatacctccagcattcagtagtaaccacagtacttggcttctctgaacttcactttcttcatctataaagaacccctgctcttctgactaaccttgtagagattattggcaattcaaaagttacatgaaatgaaagggcttggtaactctaaagtccttgattcatccgacaggtcattaatttactgtctaacctgtctgccttattgcaacttggtatgaaaagaaagtcatggccgggcacggtggctcacccctttaatcccaacactttgggaggccaaggcgggtggattacctgaggtcaggagttcgagaccagccgggccaacatggtgaaaccccatctctatgagatataaaaaattagctgggcatggtggcacatgcctgtaatctcagctagatggtggaaggctgaggcaggagaattgcttgaacccgggaagcggaggttgcagtgagccgagattgcgccattgcactccagcttgggcaacaaaagaaaaattccatctcaaaaaaaaaaaaaaaagaacaaaaaacagtcattagtatgaccttgaaggattaaaaacttggtcaaggatacataatcctttggtagggataataatgaaattaccttgctcagtccagcacacctttaagtgtacactaaggatttgctaagatttatcaaaatgaattgttcaccacccgtctgttttccattgatctctttccatcctagctggaaatagattagtagggtctaggttgacttctagagaacaagaaccctaaatacttttgtttgtttgtttgtttgactttgtatccctagacatagggtaggacctagcacactggcacatagtcaagtttcattataccaagaatgttgtatatattaagttgttaaatcctagtggcaactcagtgaagttaggatttgagcccaagttatggtaaccacagaatctaagatcctaacccactgtggtatactgcctttaagtacttagggaatattttatgcctcagatcttgtctgtataagtttagccaacctcgtccacaaagaaggtagagactaaacaagtacttcagcaggtggcatggaagagaaaagcaaacgaagaggtgttttgtggagtcttctgatccttgccttgaagtttggagatgaggtgtgttagaattcagttttcattcatttcctcagaaattggtcccccaaaggatttatctggaaaggaggggctcttagaacttgctctgataaatgtccaatgaagcaaaagtgtgcatgccataaaatcacaggtggcatgtagacaaagtgaagtggagaaatatatctagaaggagtaaccaactctatctaccatggtttattctttgcagaacagcaggtctgacaggcagctgaggaaatcggagcttttctagataccccacagccttgcacagggatacagtgatgtggggatgcaggtagtagtgttgccatggagacaccatcagtggccaagctcttctcctttgagggctcactccgtctactcatcacgaagttgaattagctctctatgtgcttggtaggcagattcctcactggcttgtgaacgcttttaaaataaagccaaaactccttcccagctgccatcttgttaccatcctagactcctgtcaacatctcagtgacagcatgttctctccccctgccatgactttattcacctgttaggactactttttcattatcttttttcctagaaacctctcctactcagtaacctttgggtccagcttcctcaagcaggccttccctgatctgttgttaaccaggaaccttctgtagcacagtggctaacacattaatgatggcctaacaaaagagtcgcagtaccaaccactttctttgttttaaaactttttattttgtaaaattgcaaggttagatcaaagttacaagaatagtataacaaactcccaaacacccttctagatttttctgttaatattttgccacatttgtgctgcttattctctccctctgttcctctctctttccacacacacaggcatatacacatatcatttttgttgaaccatctgagaataaattgcaaacatcatcccttatctgtatacatttcagcatctttctcttcagaacaagaacattcttttaaatatctttttcacaagaactctccactttgaaatttatggtctagctatttctggctgtatcattgtgtcagatagaaactcctttttatttttttaactccttgcaacacctaccacaatgcatggtacacagtaaattttcagtgaattattgtttaataaatgaagttgactgccacaagtatttcggcattgcctctgttccgccttttggactcatggttcctgcttctgtagaaactctaccttgttggttgagcctgcttgtcttgcctgtgggagagggcaaagagcaccaaggagtggtcttcaaccaatggctgttgagagttggttgataagtacccctacttccttgactctcaaggggaatgtatctgaggaatgttctgtactgtctcccagaggtcctcagctgaaatgagttctggttgctcaaagctgctacctgttcattaacttacactctattggcatcctacccttccccactttcattcttctgttccctgtcaggcctttttgggatcttctcccacaagattcagataccttccaagagtctgattctggggaaaaccaatctaagatactgcccctcaatgactgaggcatcatttctgcaaatcaaaatacagtaagagatctttaaattatatgtttccaagcaaagtcacccaggaggcttatttttaaaagggaaggaatttccactgctcaaaagttacaagataaattagtctaaagtaaggcactgcatataattcttcattgaagcatgaattggcatattaaaaagaggaaacaactgcccctgaaaattaccctgtaccaacttcagcaacccctgggagagagaagcacttcttggtgcagatggccagagccgctggagcccagccggaagggagggagttggataggaccaggcagtgtggtcttggcactcagcacacaccagcctcatacccagctggccccgtcacagtctccgcccttgagcttctgtgtttattaggaaaccatttttcctttctcacagagatagaaatcttgctcccagacatggcaagtgtcaaggttcatgcctgggtccctcattcagactgagtgtttgccaaaaaaggggaaaaacaaagtattgtggctaggggcagggagttaaggagccagtaagactgcaaataacaggatatgctgacgtctgggtatcaagacagagggatatagaaattccaaggagaaacgggttagggaggacgcgaagtttcctacacccactaaaatggcaccgtcccctgaatttcacatctgtgcttgggctttgggacaggcagtggcccagccagtttggtcactgtcattaatctagacagtggtggaggaggagggaggccacaatatcaccttctgagaatgactcacacagtgctcttccccacctcaggacctgtgtgctcacttcttctctgccgggaaaactcgtactctgatttttctcatatctgcctcatagtcttctcatcacaactcaaatgtcacttcagtgggaggcccgtcctcacccatcctcagttcctctctttctgatttccctatttctgtcataacacttatcacaatctgtaaatggcaggtttatctgtttgtttacttaactgttgagtgtcttcctcacttggttcaaagctccacgaaggcaggcatgttgtctgtcttaatgactgtcgtgtgcccagcatcttagtgcagtgcctaacacacagtagctgctcagtcaatgttggtgggtgagtgggtgggcagttggttggttggtaggttggttggctggatggataggtatggatgtatgtatggatatgaatggatggatagatgggtggatggatggatagatgtggatgtatttacagatatgaatggatggatagatggatagatatagttgtatgtatggatatgaatggatgggtagatggattgatagatatggatgtatttatggatatgaatgaatggatagatgggtggatggatggatgggtagatatggatgtatgtacggatataaatgaatggatagataggtggatggatagataaatatggatgtatgtatggacatgaatggatggatagatgggtggataggtggatagatatggctgtatttatgggtatgaatgaatggatagatgggtgaatggatggatagatatggatgtatttatgggatgtatgtatggatatgaatggatcgatagatgggtggataggtggatagatgtgtatgtatgtatggatatgaatgaatagatgggtggatggatggatagatatgtatgtatttaaggatatgaatgaatggatagacaggtggatggatggatagatatggatgtatttatgggatgtatgtatggatatgaatgaatagatagatgggtggatggatggatagatatggatgtatgttcggatatgaatggatggatagatgggtggatggatggacaggtagatggatggatatggatggaataagagaaggaatattttgacactgtacctaaaacaaggtaggagaaagcactggttttagagtcagatgacataggtccttaacttcagtcaagtcacttatgagtttatcagctaaatttttatatctgtgaaatggataaaaatgccaactttataggactgctgagagagaaatgagataaattaagtgaaaattattgaatattataaaccttcacaagtatgagcagttgtgttaacagtagaacatagctgctctgttcacccctcacctgccatcctcagtcaaagcacaggttgagctagagcaacaggagtcagagcctggaggtcacacctgccacctggaggccttgatcttttggagcagatttttacctcttggaacattcccatttgatttcaggccagcctctacgaatatattttcttccttcctttctggcgttctgactctccgcttaccccttttgcgagggatgtataaggtaggagctgaagccctgtgtgggggtcacatgatccatacagttcttgaggagcgttgcttgtgctttttgtgatagctcaattttaacaactctgacctgttcaaggcaggattatctcagcaatatcttagggcaggcagaccttgcttccagttcttacagactcagtgaaacacaaccggggaatgcctttcttgctaacaacagccactgtcctttcatttgcttaccttttctaggcagcctgcagtctagaaaaagctctctttacccagacacctaattccctcctaaaacctgacggaggtgttactaaagggcagtacacttgagaagaatgtttggttcattttaggctggtgttgtgcgtgcatgtgaagagttgatgctttcattggaaactcagggaaaatgggctacagagcagatggagtaagtcaggccgctgcccagctcctcctgcgtcagcctttcccagagatctattatatggtttgaagtgatgtaagttatcgcagcattggaggttatatgactagcgtacaaagacacaattcaaagccaagtcttagtggttttaaattatccgtgccgcatctctctccacttgcacagaaaattgcaagttgatagctagtgaaatctggttgtcagattttttttttatcgaagggacctaacttttaactctgtgatacccgtaagtatatgttatatgtaattcccacgttggaggtatcttttacattacataagtggattgttgatcctgctgcagggcaccagttcagaacagacccgcttatctggattgaataatgcacatctatttgctgagagtgttgtgtgtgcatgtgtgggtggctctggctcatgtcttgtcgttaccggccagagtcttatcccctggctctggctgatgaggaacacgtagaatgaagtctggtctccagtttcttaacactaagggaaaagaggaccagcagctgtttctgtttaatggtgattatctttgggattgtgagtgttttgaaaattttttactcttacttcttatctgtagtttctgattttttctacattagttgtatagttgtatattgctttttaaggataaggaagtaataactttataataagtataataaggaggaaaatgttttcctctttttttcttattaagaatgaaaagagagctgggcacagtgactcatgcctgtaatcccagcactttggaaggctgagtcaggaggattgcttgagcccaggagttcgagaccagcctgggtaacatggtgaaacctcatatctacaacaaatacaaaaattagctgggcattgtggcatgtgcctttagtcccagcttctcaggaggctgagatgggaggattgcttgagcccaggaggtcgaggctgcagtgagccatgatcacaccactgccctccagcctgggtgacagagcagaccctgtctcaaaaaaatgtgttcttttgcctttagtgagctagagtcatggaagaatttaaatacctaggatacatctgttatttagcaaaaagcaatggagagctttgggttattttagcccttgttttaaacaaaagtgtgttttcccacctctggccttgcctgccttgggcatagccatgttgaatcctatgttgtgcattccttgtcagtcacttggtttgtactggggctgaaccactctttaagcagtctgccccttgtccctgtgcatgaaagtggcctgaacctgatctagccatggacttgggacagaggagcccacaccacaggggaggtggaagtcaagacagatggcagggctagcaacaagagacactattctcatgtctgatgtagtcttgcctttcaccagtgccttttcacaccccactgggtacccagctgagtggcaggagggcctagtgatgcaagaggttaagacatggtggcaaggaagggctggcatagattctttgggacagtttgaaaatgtacattgcccagagttgctgagaccatcgattatattggtaaaacccacacctgtttttaaaccacactctacggcactcctttctgactaggaggctactacagaagagtggccttgagctgtgcttggaggaccggctgcatcacaatcaccaggcacactggtgaaaatgcacattcctgagcctgcctcagacctatccaattatagtcactgggacatcctactattccccatgcatctccatgtaatgtcttggcaaccagatatacagtttctcacaactagaattattatttatctaagagtttcatgattaggaattatttatttcttaaaagccgttaatagcctctatattttttcttctttccatctagcaaattaccaagcacctacttcatattttggcacatgctagaaatgacttcgtggagtctaggaaatatggtggtttttagccttgtggctttggaaccttgagaatttcaaggccatgaatgtgcctggagtttggggaggaggttgagcttaggagaagttgggctcatagtcttcttctccacatcaacttgggcagccctgttttctgttttgagtttccacttatgaattcttttacaaaatgtattttcctcttattaagaagcgggggggaataaaagaaacagaaaagtaaaaaacaggcttaatgatgtttgcaatcccattcgaatctcaatttctacaatttgctacttgaacttgtcaaaaatcatgttctaaaggaagatcccttttttgccttcatcctatcacttctcacataaaacaagaccttgtggttcagggttcggtgttgtaaataacctgtcaaaatctcaaggataagtattcctgccaccaaccctgtccccagtctactcatgatgaatcctttcaagtaatggcaggcaagttaattggtatagattgttagtcattttccaaatgataacggccactggtgcagatgaccaagctacttggagatagttaaagagagggtctccgcctgacaatactgtgtatgccatgaaagggctaattatggctgctgagatacggaagccatgatttaatgctgcaactttggggtagaggatttgcagaggttgttttggggtagaggagaatgcagaatctcctctctctaaatcatgccttattcctcagaaacctgtcattcacaaacccaattatgtgcagatagaatgtcaactctgacagaatgaagccaatgcaccctttgtatgtttttttttttttttaacgaaatcctgctttgctagcaggttctattttcataaatgtctatttaaaaaaaaagccaaatcatatatttccccacacacttccgaatatgtttcattcaggttaaaagctttaatcagtgtgttgaaagagagctgttgggtgttgctgtgtgcattttgccaaagggggagagatgcaggaatgaagagaaatcctcttagcatcacttctgaccctctgcccccttctgagggtctgggccttgggttcccaatttatacatggaggttattaaattagccattaccaaaggttgtcatggaatcactcaaaggttgaaaattctttacaaagaaaaatgtcttgccacgggagtgccagttaattataaatgagaagtggaaggcgggcagctagcatggaaaacagataaggtccttgtggctttgagttactatttagggttttggttttttttttccttttcttcccccctccttggttttgcttttgcgtgtgtgtgaggttttttgttgttgttgttgttgttgttcagaagtaaaagggtattctgtggttggaatcagatagattttctataagtaactttttgcttcagtggtcagttagagcctactttgagtccatgttctgctcactatttagggttgatcaactgctctgaatagttcagttgcttaactgcttacaagccacttaaccactctgggcctttgttttcttccgtgggaagtggagataatatttcctttcctggaggactgatggaagagtctaggatcatgtatgtaaggtataaagcaacttaaatgccaggcatatggctcggtatatgtcccctccccatcctgacctcccatatcctgcttctttctggttttcagtagcacttgctgcctttaacatactttgtgattgaaaggcttgttatgtgtattgtatgtttctcccctctgagaacgtaggccaagagggcagggatctttgtcttggttgggtacccaagtacctagagcaggccttggtacgtggtaagtgcttgatagttatttgggtttttgttgttgttgttgttgttttgtttttgttttagagtgtatgtgtgtgtgtgtgtgttgagacagcatctcgctctgtcacccaggctggagtgtagtgatgcgatctgggctcactgcaacctccacctcctgggttcaagcggttctcgtgcctccacctcctgagtagctgggactacaagtgcccaccaccatgcccagctgatgtttttttttttttgtatttttagtggagacatggtttcaccatttggccaggctggtctcgaactcctggcctcaagtgatccatccacctcgagttatttgttgaatgaccacatggggcctcagccctccccatcgtctcttttctgtttatccttctacttgtcgatgctcattctggatctgattctgcactcctcctttgttttcttgttatctttattccttctcctggatcctcagttcgttaaatcatgtccatccggcattagtgtgctcttccctgcataattagtatgtgaataaatgagtttaattggtggatattttgggactgaatttggtaaaagttttctacattttgatgttcaagtatgactttctagtaaaaagcattagtcaccaaagagcttagtcaacttacttaaacacattgaaacttgtttttccttaagtcataaactggcataaaaatttcttggagaaataaactgactgcttcccaacagacctgaccattgtgcagtagctgattaattaaagagttactattcaaatgagctctgactatttttaaaagcaacaaccagggtttggatggaacttctttgagttggagatgcaaacgagatccaaggtgtgcattctgtctggtgtatatttctgatttgatgagaagcagaaagtgggggaatctgacaagccaaaatcagtttggttagactaaactgatttcgtttcttcaagtacatttttatgttgaaatttaggcacaacacattaatagaataaagacataaaataactaatcatcttgatagatgcagaaaatgcatttgacaaactccaacacccttttgtggtaaaaacaacaaactagcatagaagagaacttcctctacctgataaagagcatgtacaaataactcatggctaacataatacttaatgctgaaagactggtgctttcccttaagatcaagaacacaacaaagatgtccacccttgctacttctgttgaacattgtactggaggttctaaccagggcaataagatatgataaagaaataaaagacatcagattaaaaaggaaaaagtaaaactctctatttgcacatgatatggtcttatatatagaaaattctaaagaatacacacacacacacacacacacacacacgcacacaagtacctaaactaatacaactaataaatgattttagcaagattgtatgatttaacatcaatataaatatcatttatgtttctatacaataactacctgaaagtgaaattgagaacaattctaattacagtagcatcaaaaagaataaaatacttaagaataaacttaaaagaagtgcaagccttgtgcctaaaaaccacaaaatataattgaaagaaattagattgaagtaaatggaaaggtagcctgtgttcatggattggcagacttaatatcattaaaatggcaatactcttcagattaataaattgatctacaaagtcagtgtatctctatcaaaactctagttggcttttttttgcacaaattgacaaactaatcctaaaattcatattttatgaatgcaaatgcaagggatgaagaagagccaaaacagttttttaagagaagaacaaaaattgcttgactcatatatacttcatgattttaaaacttaccgcagaactgcagtcatccagacagtgtggtactggcacaaggagggacatacagaccactggaatagaactgaatgtccagaataaactcttacagctatggtcagtagattttttgacaagggtaccaagacaattcaatgggaaagattattcttttcaataaatagtgctgaaagaactggatagccacatgagaatgaaggtggactcctacttagtgccatatacaaaaattaactcaaaatggaccatagacctaaatgtaagagccaaagccataaatctcttaaattaaaatgtaagaatacatctttatgaccgtgagttatgcaatggcttcttagaaatgattaaaaaaacaaaagcaacagcaacaacaacaaaattagacttcataaaaattaaaaacttttgtgctcaacagatgtcatcaagaaagtgaaaagacagtccacaaaatggaagaaaaaatgttcctatcacatatctgataaaggacttgtatccagaaaatatgtgaagaaagcttataactcaacaattagaacacaacccaatgaaaaaaaatggactaaggatttgtatagacatgtctctattctaagaagatacataataagcacataaaaagatattcaacatcattagacgttagggaaatgcaaatcaaaaccacaattaaatactgttttatacccactatagtagctacaataaaagaagacagacaataacaaatgtgacaagaatatggagaaaatggaacactcattcatcagtggtgggaatgtacaaaggtacagatattttgtgaaaacaatttgggagttcctcaaaatgttaaatctaaagttgccacatgacctagcaatttcatttctaggaatatacccaaaagaattaaaaactttggccaggcgtggtggctcatgcctgtaatcctagcactttgggaggccgaggcaggcggatcacgaggtcaggagatcaagaccatcctggctaatatggtgaaacccggtctctactaaaaatacaaaaaattagctaggcatggtggcaggcacctgtagtcccagctactcgggaggctgaggcatgagaatggcacgaacccaggaggtggagcttgcagtgagccgagatcgtgccactgcactccagtctgggcgacagagcaagactccatctcaaaaaaaaaaaaaaaaattaaaaacatatatccgactgagggcagtggctcatgcctgtaatcccagcactttgggaggctgacgcgggtggatcatgaggtcaggagttcaagaccagcctggccaacatggtgaaaccccgtctctactaaaaatacaaaaattagctgggcgtggtggtgcatgcctgtagtcccagctactcaggaggccaaggcaggagaattgcttgaacctgggcggccagaggttgcagtgagctgagatggcaccactgcactccagcctgggcgacagagtgagactctgtctcagaaaaaaaaaaagccaggcgtggtggcatgcccctgtgtggtcccagctacttgggaggctaagacaggaggatcgcttgagcccaggaggtcaaggctgctgtgagccgtgattgcatcactgcactccatcctgggaaacaatgagaacctgtctcaaaaaacaaaacaaaacaaaacaaatatccacacaaaaaattatacataagtaatcagagcatcattattcataaaagccataggtgaaaatagtccaaatgtgcacaactgatcaatgaaaatgtggtatatctatacaatggcatattattcaacaataaaaggggatgaaggattgatacatgctataacttggattaaccttgaaaagtcattctgtgtgaaagaagccaacttcaaaagaaccacatattatatgattgcatttatatgaaatgtccaaaataggcaaaaccatagagacagaaaatagattagtggttgttagagcctgggggcagagggatatgggaaataactgccaatgctcctggggtttcttttggggaggggatgaaaattagatagtgatgattcacaattccgaatgtattaagagtccatgaattgtacactttgaaatggtgagttttatggtttgtacattgtatcttcacaaagctgttatcagaacgttcaggcacatctggggattaaaattctgggctcttttatcacctttataaggtgctacggaaactaataattttaaaaagagtgaacatggaataacttatttccttaaaattttcctcctctattctttttttctctctttttattttattggtggaagctagaaatgcttttgtgttgctgacatcaacatatttattgcttcatcatttctgtagctatggataagagaacagatggtaaccttaaaagagaaatgttcagtttgggagatttttatctttggctgctaccttttgaaataattcacatgcatgatcttcttgtatataaaaaaccccaccaacatagggaaaatttgggtttctaattagaattccaaacctacagggatctttaatggaggtgaaattgtctttcctatgagatcttagggccagatacgtttcatgagaaaaaatatgtatgtttgctcttcttcttaaagaacattttacctgcatttttaaaaccattttctccattttccagggcttaggaaccttttataaaagcagtatgttgtcagtatttgttaaatctacaagtaacacttcaggtcaacatatgtattatgtatatttaattgctattgcagtcaaggaaattgtggtcatgggccatatccagtggtctacctagtaaaataaaaactatattaccattcctcttggggtattgatttagaagagaaggctggggtccacatgtaaacacccttagcatgcttacctggtggcctctgacctttcatgctgttttcacatgcgtgtaccacgccctctgcaaagacagtcatgttctggaacactgctcgcgatgcctttgcccgatgcccattgccaaggaatgtgtttatggtttgggatccaggggctagtgactggcaggctcttggaaaaaaaaaaaggttttttcctctttctcaccttctacctttactgcctgcaggaagatctgcctgcactgcaagtgtccccaggaggagcacatggtgacagtgatgccgctggagatggagaagaccatcagcaaactcatgtttgactttcagaggaactcgacctcagatgatgactcaggctgtgctttggaagagtatgcctgggtcccgccgggtctgaagcctgaacaggtaccattctggatgggagcatgctggtggtttgggtgtttcactttgccttactggtccttcctcattccagttctgtaggaagagtagactttgctgattcagagaagtggtagggctaaatatgttgaagatgccaggggccccagtggaaaatgaggaagggaaatgaaattgagccaggagtgatccattgctaattcattctgtattgtcattattaactgttaccaggattgtctagaaacatctcagaggtgtaccacatttttctcagtgaaatacagcctcttgtatttcttggtacttcaaattttctcctctaccagccccatgttgtttaagaagctcttttataagctgggtattttcatgatgtttcctgtgagaatctgaagtgccagaatctgaagtgtttgaccactgttgacttcctctgacacataaaatttctttctcaggacatcttctctatgtccaacaaaaacgttttaaagtttaaacagcccttgaaattttttttgttttatttatttatttatttatttatttatttatttatttatttattttagatagagtctcgctctgtcgcccaggctggagtgcagtggcgcgatcttggctcactgcaagctctgcctcccgggttcacgccattctcctgccttagcctcccgagtagctgggactacaggcacccgccaccacccctggctaattttcttgtatttttagtagagatggggtttcaccatgatagccaggatggtctcgatctcctgacctcgtgatccgtccgtgttggcctcccaaagtgctgggattacaggcgtgagccaccacacccggccatcagcccttgaaattttaacttggaaactttaggtgtgataatgcttttagggaaaattctttttttttttaactttattttcagttcatgggtacatgtgcaagtttgtcacacaggtagactggtgtcatgggagtttgttgtacagattatttcatcacccagatattaagcctagtacccattagttatttttcctgaccctctccctcctcccagccttcactctgtggtagggcccagtgtgtgttgttccccactatgtgtccatgtgttctcatcatttagctcccactgcatgagaacatgcagtatttggttttgtttctccattagtttgctaagggtaatggcctccaactctgtgcatgttcctccaaaggatatgatcttgtacttttttatggctgcatagtattctattgtgtgtatgagtctaatatgtagactctataaggaactcaaacaaatttacaagaaaaaccaaacaatcccattaaaaagtgggcaaaggtcatgaacagatacttaaaggaacgcttatacattgttggtgggagcgtaaatgagttcggccattgtggaagacagtgtgacaattcctcaaagacctaaaaacgttaataccatttgacccagcaatcccattactggttacatacccaaaggaatataaatcattctattgtaaagacacatgcacacgtatgttcattgcagcactattcataatagtaaagacatggcatgagcctaaatgcccatcaatgacagaccggatagagaaaattatttataataaagaagaacccaagaattcactcataacttaagagtagtgatactaatataaactcattgattagccattgctcattttcttctaattttgaagttgcaaattggcagatgaaatcagggacacggtaggatttgtttagccagcaaggtattgttttaaaatttaattagctactaatacttcaaaattagagattttttcatgtaaaagtttatgtcttgaaattttgaagatctggaatctcattcctgtaaggatataattggttggagttgagtgatggccattccttttagacaaaacaaaacttgattataccgaatcatccgagtctctacaaagtcctttttattcttttgtgttaccttcctgaaacctacaggcacttccgttttgtgatctctgttctaattctcactacaggggagaaaatgtcttagaatagaaacactcccagaaaataatctccatgagaattgaaggcaattctctgttgggttattaacaggaagaaatgagtgctttctcccagtctgtgagttgaggttatatcttctgttttagtaaagattttattattaaataattagtttaagaagaacgagagtgtttgattgagtttgtttagacactcagagagggtagtggctgaccgcataactttgtttgacattgccattctaccaccagtacttgaacagtgtgttttcatacctagatacaccagtgagcttgtttcattttcttgctaaccttatttccaacaacttctgctttaagcagcccatctttcttttgtttacctgaaggatgttgcttcttgctaaattgggctctgaattttccaaagttaagcttttgtcagtttcctgcttaaatagagttttctctaagaccattaaacgtcattccctgaaatgcagattcagagaaaacgttctactcatattgacccaagaaaaaagacaattgcagaagctagggttttgattaaatttatgatttcaaaagtgagtgctaatggtatttttggaggtcccttgactcatccaaaatgaatgtctttgggaagcataaatctgaaatgtctttgatttgttttgaaagaaagtcattagtgccattgaacaagtggtttgaattatgtcaaatgaaagggtagtcctatctctaataattctgttgttctttggatggttttccctatttcctacacttactcaaatctttatgacacagatgattagaaaaggaaatagctctgcagagagagacaatcttctcaagttattttaagaattctatagcgcctaataaaatatgcatctatattaatggtgtttgaaggggtcatattgcatgtaagaaatgggcttcaaatttgtaaattggaagatcttttaaagtctattacgtatagcactgtttatgaatttaaaggtttttttttagaaagctgtatagtatgctgtaagaaaaaattgagttcctaaatgccgttcactaataaaaattctgatgtttaatatcatattagctgtctgagaaagtctatttttctatcaagagaaattatagtgagtgtaaaaatgctttgtcctggaggcaaaaatattaaagaccagttagggttgagagtaatgtactttcatttttgttagaaacctttcatttcactcccaggtcgtaggttggtaatataccttcaggtgatactctttattattttatttctcctgagaaatgccttcaattgaatataatgtaaacgaaagtcccctcccttttagggaagtgttctcgaatacggacatttaatttcataaaaatgcactagctgtaaaacccagccttttaaaaatagtgggaaaataataaatataacagatgatgccagaaaggaaaggcatttatcttgtgatctctaatgactgaactgaaaactgatcagagaagttgttcagatcctttgcctctgctcactccaaataaggggtttaatggtagcagaacagagggctggaatatgcccctagttgatcatctgaagtcttttttacttttttgtttatttttatttttttaagagacagggttttgctgccacccaggctggagggcagtggtacgatcatagctcactgcaaccttgaactcctgggctcaagggaatcctcttgtctcagtcctaagtagctgggactgcaggcacatgctgccacacccagctaatttttgtattttttgtacagaagggggtctcactatgttgcccaggctggtcttgaactcctgacctcaagcaatgctcccaaagtgctgagattacaggatgggccaccacgcctggtctgaagacattcttaaggcttcaatttcatttcaaactcaaacagtgaatagtgtataccgtatctctttgaggtgctaggatgatacatttacagtagataatattaaaataggaacttagaaaataattaacaagctataagaagggcagatgatgaagaggatttctcagcctcagcactgttgacattttggacaggataattcttttctgtggtgactgtcctctgcattgtgtaggatgcttagcagcatccttggcctctacccactggataccaaaagcacttcccatttgaggtaaccaaacatgtctccagacgttacccaatgttcctggggaataggaggatcactgggtggaagtgatgttaaaaactggaggacatctcagcagaattctggcccaatcaagacaaaaaaggatgactcaatttagcaaacatttattgagcacctaccatgctctagttccagcttagaacagttgttgccttgtaatatggtcgagtattcagcagagtgaaaaagtggggatcccacgttgcttgagcagatccctgaggcagatcctgccatcttcactaaatcaaaatgagaattggagctgcatgaccagctggctgtggagggtcagctttttgttctctaaaccaaaaagaactttttcctcttttataaaagggagacttgttcattaaaaaagaaaagaaaaaatgtgagacatccaggaaagcaaataaaaatcactcacaattccaccaaccaaggaaaattgtgtttcaacctttttgcctgtgcattagtctgttttcacactactgataaagacatacccaagactggacaatttacaaaggaaagagatttaactggacttacagttccacatggctggggaagtctcacagtgatggcagaaagcaaggaggagcaagtcatgtcttacatggacggcagcaagcaaagagagcttttgcaggaaaactcctccttatagtaaccatcagatctcgtgagacttactatcacgaggccatcatgggaaagacctgccccaatgattcaattacctcccactgggtacctcccacaacacatgggaatgcaggatgagatttgggtggggacacagccaaaccatatcagcctgtatattcaagtttctatgtgtgtaggagtatatttctgctttgatttggacaaaaatgtgatgacgctctccacttatcttgagctgtcttttctaggccttatattgtgaacatttttctgcatcagtatatttcgatctggattatcctttgtaatggttcgatagttttctattggtaggttctaacctggagtggtaccactgcctctagagggcatttggaaatgtatgtttgggagagggcaattactgtctaaatgactaggggactccactagcctatgcatgggtccttgagatgctaagcatcccaaaaagtaccagatgatcctgtgcaaaggagaatggacccatctcaaatgccaagataccatcattgagcaccatggagctgagggtttagttttgaccacttgcatttattggcagctttcctctatattacaagacagcagcagctaaccttatgcattttatacatgtgcctgctcctttccataagcgtaatttctggaggtgtagtggtcatgtgtaagcttctctaaggttttagattcatgatgctacaccactctccaggaagatcataactggtatgtcttgtgggtggatagctttcattggatgcaagtggattttatattagttctcgtccttgctgctccatgaaactctgaagaggccatcagattgtttctcctgagtggatgtctttttcattgatgttttggatgctcccaagtgttcatggagggtacttaaatatgaatatctccaaaggttagtaattttaccttgaccataactatgttttagcacagaataagttgcaattagattcatcatccagaacactcaactctcacttcaaactgtcgcaggaaggatgaagggtagataccaagtgtgactgcctagtttttggctttccaaagcattgtctcataagtggtaaaatagaacatccagtactacccagagacaggggtgaattagttggatttgagccttgtaaagctgtaaaatatctcttttgggagtgtataaaattctttatttggcttttattttagtgactattactcatccatcaggtgtcagattaaatgtatctcctcaaagaactactttggctggcccctaatacaagattaggtcctcagttacatgctttgtagcaaaccctgcaatttttgttattaacacttataaaacttgtaattagatacttattggtataattatttatttaatgtttggcttccctactttcctttaaggcccaggagggcaggaatcttgcatgctttcttgtttcggaatcctcccagcacctagcatagtgcctgacacatggccagcacccagcaaacatctgttaagagataggccaacggcaggggtcctctgtagaaccagaaatgttcaggtcgcatcacactgaagagataaaagcctttggcattattttcgacataaagggttattccatatcaattatttctgttccctcggctgctcctaaagatttgtattctaagcagattcccctgaacatcccaattgcttcagagtttgcttaggttgcaaaaggccagagagggtgacatcttgccaacggctgcatttagcaaacctgaggcagctccaccagctccaagtctctgggtctggagcagggtgggaggagcagtgggtctggcagaagcccactgtgtatccaaacccaggcaccatttatgtccccatccgaatctcgggagcccagtgggagccatggcatgaggaggaaacagcctggtccagtgggaagagccttgcttccggaatcaggcaaatctctctactactccactactttctgaccacagtaaagttgttaaatctctgggaccctcagtttcctcttgatgaagatgacaatgatgatggaaaagtaattaaactctcattgaacacttgctatggacccaccatccttttaaacactttgcatgcattgtctcatttaatactcaaccaacattatttagtaattactcttcctgtcttcaccgtagggtgagtaaagcaaggctcagaggagttaaataacttgcccaagatcacacagctaatgagtagcagagacagatataatctcagacaacctgactttggagccggtactattagacctggagatcacagggctgatctggccatggatgagagagtgcttataatgctcctggccctctgtctgcacgtagaagttgctcaataagtcagttgtttccttcccatctttcttgtgaaatagtagtatgtgactaactaattactattgccctgagtcagctcaaagaggagcagaaggaacgtttggcttccgggaaagagggaggttacgtggagatggagaaggcggattaagcatagggtttgtagcaatcctagagtccttctcagccttctcaaaaggttttcataaggtaattttgaattctgccaatatgggaacctttctgtttcccaggccttctgctgtgggattgttataaagatacaagttcgtcccagtggagttctctggctctgtggagcctgtggaagttattcagggccccagatggagcctcttgattctgaatcctctaatgccccaagcaggctttgggattatctgctgaagtactgagctctgccacccaccttccttggtgcctgagatctcctgcagcctcacagtcctcagacctgggaggaatgagtccttggggaattttctgtaggcttctcagagtgcaaagggagtcttcccacaaagaatattctacacatctctcttaggggatcaacaggtcagcagaggctccttgatttggcctctctgccagttggaaccttgttagtacctgtctgtaatggtttggctatgggcttcttggcagcattccacttgattttccccatgagagtccaaggaataaatcagagagcatgctagaaaattgggtgaaaaggaaatggccattgggctttttctgttcactcattcacctatttaaggatatttattttatacctactatgtgtcaggcagtgttctgggcgctggggacaaaacagtaaacaagagacttaaggtttctactgcactgtagttatgtgaagagtaaagacaaataattagaaaacaaataagtaagataatttcaggttgtgattttttttaaaaaaacatagtgatgttaagaataggattgtaaatatttagaaaactcttacatgtgtcagatattttcctgggtgctttacaagttgcttctcacttaatgtatcctataaaaacaaaacaaaacaaaacaaaaaaacagcttcagagatcattgatgtggagcagggtgctggggggattggctaatttagcccgatgggtcaggtccggcgtctctggggaggcagtatttgagctgttactgaagaagcctactatgcagagatctcatttgttacagaagttaacgtattcatttgagtgaaactcagaagtgaaataaaatcagtaccaactttgtgcacaaagaatttggggagagtgttggcagactggggagacacgaatggagcccatgcagtgctcggtgcttgccaagacatccctggacatgaaggcaggacagtccaactaccttgcttgcccctggaaaattggaggcacttaatcatccatccccttgatgtttctgccccaggtgcacatagggcaacagagagcccccatttgactacagaggtgacatcttccatatgttaaattcatagctagtactctacttacatttatttatgtccatactaccttccaaaatgtgagtctgttagagacggacattgtcttattcaccactctatgctcagtaccaaaaataatgctgggcacatgctagccatttaataaacagggtttgcgtgaataaacagtcccatttaatccttggtacaaaatcttctatttctccattgaaatcattgaggctcacaggatcagaaacttgaccaagatgccgcagtcagcgagggacaaagacagcacttgaaccagccatttgtctgactctagtgcccgtgtgggcttttcctcctccaccccttcctcatgcacagtgaagagcatgcacattgctccactcagggaatcagatccaagaaagcagacttggtgtgagttggaggaggggaacagcatgagtcacacagtctctttcattcttagggatgggaaatttctcctaatctgaggttgaccttagtgactaaggaattcatcttttccccacctccagtttccccaccactgcaggaagcagcatggccctgcttcaaagatttgtttccctatcgacaatctctgtttatccttatctcttctcactctcttaccctggctttactgtacttcctccaggggctctcatgttactggtacagacagcgtcacgtacctgggcactcaatagtgacattcattcagcaaatattttttgagtgccaactatatggcaagtactttcctaggcactaggggacagctgtgaatagaaaagcaagtacttctgcctttgtggagctgacagtttagtgaaggatgcagacaacttaatagctgaataacaagacacattcagagaccgacgtctattaacaaagcaataagaaagggtgatatgatctggagcaaggagttgacaggctttgtctgtaaagatctagatagtaaatataggcttcatggattgtacagtctcagtggcaaatacccaactctgatgttgtaatgtgaaagcaggcattggacaataggtgaacaaatgggcatggtcatgtgacaataaaactttacttacaaaaacaggaagggggcctgatttgaaacacagacccctgatttagagaatctatctactttatattggatggctaagagaagcctctctgcagaagtgacatttgagctgggactttacatggaatgatggcttgattacccagatttggtctgcctcgtcccgtggttttcaaaacgaggttcccataccagtagcactagtatcacctgggaacttgttaaatgtagactcttgggacttgccccagaccaaataaaccagaactctgaagatggagcccaacaatctgtttcaacaaagcttttaggtgtttctcatgcatgacaaagcttgagagccattactgttggctaatggaaaagccacattgctaggaatagatgaggccacatctagactccatcacttaactctgtaaccttgggcatctcaagcatcagttttcttagctgtaacacggggatgcttctgcccaagtctaaagtagctaacagagaagaagtgaattcatctttgtaaggatcctaggacaaagcagacaccaaataggtcctcagcaaatggtagctgctgtcctcatcagaatcattatttgaatctccaagacactgaagcagatttgcgtgcagatacggatgaagggtgtgccccagaagctacccaatcccattcctgtctttttgcctttgactggcatgccctggatatcacccaaatacaaggctgattgttaaaggaaaactcaagatgcttttaaaagtctttcattggccctgtttcttcagctccctttctggcctgttaacctagagcatgcgctgataccttttactgcaggaccgtgaattatacagctgtgactcaccaccacccggctggggccacagtgccaggcgtccagctttaccgttagctttcaggctactgacagtttgctcttttatgtgagaagctatttataccaggagggacaaaggctggcagatgctgggggaagggagagaagaatgataaaatggttcatctcccaaggtctgctgggtggttttggcttataggaaaggaatgcacaatctaatagcccttctaaaacccccataaaaaccatcattagactcaccagccatttgcagagtgttgtctttatttcattactccatcagcacatgctgagatcaaaatggaatttcatggtacagggagatgcatgtctctccaactgaattggattaaattccccctaagctgcatctcctagttagccttcactgtcactcacctcggtgttttcaatgcagtttgagagatgagttgggaagggagggaagaagggggcagggcaggaggaggcttcagagcagtccacctcactcttcttgggaagctagtcacatgaacaatgctgtatttatcttggctccagaaatacactgatgtcatcagatggcaatgggaaatatgcctgtgtgtgcagctttcactaaaactgcctgttaataaacttgttttcaacggagctgtcagagttgggactagaacctgggttcccaggcttcagggcctctgccagatgaagtcagcagcaacacggccagattccaccagcagggacttgtcaaggcttgcgtgcagattatgaggcctagaaaggccaaggctcatttgcaaatgcaggatgagagacctgccattggagttctagctttcaagacaggtatctccaacctttacagtaaattcactctggggtcctaaagtttgggacttggcctcttacttagacttcctgcataaattcacagctgcacaccctttctgctgactgggcagtctacactgtagcctggtgtgagagttaatgtagtatcaagatgatctcctctgccttatgacgcaggagatattttgagtaatttcatgggatgattggattaatccaccaccaaatcagcaagtaactaacttccttcctcaatctatttatctgcctgtgccttcctttatgcatttatttgtgcattcagccatttattcgttcaacagttgtttattaagtacccatatgtgcaagctgttagtataggtgtgatttcaatatggcagttttccaggtccaatcaaaaactggagctttccaacaccagtctttatatgttgctttaggtggcctggagccatacaaaggtagatgtagaaagtgtctcatggaagacccatgcagacatcaggctttgtgctggcctccgataacttctgtcttttgagtaactatccttctgggctcataagtgtttgagagtctaagcttcgatgataactagctctgtgttcaaattttagctgtgctgctttccaacattggccaagttaattcacctccccaaactttcatctcatcttctgaaaaacaaggatgtcagtacttaactacagcatagttgtgaaaattaaatgaaacaatgttttaaacatttggggtttttaaagtggctgctcttagttttcttttccatagtcaaaaattggaaataactcaaaagtctatccacaggtacatggataaacatattgtattatatctatatagtatactactacttcacaataaaagtgaatgaactgttgatctatgcaaagtgaatcagagtctgagaatcattattccaaatgaaagaagccaggcaaaatagtacacactatgtgatttcatttatataaaactctagaaaatgcaaactaatctgtagtgacagaaagcagatcaatggttacttggggatggggaaatgagagggaggaacgacaaaaggattgacaagagttctgggggtgataggtacatttgctatcttgattatgttgatgctttcatgggtacatacatatgttggaacttaccaaattgtatacttgcatgtgatttattatatgttgatacctcgataaagtgatggaataaatgaatgaatgaagttactctttagcaaacaggaaggcaagcttcctcccatgccaatggtggaggcttcctaaggtttcatcaattgcctcagggagtagctaagtcttttgccaagcttttgtcagaaagaactgctcagtattaatcatgcacaatgaaaaggagatttggggtagaaactcatcaacatccagatggatggcacaagaaaatgagttccacagactggctcatttcataatctctaagctcccaaggacagtgcctaacacgtagttggcactcagtaaacagtggtggtagttgttattgctatggcaattattagagtggtacaaaagtaattgctgtttttgccattacttttatcagataatctagcttggggactgactttttctaattcttagttgggaggctgtcttttcctaacttactgaaagataccaaaaattctagcagcaatctagggggggtctgtaaacattaacttccctacaatcctggggtcctgagaaacctttctgactcttgccaaagggtgttaggaaaaaagaggtggtgtctccatcctcactggatccagtgtttggtgagaaggtaataatttcctcagggttgatgatcaaaattgtgaacacttaatctctgtatgttcccaaggacaatatctaacatgtaggccctaacatttgggcttgtattatagtctcctttctcttccatcattatgtaagttattgcaagaatcatagccttagagaggcaaccagggaaaaaagctgcagtgccaaccaactaagtttgccaaccacttggcaattctacgtgtgttgagagagaaggtcaaatgacatggataaatttgaggttgggcttgaacatagttgtgaaacatccatcttcttttgtgccccattgctgtgtggatagtcaagaattcatctggatggtgaatatgccatgagaaacagctcttctggcctggaacagtgactcatacctgtaatccaagctacttggagcctgagacaggaggatcgcttgaatgatggcttgagtctaggagtttgaaaccagcctgggcagcatagcgagattccatctcaaatttttttttttaaatcagtcagtcattggtgtgggcctgtagccccagccattcaggaggctgaagctggcagattgcttgagctcaggagttcaaggctgcagtgagctataatagcaccattgcattacagctgggtgacagagcaaggccctgtgtcttaaaaaaaataaaattaaaataactaaacataactaaaagaaacagctctgctgaaatatgatcagtgggaccattttctgtggtctttctcaagcacagtaattaagagccatggctgtggtatcagacgcagctgggacctgatccagttctgccactgtccagctatatttatgattggagcaagttgttttaccttgttgaggtcattctttctcatctataaaatgaagacagtaatgtttcctgccttatagagcacttaatcagtacctggcatttcaagaaatgtatatctttccagactagaatggccaattgttttgaaaacacttttcttggtaaggcctatctggggaaacaagactgagatctaagtctgaagttcttgtccatagatgttgggggcaagaattaaagcattctaagatataagcaaaacaagacagaacagaaattcttaagcccaaaccttggatttaatatttaagaaaacagtctcagagaacgtacatgacttgctcattgtcgcatagggccagtgcttagggagcagttaatataccactcttcccctacgacatcagggtaaatacccagggaatgtagactgggaagatacacagaaaagagagcattcaagtgcagaaaaagtcatggatcagaaaagtttgttttcaggcagtgatcaagtggccttgaccaagtttctttgcatcttctagcttctatttcccatttggattgtaaagatgtgaaatattttctttccattataaagtaaaaataaacatggcaatgtttccaaattgttagaagaaagatgatgatagagttcatgaacagtaattactattgctgtgatatactctatagctttcataatttttgcctttttggtctatcaatgccgaatgaaggcaacttaaaatctttctctgtaattatagatttgtttttccttagatttctgtttttgctttatgcatttgaggctatgtttttaggtgcccacaagttatagtatataatatataatataacctatggttatactatagttttgatagattattcttttgtaacattccttataaatatatgtgttattttgtttatttgaacataaaataacttttaaaattttatgaacagctacataatatttttcaggaatagaagtagtgaactggtggccattataaaacgggtcaataaattgtatcactaataattttgaaatgaccaaggatctattaattgtaacatccctttatatcttgcctaattgtatttgttcaaattctggtttctataatactaacattgcatactagctttcttttggtgagtaattgcaagactatgcttttccattcttttattttaagccttttcttatggttttaagtgggactctgcaagcagcacatgatagatattgcattcctattattccaaactgataatccatcttttaattgatgggtataatacatttaaatttattataataacttatataatcattcctaccactttattttctatttgctatcttttttcctctgcttttttctgttttcttgtgttctattttttttaatgaagccttcccagttttcttcattttcctttgcttggtggaaagatacagaatatatttatattcttagagtggttattcgccatttcttaacatccagccacactggatccttgtcttagtctgttagccacttgtcttagtctgttttgtgctgctataacagaatacctgagacagtgtaatttataaagaccagaaatttattctctcacaattccagaggctgaaatgttcaggatcaaggcaccagcatctggtgagggctttcttgctgcatcctcaggtggtgaaaggccaaagggcaaaagagggaatgtgtccccacatggcagaagaacagaagagatgaacccactccagcaagtccttttttttttttttctttctgagacaaggtttcattctgtcacctaggccagagtgcagtggtgcaattataggtcactgcagcttcaacctccctgcactcagatgatcctccatcctcccacctcagcctcccaggtaactgggactgtagatgcgcacaaccactcccagctactttttgtattttttgtagagacagggtttcaccttgttgcccaggctggtctctaacacccggactcaaaggatcttccaccttgtcctcccagagtgctgagattacaggtgtgagtgaccacaaccacgcctggccacaagccctctttatgtcagcattaatctattccaagcaacttccaaaaggtcccatctcccaacactgttgcattggggaataagtttccaacacatgaatttgggggtacaaattcagaccatagggccactcttcaagaactccaagcttcctcccacctcatgcctttgcacttgctgtgctttcctccctctatcacttttaacaaagctccagttattcagcatttttgtcttccttcttaatagtgatcttctgtgacacacgttttaatgccacatcttagattacccatgaaagatttttcttcccgccttgagtagcctgcatctcaatatacttctgaatcaattcaccagaccttgggttcatattcactcaagccaaagtaagatataattttgggtagtttctctttaaaacaaaatcatatgaatactaagaattttaagatcattttatgtctgttatttttcacacatctttgctcccttcacttaacacattaacaacggattctgaaactcccattttcaaaggttacttcctaaacatgtggtagaaaagttaagattgtttttttttcttttcaatccattttctgcctagtttccgaaaggatctggaagagctgtcagtagaataactaaaacaaggggaaagcatgctataggcaacaaagagaaaggacataattataatagataaccaaaactaaagggcactagtagagtaaggcaatgttgttggctaaccacctaacagtatctccagttttggatgaagactgtgatagcaagaggatgagcgttgttttagtctggatgttgggactgtcaggatgcggaaggatgcctgccagaactgcttttttgggtctgagcctcattgatgctgagtgcttgtctctcacaattgttggctaacaccttttgttgcttctcatgccactcctagagcaatcagaagactctgtcgtgagccaggaagaggtactgtataaacggaattctataatctgtaaaatataacaaagtgaatggcctgagactaataattcagaagctataacttgcccaattatcagtggtgatttatttcctaggtcttctcaatgaaaatgctacacacgaatgagttgccagatcatttcatttgttatagattctgattgctggggccagcatcttccctgtgatccttgattgtcttattaaaaacagaaggaaagttgcttatgaaaggacttaaatgtaagtgtagacacactgtctgactcattttctccccattgattttcaccataatttcagagaatttaccacagaaaaacatttgttcccaacacgtaataaaaatcactctcagctgggcggtggctcacacctgtaatcctggtaccttgggaggccaagatgggtggatcacgtgaggtcaggagtttgagaccagcctggccaacatggtgaaaccccgtctctactaaaaacacaaaaattagccggatgtggtggcacatgcctgtaatcccagctactcaggaggctgaggcaggagaattgcttggacccaggaggtggaggttgcagtgagcagagatagtgctactgcactccagcctaggtgacagagtgagactttattaaaaaaaaaaatcattctcaaattgtcaaatttgtagatactgaaaggaaaatggtggcttccaagggctgaaggggaggagaatgggaagtgagtggttaatgagtacagagtttcagtatgggaagataaaagaagttctggagaaggatcgtggtagcagttgcacaactatgtgaatgtatttaatgctgctgaaaagtggtaaaaatgctaaattttatattctgtatattttaccgcaaaataaataaacacatacatacatagataactctcaggaattggagcagtcccttcaaggaccacatggtctttgttgaggatgaacctgggcacattaacttctcttgcacagaccaaaggggaaacaaattcaccaagcctgagttagttcccataatcctcattatataacatacgcacataacattcaaagtatgcacattactcaataatgcagttgatttctaccttctttggagttcaaactgatccatgtggctttcatgattaagcagccactctggcctgtttagtatttaaggttttagcaggaattgcaagcttgaagaatgaactgtgactacactgctcattgattcatcaaatacataggacagagtgtaatcctttgactagttttgggagacagtggggtggaatggatagagaatgagctttgaagtcagacctaaatttaaatcctggctcagccctttactccttggtgatcaaatggtttataattttgttgatccccatttttcatgattctgtatttgcaaatgtgcccacttgccaaaatttatttgtaaccccaaaatcaatacttgcggcagcactttcatggtcatttgcagactttacttgtaccctgaaaatcaatatttgcagcactctcgtggtcattaacaggcatacactgagggataaaaaatttgaattgcctaatgcatacatggccagctgaggtagaacagctaattctatgctttcttattccagctcacagactgaataaacaagtggtctatttagggccacttttttgcatcctatgctttttgttggtgatttcactgtttaaaatagccccaagcatagtgaagtgccatctagtgtttctaaaagcaagaaggctgtgatgtgctttatggagaaaatacgtatgttaggccaggcacggtggctcacacttgtaatcccagaactttgggaggctgaggcaggcggatcacctgaggtagtgagttcgagtccagcctgaccaacatggagaaaccccatctctactaaaaatacgaaattagccaggcatggtggtacatgcctataatcccagctactctggaggctgaggcaggagaatcacttgaacccaggaggtggaggttgtggtgagccgagatcgtgccattgcattccagcctggatgacaagagcgaaactcagtctgaaagaaagagacagagagagagagaaaagaaaaagaagaaagaaagaaggaaagaaaagaaagaaagaaagaaagaaagaaagaaagaaagaaagaaagaaagaaagaaagaaagaaagaaagaaagaaaatatgtatgttagataatcttcagtcaggcatgagttatagtgctgttgggcatgagttatagtgctgttggccataagttaaatgttaatgaatcaacaatacatattaagtaagttgcccttaaaaagaaacacacatgaaacaaggttatggattaatgggttaacgaaaatgttgggaccagaggctcacaggaacctaaccccatatttctcctaggaggaatgtttagtattcagaaattcagtgtttgctgtgattttatagcacataactgccatgaataaagagaatcacttgtgtttacctttgcaaaatgtaatatcctgtttacatagtactctcttctttccctgctgtggcagggattatggctatttacaaatggttggttccttcttcttccaggcacaaagggggaatgtactttctcagtccgtttaaagttaggcatgtccatgagacttgctttcaccaatgaaacctgaacagaagtcacatgtatcatatccaggaaaaaagcttttcactgccagtgttcagctccaaccatccttttctctgctgccatcctcatggaggcatatctccatatggagcccccatcacctgggtctctgcctacctataggaggatacagtgtgagacagaaataaaatcatggtatagataagggtttaagatacagaatatatacggttcaacaagaagacaactcagttaaaagatgactgaaggacttcaatcaacatctctccaaagacaatatacggtcggctgataagcacatgaaaagatgtccaacatcattagtcattaatataatgcaaatcaaaaccacaatgagatactgcttcagacctactaagatggttataattttaaaaactggaaaataaatgttggtaaggatgtggagaaactggaatttctgtgcattgctggtgacaatgtaaaatggtgcagccactttggagcactgtttggcagtttctctaaaagctaaacagaattaccatatcatccagtaattccactcctaggtatatatgcaacataattgaaagcagagattcaaacataattgtacgccaacattcactgaagcattatccacagtagtgaaaaggtaaaaacaacccaaattccgtcaacagataaaaatggataaacaaaatgtggtatatacatgcagtgaaataatagccacaagcaaagtcctgacacatgctacaacagaaattagccttggaaacatattaggtgaaataagcagacacaaaggacgaatattgcatgattccacttatatgaagtatctagactaggcagactcatagagacagacagtaaattagaggttaccaggggctgaggggaggagaaatggggaattattatttatttggtgtagagtttctgtttaacatgatgaaaaagttttgtgacgagatagtggtgatgattgcatgatattgtgaatgtacccagtgccactgaattgtacacttaaaaatggttaaaatgaggccaggcatggtggctcacgtctataatcccagcactttgggaggctgaggcaagtggatcgaggtcaggagttcgagaccagcctggccaacatggtgagaccctgtctctattaaaaatacaaaaaactagccgggtgtggtggtgagtgcctgtaatcccagctactcgggaggctgaggcaggagaatcacttgaacccgggagacggaggttgcagtgagccgagatcacgccattgcattccagcctgggcaacaagagtgaaactctgtctcaaaaaaaaaaaaaaaaaaaaaaaaaaaggttaaaatggcaaatcttgtaatgtgtataccacaataaaaaattttaattaaaaaacactgcagtacaaaactagtgatattttggtggtgtttgagatattgtgtcatactctagctcatccaaaccaaaccttctttcctgtctgtttctctaaagtggcataatataggccctttagggttttatggctatacgcaaactataacccgcaggccaagatattaccttcactgatcttttggcgttttggaactggaaagactgaattctcacaattgtttttatgattcatttgaaacttagtgggcaaggcaagttactcaggctgaaagtagccgtggtagtcagaaatacatcctttgtaatgtataagtgagttccttcattttcatattttctggtcacttctcaatcatgtatttaatgtgcagaaatgaaactgccttaaatgaactgacttgaaacaaaggttacctgtattctaaaatgtgtttccaacaatgtcctgtgatcagtaagctccagtctcttgcaaaaagaattctttctttggattatagcatgtgtcattatgaatcactttggacacttgaaaacttgaattggtcctagaatttccttctgtctttgctttctaaactttattcaaactggctttgcataaccctgtgaaactaatagtaatagaggagggtaatggactaattatgtcatatgtgaagtgcagaatcaaaaacaatgatttaaaatgcacagaaaagataccatgtaggacactcctaaggactccacataagaaagagataactcaaaattcagatattctttggagacagattgctaggtgtcacccagttttagcatctcctcctttcctaataacggaacctgattgtattctgggcagcagtatgccctactaaggaccctgtttcctagcttcccttgcagctagtcctattcaaggaattataaataggaggttagtacttctagtaaaactctttaaatgttgttgatccatctgcctcttacccttacccaccttcttacctcgaacgtgaatgtgatggttgagactccagtagccattttgcagttttgagcatagatgtcactaacacatggatgatgggtacagaaagacaggaagagcctaggtgcttcatggtttttataaaatgccaaaccagtcctaggccactattctcgggtcatgattactagcagcccaaagcaattataatttctagttttgttgttatttttaataataataaaactaatctgacaattatgtacagccttatagttcacagtgtattttcattcttttgtcactttattttaaaatatgtttatttttattacattttatattgaacaccagcaaagaaaataattgtaataatttcaaaatgcaatacctggattcaataaatatcctgtataatcaattataccagtcaatatctagaaatgcatgtagatgtaatgaacaaaatgactaaactataaatctaagggaacttaaagctttgatctttgttaacttaaaacaattcagtttcatatgaagaaattcaagaagaaaatttcgggacccttgatcagaagcttgcaatgcttgttgtactactttggtgtagacaaatattcaaataaggccaagaaagaagagtgtttccactgaagacacgatctaagaagtaggtgaactagtgttctgtagaaactaactagctagccatcaagatatttccactaaagactccttacactagcaactaaccatgtttaaaaaaaccttagccagtattacaaaaacaaaacatatagagtagtgttcatgaatacaagcataataggttccttgccttctacaaaaataatcatctttgaaatgctaaaagcaggtttcaactggggttcctctctgtgatgagaaggtgcagatacacatggggtgatccactgatttaccttctcaaagtattctttggaaacagtttgatttgacttgattgtaggagactctagtgtccagtttgctgggcagacttctccatgggttttttttacaaactggaatgcctttaccaagcagagggtgtcttccacgttttagcccactgggaggtcactgacactcaaatgcttgataaattcatggggtcaattatgaagactcctcttagtgcaaaccaggaccttctaacagcacaccatagtctcaggaaatgtgtttaattaaatctgagaaaagtgtgatgttcatgtggcccaaatcaccattctttcttggtatatttatccaagcaagatggctaaagtgggaatccactaagactgcaacaacttcacagttcacattgtaaaattcattctttatcactaacagcaagaaattgttgtcgacacacaaaggtgaaatccaaaggataggagaaaagcaccaaacatttcccctcattatcatcaaggcttagatctttgaactctgcattgacaaaggctgtacctttaaaatagggtgacagcaagtgcatggtatgaggaaattgtgccaaaggcgaattctgctcgaccagaatcagaccacaatatgtttgtcaagcatgttttccccagaagccacaggcctaaggactgcagagacaggatggtgtgcacatgtcggtcaaccgaagctagggacaaccttcccacagcggctgccatcttcagtgccttgcaggagccaccttttcatcactttaaatcctcacaataactgtatgagatgaatacaagtattctagtcctagagataaggacaatgaagcccagagtaggtagttaacttggccaaatattgcacgcttagaatttgtcatggttaggactcaaacattcaacatcaaatgcagtttctttctcctatactgtaggtaaatattaactcagttgatactggagtagctattcccaaagtggagaatcttttttttctctattaagaatcactgacctactagaacacagtttgataacaacgtactagcataaaaaaggagttttattaaggtttgggagggggttttgttgttgtttttcttcttcatggggaactacactatgtttaactcacatcctctttactttgagaaaacaaaacacctgccaatacataaataattgtgagtgttcatcagttcttattattcctgggagtttagaaaggagacaggagggagaaaagaaaagcgtggtttagagaaagggcaaaattctggagattcggaaaaggctgggagacagaagagctgtgactattctgaagtatgtgtcagctgagatagacaacttggcttaatgtgtgatttgctgggaccgttgaagacagagttgggcaacagatcagttgtcatcgtactcttcaaagtgctctttagctgtttaatctcatttacagctcttctactgctctttttactttttaaaagagaatttgccaaggatactggccatttaagcttctgacagaatgctagagccggcctcatactgccttgcaagagccaattggtcagttttcaggaattttgtaaatccattgttaaatacagccattatgaaaatttaattatataaacttataattaaataaattatattttttaaagatgataaatacttgaaattcatcacttcctatttaatttatcctattccactgttatctatgttcttgagactgttttgcctattatatctgtatagtgggagtactgtgtgatggtatgctatgtatagctcttcccagttccacatccgatgacatcacattggtagcttgaatgtgggattcatagtgggatcacataccctatggaaattggcaaatgctacaaatcagtacctaacttattttttattgaatctttgtagtgtttttgtctacctattatggcttttgcattattttaactttgtattgtagtcatttgtctacttgtcttataccctctgccaaatataacctctttccacctaggggtggtttcccattcatgtgtgtgttctttccccacaagcactcaacagttccttacacttgcgtatcacagataacagaatagcacagactgggtggcttaaacaacagaaatttattttctcacagttctggagtccaaaagctcaagatcaagatgtcagcagggttgatttctggtgaggcttttcttcctggcttgcagatggccttttctctgtgcatgctcctggttatctcttcctcttcttacaaggacaccagtcttattgaatagggccccagccttatgacctcatttaatcttaattacctccttaaaggccctatctataaatatagtcacacataggggttagggatttgatatgtgaatcacagggggtacacaattctgtttataacatagacatttatgaattatgcattagactgcttcaaagccaagaaatatagagccttcagcctgtgcctctctctttgttagttacacgatatcatttgagcctcttattaatgcttcaaggtagatattattgtccccaatttacagatggagatattaactttctacaagagatcaaataacttgcccaactacatgcagatggtaagtgttacatccattattggaacccaaacaatctgactgcagagtccaaacaagttacccctataagaaactgccatccttcttttttcatacttatgtatgtgtgtattttatctaaaggcagtattgaaactgttgtcaaatgaagttagcaactgttggggaatttttaatagggcatatacgcaaatgcgtagacaatctgcaaagggtgttttgataaaattgggatgagggagtctatttaagtgtagcttaagtagaaaatgttcaaaccccaagttcttccatttctgcaaccttttctttaacacaagataaaataaatgtcagataatgctccaaactaaatggaatgtattttctaacaaaacattgaagtttaatattctaaataaaataataaacagggttggaaagagtggtcatgtgagaactaacaggcataggagcaaagcaactcatgtgattctgaattatggtaccggcttagggcataacataattattttccttagtttgttcaaacgaagttaactcaacttgaaagaaattctctggcttcaaatacaaatgggtgtcgcttttgtcacttcctctgaaataaacagtatattgacagttattccatgcatcctttacttagcatctccacccaccccacagcactaatctttggtgaaaaaagcaaatgctttgatggaatgaaagagaagcttaatgagttttactctgtttcctcttgaaatctcgcttgtttattctcttgctgtatgtgtctgtctagatcctctaataacccagacagctagaaaggtaagatttgaatacagcatgcatccattcaacaaacacttattgagtatcttgtacatgccagaccctcttctgggggtatacagcaaacacagtcctaagtactcacattctagagggaagagaaagtcaacaaacaaatagatcatttgtcaacaactgataagttctttgacaaaaagcagatgaagagtttatcagtttcagcactgttggcattttgatggggatcttttgctgttggggctgacccatgtattgtaggaagtttggcagcgtccctggcctctacccactatatgtgccaaagcagctccctccccaagttgcaataacaaaaaatgtttgtagacattgtcaaatatctcttggggggtattattgcccccatttgagaagtactgggttggaagataagggatagaggtgctaatttattaggatagtcaaggaaggcagccaaggtggcccttgagcaaagactggaagaaaggaggatgacaccatgtaaatatctgggggaataacctttcaggccgagggaatggctggtgtaaaggccatgaggtgaaaggaacagcaaggaggtcattgtgagcacaagacctgaacaaaaggaatatggtaagagacagagtcagccaggttgtaaggagtggggaggtcatggtgctatagtgaagactttggctttgcattatagaggcatgggagataatccagggttgttgttttgggggttttgagtttttttgttttgtattgttttgttttgtttttttgagatagaatctcactctgtcacccaggctggagggcagtggcgcattcgccactcactgcagcctcaacctcccagactcaagtgatcctcccagctcagcctccagagtagctgagaccacaggtgtgcaccaccacagccaggctgttttttttttttttttttttttaatgtttctagaggcatggtctacctttgtttcccaggccagtctcgaactcctgggctcaagcaatcatcctcccttagcctcccaaagtgctgggattgcaggtatgagctactgcacccagaccatccagggttttgagcagagcagtgacacaccctggtttatattccaatggagttgttattgctgctgaatagagactcgactgcagaggcacaaaggtgaaagccgggtccagaagtagccacagcaatagctcaggcgagcacttagtcatagctagactggtcctgcaggggtggtggaaaatgactggattctggatatgttttgaaccgacatccaacaagaatcactgttgaattagacatcaagtgtgaacaaaagaaaggagtctttgaaagagtcttctttgaaaatactgcaaatgagcttttatttctgattttgatcctaatcctaggggagttcaacatgatggagacattgtttaggcattaggcattagactgttgtttcctaaattgcttcctgagtaaaccaattaaaattataatgtgggtctccaggagaaaagggaaggagccaaacttggtacaatttcacctcttaaatgccacttaacggcacttttctcctattgcttgggtaatgaaattctggcaaataggggcaaaatgaacacaggggccctcatgagcagcccatccctatttactcacagctgtaatgctacctgatggtcctccaggtccccatttgggaaccactgtgtacttttttaaagaccaccacgtgcagcaaattcaggcagcatctttcccttctctgtacaacctgccttctgagatgctcaggtgcattttagatattacctccccgaattgaggtagattaaacaaggttccaagcttctcaaactgcaggtgagggggcacgtgaaataaaggatcagtgttcgaattagtccctgggttaagttggattttataaaaccttccaaatgtatcagctcatgtctgagattacacttcaggagggttggcctttaccttgtgtttgtgtttgccttttccttaaactagtgtttctcctggagtggtctgaggtgttaagagtgcatagttctggcctccttttcagacccagagggatgaaaatggccatcatctttaataaaggcctcagatgattctaaagtatgctactgtttgaaaaccactgctgtatcatttaggaattgcattcacttcctagcaacagagactgtaaataaagaaatagcttatttctctcactcagaagttcagagaaacgcaatccagggttagtctggtggctccatggtataaaaattttaaaaattttttgaagtccaggctcataactttccgtcctactatcctcaggttacagcttccattcccatttgtaaggttacttcatgacacaagatggctgctggagctctagccattgtgtttacattccagacaggaagcaggaagaagggggaatgggcaaaaaaaggtcttggctaacaactgtctagcctcctttaaaagagcttcccagaagtcacacccttccgtgtcattggccagaatgtgtaaggccacatgtagctactaaggagctgcagaaatattattcttagctgagtatattgatgctctcagtcaaatgagggtattgttaaggaagaaaaaaaaaatggatatggctgggaaaactctgccacaactctcttaccatcatgccatggtgttgtggaaagactgtaatttggagatttttcacttactgtctgttcattttggctttatttgggagctgtgtgttggttatgttctgggtaataccaaaggaaaatgtgttcatcgtttctgtggtcagccacgcagacctattgggaatctactgtatctgggtatgatttggttttttcttccttctttcccatccatctgccagtctcttcagtctctttttttcttgataaaggagaacagaaggagaggatggggaagtcaagctcaaaggtggctctctcactttgtaactatgtgatattcaatctgatgagtatgaaatacccacctccagagtgtgcagaaggtttatgaaatactgtgtataaaaacgcgtcaagccgtagggtcactcagtaagtcaatagttcgatgaccgcttccttcattcagatcaggcttgtccaacccgtggtccacaggctgcatgcagcccaggatggctttgaatgcggcccaacagaaatgcacaaactttcttaaaacattatgagattttttttttgcaattttttaaagctcatcagctatcattagtgttactgtattttatgtgtggctcaagacaattcttcttcttccagtgtggcccagggaagccaaaatattgggccccctccgcatctagatggtgaagaacaattgattctgaaatcggccaagaaagtctaacttctcctttgtgggttcctgctctaagaaaataaggatgcttttgataaggaaaatgttgccacccaaaaatgtgagcactttgcccttaggatttcttgttcttgccagagctggtagaatcccctgctgaatcatatatctaggtgtggaaggagacacctgaaaaattgggtgaggtccaacaagttctcttcccttttctgggcttcctagatctcttgaagaaagtgggaatcctaccatttgcctggcaactgcataatgttggttgttgagggaaaacagtagaaagctctaaaactcacaaagtgtgttccctggactaacagcaggacctgaagaggagtcagaaatgcaaatgtccccatcccgggcctactaaattagaaatctgtgttttaacaggccttccaggtgattctgatgcaagctatagtttgagaaccagtgctctaaataaagtgctttgcacacttctttataaaaaaaaaatcagcttacttttcatacacttttctcccaaatgcagagttattgcttctccagcctccatctttctgcccaggcagaaatgctatcaaacgtgcagttccttccaacaagcctcatctttccagctgggcgaggctttgctttgtagactttatatgcgcactgactaaagtgcttgcgatctgtctgacacacactgaagttgctgccaaacctttcctgttgcagagttacaccttaaaggcctttggctatttcattttcataagccagtttattgtgttcaaaatgcttttgtttaggggaaagttacctagtatgatttcacctggggtggaatcacagggcacctttatctgggaatgtctaaatggagcaaagtctttagcacattcaacagacgtgcttttgaataaatatgttcaatacacacagaatgaaaaatacagttatcagcataatgggtaatagcttggtaatgatcatcattgacaaaattctattggatttgcttatttactccaaaaaaaatgaacaagtgaaacatgtttggactaaaatgaacaatctgcaggattttcagggattgtgccaaatttaatttttgtagtgccagaaagtatactcagtattttcccattacccttggttcacttgatgtttgttttgggccatacagtagtttcactgtggagaatgccagaggaaaatgcaggcagcattcctgtatccagccaaagaattcaggagagctgtttctccctccctcccatccatccgttaatcccctttgctcagtgaaaaatttggaaagtccagcatctaaacaccaggaggcgacacaaagctaacattagagggatgcgtttttctcctggacttcaatggacttcgaagaggattggaagtcctgaaaggactaaatcattctccttcctcagagcaagccacatcacctaccatgtgatatgggagtgatttggtaggttgttaattaatattaacttatttattttagaaatggggcatcttgctacctaggtaagttcttaagtcatccatcaaattattagttaccttgtgagaagatattctagcatattgtatatttgaggaattactggaataattttgagtggttatcagtaggcttgaattataaaagttgacaaaagatgtccaggaaagatagagctgtgttcccaaagagtagtcactgcctctgttgacttcagaattcagtctttaggatggatctcagcacaccaagggacttatttactcctaagtttctccagagtcctccatcactgctggctgcaccttcactcagtcatgtcatgttgggattcatttattctccagttttcaaagtactgaatgtctctaatctcatttctgggtgtggacgctgcccaagacagggtaatcagggtccttctctggggaatttggaattgagaaaagcgagtcactctaggacagactcttgaagtgatgctgtgcaaactcaagtgctgtgggaaaccttaacctttgagaaggtgagaagcagatctgcaggaagagaagagagcagaggtaagaggacactgggctcagagagaacagaaacttggtacaatcaccttccagtggcatattctatttcctcatgagacccttttatatacatggctaagtttctaaaaacaaaaacaaaacaaaacacacacacacacacacacacacacacacacacacacacacacacacacacctttataacagtttgccatttttcccctgaagtcaaactagctttaataccattgtattccttgcaacgtatttttcttgctttgactaatataagtggcttcagggtttggtctcactctacaagccagcagtgttgctgcccattcaaaagtgggcctgatggggtggctcacacccgtaatcccagcactttggaaggccaaggcaggagaatagcttgagcccaggagttcaagaccaacttggtcaacatagcaagaccctgtctctccaaaatattttaaaaattagccaggcatggtggcatgcgctggtagttcctgctactctgaggtgggaagagtgcttaagcccaggaggtcaaggctacagtgagccatgaccgcgccactgtactccagcctgggtgacagagcaagacctagtccaggaagcatctggattgttccatttagagtaggccaggcttgatagtataactattgtcatgtattcgtgttatttatttttattaagagccacatgcttgtgcctacactctcatttaatcatcacagtcttatgatgagtattttgaacagccacataacttgctcaggaacccagagatgggaaacaacagagccttgactcggggtccagatctactggccatgccctagagggtgcagggaagattccaacttgggccagccttagacagtatcagaaagggcttggttcaaagtaccagttaagaagggctctcaggcctgactgtgctctaggcaatggacagggggtatgtgagtaattagaggtgattaagaggagggtcgatggaaccgcaactagactctgcattttcaagcatccatagtaattcatctcatattagcaattgtccctaatgttccataacgacaatggaagttgggagaatgacaaagtaatgatggaacaaggcctttctacaagcagtcttctgacttgggagtcagaagcccattccccaagacatgagactgggcgtgcttttttatacctggcctttgtctgatgaggcatatggcacagggacttttctgaggatggaatgctgtgcaagtctctaataggcaaattgccagcttctaatcccaaactaactagtgatctgggcttttacttcttctcagagtactggtcaacagtgggctctcttcagaacccggcatcattcattattgcccctgggcatagctctctgccagctgcctatagggaggggcttatacagaccctgcctttggaaatctagctagtctaggacaagaattctctttatagttgcctctgggatttgattaaaaggatgataggcacatgatggttaatggttaccatcattagttatgaaaataaagatagctttcacattttttaaggccttgtcattacaaagccttttcaccccctcttctaacatttatgacttagtttctggagatcaaagtagacagagctttcgcacctcttcaccccagcattcccaaaacatgtgttcatacccacggctccctaaatgcaaaggaattagaccaagtttagaccaagtttgtagaatgtaacaaatttttttttttttatttttgttgatgttttttgagaaagagtcttgctctgttgcccaggctgtggtgtgttcaagcaattctcctgccttagcctcctgagtagctgggattacaggcatgcaccaccaggccaggctaatttttgtacttttagtagaggcggggtttcaccgtgttggccaggctggtctcaaactgccgccctcaggtggttctcccgcccgcctcagccccccaaggtgctgggatttcaggtgtgagccaccatgcctggccaaatatgatgactttcagagccctcagtcttccatcttctccatttgttgaatgaatgccttgtttcgcaagaggtgctcatgtcgttaaataagagatacttgagagtattttccatgatgtcatctgggcttgtgggatttttttttttttttttttgcctctcctatataataacataccttctgtattagccagttttttctctctagttttgcatgtggctgaatggtggaatgtctgttttcttttctcaggcaaaattagctgcttggtgctttccccagttgttagggttgaatgagcctcataaagtacaagaatatgtcctaacagtcgtaaacaggaatgttgtgggatgtgcaaaaatcctcatgttagtgacaatttttaattacatgctctgcatcccagatttagtgagtctatttctgatggatgtcagctgctgcctgccttacaaaagtctcgaaacctggagggctttaaatgtaggtggaggctgaggtacctaggggtttgccgagtgccaaagactggctttaactccattgccgaggcaggtgctgacatatccctttggctagggaggcacgtcatatgctggagactaacagagaaaatggtaaagccagctctcaggggagtctgccgagaaagccctaccctctggttcaccagcatgtctgctgaattctctgtttctaggaaaatttactagctttatttttccctcacagagagagggaaaaatcccagatatggatgatttgcctgactcttgctttaaggatgaatttctctgcttaccataggaaactcatctgctgttgactttcataaagagtcaggactgcagaagtcagttacatcctgctgggggaatcatcttcccagtaagtgggaataggcacatggtttgagtaatgggcaagtcatctatatgctttctgtccttcaggtacaccagtactatagctgtctcccagaagagaaagtcccttatgtcaacagtcctggagagaaactgcgaatcaagcagctactacaccagctgccgccacatgacaatgaggtaaggggctagagggggcttatgcagaattttcttagtgccttctatgaattgttacctttttcataatctgccaccaatgaggtagccgaagaagaactctggcaatttattttaggttttagcttccttaattagggccaaaataaactggccaacaatttacttctagagagtattactaaaaaagcagaatctcattataaactggattggcctctatgcctggcactactagctatttgggggtagccagggagcactaaaattcaaaagctatgattccaagttttcttacttgaagaatatgccatgtgggtttcctgtgtattttggagagatgactgagatcccctggaccacttcaagtcctacaaaagctttgtgactctcctgaattttcggcatcatttcatattaaatgagcgtgcaagttttccacactacactgcaggagaattacatgtccagatttgtagcttcgaacgtctgtgtttttgtcatggtgaagtctgacttgctgaggttgttctttgtactcttgaaagtgtggactagcagactgtccttttttctgaacccagaaacatggcactgtaagcgggcatctcttatcctcgaaatctgattgctcataaagagaaatttgtaaacatggttttcaaagatcattatgctggaagggaagtcagtttacatgctagaaattcatttttaggtaactggtttttcaaaatagtaatcctatggaactgaactgtctacttgactctgactgcatttaaaacaaaaatgtaatttttaattgataggagaaataacccccttagagagctgggcaccagctttctaccaactctccaacccacgagctgaatcccagcagctccgtcccaggggaaatgagtgcttttcagtcttattttcccacattagaatgaaaggggatcatttgagagcctcaaaaataaatttgagtaagcaggacaaaaactttaaaactgaagcagttccctaaaaagagagctatgatcctctttactgctgcttatttcagacatcataaagcaaatataaataatgctttctcctttaaagttgagagcaagcattgtaacctgatgcctggttaactaatttggaagtgaaaatgcgggtttttacaagcaggaagggtgtgccttcctttgaaagcatgtccctaaaatgtcagtggtgtaaccatatattctgggctgttcaggtcactgcagttctctctgggacgtttacatggagacttttttttttttttttttttaactctttttatttgacagagagaagggattggctcttctctgattttagtggtttgttgtgtttatggttaactgtgcttttatgaaaagagacaccattcagattacaatgtcccattggtaggaattgtgtgtgtgtgacccagtgggcagatttagcctatttgaaatggctcttttgaagacaaagggtgattgtgattctaaagtaaatatttgaccattttcttttttgcatagataagacaattttgatatccacagctgtcctggttttcaaattaggatgtgacagtcctagttccaaggtttccctctaaccatctgtgtaacaaatcatccaagcaattcacttaacctttctgatgtccagattactccaaagtataacaggagacgggattaggaccgtgtttcccaaagtgtggtatatacatgactctgagtgttatgtggacatggcagtaaatgaaacgaaaccacatattgagagagttactatattttaagttgtattgtattccttgtgatagagtagttgaataatcaaggaggaaatttcaatttagtgctagcaggtgtctcatatctctctaactcacactggcctccacttttaagtaggagcgtcagggatctctgttttaggatttcctgcaagcaaagtgaccagctagaatctaacaacatggttctgttcccagtctatttaggtttcttctggtttttttgtttgtttgtttgtttgtttgtttgtttttgtttttgtttttacgggtgatattggttttccatttatagttatactttcttttgaaataaatgcatccaagtttccaaaaaactgagtcagtattaaaaacagcattgagtaaataacagtgcaagaatatagcacaattcccaaggtgtgcataagtaaggggagatactggattcaaattatctttaatgttcctcctttaattctctgagtttctatatttaacaagaaggaaaatgtctcttgcaagtcgactcaactgaagtctagcaggcagcttgttcctctctctacaaagataaacatgcagagacttttgtgcagcatcacagatgcctggtccaactcctcaggctcacacctttgtttccctgtttttccaaaatgagacgggagaacagaagctgtgagcacgtggacacctgctctggctcactgacttagagtcattcttggtgtcaaggatcacttgcatgggcacatggagatgaaagtatcaggttcctgcagtttggaagaaggagaacttctcagctctttcctggcagctgagccaccccagatgatttgatcttaacatggtgagcagagtgaggcagtcaggataaggagcaggcacctttagcctgcccaaggcttgggatccagaattcagagcctttggtaagctcttttggctgtccgcaatcttagtagagactcaccttagtagagactcaccttaaatctctccaaggctgttgtggttaaagttcaggcgagggctataaaaccaaatgagagtgtatttaacgagaaaactcagagtcatgggcttcagaaatcttaaggagcaagggtgactttttccatgccattgtctgtgtctattcaggttcgatattgcaactccctggatgaggaagagaagagggagctgaagcttttcagcagccagaggaaacgcgaaaacttgggccgcgggaatgtcaggcctttcccagtcaccatgacaggagctatttgtgaacaggtaagcatggattcaggggagtgaagaggcattgttctggcatcttttcacccattcattcatccaacaattgttttactgagtgcctactatgtgcctgagatacagtagtgaacaaaagacgggaaagtttcatcttgcccttctaaggagttggattctaggggaggaagtcagacaatatatgtaatcaacaaaatagaaaaagatacagcaaggaaggagacttgaatgtactggaagtgtggggaggctgcagttttaaggaaggttgatggggaagaccccacttagaagatctgagcaaagatgtgcacagatgtgcaagagggagagagtcttgcagattttagggcagagggaatgctaaggcagaaggaatgaccggcttagaggccctgagacaggagggtgtctattatgttcaacagtgagttggccaatgggctggggcagagggagtgaagggagataattcagataaagtcagagttctgggtgagccattggaagaattgagcagagcaatggcatgatggatttatgttttaaaaagagacctttagaaaatggagttggcttgggccatgggtcagcctccctcccaggatcatcccagaacgagagccatttaaaggggaggtaaatgatcttctcctgagaattgagagttccttattgaagtgcatgaagcccttccgagtcatgttgacaggagctatttgtgaacaggtgagagtgggttcaggggagtgaagaggcattctccctgggacctcactgcgttcaagattctggatttcctgtctcctctgctcctgttgagtgctcagggtgtggtgaagaagagttttagagactgcagggtgggaacacaccttgccccacctctcagctgccacaggctttccagtgctgatcgtcattcttggtacttctctaagtcctacagctttttgaacattcctatctaactccttaagctctgcgtagaccccttgagagctgaagatatgttaactggatcaaagaagaggaggtgggatgctgcccaagggaagcagatgtcatttgaggcccttttttgagatttcagaggggtagagtgagaaggttcagttatatgggatggggtagctaattgaccagagatttggcagtgggatctttattcttatgaagtatatctgggacccacccttaaggtacaggtggtcagtggttgtgatctgagattcactgtgctccatccaggcaaggtgaaatccttgctcctctcagatcagtctcctggaaccaggcaagctgagtttgcctaagggagaaggaaggttgggcattttgtgggcaggtgccaagaattgtgtagaatagtgccaagagtgtgaaggcagaaagagctttcataagtttgactcatgtttcttccagatgaccttgaccgtgttacttttccttggttttgtcatctatagaatggatgaatgatgactcatgtgagggttatataggattatgtctgcatgctttagctctgctaacattatcacggaaggtaaggataacatgatgcctttcttttgtccagtcacacacgtggatgagttcccagagactgtttgtgaggtctttacttcattttctaagatacatttcaacgcatagcatgggaaagatttggtggtagcttctctgctctttagacattgtcccctgagctcagccactcttgtatgaccctagaactatactcaacctgtgaacctcaaggcccatgccatggtcagcagaagcatctccctagacctactttccacattttattcttccctcagagtccctcaaaccatattctttttgtcccaaccccaactgtaagcataggtggccagtgattctgccttgtttcttttaggatcaagagggaacttgagaaaatgagtgagaaggtagggaagggataggaagaaaccctttccatagtttggccttagaagtggtgccgtgtcaatcaagactatgtagaaagatgttagaggaagcagactaaaagcatgcctgaaaggcacacagagaaggtagttaaaggtgagcgtgctgttatgtatccaccctccctcccatataaaagtataggtcccacctcctccaagccccgtcctcccacccacctccctccccagccactcctggtggtgttaaacctggctgtgtctctgcatggagtttaaagtatctaaaagataatgaggctttcctctgtgccagtttgcctcctgcctgcagagcccctgtacgttattgtgctaaaagagcttttctttctttcccacctttgtgattcctcattctcccaatgactttctctctacattatttgtaagccttaggaaaggagagttcagggaggacaagaaaaacctgccctgctgcctgtgtaaagcaggaagcatagtgactgctttgaacataagcactcagtagccagctaatggtggttgtcctttatcatttatgcacagcactgggagatgggggctagtgtgactactgatgtttctgtttgcctcacagtgcggaggccagatcaatggtggagacatcgctgtgtttgcgtcacgcgctggccacggcgtttgctggcacccgccgtgcttcgtatgcactgtctgcaatgagctcctggtggatctgatctacttttaccaagatgggaagatatactgtggcaggcaccatgctgagtgcctgaagccgcgctgtgctgcctgcgatgaggttagagcaaactccagcaggtttacctgcccatcaccccttcattgcaccatagccaacacatggtcttctggctttctgcactgaagaaagccataggcaacttcattttcttgcattaacccttttgggagagaagccccacccatccctggtttctagaatgtctggggttgcggcctgctttactgagcgtggaggtctcatagcttcctgttgggaaggcagtttctgtatccatgaagatccccaagtgacatataactggccctaagtaagttcagaaccctaaaaacaaaacaaaacaaaattgcattgtgcatctttagatattaaccctaatctcatggaataatcagtaatggagtgccacttatatcttaaaattgtttcattttccaagattcactgctgcaaaatgattagaaaagagaaaataggtagcattatttgatttttctacagtttataaaagttctgagtgaaaaaaaaattcaggaggcagatggatacttcatttggatgtctctgccccatgctctaagaagtaccctatgtaagaaagcaggatagaacgcaaaacctctgcctggccttcttcccctactagaagcacaccctaccgtgtaagctgacagaatagaaaacctggtttagctttataagttgggagcagaaaaaagaatgttctaaatctgaccacttttatgggaataatttgggtaaaagtcctagacagaggtttcctcctgtgcaaaggagttttttgcatctatctttctctgtaaatagcagtgtgggaggtaagtaacactcccctttttcagccagacagcctactgttacatgggcatttctttcttacaaactacctacgagggactcactttctaggaggaagctgatcaggctcaactaatttgaattctaacactaatggtgatgttctggagagaccttctagaaagatagctggaaaactaaattcaggtccaactctgtggttctagaacaccttttgaccttcatgcctcagtttccacatctgaaaattggtgctcagaatacagctttgtgttgtctaatggcaattagaatatgattgaagcacacactttgaaatttgtttattgagatataatttgcatagcattaaggacccttttaaagtaaataattcagtggattttagtatattcacaaagctgtgcaaccatcactgctgattccagaccattttcatcaactaaagagaaactctttatccattagcagtcactcctcatttccccctttccctagcccctggcaacttctaatctatttctgtctctgtggatttacatgttctggacatttcatataagtgaaatcatatgtgacctttcaagtctggtttctttcgtttagcgtgtttccaatgttaatccatatagtagtatatgtaagtacttcattccttctcgtggctgaataatattcagttgtatgtatgtatcacattttgtctagccatgtatcaattgatggacatttaagttgtttccactttttggctactctaaacaacgctgctatgaacatttctgtgtgtacatatatttttagttctcttgagtgtatacccaggagtggaattgctgggtcatatgataattctaagtttaactttttgagggaatgccaaattgtcttccaaaacaagtataacattttacattcctgctatcaatgaatgaggattccaatttgtccactttctcactaatacttgttattatctgtttttttttttcattatagctatcgtaatgggtatgaagtagtatcacattgaggttttgattcatatttccccaacagctaataatgttgagcatcttttcatgtgtttattagatatttgtgtatcttctttttcagagaaatgtctgaaaaaatttttttaatttaaattttttgactaccttttcaattgggttatttttcccttttttttttttttttttttttaagacagagtctcactctgtcacccaggctggagtgcagtggcatgatcttggctcactgcagcctctacctcccaggttcaagcaattctcctgaccgaacctcctgagtagctgggattagaagcatgcaccaccatgcccagctgatttttgtatttttagtagagatggcgtttcaccatattggtgaggctcatctcaaacttctggcctcatgtgatccacacacctcagcctctcaaagcactgggattacaggtgtgagccactgtacttggcctatttttctcattattgagttgtaagagtgatttgtatatattctgtatactagtccatcatcagatagatgattggcaaatattttctcccattctatagctgtgttttcacttactcgatgatgtcctttgaagcataaagtttttaattttgatgaagtctacgttattttttgttgtttatgcttttagcatcatatctaagaaaccattgcctagttcaagatcataaagatttacacctgtgttttcttctaagcgttttattgtttttttgcccctagctctttaaacccatttgaattaatttttttttcttcgagatggagtttcaccctgtcacccaggctagagtgcagtggcacgatctcagctcactgcaagctccgcctcccaggttcacgccattctcctgcctcagcctcccaagtagctgggactgcaggtgcccgccaccacacctggctattttttttttttttgtatttttaatagagacagggtttcactgtgttagccaggatagtctcaatctcctgactttgtgatccacccacctcggcctcccaaagtgctgggattataggtgtgagccaccgcacccagccttgagttaatttttatgtatgatgtaaggtaggggtttgaattcattattttacatgaggctctcctgttgtcccagctctgtttgttgagaaaactattcttttccccatggaatggtcttggcctccttttcaacaattaattgaccatgtatgtatgagtttaaatctggatacctattcatctatatgcccagccttatgccagtgccatgctggcttgattactgtagctttatagtaaattttgaaatctgtgctttgaaattttaaaaactctatattgggggaaaatgcaaacacttgtgagggcctggcaggtgctgtaaatgaaggtgacttattttaaggcaatagggaagggtgaagaatatgacaaactggagaacttgccactcattggaaagcagcagcctctcttcttagctctagtttattactgccatgtaggaatgtgcactgagcattgcaaatgttgtgttttcaaaagataaaccaggattacaagtgttaatatgatattttccatttaaaaaaataatatggccaggccaaatgaagcagatatgtatgtccaatgtgcctgtgagctgtcagtttttgatcctgccttatattctccagggtagaacattctttctcttattaaatgtggttaagttaattactggctaggccagaaatcatgtttaattatgctttaggtaaatccatgtataggaactgatatacatacagaataaacatatccatatggatttttgtttaattatttgtgagtaggatctgctttcttacccttctagttcaaggaccccatagctttcttcctttaaaatatgttctggatgggttttacacactgaccatttggcttccccatctccagatcatctttgcagatgaatgcacagaagctgaggggcgacactggcacatgaaacacttttgctgcttcgagtgtgagacagtgctgggcggccagcgctacatcatgaaggagggaagaccctactgttgccactgcttcgagtccttgtatgcagaatattgtgacacctgtgcccaacatataggtgaggcaatatttggcagtcagcttggtccttctgtgatgcggtcacctttgttttgggtgtagttaaagtatctttgattgcaagtgttagaaacccaactcatgctaacttaactgaaaaagggaatttcttgattcatgacactagaaaggccaagaagtatactagcttcagataggggtggatcaagggttcagacaaaaccgatttttttctctgtatctcagcttaatttgccttctgttaacatcatttgggagaagctgtcttcacctaatggtcgagatgactcactagtgatactagtcttagtatttgcattctcaaaaggagaggaactgtgtctcttccagttttcaggtcagttcttccaaataagaatcttttcagccttgctttggtcaagggcccacctccaagtggggactatgtgccatacagtcccacaaccgaggctcagggcagtgggggaagctcagaaggaaaatctaaacagatatcttccatagcctccttgggacaagttggggatttgcagaggaggaaccaaagtggtctcttggtggagagggattgtcaaggaaacccagtggcttctggcaagtatgtctttaaaaaaaaaaaaatagcaaaagctactccagccaaatgcaaagcaaatgaacttcaaatagtccataaactattaactcccccaataagtggcagatctgagatggtgaaaatcattttccctctgcaaatacccaatttgttcaaccctttaacgctgttccagatcatactgcattgtggcttcttcattcaacttgccttttctggcaccttgggaaggagccaaccttggagggaataaaaaagttggcagtggctgaatgtctgtgagatcacagccagatcatccagtggcttgtgcaatcccaagaagtctgttcagaagctgccgatttcttacctagagtgaggagatacagagataatccattttggagcccattttgccccacttaaaaggttttatcaggaccaaaaaaagtggctttgttttcttggttcataagaagtgatgtattcaaataaaaaaattagctagtatttggagagctctgtgtgctgataaaaaccctggctttgtggacaagacagctagcgtgtgctcaacggtgctttgtcattgggcattcttgtcccacatgctcaggcctgggcttaagctctgctgtgaagacctctgttcagctgcatttccttctgggggcttaggtgatggcaaatttcccatcccctaacccctaaaaacctcacccctctcacagcctgttgcttcaactcagtacccaggagctttcatgtctcacaagatcaaagtagtcaaacagataaaccttctttttgctaagagttaggaaatgcgaagatcagttgtgacaagtgacaagacgtgtgtggaaggggagaggtaggacagtgtcagggaaaatggtgcaatgtcttgactcagtattgcccaaccgaggattcaagtctgcaagtgcacacttgctcagatgagaggggccatgtgtgcagaataccagcccatggcaacaataccccttcccatccatatttctgtttttcctgtttctgtccttggaggctaagagcctctccagaaactgccacttagaatttttgctcagtacttggcagagagaaaaaatctctctgttgctgcagcatgtacacctcagatggcccctcggttttcttctctttctttcgccctttggctgcccagcacatttattggcattctctcctcctttcctattaaatccattaaagggtgtcagtgttttatcagaaaaggtgaccatggtggcctgcagtattattgctgctgtagttaaaatgctgtccctaatgtttgttttaaatccacttttttaccaaacataattttcctgtgacagtgaaagagcacactctatatagcatgcatacctcagtcactgggtgctttacctctgaccatactgtacaaatattccatatttatacagccgctcagagcaggccctgcgtcaggcagccgttgctagggcaacggtacttttgcctgtgcacagcagagtaaacagtcctataaacagaccgaggctgtggcagcagtagacacacacaccctccaagaagtacttaaagggcttagagaaggaataaaaaaagaacgcttagatgtcgaacagcagagcccttttccagatgtttagagttcaggagcagttcagaggaccatctgacatcgatgtttatcggggaccacgttctgctgcctgccaggccgctttatgatatgcctcccctccactctcccaaactgagcccttccttccatgaggcccccatcccgaggaactaggcccttgctgctgcatctgagcatgtgtgcttgccaaagcttggagaagcagctggtggcagacagaccagagggactggacttcctgtgtacctctaacagggagtggggatagccgcagctgctctggatgctgtgctgattagagctcaccaaaggacccagggatgccatcatgagctctctgcactcttggcatttgagaaagggagtgagaagaaggaggaggaagaaggagggtgggagagggcaggagagacagagcagcctcctagttatttcttggaatgcatctgggcagtgaccctcagcgaagagagaggcaggctttcagacctaacgcaataaaagaagagtggtcagtaggcccagttctcagcactccatgcatgttaactccattaccaagtactatgattatccccattgtactgatggggagaccaaaacaaagagaaatgaagcaatttgcctagggtcacacagctggaatgcagcagagtcaagatttgaacccaagcagatggccgtcagcatctttacaaccagctgctgtgggatggagctgggatttgaacctgtgttcatcagagtcctgaaggcttatgcttaactactacagagtcccatgtccctgtgatgtctgcctcagctttctcccaagggtctggggaggaagtgtccacggcgctcggggttgtctgtttctagccccgccccagctggttatttctcactctgctggggagcactggtgctgtaagagatggagttgatccgtctcaaaaaaaaaaaaaaaaaaaaagatggagttgattcagttgattcacacagtttcctgtctcccacttggggtgacccttgtggctgctcctatccctataaaaaaaaatcccctcttagtctctaaggccaggtttcaaaatgaaaagagaaccccatagtttgggaaagagctaatacgagaagaattgccctcattcctctctccctgggctccattgacacaaaagtgagtcagggaggagaaaggtaggctgcttgggccggtggccttttgttcttgcaattctcttcttctccctaatttctggttcattgcctctttagacaagtctccagaagttcttccttgaaagtccaggctcaggaactctcagccactgaagataaaggccacattagtccctttttctgggaagccgtgtatcattacgcatcaggagaatgcaggggtcctggtccaccctacagtcatagcttgaggctatattcccagcaggctctccccacgggaaggggccccagcagctcccagtttccattctgccagttttactgctgctataaaaagagcctgctgtgtgactgccttagcaaaagtcctgccttagaaaaagcaatgagaggtgttggcttagtgcaggtcacttgcccacccctgaatcagtccctgggtgccaggagagcagattttttttgctggcctatgttgggccccagatcagcttttgccccacccaaagctcacggcctgaagatggcagggaaatggtgtcccacagggagaggaagtcctataaccagaagagggcagagatgatgagaaggcagaacccctggggctgtgggaggctcccttagtacgcagtgtggccaggctatataaacctggcgcaggcctgtcacagggaggaatcgtacctcttccttccctgatgaaattaagcaaagggtacttacgctcccagaggggcagtagctttggcaataccgtgtctaggtttttctttaccgaaagcagatttttccttaacaagagttgaaatccacatttttatttcccactaagtctgttgagactgctttaacggaatagcacagactgggtggcctctgagtaacagaaatgtattgctgacagttctgaaagctgggaagttcaaactcaaggcaccagcaaatgcagtgtctgctgagggcctgttttttgtttcctggatgatactttctggcagagtcatcatatagtggaaggagcaaacaggctcccttgggcctctgttataagggcactaatctcattcatgaggtatccactctcatgacctagtcacctcccaaaaagctccatctcctaatgccatcactttaggatttaggtgttaaacttaggagttctgaagaaaacattcaccatagcatccactgagttgctgctgtgacttacccattggaatagcatatgctagtaatgggattcactcgatctatctacacacaaagagccctgtcatacaccaggccatgttccaggtcctggagatgctgtagaaactcaatgagtctgtcctcatagagcttcacttttagcgggggagagaaataataaacagatgcatgtatatactgttgtaatgtaaagcggtattaatgctatcaagaaaactccagcaggtaagggtggagagtaatggagaatcactatttagtgtggataggaagacttctcagaggagttggcttttgagcagatgcctaactagagtgaaggagatagtgtcaatgtcatggttgagaataagacttcctgggtacagatctcgtctctggttcctagttatgttaccctgccaagttacttagcctcatctgcctctactttctcatgtgaaaactgcaaataatattagaaagctagctcaaggagctgagtgattaaatgagtttacatatataaagctcttaaagcagtacatgatcatacgttaatattactattgctatttgtcagggggaaatgtgtcccaggcagaaggattcatagacaagccattttaacctagagtctttgtgcttggagcaaatgagttaaggcgcatactggtacaacaaggacttctcgtaataggacgtgaataccatttacataagggtctgattgttgatttattgacagtttatcctgccgcacctggaatcctgagacaaaccaaggtgctatgtgtttcacgtcccagtgcagagctctgagcagctcatcagcctctccaatgtctctcatttttttaggtatcgaccaaggtcaaatgacctatgatggccaacactggcatgccactgagacctgtttctgctgtgctcactgcaagaaatccctcctggggcggccattcctcccgaagcagggccagatattctgctcacgggcctgcagtgctggggaagaccccaatggttctgactcctctgattccgccttccagaacgccagggccaaggagtcccggcgcagtgccaaaattggcaagaacaagggcaagacggaggagcccatgctgaaccagcacagccagctgcaagtgagttctaaccggctgtcagccgacgtagaccccctgtcactgcagatggacatgctcagcctgtccagccagacacccagcctcaaccgggaccccatctggaggagccgggaagagccctaccattatgggaacaagatggagcagaaccagacccagagccctctgcagctcctcagccagtgcaacatcagaacttcctacagtccaggagggcaaggggctggggcccagcccgaaatgtggggcaagcacttcagcaaccccaaaaggagctcgtcactggccatgacaggacatgctggcagcttcatcaaggaatgccgagaagactattacccggggaggctgagatctcaggagagctacagtgatatgtctagtcagagtttcagtgagacccgaggcagcatccaagtccccaaatatgaggaggaagaggaagaggaagggggcttgtccactcagcagtgtcggacccgtcatcccatcagttccctgaaatacacagaggacatgacgcccacagagcagacccctcggggctccatggaatccctggccctgtctaatgcaacaggtaggttctgttcaccttgaaaacagatagaaagggggtagtctctgggtgactggatgctggtccccaggaattttttttttttttgaaatggagtctcgctctgtcccccaggctggagtgcagtggcacgatctccgctcactgcaagctccacctcccgggttcacgccattctcctgcctcagcctcacgagtagttgggactacaggtgcccgccaccatgcctggctaatttttttgtatttttagtacacacgtgtttcaccgtgttagccgggatgttctcgatctcctgacctcgtgatccacctgcctcggcctcccaaagtggtaggattacaggcgtgagccaccgtgcccagcctggtcctccggattttaatgttgtttctgccacgtgccctcttctaataggctgctgaggaaggtaaacccaagtttgagatggcttctatctttgatgggcttccctgtaaacaaagcctgagacaggtccagatgcctgtgatgtactgagggagtgctctcaggagaaggggagtgagagaaagaggacagagcatggggaggagccaagtgaggaatggtgtcttcactggggtctggcttctgcctgatcccacaggggactctgatggatgagttgcactatagaatcaattgcttcttgtgacgaaggggctgatgttttgtaccatcgtgttagttggtcatcagctttgggctgctgaggagtgacaaagggatgagatagtggatgtgggcttggggcaaggcagctcctgttggccaaaggcagcattaaagaaagaaaatactatggtctgaatgttttccccaaaattcttaaattaagatcctaaatcccaaggtgatggcattaggagaaggggccttttgggaggtgattaagtcatgagagtggagacctcatgaatgggattaatgcccttataaaagaggtccaagggaacttgtttgccccttgtaccatatgaaggtggagaaggtgtagctgtgagctgatggcagtactcacagcacctggagcccagttgccccagcgtggtgctgcctggggcaccaaagcatccatgacagcttctgagactgttctgaacctgtttctcaccagggaactggcttcaaagtgcagataaagacataagaaatgtttggctagacaaggagaagacaggcaggctgaaaagaacagaagtagagagagagagataatggcatgcttctctctccagtgaagttgtccagctggttttgtgtgcgtgggaagactgatgttggccaggcatggtggctcatgcctgtaattccagcactttgggaggccaaggcaggaggatcacttgaggccaggagttggagaccagcctgggcaacatagtgagactctgtctctacaaacatatatgtgtgtgtatatatataaaatatatagcgtgtgtatatatatatcatatataatatatattgtgtgtatatataatatataaatatatatgatataatatatacaaatatattatatatatatatataaattagctggacttggtggcacatgctcatagtcccagctacttaggagactaaagcaggaggatcacttgagcccaggaagttgaggctgaactaagcaatgatcccacctctgcactccagcctgggcagcagagtgacaacctgtctctagaaaaaaaaaaaaaaaaatttaatattattgatttaatattttaaacattatttaaaaaatatttttaaatgtgggaaaaaatagagtaacgtagattttctctgtgatagtgctacttaaagcagaatctgaggataacactggctgagaactatcacccatcagcagtgagattagtacttaacacctatcagcagcgagattagtactgaaactggaagtgttagaaacttatagcagttcgatgttgcggtgccatccaagtgcgttttcagcaggcttgtcttattgatcaggttatagacccatcagggtgttatagaactcacatactgagctctttgtgctttgtgctgtgtctcagacatgctcagcagggccatatgtcggtccacaagggattgaaaatgaaaacaaactggtccttcaccactgatagcttgagaagagtagcgctctaagatgtgctaagtatatctgcccctttgtgggcaaggtaccagaggagggagatatacgtctgccccttacagcaaggattccatagccgatggtgtctggatagagactgtgataatgttagccccatttgaaggggacggccactgctcagctccagctgcttgttgccatgtgctgggatatttatgtatccacctaacctttatatagctcttgcaatgtgtcaaacattgttctgagcacgtcataaatattagcttgcttaattacattgtcataacactgtgagggaggaatattgttatgattctcatttcagagttgaagaaacagaaatggagaggttgagggactcacccaaagtcactcagctttcagagtggtagagcagggatttgaacctgtgcatatgatttcagaaccttgctcttaatcacaccaggctgccagtctaatacaagccccatcctgtcagatcttccagtttttccagagaagttaaaaatgtggatttttaaaaatatgaaatctatttcaacactgctagacaaacaaaatgaggctctgagttgtagcttgtccatgcagtgggttttactttctatcctcctcaaatacatccacatctgtgttcccatttgtccaagaacaaagagtagatatcctcatccccatgtttcagatggaaaaaaaaaaaaaaaatgaggccttggtgactaagcgccttgcctgatgtcttagaagggagcaattagtgcagagtgatgactgcctggcttccagcccaggttatgttattctcgaaagatttatgtgctataattatttaagaggacagcagataaatatatacttcagcctctgaagaagagtttctcaaagctagaccacctgcattagaatcatgggtgtgcttgattcaaacataggctcctgggcctccccctaaccccttgcatcagaactctacagaggtggggcccaggaatctgcatgttaagcagatctctgctgaggctgatgtgcaccattgtctgaggggagatgtgcctgggtttgtctgctctgactgtatcatcctcacgttgtggctcatgaggaaatcagaagggctagaggttgaggaatgctggaaagggcaagtgaggaagacactcaatttccattcctaaggagggagtggacgcggtttccattcctaaagaagacatcatgggagatttactctcatgattttctaggatccttgggcaaagcaactaatgcccctttgcctcagatttttgggaagcaaccctggccatgcctgataaaactgagggaaaaaaactcctgagatcagcactgtctaatatggcagccatatggggctgtggaaatttaaacgaattaaaattaaatgaaattaaaatttcaggccattagttgcactagacacattttaagtactcaacagcaatggcctgaagtttaaattttatttaattttaattcttttaaatttcaatagcctcctgtggctagaggtgaccctgctagaaggtgcagatgacagagtgaactgataagatgggcacgatattaagccatcattagtctctgaagttcttacatgagccctaattttttgtctttctaattaattaatagttaggattactggttctggagtcacacttgctgggatgagatcaagccttcatcatttaggagttgtgtggccttgaacaagtcacttaaactctgcaaaactcaatttcctcatccatggaattttgtgaataagtggataaaggtgttcctgtagtacttcctttgtatagctttggtgagggttaaatgataattgcgtttaaaatcattaatatagtctttgacacatatgaccttctataatggttacctgcgactttttattattattaattctttctcctcccaaacacactgattcaagttttgacctgttgtggctactaacttctcccaccatccaccagctgtgcaggtttgcattttagatttgaaaatactcctgcatgggccaggcgtggtggctcacacctgtaatctcaacactttgggaggccaaggcaggtggatcacttgaggccagaagttcaagaccagccttgccaacgtggcaaaaccccgtctctactaaaaatacagaaattagccaggcatggtggtgcatgactgtagttccagctttttgggaggctgaggcacaagaatcacttgaacccaggaggcggaggtttcagtgagccaggatcacaccactgcaccccagccttttgacagagcaaaactctgtctaaaaaaaaaaaaaaaaagaaagaaagaaagaaaatactcctgcaggctccttttttcctaaccagcctgagaaaaccatgaaaaacagggaattaaagaaagtcattttgtgtgcgtttctatggttctgtcagatatgacagtgtcagaagaaagatggtggctaatattctaagcacagcttcatcattcctcattggagcagaccctacatagcctttcacatcctactctgcacacccatacaccgaggactagacttggaaagttggtgtttttgctgctgtccctcactgtttacatttgaattttgctagaaaattcagtagttttttttttaatagcattctaaactatctgcatatctttaaatcctagaatcacagtctgaataccaggtacgtgccacaaaaggcttagtgaaagcaccttgatccttcagataaagctagatttcaagatgatggattcttttttcttccatggtcagtaacttatgttattgaataagtctgtagtgtttaatctggcatgaagtgtgatctttctgtgggcagcatttttcctcagaacagatctgaaaaaacagatagctgcactggcttgtcagcctcagatctgggctttggcctctcccaatgtgtttagaactgggagtgtacagtcccttctccttggaaaacacaattcatcccttatgcttacacggagtgactcaggctggcacagccaccatttataccactgcaatgcagaagccttgcagaagcgctttaactttgccagcccctaaacatgcctctaaagcagcttgcagcctgcgtaatcatagcattagaagtagaaataataacaacatcaagaacaactgacattattgagtgtttatatggactggatgtttttctaagtactttccataaactaaactcactcagtcctcacaacaaccctatgaggtaggcatggttgttattcccattttacagatggtgtacatgaggcactgagaggctgaatagcccaaggccacattgcttggaagtagaaaagcagaatttaaacttgggcattctagctacagagcttgtgcccttaaacactgtgctatggctgatgtgaatgaccatggtaaatgtactgctgcttctgatgttgattgtaaccaatgataatcataatagaccactggctatgacctgacatgctaatggcttcatgtagaatgcttctttaaatgctgtgagataaatctgatcattatacccattttacatatgggtacactaaggtttatagaagtaacccttttgtagtcgccacagatggcgaggacttgatcccaggtgtgatcaactgcaaagccatgcacttaactggcctgatattcctcacaagaagggtcataatcacagtcagaagacttgcacaacggctttagctgaagggataggcattttctctcctgtgacagctggcttgttgatttgtctgtttgccaatgctaaagagaagcatgcgagcacagctgtgaatgccagaagtcagaggtggcagtccaagatgatgtgccaaggtcagaggtaggaaagacaaggcagacaagcagagatggtccaggggctggtgcctgggcaagagacaccaagggcagagtgggggaccaaggcattagttgcaaattagaggtcagggctcaagccacacactgggaccaggtatatagtagagctggaattggaactggctgccttaggcagaggccacaccacaggacaactggagactgtgagctggtccctggtgaaggatgctggtgtggaatgatgaggctgggaacatgaccattccttgaggatcagccacattctgtaaggggtggctgttcatagagagctgggtcccataggaaggacctctaggtaaggatgggagtgagggaaggggaaacaacgtttctgtttatttttttgattcacttagcaaatatgacatgagcgcctaccctgtgagttatagcagaatagtatgagagcatgggctgtagaccagtatgccagagctggaaactggacttatagtttaatagctctgtgaccttgggcaacggatttatctattctgcacctcactatcctcatctttgaaatggaatgaccctacttttcagggttgtaatgtgaattaaatgagtgagttcatagaaagaatttagaacagtgtctaacaccctctaagtgctcattgaatactggttggtattagtatttgtaggtgccacctatgcaaggtgctgggaatgcaatgctgagctgaattggacatgggccttgccctcttgtacctcacagtctagtgaagttgatacacagtaaccatccaattgtatgatataagtaagtgtgaggctaggaggccttacaaagagggatgtggctgagtcaaaggacatcctgaaaaagtgatgcttcagggataggggaagggtcattctaggcagcaggagcagcatgtgtaaaggccctgtggtaggaatgtatgaagagttgtcagaaggtcctatggctgggtgagcacttagagtaataagacttggaaggaaagcaagggccagatggtgcagagccatttagggctatattaatggtgtaggcctttctaataagggcaacggaaaacccttaaaatgtcaggccctgcagtgagggaggtgacatgatccaatttgcattttgaaaagatggcttcagctgctgtgtggggaattgattggaaaagggcaagtgctgatgcagggagtcctgttaggaggcaatctggggctgtgtagcccaggctagaggtgaaggttaatggcaaagtccaaaataagtggatggatatgacagtgacttaggagaggaaattggcagaggtttacagtgtcccaaggggagtgggtcctgggagacagaggaaaatagatatgaaaacattagcaatagttaaaggttggtctactctgtgttttttttactcaggccagcatcaaatgcaagtgcatgttttattggcctgaataagtggagacacggagcaggaatctgaaagggcttcctaccttctttgatcagtgttgcattgttgtgtcaaggccatgccttttacacacctcatctacacaccttggcaagggaaacttagttgtgcaatgccagaaggtaacagggtaatttttcagcattgctgacaaactgggaaagaaccagaaaacaacaacatgaggatataaagcaacaactggaaccactcactttaccaagaatgtctgagatgttttttaatccttgcaatgcaaaacatttctatatttaatttaaggaagggccaggtctattcttctgcataacttggataaccatcctctaacccaatttctttatttaaatattgggtagaacctcttaaccagctggcacccattacttcattggccacacctcagatgtgcttatgtattgtgtggcccagatctttttgttcattcccgtcactggggaagatgtgtggtccagtctggaatcacaaccttgagtcctatccattgaccacagggccctgggatatacttgggaaatgcatagagattgcctttgttcattggtattgcagaactcttttgtttggaagtgtcagaattctaactccaatgggtgtaaacaaaatttttttgatcaagtaacttcatacttcacagatctttagttccaggggcccaaatgatgtcatcaggactcggtttctttctgtctctgagttcttgttccctgtacactggcttcagtctcaggcagcctcttccctgggatagccaggagggctgtcagtcactgcagaccaatgtccatcaacatcaggtgaaggggaaaaagtattgatcttccctattagtgtcaccaaaagtaccagaattgagtcttctcatttgcctgactttggtcatccaacaattcttaaactaaccactgtggccaggagaatgatagctctggtatgtcagacctgagtcatgtcccatcccaggaactaggcaatgaggtcaaacccatcaaaacttcaggactgacaatggagaaggaagaatgttcaaagggaaatcaaggtcatgttttcaaaggaagagggattaagctgcaaggaggtaaaaccacaggcaccataggtatcccatccatccaggactgacgtttttatctgatcccctcctctaaaagccccaccatatttgaatttaacatcaaacacccattatgtatttcagctatggttttctggagacaaagctctggtctttggggtgtggcctgtggtgattttaacgtaggggtttcaggctatgaggagatattttggagggagagattagatggagcccagccttctcactcaatggttagtacatcctaaggagcaccttctgactggtcccatagatccccaaggaagctgtgccctgttgttggcatttcatgactctgaacatcacccctagctcacagaccaggggccagatgaaaaccagcagagtgaaagtcccaggagaatccatccctcgtttctttttctgctttgctttcctggcatgtgggaagccgaggacaatgtcagagcaaggtgggacaacagggaatcagtgggcagttggaagagagctcagcccagagcaggcgatatacccctgctacaatgttgtggtctccctgacattttctgggcccggagaaccttttccagtgtcctggtttttgataactgttcaaaagtcttatttataacctccttgggcgtgagcagtcatctatacccacagtcagtaaccatggctgctgacagggagaaaagattgctgattttattctctttgttactgaaaaggcaacactggaaaattcgtccagggtggaggccagcagtggtggggttggggcgtggtgtgtcgtgatgggttccccagactggtgcaagattttatagagtgattttttttaagaatgtgtgaacatttcatttctcttggaacttttgagtttgttaatctcacaaagggaaatgagaaagctcttatccacttggaaatggctttaaaactcaagccatttagtttttaaaatatggagagtaaggaaaacacagaaaagaaaaattctggaaaaagatagaaatagtgaaaatatagcccaaatctcaccacttgaccagtgttcatattttcatgaattttcaagtttcttccctacgtattagttcactatttttctctaacttggttataaacatagtgaatagtttgtggcctgcatttcttcatttgcattctatctttagcttatctgtgtggcatttgtaaccatcatttttaatgactgcattaatattcaattgaatgggtgttaccacacctccagaattggacatataggcagtttttttaaatgatctgtatttaaatcctgatttcctttgtctgccatcaacaaaatattctgttttgacttccttttttattgacttgaccttgaccttcctaccttgaccttcctacctggccacttggcaaaacttctttagcatctccctcccacagtgttctagtggtcatatgagacttatgggtgattctgcaccgaccatcaccttccttaacctcccctcctctgcctatacgtaaagtgcctcccagagcagtggaaaactaacatgactaaaaccctacttcctagtacaagcagcctaagctagctttggggagtctatttctccatgtaaacaataaactatccactccatcaatttgagtattccagggatcacttacactacgttcatctaggatgcttgtcaattgtgcaaattcttgggccacatcccacacccacaaacagaatctctcagggctcagactcagcaatcagcatttcgaacacacacccccagagaactcataggttcactaagtttgaggaccactgagctaaggaaacccagactcttcgtcttacatatgggtgaggtaccatactcatgagctcgcctgtagttagaacttgcatctgtctacactgcctcttctcttagccctgagtctagcctcctgctgagacaaaagaaaaagtggattatatctcctctcaaaatttctgaagatgtccttgacatcaaatcactcttggtgtagtaaatagcaccttagtaagttaagagcacattatctgaagcatgtggatgatacatatcttaattacatagtatggattaaataggaaagagggtaatacttgccaagagcatttgatggttttggaatcatcacggactgcatcagaaaaggtggacaacaaaacactctaatcttgaaataggacctgtttccgctctagaatcaatgtgaaaatcaagagatcatgagccgaaagttgcgtaaaaaatttcaagatagcttggtttgttgtgtgtttgattgtttaacctagaatagtttccaccaataagtttcactctccccagttttctaccagcatcaccttgagcacccagatagctctgtgtgtgtgcacgcaggtgtgtgtgcgtgtgtgtgtgtgtgtgtgtgtgtgtgtgatctgtgatcgttcctcgtcctgttctgccaggaatctccttcagcctgcccaccccaaatcaaaatcagaccatcacacatctctgggaggcagctatcacaaatcaggctgagcaaacaggcagggcaccatttagaagataaagtctgggtcttccacttcaaagtcactaagaaaacacgtagtgttttccttggtgcaaagacttttaatggcttaaaaatgtcatccagaattcccccatccatttagctaaggcaggtgtatttctcccattctttctctcctagaaaattgcctttctcaactctttgttacccaaggatttagtgttctactttgcagattattcagaccctgtcttctcttttctctcttatttttcccatgcacaaggaatggaggaaaatactcattcattttgcttcttacccagcagagtagagactgtacctctgtgcgtttctgttatctgagtctttccttggaataaatccttgactctcagctgtgctaagtctgagggattcttgcatattcttgcttcttcgagtcatttatccaacccactcaaatctgcccccaccgagggtgttatcagtccaagaacacctgcagggatttgtttctgattctgacattgagcttttggtgagaccatccctagcagtgactctgctgcctaggagtgagcagctcataccttgctagggtttctcatcctggcagcagcagacttcccagtggctgcctttgaaatcaaaggtgccaattttagaaggcagaaaagtccagttcagtctttactttgggaaacagattgagctcatagctggaaatgagagaggagaggaaactgactggaataactcaccctttttctttctttatactcaaataatgggtcctaggtaaaaagatgaaggaggaaattccctttgcctaaggtacacactcatacacaaacactaccccaggggaaacagggtggtctagatgaatgattctcaacagagatgggtgggggtagttactaggggtggtggtttttcccacccagggaacacttcgaagtttggaggcatttttggttgtaataactgggggtgcaggacactacaggcgtctggtaggtagagatcaggggtgccgctaaacctcctacagtgcacaaaatgtcatccatccccctatacccagtcaacaaagaattatccagctccataagccagcagtgccgagactgagaaagcctggcctagacacagggaattccaatgaaaatcattagtcccaatctaagtcattctgaaccacatctgaggggagtatgatgtcacgggaagggacctcctcagctggatgcttcggaagccccgtctgcagctgagagagctttttttacttcttgctctgtccctagctgcaacacacattcacacttagtgtttaagggcccagttgacctggttgaaaccgtaccacctctctagctgtgtgactcaggcaagtggcttaaatctctcaatccctcagcttcctgagtaaatgtaatgtctgctgcagtggggctgctgggtggtgtggggtaacatgcgtggagcacttcaccgcctgcccagtacatggaaaattcattatttgagagtaactattacttgtattatttggtaccctgatctcctgccaccttcctcttaactctgtctcggccagttgctcacttaacagggagagggaagattgaccagaactcaggaatcattctaatagaaagggatagaaggcaagaaccagcatcaatggatgagtgtgagatttggcgattctgtacatgtcaatgatccagacccatgttgacccccgtaactggggagcactttgcttgcatttctaggaatgcttgcagccagaaagatgagccttgtctccttgaatctgatttacagccttgtctgagtcaaaagaggctaccagaatctgtggcctaattatgcccatgttacccctattaatgctaatagagcccagccttcacatgtgagaaagtagactgtcagttcacagagctcagccttcctgcactgatccccctggccccccaccccagtatcaattaacttcacagagaattcccatttgccacagcttagaggagttaatttgttctctgagtctgtggatgagaaacaggcccagctttggtccctaagtgaggaagacaatgaggagagtacagtaatggaagttttccactgagatcattatcagctcctggaacaagcccagccaggcccttggctgcagatctgtttccagctctggctcctcttccaggagaaaaattcgaacccggcctgagcttcccatcaagctcccctttatacaacccaaggctcagcatccctgagtgaaccatgagccgtacatgtccaggtcctctgtcacccattgtgcctctctttctattcaggagttaggactacctaagaagcaggtggcttcctctgtcactttctgccttctgaagcggtttaatataggggcacgttagggtaggggaatctggatgacacacctttatctggcaatactggatgaagcacatcaaatcagaggacatcttttattccagcttcctctgagcccagggactgctacaaaagaagaattttgaatcctcttagtgggttcataaagcaccatttccattcccactcctacccctgttgtcttccagagatgaactcaaagtcttcctggaaacatggagttgtaaatatcatttagtctgaactcagcccctaatattgtgtacctcaattaaagaaactgtgtaaggtgccacatcctcccacacggcatctgcccaaaatatatctctaatgtactgggtttctagagtagcaatttaagagggggccatgctggtgggctaccccatctaccctcaaccccagccacactgttttatctattctctataccagagtttgatcaagatctttgtggaaacaaaaagaatggggaagagaaagatgttttaaatttttgattctgagttgttttatattcatgttttcaacaaatatttattgagtgtctaccatgtgccaggcactctgctagttgcccagtgtacgttggtgaataaatcagactagtccttctgtgggtcaggccccagcaggaagcagatggcatattcaaggggtaattaaagaaaacctaatgaaggagatagatagaaactgaggccttaggtagaatgctgcagccaagctgcagcctagcaggagggagccaggacaataaatactttctaccctctgatcttttcccattggtcaaacccaaccagcagccagagagcaagagagccattcagggcagagtagggtggagaatggcttataatgtaggaggggacctacaaacacacagagaaggacagattgtgataagttgcaaagaaaaaaatgagcaaagaaaagaagagcgaatattgagggttaactgcattgaaaggatggtcaaggaagctctctgaagtgatgggtgagctaagacttggatgagaaggacttggccttgcaaaggaaagaattggcaaggaagaaggttatcttatatgcaaaggccctgaggcaagagagaacttgtccagttctaggagcttaaaggaggccagtgtgttgagattatagttgtcaagaggaaagagctatatttggagtggtaaagcactcacattttattgctggctcaaattccacctcctggtatccctctgagaacactgccctggtcccctttttttagtgggatgtcttaaagtagaaaaagtcagatgatttacagaggggattgagaaagcaaatgcaagactacaaagaggcagtaggtcgggaataccatgtgcattgagaagtacagggtggagaactttccatttataacagaagaaaaaatatctgtgaactcttactactgttctttctattgctatagcttatttttcctttcagggctgatttctctcttggttatgtcctggatttcatatacacagtacatttgaattttaccccaggtgtcctggcttagccaagtaactaatatacaaatctgattaaagcacaaaacctttccttaagtaaacagtaagccttgaaaacatatggctaaacagaagttgattcacaaatccccttatttttcttctcttgcaccagttagccagtattagccatggcagattgttatcagggctctttggatatttctgttggtccttaagaagaaagactgagcagttgtcatttttcccaggtgggtgttgccacagttacagaaggctttctcctgtctctcaaagatctggatccctccatcctacctcaaaaatccctttctaaggctgaggtccaggagttcagcaggaagagtttccattattggggggaaatcatatggaatattgtcctcctacggtcttatcgcttgtgatgaaacagatgaggccaaataggctcacaatttggggcaaattcagcgactgggaccaaggctcagccttacaaatctcaagagccatctcaggtttgaggccttttaccacactcagctttgctctggttaacatggaaaagggagacagtatctcactggaactccaacctcaacctcaacaggtttagagtgaatacttcacacttactctaaacagtccgcaggccttctccatctcttgtaagagagaattagattgggtacccactggaaagatgtaaggcagaggctaaaatacccaggcactggttgtcaactttggccacacttggagtcatctggggagctttaaagaaatactgatacctggaccccacccccaagattccaatttaactggtctggtatttggcctgggtgagggactgttttaaaattgtccaataattctaccagtcagacaatattgagaaccatagtgttaagaccaaactaaattcttcatcaggtgcctgtgtttccagcttctgggataattcgtgggtggttctgctcctagtgccctagtttggttctgggtgtacatgtgtgagacagaattagcactcatcctaagagatagagagctcatatatgagcacacaaaatgctctcttctagtaacctttgccctaccaaaatctacccaaaactcctagaaattgcagagagtctagcattacattgcctctctcaagaggatcttgagcgttagatagaccacttttcacccttggctctgtccattactggctctgtggccgcgggcaagttatctaaactctgaacctgaatttccccacctataaaaactttttcatgggattaaatgagaaaaaatacaacacctagatcacagtaaacactcaaaagtatttgccataattagcatcaacagagatgtggaatactctcaggacatccagatgttaacgttgtgatagctaagggctgaagtggaaaagtcaagtgaactacagtaaacatcaaccacattgatagtgattatccccatcttggagatgagcgaacaaaggatcacagagtttaaggtcacacagctagtgaatggatgagtgaggattagagcagtttgccagtgtgtagtttgaaccactactccacatttctgtccataaaataaaaactcttggtgacatcagcccttaatcttggctgataaaaggggcttgacacaaagctcaagtctttctgatgggaaggggttccccagaaagggatcagcagataaagccaaaatgagctgggtccactgactgccacagacacctcaaaaatcatcttccctccctttcattgtttgtttcctttcctcacacctctccagcccctgtggcaccccccagcagccaggacacagcccttgactaatacgtaaatctgattatacattaaagccgagtctcagcccaaacaacctcagtagctgccagtgtaagattaaactcctaggctcaatgggtctctcttctccttgttccttctgtcactccaggtagaagcaagatcctctgcaattctgctttcaacagccatggttcagaccggtgtttctcaagttttttttaatgccctttttttaactaaacatgagactcccaccccccagcattcccgaattttttattctttgcattcccgatctcttgtccagagactgtcctcttttcatccccaaggtgacaaagatctgctgtcatacatagagctaacagctgtgaagccttccaagtgggacactgtgttaactactaatatattgttatcttggttaatctttacattaatgctgtgaagcatatacatgatgtcatctgatgtcatctccgttttatagataagaaaaccaagactgggagagcataagtaacatgttcaggatcacagattagcaagtggttaaactaggcatctcaacacttgagtcttgtatttttacaacacttgagtcttgtatttttaaccataatcccatggttctcaacctggatgattttacgccctgatccctgccccaagggacatttgacagtatctgtagacattgttggttgtcacaagagagaattggatgctactggcttgtgatctggtgggtagaggccaaggatgctgctaaacatcccacaatgcacaggacagcctccacatcaaggaattatcctgccccaaatatcaacagtgtcgaagttaaaaaaaaaataaaaaatccctgccataaccccaaactactaaggtttttgtttgtttgtttgtttgtttctttggtggaggagagagggaggggatatgtactgtgaaaataacacttttttttcttttaaaatgtaatatggtatcataacattgaatatgccttttttttttttttttttttgagacagtcttacactgttgcccaggctggagtacaatggtgtgatcttggctcactacaacctctccctcccgggttcacattattctcctgcctcagcctcctgagtagctggattacaggtgcataccaccacacccggctaattttttgtatttttagtagagatggggtttcactctgttggccagactggtctcgaactcctgaccttgtgatccgcccgctgtgagctcccaaagtgttaggattacaggcgttggccaccgcacctggccaaatacgctttttaaattgcccatgcccctccccttgctctacagttctcttctaggcagggaagcattagccattccactccccactttgagaatccctggctttgtctttggcaaaatcactgcatcctgttaacagctaaagttgaatctgttttcagaaatttctttttgcttgcagagacattcagttgctatgctttcccagctccagtaattcagttgttccacgtgtggagaaagcgatgggtgcctgtcaccctctgaatccgctgtgggcactcttagaccaggccagcccttcctgcccacactgtgactcctcctgccacctctaacgcccccaacgctacctcctctccttaagcctgggagctccttccatgggagcaacccccaactgctgcaaagggcagtgaacagaagtggaactttttttgatcatataaaatatgaggaaatcctctggttgcttgacctcagctgttcaataaatctgccctgctcaagccccactctcttttcaagggttctggtttaatcagtgcctgctgccctcttcctgtaggggaaaacgttcaagataggcagctgagtctctttgggagatccaaaatcacaaaatgggaccaagagagagaagacaagtcaggattccaagtttgcctttacaggttatcttgagcatcggggcctagcatagctcaccaagcaggagatgacgctggagggcaccgtgggctgacggctcaggtcctcaggaagggctgaggatgccctgagatggacgctgggtacagtcttgcttttgcacctgggaggcagaagagctccccagctgagaccttaagccttcagtcaggctaatcaggatttgaatgttccctgtgtgatcagggcagcccccaacctctttgagtctcagattcctcttttgaaaaaatgagaatgatgatacctgctcttagggggttcatgagagtcagatgaggttggatatgtaaaattgcccagcaccatgccttgcccatggaagatactcacaatggtacctctcattaaataccaatagaggaaaacttacagaggaccagcgttggctgcaggagggagagtgaccgtggacaaaggtggtagtaatagtagtggtggtagtcatggcatgagttatagagtggtgactacaggatgggggttctccctggagcattatgttgcacattatcttattgggtaaggctgagcttgtattgcctggatgttgtcctccatgaactgctcttcttattcctttcctgccttattttctctataacactcagcaccatttgacatagtgtatattttacttatttgttctgtttattgcctgtctgccctactggaatgagtgctccttaagggcaggaactttatctgattttattttgctggtgttgccccagcagctggagcactgcctgatgcatagtaggcatttgataaacctgacaaatgagtgggcattcacgaactatttgcgaatgaatgagcctccattttacagaggacaaaacagaggcttagtgaggttaagaaacctgcccacaaggccgggcacagtggctcacacctgtaatctcagcactttgggaggccgaggcgggcagatcacaatgccaggagttcgagaccagtctggccaacgtggtgaaaccccgtctccactaaaaatacaaaaattagccaggtgcagtggtgtgcacctgtagtcccagctactcaagaggctgaggcaggagaatagcttgtacctgggaggcggaggttgcagtgagctgagatcatgcaactgcactccagcctgggcaacagagcaagactccgtctaaaaaaagaaaaataaaaagaaacctgcccacagtcacatggctaatgagaggcagcccgactccagagcctttaaccatcatgcagtgttgtttggtcagtctcgatgaccatttaaaaccagctgcagaggcagtggatcctttctttgggttttgagctttgaggtagaggtgtgggttgagatggtatggtttaagatgcctgcaagatttgaaactacctgccgtggtttctcatacctgccatgacttctagattttctgttgtaaaacagctgtgaataacttagcacaagatttgtggaggaatttttctttgctgcatctcctagtgtttcagaaatgataaatattgggctaaaaattcttgtcccagactgtttcagccccagaaaaagcttcagattctcttgggagataggccaagatggtaaagggtaggccccccaagtttttcatgaaattttactgttttctctaattacaagcaaaaatagcttttaaaaaattacaaactacagaaatatataatgtataaattaaaattgtccacgattactctccccccattgactattcctttggtatttgttgttaggcatatgctgacacatagataactaaaaacaaacaaaaaaaaaagactcatgataatgttttgtaatttgttttttcacttaacgttatacaggttaggcatcccttatctgaaatgctaggggccagaagtgttttgtatttcaggttctttgtcagattttggaatacacacatacctcagagatatttcatgttcagttctaaaacacctcaatagagcagatatcacaataaagtgagtcatgcaaattttttggtttcccaatgcatataaaagttttgtttacattatactgtagtctattaagtgtgcgatactattctgtctaaaaagtgtacattaatttaaaaatactttattactagaaagtgctgttgatcctctgagccttcagtgaataatgtttttgctggtggagagtgttgcctccatattgttggctgctgactgatcagagtagtggttgctgaaggttggcttggctgtggcaatttccaaagataagacaacaatgaagtttgacacattgattgactcttcctttcacaaaagatttctctgtagtatgtgatgctgtttgatagcattttacccacagtagaacttattacaaaattggactcaatcctcttcaaccctgccactgctttatccactaggtttatgtaatattctacatcttttgttgtcatttcaacaatgttcgtagcatcttcaccaggagtagaatctatttcaagaaaccactttcttctctcatccataaaaagcaacaattcatccattcaagttcgatcatgagatggccccatcttcaggctccactcttaattctagttttcttgctatttccactatacctgcaatctagaacccctcaaagttatccatgagggttagaatcaactttgtccaaactcctattattatgtatattttaacctcctctcatgaatcacgagtgttcttaatggcatctagaatggtgaattctttccagaagattttcagtttattttgcccagatccatcagaggaatcactattgatgcagccctgtgagatttatttcttaattaagaagacttgaaagctgaaatcattccttgatccataggctaaagaaggggtgctgtgttagcaggcatgaaaacaacattcatattcttgtacatctccgtcatacctcttgggtgaccaagtgcattgtcaataagtggtaacattttgaaatgaattttttcttctgaacagtaggtctcaacagtgggcttataatattcagtaagccatgctataagcttatttgctgtcatccaggcttgttgtttcatatatacagcacaatcagagtggacttagcattattattaagggccctaagatttttgaactggtcaatgagcattagcttcaacttaaagtcaccagctgcattagcccctaactgaagagtcagcctgtcctttgaagctttgaggtcaggcattgagttctcctctttagctagtaaggtactagatggtatcttctctgttgaagactgtttcacctacattgaaaatctgtttagtgtagctatcgtcatcagtgatcttatgtagaccttctggacaacttgttgcagcttttccattagcacttgctgcttcaccttgcacttttatgttatggcgatggcttctttccttaaacctcatgaaccaacctctgttagtttctaacttttcttctgcaatttcctcacctcactcagccttcatagacctgaagagttagggtcttgctctggattaggctttgacttaaaggaatgttgtgggctggtttgtttttctgtccagcccacttaaactttccctgtgtcagcaataaggctaggtcactttattttcatgcatgtgttggagtatccctttaaattccttcaagaactttttatttgcattcacaatttggctaactggtgcaagaggcctagcttttggcctgtcttgactttcaacgtgtcttcctcactaagcttagtcatctccagcttttgatctaaagtgagaggtgcacgactcttcctttcacttgaacacctagaagacattatacggttattaattggcctaatttcaatattgtttggtctcaggaaatagacctgagaacagggaaaaagatgggggaatggtgggtcagtggagcagttagaacacacacacatacaacatttaatgatattatttaccatcttatatgggtgcaattcatgatatcccaaaacaattacaatagtaatatcaaagattactgaccatagatgaccataatagatataataataatgagaaagtttgaaatattgtgagaattaccacaatgtgacagagacacaaagtgagcacaggctgttggaaaaatggtgctgatagtcttgcctaatgaaggattgctatgaaccttccattcgtaagcatcacagtatctgcaagatgcaataaggtgatgctcaataaaacatggtatctatatttgcatatggcttaccagttgagcatcactaatctaaaaatccaaaacttgaaatgctcccttgagcatttgagtatcatattgtcacccaaaagttttcagattttagaacattttgcattttcagattggagatactcaacttgtaccttgttcatccttcactgttggtccatatagctcacagtcatctgaagttgtgctttattccattgtgtcctaattattttaacccacctcttcttgttggatactttgatttttccatagcataaattcctagaaataagactgttggatcaaggagtgtgcacattataaatttgtacagttaatagcaaatggtccttctaatggctggatcagttgcacttccatcaaaagggtaggagctctgagctgggtgcttgacagaaccacaaatcctgctgaggacaggagccacatagcattcccagagtgttcacacacctgctctgatattttggggttgtaagtgctcacagagcagcgaacagctctgatggccaagagttggaggcaaaccaagcaaagttcctccctctcttccaggtctctagcatcctgttgggtttctcaggtgctgaccttctgaagagtttccagggggagctgggtcaccatctaccctggctgggttggcacagggaccacatttagtgacaggagcagggaattaagtcatcagtcttcaccagccaggatttggcgggaggagtaacacaaattgtcctggaaagcctgcgtctgacagtggcccggggctttggcaggtcacagaatcctcacaccttgcttggcactgacaaggcagagttacctaacaggcagtttttcagagtctgaattctagggtcacccacaagtgagggcagccagtgctgggaaacctgatcatttgttcacacccacatgacttcaaagcagtcattttttggatctttaaaggcatcaaaatcaactgaagaactggctgaaaatgcagattcttgggcctcccagaagttctggttcactaggtctgggacaggactggggaacttgcaggtgattctgtgattctgacacagcagtggttcccagacaacaccctgaagtgagccttggctgttgggttatgaatttttgggggcaaagggtgggctagtggggacatctacttgagacctgttagcaggttttgactaatgacagatgatgaggtagacaaatcttgggtttaggtttctctttctctcatttatgttcctttctgtcaacaaactaccccctggttatctaggaacctcctaagtgttttccattctgacctctctggcagcattccataactcttctttccctcccttttaccccctttatgaaaacttactttgctagataacattccctttgcaaagatactctgcagatattcctcaaccataatccacactgatctgataatgggtggtatctggaatcaaaatcacagactcagctgggaggagcttggagcgtctctgctagaagttcagaagaaagccaaggttcagaggagagaagtgatttattcagtatctcactggtatttatggcagtgtgctctactttccgagccagtcattcttttctgctaccctggaaagcaccgtttatagcaaatatacaacacatggaacttcacaaatgaaaatcaaagatttgactaaggtgtaaggtgagtggcctgtctgcccagcatgggactagggggcggcaagaaacaccctcccccatggctacataatttaaaggggtgccaaaaaacttagccatcaagataaggaatattttaagcattaaaattcatacaaaaaaaattgtgactaacaaaagaatacaatttgtaaataaagacaggatctgtttcactgattttttttttttcttttgccttaggctccagtttggctgaacacagccgagttacaataactgagacagaaattataagcagatatgtttggattttaacaggaatcaatgttggtaaaccactatttctcaaaacatgtttatgagtcagggtggggctgggtagagaaggggttctgtttccaaagtatggaaaacaatgcattttctatcttctttctgaaaattcctactgcactgaagcctgtttttgagaagtgccgtagaaattcccaaacctaatttcccacccaatcgtttttttgcataatccagagaggatagtttggaaaggcttcctttagctcacgagctggattgatataaagatttgcaaggtgggaggaaagagatttgagggccctggaggactctccaggtactcagctcctaccaggtaagcagctgcttattccatctgtgcagagggggagcccagccaaacccacgttgcctcaggaagccagacgaagggcacaggctggctgagacagagattggagaccaagagcaggaaaagaagttttcatggccctgttcaaggtctttatgctttccaagaattcagtcctggctttgttgtttgttggcagagacaggataatgggttcgtggcagcttcacttttgctgaagggagaagtaggacacggcatagtgcaaagccgtgctttctctccctattcctgaggttccctagctgcctggccagaagcctgggagtgtggcatgctcaggtacagcccctggttggtctctatgatatatgccttcctggatatgttatgagaaacaaggggagctaggctttctttccacactcatgagataaaggaaagcaccccagaccctttgctgttccaaatgtggtctgtggaccagtatcttctagaagcttgtcagagattcagaatctcagacttagtggattcagattttcattttaagaagatccctgggcgacttgcatgcttctgaagcttgagaagaggttgccttagagtctggagacctgctttgattcttgcctccatcactgactcctaccctcacccatgaccttgggcaaggtgctcatcttttttctgttttcagttccttatctgccaaacgaaggtccatctgctgtctttccagatttccggaagcaccagtgcattttatgctcttaaaaagtataaagagctctataaatgcaagttaataatacaagcagtaatgattatctgaaaacttaattcttacctaagacctttattccatagcttctattttattagaagttgactttttcttataatttcaacttttattttagattcagggggtacatgtgcaggttacctgggtgtagtacgtgatgctgaggtttggggtatgattcctcctgtcacccaggtactgagcatagtacccaatagttagattttcaaaccttgcttccttccctccttcccctctagtagcccccatgtctcttgttgccatctttacatccgttgagtacccagtgtttacctcccacttacaagtgagaacatgtggtaattcgttttttgttcccaccttaattcacttgggaaaatggcctccagctgtatcgatgctgccacaaaggacatgatctcatacttttttatggctgcatcatattccatggtgtacatgccccacattttctttatccagtccaccattgatgagcatctaggttgataccatgtctttgctattgtaaacagtgctgtgatgaacatatgagtgcatgtgtctttttgacagaatgttttattttcttttggatatatacccggtaatgggattgctgggttgaatggtagtttggtttaagttctttgagaaatctccaagctgcttttcacagtggctgaactcacttacatttgcaccaatcgtacataagtgttctcttttctccacagcctcaccagcatctgttgttttttgactttttaatagtagccattctgactggtatgagatagtatctcattgtgcttttgacttgcatttctgtgatgattagtgacgttgagaattttttcctatgtgtgttggtagctcgtatgtgttcttttgagaagtgtcttttcatgttttttgcccatttctttcaacttttattttaagttcacaaagttacatgcaaacatttgttatgtaggtaaacttgtgttatgggggtttgttgtacagattatttcatcacccagctattaagcctagtacccgttagttatttttcatgatcttcctccttctaccctccaccctccaatagatcccagtgtgtgttgttcccctccatgtgtccatgtgttctcatcatttagctcccacttataagtaagaacatgtagtatttgatttcctgtttctgtcttagtttgctaagaataatggcctccagctccatccatgtctctgtaagggacgtgatctcattcttttttatggctgcatagtattctatggtgtatatgtaccacattttctttatccagtctatcattgatggttatgcagattgattccatgtcttcgctagtgtgaatagtgctcaatagacataaacacctgcatctttctttataatagaacaatttatatttatttggatataatatttatttgctgggttgaatggtatttctgttattaggtctctgaggaattaccacactgtcttccacagtggttgaactaatcgacaccctcaccaagagtgtacaagcattcttttcctctgcaaccataatccatattttttttgcctttttaagaatagccagcatcagtaattttttgcctttttagtaatagtcattctgatgggtatgagatagttatctcatcatggttttgagttgcatttctctaattatcagtgatgttgagttttttgcatgattactggccacatatatgccttcttttgaaaagtatgtgttcatgttctttgcccactttttaatggggtggtttggtttttttcttgcaaatttgtttaagttccttatagatgttggatattagacctttgtgagatgcttagtttgcagaaatgttctccttttctgtaggttgtctgtttactccattgatagtttctttttgctgtgcagaagctctttagtttaattagatcccatttgtcaatttttgcttttgtcgcaattgcttttggtgtcttcatcatgaaatctttgcccgtgcccatgtcctgaatgatattgcctaggttttcttcaaggtttttatagtttaggtttttacagttaagtctttaatccatcttgagttaatttttgtgtaaggaaggagtccagtttcaattttcagcatatggctagccagttatcccagcaccatttatttagcaggcaatcctttccccattacttgtttttgtcaggtttgtctaagatcagatagctataggtgtgtggccttacttctgtgtttcctattctgttccattggtctatgtgtctgtttttctaccagtaccatcctgccttggttactgtagccctgtaatatagtttgaagttgggaaatgtgatgccttctgctttgttcttttttgcttaggattgtcttggctatttgggctcttttttgtttccatatgaattttcaagtagtattttctagttctgtgaagaatctcagtggtagtttaatagaaatagcattgagtctataaattactttgggcagtatggccattttcatgatgttgattcttcctgtcaatgagcatggaatgtgttttcacttgtttgtgtcatctctaatttatttgaacagtggtttgaagttctccatgtagagatctttcacctccctagtcagctgtattcctaggtaatgtattctttttgtggcaattgtgaatgggagttcatttccgatctggcttttggcttgactattgttggtatataggaatgctagtgatttttccacattgatttttgatcctgagactttgctgaagttgtttatcaatttaagaagcttgtgggctgggactgtgggatgttttagatataggatcatgtcatctgcaaacagggatgatttgactttccctcttcctatttggagtgccttttatttctttctcttgcctgattgccctggccaggactcctaatactatgttgaataggactggtgagagagggcatccttgtcttatgctggttttcaagggaatgcttccagcttttgcccattcagtatggtggtggctatgggtttgtcatggatggctcttattattttgaggtatgttcattaagtacctagtttattgaaagttttttacatgagaagatgttgaattttatcaaaatccttttccacatctattgtgataatcatatggttttcgtctttagttctgtttatgtgaggcatcacatttattgatttacatatgatgaatcaaacttgttcccaaggataaataaagtctacttgtttgtggtggataagctttttgatgtgctgctggattcgggttgccagtaattttttaagaatttttgcatcaatgttcatcaaggatgttggcctgactttttgttgttgttgttgtatctctaccaggttttggtatcaggatgatgctggcctcatagaataagttagggaggagtcactcctcctcagtgttttggaatagtttcagtaggaatgataccagctcttctttggacacctgacagaattcagctgtgaatccatctgatcctgggctttttttggttggtaggctatttattactgcctcaatttcagagctcattattggtctgttcagggattcaatttcttcctggttcattcttggaagggtgtatgtgtccagacatttatccatttctcctagattttctagtttatgtacatagaggtgttcataatattctctgatggttgtttatatttctgtagggtaagtgataatatccttcttgtcatttctgattgtgtttattttaatcttctctcttttcttattagtctagctagtggtctatctattttattatttttttcaagaaaaccagctcctggattcattgatcttttgaatggcttttttgtgtctcagtctccttcagttcagccctaattttgattattttgtgtcttcggctagttttgggatttctttgcacttgattctctagttcttttagtttttatattaagttgttaacttgagatctttctaactttttgatgtgaacatttcagtgctataagtttcctgcttaacactgccttagctgcatcccaaagattctgatatgttgtatctttgttgtcattactttctaagtacttcttcatttctgccttaatttcattatttacccaaaagtcattcagcagcaggttatccaatttccatgtaattgtatggttttgagtgaatttcttagtcttgatttctaatttgattgtgctgtggtctgagagattgtttgttatgatttcagttcttttgcatttgatgaggagaattttacttctgattgtgtgatctattttagaatatatgccatgtggtgatgagaagaatgtgtattctgtttttttgggtggagagttctatagatatctatcaggtctgcttgatccagagcggagttcaggtcctgaacatctttgttaattttttcttgatgatctgtctaatattgtcagtggggctgtaaatcctgccactattattgtgtgggagtctaaatctctttgaaggtctctaagaacttgctttttgaatctgggtgctcctgtgttgggaacatatatatttaggatagtgagattttcttgctgaattccaccctttaccattacataatgcccttctttgtcttttttgatctttgttggcttaaactctgttttgtcagaaactaggattgcaactcctgcttttttctgttttccatttgcttggtaggtttttctctatctctttattttgagcctgtgtgtgtctgcatgggagatgggtctcttgaagacagcataataatgggtcttggttcttcatgcagcttgccacactgtgtcttttaattgggtcattcagcccatttacatttaaggttagtactgatatgtgtagatttaatcctgtcatcattatgttagctggttattttgcaaacttgtttatgtagtttctttacagtgacactggtctgggtacttcagtgtgtttttacagaggctggtaatggtctttcctttgcaaattaagtacttccttcaggagctcttgtaaggcaggtctagtgggaacaaattccctcagcatttgcttgtctgaaaaggatcttatttctcctttgcttatgaatcttagtttggccggatatgaaattctgggttggaatttcttttctttaagaatgttgaatattggcccccattcttttctggcttacagggtttcagctgagaagtctgctgtcagtctgatgggcttccttttgtagatgacctgatctttccctctagctgcctttaacatttttttcttttattttgacctcagaaaatcttatgattatgtgtactggggataatcttcttttgaagtatcttaagaatgttggcctctctagctaggttggggaagttctcatgaatgatatcttgaagtatgtttactaagttggttccattctccccatctctttcaaggacaccaatcagtcatagatttggtccctttacataatcccatatttctcaaaggttttgtttattccttttcattcttttttttttctattcttgtctgcctgtcttatttcaaaaagccagtcttcaagctctgagattcttttctccagttactctattctattaatacttgtgattgtgttgtgaaattcttgtaatgggtttttttagctctctaaggtcagttatgtttttctctatattggctattttgtctgtcagctcctgcattgttttatcatcatttttagcttccttgcattgggtttcagtgtactgagctcaatgatcttcattcctatccatattctgaatttcatttctgttattttagctatcttagcctcagcccagttatgattccttgctggaaaggtgatgcggttgtttggaggaaagaaggcactctggcttttcgtattttcagcattcttgccctgattctttctcaaatttgtgggcttatctaccttcaatctttgaggttgctgacctttgcatggtttttttttttttcttaatcctatttgatgactttgagggtttgattttggtatgagatggattcagctgactggcttcattttggggagattttagggggccaacacccagctcccaactgctagactgtgctcttactctgggggacttgtattgggccccagctttgttatctggctctgcgacatttggagtccactgcactggaggtgccaaggtgtggcagctgtaacagtgctagcagatgcaggggtgcctacctccctgtgggtgttcaccacaatgacagaggcagcatagctgggtggagtggggggcccctgctggagattatgtgtgtggttgtactggatatggtattggcttggggcagggtgctggctggggcaggtttgggtgccttctctgtgccctgcaagcaggagtgatccctgagggtgtgggggtgtccgctgttctctgtgcagtattagtataagggcagggtgctggcaggggcagggcttgctggctttatgcccaccaaagctccatctgcagtggtggctgggggctgggtgggtgcagactacactccagtgtgctggcagggcaaggaaagcaaaacctatctgtgcagacatgtgccagcaaagtgatgtagggcattgccatgggccccggggaagctgcagtatggggagggagcatgtgcatggctgtataggccacacctcactggacttctccaccagtcaggcaaggttcactggcacagaagctatgctgtgggcccccaaggtacccaagactgccctctaagcaggtgtggccaggctggggccccagaagaggccaacagactaaggggtgcacaggtcagaccagccccatctgatgtgcaagaccacccttcagcgatcaggtccaacagttcttctagggctaaagtctcttatgggaacaagttgagtctaggggaatggccacccctgcccgtgctgcactgcagacacccccacagcaaaccctctgggctacacatcagctggcttgttgccccaacacttccctaagcagccctccctgccacctcaagtgtccatggtggtcaaggggtccccctccttctagggttcccaaggcctgtgacaagagcaggttgctccttgccagttcaactcacccattccccctgagctgttgttgttcaaaagtgagtcctgctgcagggtagcccatgcagggttcccagatttctatgtcttgcctccatccattctcagtgccctccttctgaagatctgttaaaagcatgccagtcatctcagtccctccttgggagctgttccacttgtctccgtctagtcagccatcttgccttctccccctttgctcattttttaatggagctgttttttgcttattcagttaagttctttatagattctgtatattaggccttgtctgatgcacagtttgaaaatatttcctcccattctgtgggttgtctatttactctgttggtagtttattttgctgtgcagaagctctttagtttaattaggtcccacttggaggttaactttttttgagagcccaaaactttgtctgtcctgtaactacatcacatttgcacccattcattgattaattcagttatccttccatttatttatccccaccctttattatccttcataccatacacccatccatttaaaaattattccatcttcttgtccattgtacccatttatccatctgtcagccaatctagtaattggttctgttgtacatgaggtcatgaactgctgtcccacaaatggcactttatcaacccccacctgtagagaagggagatcttgagaagcaaagatcccaagcctaaaggagtacattgtattttgcctcttaaatccataaaccacttttatccaaacatctaacccacctcatcaagttggctgagaccagtgggaaatgcatatgtctaatggggaaaggaggggtgtggacaggcaggtataataaatgtgtaaatttggccaagggtaagagcataggtgataaaggtcctggtgtatcccaacttaaaaaggcaaaaggaaatttaacccttgagattaaataaaaaagcttagtgtgttggccaccaggtggaaccatgtgtgccagccatacaagtctagtgtatgagacgtgccgttgaggaagtgtgtgtgtgttgggataggggattgtgagttctgcatgtttaccttttacattgtcatgagtgcattcttgcctctcagttataatttctcataaacattatatagctgtataacaaatagaaatatgcaaaaatcacaagtgacacctcagtgaattattacactgatggtaccatctcccaagtcaagcaataggcagtgccagtaacctagaagctccctcatgccccctcccagccgctgctcttccttcctctccaaagtaagcactattctgacatctaacagcatagatgatttggggtggattttaactttctataaatgggatatactgtacatgttattttatatctggtatcttttactttatgagattcatccatgttgttgcatgtaattcatatttatacaatagaaaactatacattaataaaaaggactgttttcattgcagctgctggttagaagctggggagtgtcactggatctgtacttctctctgcctcctgccccctcaaatctctgactgctagcactctggccacattccttttactttttgtattcacagtaataaaaggcaggaggtgggagaagagttctcaagtagcttctgtatgaccttgggcaaatcatccaaactcccttttcccacttagaaagattgtataacaatgcccagcaatttcatatatgacaacatgcgtaaaagtgctttaaaagtgacagataaatatggagtaaaggacagtaagaagattgaacatttcattggtgtccccgcaccagcactgttctaagtactttgtgttttaacccatttaataccttctcccttaggttgtatgattattcccatttcacagatgagggaactgagcacaaaagagtccaggcctgcctgagaaggcacagcttcaagggacagaactggaaggtgaactccaaagccaatgctttcaccagtcccctgtgctgcctctcagttactttttataattttgccagcagcacatgaaagacactttttttttttttttttttttttttgagatggagtctgtctgtctcccaggctggagtgcagtggcacgatctcggcttactgcaagctccgcctcctggattcacgccattctcctgcctcagcctcccgacacttttaaaacccagagtggactaggaagaacctccgtgtggctccttttcaccttctgagcctcattcctgctgctgtcctccttgctcacaatgttccagtgtcattgcccctctgctacatcttagagctcgtggcaccttctctagtacaaaatattcttgctccctctgcctggaacacttttccctgcccttggctgggtgggctccttctcatcctttaggtctccccatagtcatcaccaacacagagttcttttccagcactcaaagtaggtccagtctttattctctgccatagcatcccctttatttccttcctagtgattattatctgtaacggtcaccttgctatgctgacttggttatctgttctccctgcactaggtcatatccttctacgttgtcctcttaaagggccttgttcacagttgtgctcccagtgcctggcaatagcagggctttgtcaaagatctttgaagcaactcagtgggtccccaggttcttggctgcccactctctaccacttgggagccatttagcttttgtcctcctgtagtcaagtgtttcccaagtaaatacagcatggtctgcttgttgacccagactaatgggttctagaaagcagcatggggtcagtgtaaacccagagcaaactctggcaaaaaaatcttcaactggtctgaatttgttgtgtatcctttcaattagcaatatgctttgtggcaatacaaccagaatcccccatggagctgagtggtactagttaaaactgactccacatgattctggaagatgtcccttcctggtttcctccttcacttttacaagtggttttagttaaaattgactccatctttattggggtcactgatttatccggaagttaataggatgagcaaggaaagggatagaaggtaagaaacctccaatccacactcaagtttttatctgacttgtccttgtaactgtactgggtctgtcagagaagtgattctagtcccattataatgcttgtcactccccaacctccagttcaaaggcaagtccctagaatgaatgctgctaaaaaacaaagccgctattgttgggaaaaccaagatcagtccatgaccctctttggaagcagctggttgtaaagaggctgttatttagtttgggcctaaacagcccatgcctgactgagagggaaggcaggccaagcctgggggtgggagtgtgaagtaagaagttatgcacactcccctcctcccccacccctgccccagggcttggcctcccctttccctttcccttccccagtgcagctggcagaggaaatcattccttagactaccagcactgatcctggtagcaccagagcagatgacagatgtgtaactgactgcaagccaacttgtgatctgctgatcacctgagacctgctagataggccagtggctggagtaaggaagtaaaagagatacatcaaaaactcaggatttcaaaagcttcaaacctgccaggaaaattagacagcaaaggccttaactggggagttcttgatagccactgagagaaaggaatgtgaattttctgagaagagtttagagagaaaataacttttagagttccccagttttggggacataccacacccaaccaggcagagccctgataatccttctctagaaagaaggagcggcaacccccatcgtgacgaggctcctgtctgcaggatggggtagagcaggtttaactcactccaacaactgggtggacaggaacagagctccccttgggctatggtcaagcagcaggtggaggacaggatctgttagagcagcggtcctcagttgggggcgattttgccctccagggacatttggcactgtttggagacatttcggggctgtcacaaccagagggatgtgtgactggcatctagtgggtagagtccagagatactgctgaacatcctgaagtgcacaggacagcccaccaaacaaagaattatccagcccgaaatgtcagtagtactgaggttgggaaaccctgaattagagtctctgagagtgtgagggtcttgtttcctggagtagaagcacccttgtgttgcaaagaaaatcgtccttgaaactcccatcatcttggtgttcctctaactctcatgaacatgagaatcaccagggatctcgttcaaatgtggatttgaattctgcaagtccggtgagggcctgagagtctgcaaccagctcccaagggatggcatcgtggctggtccacagatcacactttcgagtgcattcatattgtcccactctcctctttctgtccccacccccagccttctttgtcatactctgtttgagccattccatgccctgtcaccaagaaacatgtggtggcgtttaagctccactgcccagatgacagtatctctccagctgttgccaatttgaagttcgggatgttgaggaaatcgattgacttagttggagaaaggatcccaagggacctgatcaagctaccgccacacatgcttcaaacaaacaaatatgtaccttgggacactttttgcacggtctgagaggcttcaactgtgtagcgcccatgacttcggggctgttcaggcttgccgcagcatgctaaaccagaggttgacaacctgtgtctataaagggccagaaagtaaatatttgaggctttgcaggtcatacagtctgtcacaactccccaaatctggaaagcaatcaccaacaacatgcaaatgaataggtgtagttgtgtttgaatacaaatttatttacaaaaacaggcagtaagctggatttggcccattgccactgtagtttgcaaaccgctgttctaaacaattccattttctccatgtttctatctcagcaaaaaagaaaataaaaatcatataggaaagaccctaatgaaagggagctacgtcatcagtataagttgtaaatgtctggaggacatggttgaatagatactatttcctttactgcacagaaatgtgaaatatgaatgcttaaaaaagttattttttgaaaggctctggagtgcagtggtgtcatcatagctcactgtaaccgtgatcctactgcctcagcctccccagtagctgggactataggtgcacaccactatgcctggctaattttctgttttttgtttttgtagttagggggtcttagtatgtttccagggctggtctcatactcctgggctcaggagctcctcccacctcagcttcccaaagcgctgggcttataggagtgagccaccgtgcctggtaatgtatctttgaagttggcagaaacacagctctctgtcttctggtgcggagtgggataagacaggacaataaataaggaacagaaagatgtgcctaaagtctgccgttcaatcttagtctttttcttctttctggacttgcatgcatacattttgcccacaaagacatgtgggggaggggagccagcaaatattttctttccgttccatcagaccttgagcattctttgaagaacattgattttctcgcagaggccagtttctgtgagacctcctatttgtagagagggaaacatttctcagacagaaatgccagtgtaccatagaatgccccaaatgcaccttcatgctggcagttaaaccacagagaaccacaggctgaattggatgctgacctctctttgtagaagcacagccaaggatcttaagggaacctgcacccctgtggtgcatggacatttgcgtagctcccagtcacactgacccttgggatatggataaatcactgcgtttaactctatcatcaccctgagcacctctcataaagcctgcattatttggcagggaaaaaccctctctgttaattaagaaaacagagctctgcttgagagggaaatgacctgatatctgtgtctccttgccatcaggtgggattcttctgccagatcctccagaggatgtaggggtactgatactgccctggactatgtgctgcagccagagttctctggcaaatttagcttgcagctcccacctccctatcacacatgtgcttgagcacgcacacacagacacacacacaccccatggcttaaacaacaagaaaagaaaaatgtgtttattacaggagagtaagggcatgttagagccccattaggttggattctattgatttgcattattttgacactgtgtcgtgttcagcacagacaaatggagtgaagagttgagcttcgtctgtgtagaggaggaatcccagccacggtttggaggcacagataatttacaacagtggctggcgttcaagtggatatcagtgcatcaggccctgtttctcaaattcattaatccatacaatcatgcattcaatgatatttgtttgcctgtaacatatttgagtctttgcaggtcatacagtctgtcacaactcccaactccagaaagcaaccctcgacaatatgcaaatgaataggtgtggttgtgttccaatacaactttatttagaaaaacaggcagtgagcggtgagctggatttggttcactggccattgcagtttgcaaactcctgttctaaacagctccattttcttcatgtctctgccccagcacataaataataaataatataggaaagaccctactgaaagggagctaaatcatcagtatgagttgtaaatgtctggagggcattcacagtcttgaggcatgctttctttccttggggaattttaggccttactaaaccttcttcctgcatactgaataccaggtatgaggtcagggctagcaaacaggagcacagtttctgccctcttggagctgctgatctgtcaagaagacagagatgaaacaacaactacacagatgcaccatagtcatgatgaaccttaaaaaggaaagatatatttttcctcatctaatcatcactacagctttagtactcacttcctgtcattatgcccatcttactgatgcatctcaagaggtttacaaatttccccaagtcacccagccagaaagtagctctccagttctgttcgtagttagaggggaaaggagtgcttctcaagttggagtgtgacctgtgacagtacagttccatcttggggacagtatcagctgctaatttaaacacatcaacagagctgtgattagtaaggagaaaacatttctgcagtgcagggagctcattataaatcacgtgtactttgactttaaaattggagaaaccccagatggtgggctatataatgaatcaccagagatggagattgacaggtgtgatcatggtatttttttctggatgtttggaatcccacccatgtggatcacagcactgacccactccaggttggagggtggttgcttttttccaagctgtgggtaacatgagaatccatttacgtttattccatgagtatgtattgagcaccaaagggtactgggcactgctagctctgcaagaatacagtgaagagtagggagaagatcctggctcccaggggattcattcagctacaaacttacatatgaccttaataagtcagggtgagtagtttaaaaaagggtcaagtgcaatagtgagtggttggccagaagacaactaactttgctactttagaaggagtgttcagaaatgacactgctgaggaggtgacatctacacgaggactttaacaaacagaagtcaggcatgcaaagggaagagttttccaaggcctgctggaataagcttattgttgtgtttggggagacagggaggaatgtaagcacagctgaagcagagttaagcgaggaggagtgtttagttgattatcttggagaaagagaagagagccaagtcacgtagggccttaaggtctgcgtaaggattctagattttgccagtaatgaaagtaaccacagaactaccctttctagaggcaagtacacagttattgctcatctttggtcaacattggcctttctgttcatgccctgcatgcaagaagaccctggaggaaaatctgagttaatgaatcagaagagaggcatttctcctctctagagtgagcaggtagtatttccagtcccacccacacatagtccaggggaatgaatggcttacatttaggtgaaactgatagtagatgctgggcttgtgcaacaggaccctcctgctctgatcaagctcttttgtttttcaagggggtgcctcaggttatcccgagctttcccgggatgcagaagcctgataccagaaggcagtacacctcccagcagaatagaagctgctcttcttcgaggtcacctcctcacggaaataggaatctgttcacaagcaggatgctctcaaaaacatttcacttctgggcttatgaaagacaggttcgggaaaacagcatgctggggaattaatagtatttgctaagttatttatgctgaccctaattctactcaagagctaggttggaaagccctgcaaagatcattgtgtccaccttttgtttctagacatgagtttgaagatgttttctttcctttcttactagagttcatccactcaaaccactcattcatcatcttaggttgttatcctctcctctctgctttcatattggggaggctctggaagtgattaggctgttgtaaatcggcttttatgatttgtatgtaagagataagcagcagagtaagcaagcgattggaggccccagctgctattgccctgacagttatcccaggaacgaaattgaaacaaaaaattactggagtatatgatatttagctgattaatttctttataggcatatccaatgttaaaatttgaccctttaacaaacattgttttattttttatttatttatttgtttattttttggagacaggggctcgctctgttgcccaggctggagcacagttgcacaatctcggctcactgcagcctccacctcctgggctcaggtgatactgccacctcagtctcccaagtagctgggactacaggcacgcaccaccatgcccagctaatttttgtatttttagtagagacagggtttcaccatgttgcccaggtttgtcttgaactcctgagctcaagcagtccaccctccttggcctcccaaagtgctgggattacaggcatgagccaccacacctggccaaacgttgctttacttttactccattttattgagatataatttacacagaataaagcaaaccaatattaaaactacatctcagtgaatttttacacatgtgtattgttttacagccaccatccagatttagttatagaacaattgcagtgccctagaagccttcttcataccccctcctcccactgccctgacctgtatcactatagatagcctcagcctgttcttgaacttcatataaatggaatcatacagcacatattctttttgcatgtccaagcattttctatgagatacatccatgttcttgggtgtagttattcgttctcattattgtgtaatattccattttatcagggtttcttctgagactgttgacagtttggtttggaaaattctgtgtggaggcaaggaagccatccttcacactgtaggatgtttagcaacatctctggcctctacctactagacgccaggagaatcccatcctaatagtgacaaccaaaaatgtgtccagatgtttccaaatttccttcagaattaaaaaccatcatatcagatgaatatattctaatgttaaagaaactttttatttggaaataatttcagacttaaaaaaagttataaaaatagaacaaacaacacctgtaatgtactctttacgtagattgatccattgttaaccttttgccacatttgttctttcatgttcacatgcatgcacacacacgcacacacacacacattttatttataaaccatttgagagcaaattgcatccatctgggccatttaccaccatatccttccatatatatttcccaagagtaaagatcttctcccacattatcaccattattaattgaccacagtaaatttagcataatacttttatctattgcccatgttccatttttttttcagttgaccaaaagttatcctttatagaggcagtccccaacctttttggcaccagggaccggttttatggaagataatttttccacagactggggccagggggtggggatggctttgggatggttcaagtgcattacatttattatgtactttatttctattattactacattgtaatatatactgaaataattacacaactcactttaaggtagagtcagtgggagacctgagcttgttttcctgcaactagacagtcccatctaggggtaatgggagacagttatggatcatcaggcatgagattctcgtaaggagcacacaacctagatcctgcatgagcagttcacaacagggtttacactcctatgagagtctaatgctgctgctgatctgtcaggaggcagaggtcaggcagtagttggagcaatggggagtggctgtacatgcagatgaagcttcccttactgaccactcacctccttctgtgtggccctgctcctaaccagtctgtagcctgaggtctgggaacccctactttatagcatttagtttccctaaagagcaggttccagtccaggatcaggtattatatgtaattgccatgtttccctcgtaccctttcatctagaacattctctcagtcttgtctggtcttaagactacagtcccttttttcataacaaatgtccctccttttggcatctgtctaatgtttcctcctgaatgcattcgggtaatacattcttgactggaatactacataagggatagtgtgcccttctgagtacatctcaactggaggcatgcagggtgcagttgcatctcaccagggatgttaagtttgaacttaaggtcaaggtgttgtctgattttacctttgtttagttactaattcttcccttgcaactaataagcaatgtgtagggaaacactttaaaacaatgctctcccccatcaaattttaccccctaaatttagcacactttttgattcttgtgtgaagcactctacctccaatggttataaaatgactttccaaatctggcacccccttccttcttgtgaacttactctactgacagcggttggcattccactatacatagagccctctcttttccctgtttgtgtatttatttatgtttttatttatctgctatcagcatggacttgtgaattcctatttgtttcagtggtttataaatcattacttcacttaaatatttgagtgctcaaattgttcagatttggccagtgggggccccttcaagttaggccctgtgtccttctgacaaacccctgccatatcttatttttaatactttctcactttatggcataacaagatcctggttcttttaatttccttgcctttatcctggaattggccatctttctaaagagcctggattccttttagtggggaatggtagaaaaaaccacaatatatttatccattttcctgataattgacatttgagttgtttccgtttctgggctattacaagaaagcttctctgagtacccttgtccatttcttggaccttcttactaacttctgatgaatatataatcaagagtgaagatggagaattgtggaatttctactcttggtcgtacacccaacagaaattcataagtccacaaaaaatggccaaggatattcagagcggctttatttataattcatatacgtatatgtgtatttagctttagtaaatattgccaagtaattttgcaaagtgctcgtaacactgctttaggttttgtcacggaagaggaagttggaggccccagtaggagacaggaataatcagtagcaggggtgataatgggccattgcaatccaaaggcatgttgtctatgaccaggaatggcaaattgctgatccttgcaatatgtaatgagtggaaaatgctgagactttgccacctggcccattcttaaacatctccttagagagctctgcctgaaaatgagcaaaatggaagttactgcagtcagtatctcccactaccttcaaaatggttttcatctcagggatgccaagagctcatttgacagcagttaagaaatggaggtccattgctggggcacccactgtttgagagcatcaaacccactgctttacttttgaaagtccctccccgtgcgaccgagaggtcccttggggtcccacacacatcttctggctgctagagacccatttacaaccttggagcattcactgaatggtctgagagagtaaatatttctctatctatatctagggagtcacttagtgtccaagacacttttgatagggagccacctgccacttagggacagcaggcaaagcaggaaactgctgcgggctaacagagaagtgaactggcccaatattgtggaaccagtgtttggtattgccagaaacagcttgggcatgatccagcctctagagcttaaagtttgctcatccaaaatatctgtcctacagagcttatagtgcatgattagaatcaaaaatgtaattaaagtactttgcaaagtgaaactccaaatagaggaagcatcatacataggatacacagtgggctcttagtaactttgatgagcctttggaggaactagtaactggtaaaatacatctctggaagcattttaagtaagtgccccctctaggtagatagtgacctactgtggagtggagagaaccccctcacaggcacatgtgccccctgagagggcctttgtgcagtacacaacttcacaacggtatataatgaccctagatagatgaccagcagtgacagtgatacccattgctgcacatctgtattaatctctgtggtcccctcctctcttccccaggcctctctgctgatggtggtgccaagcgccaggagcacctatcccgattttccatgcctgacctcagcaaagactctggaatgaatgtgtctgagaagctgagcaacatgggcactcttaactcgtccatgcagttccggagcgcagagtcagttcgcagcctgctctctgcccagcagtaccaggagatggagggaaacctccaccagctcagcaaccccattggctacagagacctgcagtcccacggaaggatgcatcagagctttgattttgatggagggatggcgggcagcaagctgccagggcaggagggcgtgaggatccagcccatgagtgaacgcacccggagaagagctacttcacgcgacgacaaccgccgtttccgacctcacaggtccaggcgttcccgacgctctcgctccgacaacgccctccacctggccagcgaacgcgaggccatctcccggttaaaagataggccccctctgagagccagggaggactatgaccaatttatgcgccagcggagcttccaggagagcatggggcatgggtcccggagggacctgtacggccagtgccctaggactgtgtcggacctggctttgcagaatgcctttggggaccgctggggaccctacttcgccgagtatgattggtgttccacctgctcctcctcttcagagtctgacaacgagggctatttcctaggagaacccatcccccagccagcgcgcctgcgatacgtcacaagcgatgagctgctgcacaaatacagctcctacggcctccccaaatcttccacattaggtggcagaggacagttgcacagcaggaaaagacagaagagcaaaaactgtatcatttcttaatatgattgggatcagggaatgggagaagatgggagctaagaatgtaaagtcagaaacttgcactgttttaaatgttaaagcgcttttgggggtggcttatgggggagaaaagggaaaatgctgtcagtagatggaggcaaggttacaggttgactcaataggtagtcacagttcttggcatgttgaatattatttgcacatttcactttggaaacacagtagactctatcgaggccaggcttggtcacttccttcccatcagttctgtgttgagttgccatctctcaagatggtaaattgtttcctgctcgcttttatcctctctggttctcttacttttaggacccttttttcagtaagtaatttgtttattagccaggacccaagactaagttatttacatgtccattgtaaatgcaatgtaaatgagagttctgataaaatatttttgtattttgtaatatcaaaggaatttctatatcgtaggactcagtggggacttgcatgcacatccaccattgtctctgagtagtattgaaatgtggcccggtaccaccttttttttttttttttttttttctatacaaatttgttacatgtcagtgagacctttttcaaaggaacatattcaatttggctttttgtggctgaaaaaacataactgttagacccaaagcattttatgctccgttccatcttaaggagccatccttaagtctgctcccaccctcagtagaatttattttctacaaagtggtagtaatttttttttaaattgcaaatgtaatttttgccaattagagaaaccaaccggtgtcagtaaaattctgtgagaaatgccatccctgctgggaatgttgaagttacttaatgttgatctatcccttggggaaagtaaaagtgactgtgagtggtgccattgtgtgatgtcagcatgacgttgttttgaatgtggcattatgttctggtgctcatgtttcctggattgtattatctgctttcctttaccaaggcagacagaactgctgccttagcctgacaaccggttgtcctcaaagcaaatgaacttaagcatttgggattgagggacagaaggattctgagggggctctgcgagggacggtgtgtgacatgtcatgcctggagaaggaacaaggctatttgaaaacagaaggcaggtcaagggtagaagttaaaggagaatctgaaggcaggtcagggaaaagaagaactggaaatgaaacagaggacaggtgacaaccacctcgaagagctcccagagattgtagaaagagtccagtgtaaccagcttagtaaccagagtatctggattacccaggaaggttgagctgctgagatttcagtggtgcaatgtctttaaaaaaacaggctttgttgggagggtatttccattttgaactttgaggactgttggtcagaaaatgggctcaaaagtgagtttgcttaatgaagacatttaacggttgtgctgtttatagtaaaataaaactccctaccttgcttcagttaaaaatgaagcacttggtttcttccatcctcctcctccccttaatggattgtggcagttgaaataatccatcggatgacccacctgtagtgagatgtactgtcgatgtagtgcccggtgtatctcagtggccatctgccatggtgaggtgagcgtgatctcttttcagtatagtagttaacattttctagtattttttatggagagaatgtcaaaagtggcatttcagaccccgtcccagatgggtctgaggaaaggaaggctgtaaaggacatggtaatggcactccattcgggatgtattaaaataatttgcttttcaggtattaatatgacatttgtcattgtcactgatttttttaaaaaagcaatgcacatgttggttgtggctgttttccgcatgctatcttcatatctaaatgcttcattaattatccgagcctccggagaattaactctattacgtttgtatagtaagtttgtaaactgcttggcaaactgattaagaaataatttgcaataccgtgctactaaagtggcaggtttctggtagaaattgtgcgagtccaatttggagttttaagttccttgattgatgaaactaaaaaggcaattttggaaaaagagagggggaaaagtagatcacttatcttagcaaacggttgaaaatatgtctgtcctctgtggccccaaatccagtgaaagaaattctcccagtaaaagttgcttcctaactctgtttttctcagaatacctcttacctttctcaaagaaagcttcaaccaccatcatcagaaagaaggtggcctaaaaactgacacatggccagtgcccggaggggtctggaggcataagtctagatgcccagagagcatccaggcactgaactgctcagagcttgagatgaaatgacatacaagcttcagggtaaaactgtctactagcaagattacctccctcaattctaccattgcagatttcttctgaccccaaatgcaaccttacagagaatgctgaatgaggaaggccaattccttacaatgatggcagaacccccaagcgaatgccctattgaggagaaggacatcactgtatttggaattctgcctgctagtgatagctcacacatcacatcccagaatcccactcccaatgcattatttcctgaggcaagaacttaaggtcctcacctaattcctccatcacaaccattaactcttattggacaagctcctcctgtgagtagggcctgtactcacttcctcttagatcataattccatcttcaagagactgatttccagaatagtaatctttttccagcgttctctcttctccaatgccctggttgttatttttcccacctctcctaatattgatcttcttgtcttttggttagaactgcaacttcggagttgagttcatttcctattgctgctcaattcagtagcaacatagctggcttgttcccagacccaggaagtataagtcattgacagtttcctgagtggctctgccaatccataccacccttggtactgtgaaaaggcttcttggcagccaggtggcattgaggatggtattcagggcgctttccttctgtcatatagttgtgggatctctaccaagtgtgaaggtgaatgaggtaagggagatcagaaccatgcttcctggtttttcatacatccaaggaagaagtcctggtgtgggttgtttgacaccttctttccactttcaccttttattttttattccttcctttctacccccaaccagtcgagcaaatgagcaattttgtgtttctaatacaggatctggaagtagtgctttctaatcctcatttcctgtaggatgttcctgcactataacaagattatgttttcttccttctgcagcagctttctgcttcttgggtactactagctattgttcaattcaggtgaggcctgtgatgacatatatgtagcatgtgctctgcgctccctgcaagctgagcagatacaaccaatgcatcactgtatactcttgctgagaatgtggatgcagcctcacagatctttgcaacactccaaccagccaggaccagttgatcagaactgatcttattggtctgataaccaatcttatttgtgaactgattcatatctgtctttccactcttggttctcttgccgtagaacaaaaacagtttaggaagcataattacgaacatttaggaaccaatatgtataagtaattcggagactccaattcacctgcccctcccccatcccaggttgtggaggctcgaggaagctgacttcttaggctaaaggacaaaaaaatctctttacctccttggccattttcatgttctctgccaattactataggcagtcttcattttgcagaggtgaggtaagacttcatcttattcttcatgtaatcccaccttctaacaaaaaataaataaatatttaaattccaaggagaagtgttctttgtgtatttctagcagaaaacagatgcttaagcctaagaaggaagatccgtccatgacaaaggaaagtggaaaactgaaccagttatctgaatacttcatgccaggacagttgctattagcaactgttttgcaccttcagggctttaaaatgggctctgcagacagcatttgcatatgcaagactcagtagccaagcctccactgccaattgttgaaggcagtttcagatcgccaccttttgaggtacatttctttaagcacaagagaagtagaaatggcctttgccttgtctccagtggtttgtccctctggtgcctcagcagataccagagcttattcttatgaccatttggaagtagtcctcaaagtaaagatcaagaaaaaattggattctttttccattttctcataatagtagcctagtcaacacaagactcccataaaatatgactcactattgggagccatactattttataagcttacttcctgctgacaaaactagctttcctcaaggaaatataaaggaggggaaagtcacatagtgttaggaaaacattcctgtgttttgaatacgatgaatccataggatagagaaaaatctgcttgttctattctgagagttctctgagatatcccttcactctgcttggcatttggccattgatattcaacaggtcactgaccaagcttttctaaatttttcagagagagttacttaccagtaaggtctgttcttaaacctacctagttgattttcatatctttccataaagtgtcatgattctgtcatagaccctgacttaacattgtaaggactatgagtcctccattttttaattaatttttttttagcaaattaggacttcggcaggttttcctctcctaaactcattctttcctccacaggattgctttgtccatctcctgctttcatttcaagtgcataaacaaaacctcaaagggcctgggaaggtgaggcaggccagagtctgtgttctgtgttgagtgtcaagctatttgttaagaaggtctgcaacaggcctttggtgtgggctctgccagagactgttctgaacactttgcttgagatccgtgccctgtaaaatggatatgatgttttactgatgtctgtaatacatttgtaaacttccaataaaatttgaataaaagaaatgttgccattcttctca

SEQ ID NO: 6277 - DNA, 80455 bp, Homo sapiens
gcggccgccgcccgcctgcgctcagagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtaagggtccgacagaaaagagaccgaacctcacgatcgggccccaggggagggaagggtcacctcctccgtctccccgcgctcgctctccttgggtcgtgggcctggccctccccaagctcttaggaggatgctgccacttctcacccccctcgccgccttgcacacaccgttgcaacaccccattttcccagggagagagatccccctctaatctaggcgacccaactccccctttcatgtttttcctgggtcaggacgcttcccctcccccaacgcctcttcaccccctttcctgggaactgcctactccacgtttacctttcccttgaggagaggcctcttgctgccctccgctcgaaatacacaggcatactttttttctctccccgatcccccactccctacccccgttctcgcggccttgtgacagacaactctgatcgctctgggggccgcgatctcccctccgtaatcttcctggacgccttccctctcgttttctggcttcccacctcagatggctgcttcccaaaggcattaccttcgccacccccaccacacgttctctggctccccgtggcgtgtgccacagcgtgtctgagatagcctcgttgaatgtgtagggttcgagcctggagttgagccagattgtgtcgttttacttgccttgggcgtggagaacgatcttgtgagaatatcttcaaaggcagaaaaatattccctttatgaattctctttccctctgcgtgtaagtcgggaatgtgaagaggagtgtaggaaagagccctggttcaagtaggtaaatcgcatgagagggaaagttaaactgttgggaaagccccttctatgctaattgattctatagagtccttgcttgtctcacttcttgggcgtcagtggtctttctcttggatatggatgctgcagtcagctctgctggtctgggtcaggggtgcgtgtatgacctgcattttctgctttctcatgttacttgtgcaatgtattcaccggtaactcatttctttcccagacctctgggttccactgggctttgtctatatttaagttcatttctccagtttccttcctgcacataggtactgaacgaatccccaagttctgtgctaattaccttcatcagttgactaaacaagtttttagatgacatatttgtgaccaaggtcatatttacatttctttgttggacagatgttacatagctatacttgtgattggggaggatccagctgagtggagtgtgctgagctttttaggagagtgtgtactccctatttgaaattattttttggttgttaattttatattattaatgtttttaggtcacagaaagttctaagtggtaattttagatgtgtgggatctgagctaggactaaagcagagaatacccacgtaatcagaggtttctgggctccatagaggacgtagggcttttttttttctattggatttcttccagttttctcaggatcattagttctcttctgtagccaaaaattctggcctgttatgggattagagtctttaaggtttactcagactgtcattatgtgtagaaaaatgaattatgccctttggtaggacatgacacaaggctctgtttctagctgcaaatttaaattagattgtagagtgcttgggaaattggctttcaaaagaccaaagcttaatcttcactcctaaactgctggcttaattaaaatggatatttagaatttggtaaatgttgatttttctaataaaaggccttggtttaaaagggtgaccttaggattgtttctttcttaaaagcataattccagcccttctggcatggagcactggtccaaaaaaaaaaaaaaaaagtgtgtgtaaggagtgggggtggggtaaagagaaggttgttcctttgggttggatcacaggggtgagtatacaaggcagcagcagctgctggctctggagctctggttgctacgtgagaagcttgagtagtgctggctgctgtctccagggaaggacagcagtgcagcgtccattaatgctgctggctgcagggagcagcacttaggcgatggctgcttcaggactaagaagaaaccttgcttttctgggaattttcactgctgagctggtttgctttttattggtggggagatgggaattagtaattcataatctcctacccatttatggatattggcatctggaaactggatcatggttaaagcctttctttttttgtttgtttgatttgatttttgttttttggcagatttttgttttttatctagacatttgtgcttggataggactaaaagttccattagagttttaatttttcaatcagtttaaaaacccaagtaataattttaagaatctttctgataaccacaataggaagaaaataacaggaattttttcctgcagctcacatatcatgccttcctccatctctttaatcatagaatcaattcttattattttgttatgtgtctccatcctttcgattagaccacatttaccttatagacgatttgctaaacattttactaagcttgaactcttaaactctaaaaaggtgccattttggagtggtttctaaataaatatttttaatttgtatattagtaataaacttctccagattagatattttctttggagtttgacttataagattgattcattatatacatgttggatatagccttctgacatcacaaatatatgtctttggccataatccatctgaaatgtaggacagaccagaagaaatatgcagaaatcgaataagtctagttcaggatactgagaagatggcctctgagccccttaggtgatctcccctcccccacaactcctgaacattaggatgatctctgattaagcaaaacagtctgagcgtggaaaaacttgaaggagaaccaccaccaccaattatatgcaatactggacatattcctgtgtgctgtttttcttccccaagactcgtgtatcctatacttttttctctcagaattttgatttgttcattttcgtgtaaatgtacttaaatctcacaaacatctataatttgtagtatcactctggcatttgtggcagagaaccaaaaagaatggaaatgagttttgtcattcacaaatgtggctcacattgttttcccagtaataaaagcagaccaatgaaacagaacctttaatggatactattttaggaggttccaattcttattactatcacatagataagatgcaatagcagataaatatgatttcatgtatactggctgtttgacatacttagggtttaagataaaaatgtttgtagttttttactctgtggcttaagttgctatataaaataattgcttttacactcgaatttcctgttgtttggaaccttttgtgctcttgatattatcattttttagaggatcatacaggcccttttcatagaaggatttacttaagttatacccttgaaaacttttttatatcttttgatactgttttgtgtccaggaactgactttctgaaattattctggcttttctggggagaatgactatttcatttttacctttgaatggggaaataataaagtgcaaagtacagatttgcagataattacttttgctttatcctctccatgttgaaataacttatgaaaaattaggccatagttaacagcagtcaatgactattggatacattttatcagaggggaactggatcatgaataaaataaaattttaaaaataatttttggctgaactctggtgattcatcagtttaatttgaagtcagaaggtctagcagtgaattttatttataaaaattgtatttcaagtgttgaaaactgaaacttcttgaccagtatattttgtttgaggcatcaaactttgcaaaatgtgcatcgtatatttagtgatataactggtagtcatttgtaatttaaagtattctttcaaaggcactctttagaaagtaatgtagtgtacccgtgatgggcagggattggtaccattccttactgccaaaaattccaaaatatgtggcaaaatgattgatttatcttgtgggtgggattctgggaagttcatgaaaggtggagagaatatagtttccttcacttgtctatatacattttgttaaataagtcttaggaaaactgttttattgtatctttaattatgaattgcgtaaaagatacccagtaactttggggggaggtgctgttagaaagcattacattggagagaattcccctaccctgggacaaaatgcattctgtctttaatacttagcgaagggaactatgggataaaataaacaatgaaggtaagctcagtctgctttatatgtgccctcactgagcaaggaatttgtaatcgcatcgtgcctcattcgtttataccatcatattgattttgtttgctgagtacctgagggaataccttacttaatgtaaggtcacattaagtatgtttgatatgaagacagggaaaggaattttctgcttcttggagtaatgtcttagtatttttaaaacacttaagtttttacatcaggccagttttgcctgatgctcatgtctgttgctttggttgggctgctgctttctcttctgtgttcttatgggttcgttgtggtataaggattcccacagctttcatggcagtatgaagtaatgagaagcattgccttagccatgttagttacatgtatacttttggcctatgttatgaatcacaaaaagcggtagctataggaatgtatacaaaatagatttctgtctggggaatcaagtttttgatttgtgctacctaatggaggggaaaatgctgaatttcttgctgctctgtttgagaaatagatggaagcatgggaggagccagagacctctgcagcaggatttggtctaagtagaaaaggaagatttttgtttcaaattgccagctgcttatgtcagactgactcccttattatgcctccagtaggcctgtcaatatggccaaacagctagataagtgcggggcaggacaaagggctctttgcacagcagggaggcaatgttggtgggggaggggcaggaggtaggaaaggcaagaggaggaggttcttttccctgggagattattcagtttggcatacaattaaagaaatcatttttagttcccactcaagcattgaatttttgccaaccacatactattaaccccaaatttgatacatttcagaatatcttgtagggatccattctcgccaaggaaaaataaaaaaataaataaagctctgtataggttaaaataaaataaatcccacactctgcaccctcctaggtgcaagtcacctcccgaggagacccgttctagagctgaattctcattaagaaatggaaaagaatactctatctgaataaaaacacattgtaatacaatgtgtttatttgggttgggattggacctgaacatgtagaataatttgtttccctttatgaaatagttgctcgtagttgtctacaattttatttcattaagataggtagcacattacagctttcatgtgttgggttgccatatgtaaaatgctaactgaagaaaggctactttttaatttcagcctcatccttagttcctggagaacctgatatttcctggagattactccctcccccaccttttagtttaggcaacctcttttgatacatttgtgttcagctcgcatacaagtgggatagttgcatccagtttattaagacttagtatgaatcatagagttggaaaagatctgttggttatctggtcctttaaaccaaaatcataatgaaatattttgaaatttgggtccctattgaagttttcattaaaatgttaaaggatcggtgttctgaacaacatttttagttacttttaaaataaatgttttgcgtcagttctttttttaaaaataaagaatttcatttataggcaaattagctggcaattatttgaattgtgataggatttctcttttatgaaggaatatatgacaaggtttttcaaaatgcttaatatattttaaaagactttaatttttagaaataattggtttgaacagttttccaagagcacatttgttgcttgggttgaggtaccacctatattgcaatgttactaaactagccttaaagttttcccttctgtctatactgcatgcaacaataaagggaactggaatgttaatttccatttatggattagcagaggagatgttttaaccgattaataaccaaaaaactgcctttcgtacacgtaatattaagcaagcctgaccaagttttgtgttatttctctctgttaaagaaaactggatgtgttactacttaacattatattgttatttaatggtcttggcagtaatgatataatatttcgaccaaaagaaattttgagtaattaattattattgtaattagttggaagtttctcatcagtaaaatagcaacagcattaacacaaaatctagtgagctatattttatattactacagaaatttagggtagtcatttctttctttataatttattcacatggattatttccataaatttgtgggactaaaatagaagccatctagtcaagcaccagtctccataccagacagttttctctgcatgtgctatgacccacattgccagtattaaacatcctttacaccctcccccttcccagataattagaaatctcttcagggtagcttccattgctcctattacctggatcttgctagaggctctaagaagttcctggtaaaagtgagacagtaagggaccacattttgattccaaaggttttgataactgttagggctccccaaacagctaatctcattttcaccaagacttagccagcagagggctggaatggaggtgaaacacaagcactgtacctcatcttgcctgtgcagctgctccaccttatttcctgctattattatctcacaacgcctcctcccatcaaaaagaaactaggacaaagggggaaaattggatgggctaatgtgatttttattatgctaggttgtgggcttgtttatatgtacttaaatacaaagctaatttgccccattcttaaaagtctttagtgatagagattttgtaacttctgtatcttctactttctttcttgataaaccatttcagattctcagccttacagaaagaaaggttttaagcatacttaattttcgttggccgttcacagtcattattaccaccagatgccactgtattattagcttgaagaaaggtgggctctcttctgtacataatatctgcaatttgttttggaaaatactaatttgtataaatctgatttatgactaaaataaggttaaaaattagacctctatgtatgtttaccctattaccttagtgggggtgaaattaattagctctttgaacataaatttttcatgtcttagagttcttttttcaagctgcataatttatgttcttcaagccatttttatcccataccacccccacaaagggggaaattttattttttatcatttttattgtctttcaatggtgagattttcgccaccccactcctgaaatgtgaagactcaaataaaactgagtaatctaataaggtatatgcgttgctgaatgtagtaagatgattgtttcatcattcttagatattatgatctagtttgaatctggtttccagtatcatgttagcatatttaatactgttgatatgttaattttaatacatgcccaggtggatctccttgctttctatttgtgccccttgtttgtcgttttgtatgaagggggtttttgttgttggattttcttccccatctctgtgtcctgttatgttctttggcttatgtttcaaaaattctgtttcctaccaccaacctctgtacatgccacaacacatacaatttgtactttcacagtttctgtgaagtaggatgatctgcagttaataatcaactgtttgggcattcttggtatccaaggaaggttttacttagaaggaagaacctggaaggacctgttggcaattagactacttctgcgtttattttacattttcccttattaacgtaggctgttgagagttgacttgttttataagagaaaccagattgacagagaagacccccaatcagatagagttattttaaaaataaatgtgtttattatggtaacatttggggtagaatctaaagggcatatttttaaaaaaacttttagttctaaagacaaaagagtttaacctaaaacagaacaaagagaagggcctttgaagcagtatgattgattatatgctgaatgtagcattagaatgttgtatgaaagcataaatttttattttctcaatttctatggtacaaactactatgcccatggaagtatgtgtttatgcccacagcctgaaatatattcggtggaatgccttaaaaaagaataaatctggccgggcgcggtggctcacgcctgtaatcccagctacttgggaggctgaggcaggagaatggcgtgaacccgggaggcggagcctgcagtgagccgagatcccgccactgcactccagcctgggcgacagagcgagactctgtctcaaaaaaaaaaaaaagaatagatctgaggaaaatgtaagagcaagtctaaaattttgaagtcctttttgaaatgctattttttcctagacaaatttagtgttatttgtggcaaatagaactttaatgtcgtaatttagtaatagaacaaaataagggtgggtttacatgtccctgcacattttaggatggagctaaaaattataatgtctgcataccaaattgttacacattttaatattggggcttttattgaaaaagtttacccaatatttagaaacctttaaaaacaaagtgacataaaatattcacagataaatcaggtagtcaccttattggtggcatattatgtaagtgtactaaagccagatatttagtgttaatccaaaaatatgaaaattatgctaacatcatatacagatctcagaagttgctgtagccagccaggcgtggcggctcacacttgtaatcccagcactttgtgaggccaaggcgggtggatcaccttaggtcaggtgtttgagaccagcctgaccaacatggtgaaatgccatttctactaaaaatacaaaaattacccgggcatggtggtgcgagcttgtaatcccagctacttgggaggctgaggcataagaattgcttgaccctgggaggcagaggttgcagtgagccaagatcgtgccactgcattccagcctgggagacagagcaagactgtgtctcaaataaataaaaaataaagaagttactgtagatgccactcttacttaaaccctaggccatgtgtggagtcccaggggaagacatgtatttttagagaaggaaggctctaggtaggtgtaaccttcctcttacagtttatcatgaacagttagtatgaaaaggaatggctggaagtttgcagtagtacaccgagcaacaagagaaataaacatatcccacttcatgaaatgactatgccagccaagggagatgaaaaacaattttttttatagtacacctcatttttttaaaaacactttaatactaggaatatgtttctgtggcaaatagttacccccaaaggattatgtcaaatatctcttgtgaaaattaattttaaaattaatcttttggctgggtgcggtggctcatgcctgtaaacccaacactttgggatgccaaggtgggcagatcacctgaggtctggagttcgagagcagcctgaccaacatggagaaaccccatctctactgaaaatagaaaattagctgggcgtggtggcgcatgcctataatcccagctactcgggaggctgaggcaggagaatcgctcgaacccaggtggcagaaattgcagtgagctgagattgcgccattgtattccagcctgggcaacaagagcaaaactatgtctcaaaaaaaaaaaattaatcttgtgtagatagtgaccacgttttactttccttgggacagtcctggtttatacctgctatcctagcgtaattagtaatagcacccgtttcactctcaaaaatgtctcaatttggatcataaattatacgcttaccataattgtagaggattgtgagacttttagtcgctacctagcaacctagtttttcttgatagagctcttcttattctggagtctcctgtgctgcgatttatctgttgacctctctgaacccccatttccaaatgagcagtttttcgaatgtcttttttcttttcccattaggtggtagtaagggaaggagtaggtatagatttgattaattttttaattttttattattaaaaactccaattactacaaaatagaaaaatactttggagtttattaaactgttagtttaaaaggttccatttgatcaggataaggtccataccttgattggtaagtttgagtctttatagattctgttttttccatgtaggattcttgttaaagaaattcattattttgtggagttcgtactctggattttgaaggttggataatcatttaacacattcctctattaaacaacctccccccacctgtatttcatgtaaattactgcttagatagattgtaagcatattttataatagtactgtgtatttccattaagagttacataatttctgcttgtctgtgtaatgttaagcagctgttgttattcattgcctagatcaaactttgtggtcttaaaaattgaagacctggaagagcttttgtttgtgtgaattatgtcaagatttaccatattagaaactaaaactgagaaaaattttaagttatttattaatattaaaataacagtaataaagcctgctaatacaagtaatgtgattttttaataaaaataacatttttaattttataagtgtcgtttgacatttttgcaaatctctttaatgtctgacttaatagaagacagctgctttctcataactccttctgcatttaatttcttgtgataagttgttttggttgaagactgaagaaaatctggccttgtacagataattggttggaaaatggaagacctcatataaccctctgacagaatctagaggacttcaggcattctcacaccaccctttttgagaatcactggcctatattcatgatttacttcatattagatgatattttcttacttcttcatttattgtccggaatactcacccttatttttatttggctatactaagatagtttatatacagaaggtaagataagcacttgggttttttacccccttatttactagttttcaaaataatgggttggtaacttagcaacatctaaagacgtgaatgaagtattattattgtgtactcatggttttaaacatgtttgatatgttacagtctctggcagttactatttttgacattcaggttgtcctacctttgtctgttggctactaaattcttttgattcattcttaatactttcctcacttgtttccttgcttcctactattactagatgttctaggataattttgtacattttttgccccaaacctggaatcagccatttctgcagaaacctcttcattcttttaatgaaaaatggtacttagaaaccacagtatggatggtaggagtgttcattgctcttggtttgggccttgtttctagatttttcaatgaacaaagtttaaaagtattttatttctttttaaaaatatcacttggtattttaaaagctgcatttcaaactcagtgctacatgatgtttacgtaaacctaatctttctccctttccccatgcccaaaatctcagttttcactaacaccaatgtaatttctctttgttttgtgccacaatacacacactacagttttagtgtgacagaacaatatgattactggaaagtggctttttgttttgttttctcatgtctttttgcccttagggtatatccctttagagatagagatagtcatgcctcacttgatgaggatattttctgagaaatgtgttgtcaggtgatttcgtcattgtgtgaacatctagaatgtactaacataaacctagatggtacacctaagctatatggtatagcccattgctcttaggctacaaatctgtgcagcatgtgaccactggatactatacgcagttgtaacacagtggtaagcatttgtgtatctgaaaatggaaaagataaagtaaacatacggtataaaagataaaaaatggtacacctttgtagggcagctccattacagtcttatgggatcattatcatatgtggtccatccttgactgaaatgtcgttatgtggcacatgaccatatatagtcagattacagtattttgaaatcccccttagaatagttctctatggttgtgccaccagtttgatacacagtgaggttaatttgttacattttactttcagatttttcagggattaggttttgttttatgattatgtaaaatacttaaatggttaataagtgaaatttacgaagctgggtataatcagaaaaattgagcttctatcctagtgtcttccagctggttctctccctgtccctgtatgttagactcaacagagtcatcatgaattttcagagtgatgttttgtcgatacttccccttttagcagaagaagcatttaggttagttcatttactaaaactatttccttctagatttttcactaactaatatttttacactgtagaagaggaatgtggaaatttctgttctttcttttttggaaccagaatttcttggcttaatacaagcagtttgagataagaaactttctccagtaaaaattctctttttttttttcttttttttcttttttttgagatggagtctcgctctgtttcgcaggctggagtgcagtggcatgatctcagctcactgcaacctaggcgtcccaggttgaagcaattctcctgtctcagcctcccaagtagctgggactacaggtgcctgccaccacgcccagctaatttttatatttttagtagagacagggtttcaccttgttgttcaggctggtcttgaactcctaacttcaggtgagccaccgcacctggccaaaattctctctcttgaaatgccagaccatgtttgtctctgggaatttcaggtacacttgggacactggtgctacttgaagtgtagagagctcatcagttaacatttcttgaatggtttgcccttagacctgaaatgtatgttatttagaaaggatgtcatatattttttaactttgtcatttaaaatccaagttatttgattttatgtgttttaaataaaatattaaaactttaaaagtcttgtacctgttaaatgttttatccttcctaattacagtatcttaaagttatcacatttcagcaatacgtcactttctaatgactaatatagtctttaaaaatactaaatcaagatataccaaaggtgaagaaatagtgattaagaatgtgaggattctagctgtggttttcttgctttggctttggccaagatgagtttaattctttggtctaataggaataatacttttctcctaaacattatgagcattatttgagttaatgcatgaaaagtggttaaaggaacagtggctggtgcaacataagcatccagtaaatgctgcctttattttggaagtggttattgttacgagtatttgatcagttctctaaactctgtctgaactttacttagaattagtaatgttcatatgctgtaaataacacctgattttcaatacttcattggttatatgaaaagaaccaactgttaacaaaggaataattggtatctagttaaaatttgaggcctctgacttcacaagtataccagtgcttactatataaatataatcacatttaaaaatttaataaagaaagttttaaggaagtaagtctccttttcaggatccagggtcctttacaaacactggatcctgaaattgtattatttgttgtggctttagggtattgtgtatgctgaccagagtcacaggtggtttttttgtttgtttaacactagaattttgagatacatttgtctttacatgccctcaaagtaagttatataacaccagattgttcattagttcaggtttgatttttttgttgttgttttttgtttttctttttaatactctggggttggagtgaggttgtagagtgctataaggaattcctattagaagatagtattttagatatgggcattctaggaaaggacaaaatggtacactaaagttatcttcccttttcccccaccaccaaaaaaataaggagcaaactacagtgcacagttttgggttttttttttttttttttttttttttttttaaagagacaaggtcctactctgtcgcccaggctagagtgcagtagcacaatcattgttcattgtaaccttgaaccactgggctcaagcagtcctcccacctcaacctccagtgtagctaggactacaggtatgtgctaccacacccagctaattttttaaaaaatatcttgtacaggtgggggtctcactgtgttgcccaggctggtcttgattgaactcctggcctcaagtggtctcatacctcagcctcccaaagctctgggtttacaggcataagccatcaggcccagcccacattttgttttttaaacaagtctttatcttttggagatacatgctgaaatatttatggatgaaatgaaatgttatctggggtttgctttagatagagaggagataatagatgaaacaatcaacttattagttggtcattgtcgatactagataatgaataaatggacttctttataccattttactttcatactttatttgaaacaaggtcttgctatgttgcccagctggccttgaactcctggcctcaagagattctcatgcctcagcctcccagagctttgggattacaggcatgaaccaccatgcccagcccataatagaaagttttaaattttaaaataaaagtattcatagacttggctatcatggatcctggtaaagtagactagtgaacataatcagatgtttcagtctttccctgttgatactgcttgccctctgagcccatttcctctcctgatcatcgcctgctatttccaatcaacagaaaaaatagagtagcctacatatataatgagtttatactaagagggaaattttaatattataaagaagtctatacagattctggagagcattcctgaagagaagattgaggaagcaaatggattaattaatgtaatagtgtgttcagtgtgcaataggtaacattttatgatatggttgaatttctgaaaaggtatcttataaatatcagaccatatttaaggagacttccacctctactgataaaatctgcccttctctctccccctgactttattgctgcccatctgtagttttgatcttttttctctaggattctttgcctagaattgccatgggccttctggatctggaacacggatgaaggaagaggatgaatgtttttcagatgttatcccttatgggagtaatttgtaaattctagcttcttcgggtggggggaggcggggtgtgtgtgtgtgtgtgtgtgtgtgtgtgtgtgtgtattatttatttatttttttaagttaattggcctcttccagcaaagagtatacagcagagacctagaagtttcattttttgtttgtttttgttttgttttgttttgtttttgagacggagtctggctctgtcacccaggctggagtgcaatggtgtgatctcttctcactgcaacctctgcctcccgggttcaagcaattttcctacctcagcctcccaagtagctgggactgcaggcgcgcgccaccacgcccagctaatttttgtatttttagtagagatggggtttcaccattttggccaggatggtttccaactcttgacctcgtgatctgccaccttggcctcccaaagtgctggaattacaggtgtgagccacggctcctggccaagacctagaagttttacgtcaaattttgtctctgcagttttctgaggaatgagtatatgtgctcaaataatagctaagtattaagtctgaaatattctagaaaaacagtcacaaagtagttatgcctaggatgtttttgaatattggtactagaacaaatggattcctactagatttcctttttactttcatattcagatgtaggaagagttggaattcaaaatgtgaaaagcagtcttgaatctcagtaaattcttaagaaattcttaattcattgaagagccattggtcgtgtgtgttttttggggagtgtgtgtgtgtgttgttgttgttaagaattcggggatgagtatgaggctatcattgcttctacaaggcaacttaatgatagtttgctgcttggcacaacaggtgaaagggcctttctagagcagggatcttggtttccctttttcccacctagtagtatcattccatgtatttaccaggatatacattgtttagtcctgtcttggctaaataggtaatggtccttaaggacataaaatggaaggatattgtgcagaagaattactagttctccgtagtgtatttttttactgtattctcctcatcaacagatggaaaatttttaaacttagaagaaaaaacaagtgtttttctccaaaagattgagaaccactgcttttaagttattaatggaggtcttcaatggatttgttaaaaatctggagcatggattttttttttttaatttttttgttattggttactgagtattggaaaaggaaatacagtattcaaaaacagtaatgttcaggatttggaactattttactcaggaaaaaataagtttataaatagacattttaatgaaaaggaaaatagcaaatttatggaaatctgagatagtctgtgttttgcttcactctgtttagtgctagaattctggactttgtttggggtcaaactctgatatgacaggaaaactaacagatgattaaaagagacagtaacataaatgggaaagtttaaatatggtatatggttttaattatattttgtataagaaagcagtttataccagttgtattcctaactaaaaagtactattttatcagtttcctgggactaatttattataagttaattaatgacatgagcattttggcccaaatacagttgaaatgttcattgaaactggatcaaagatgagcatatgtgtcaaggctttaaaatcatttttcatattaagatttccagagaaagtttttgtaatatataagttaaatatttttaatgctttagatgacaggaactgttgaaggtcctggatctcataacaagccactagctagctgatccaaagacatttggccccatgggcttctaggaagacaaatgtgcttaccatttcaaagattttattttgctcagtaacctactagacatatattagtgtttgtttgagttggtcgttgtcttccattgctgttattttattattattatttttttaattttagagacaggatctccttgtcacccaggctggagtgcagtggcacagtcatagctcactgcagtctcaactcttaattaggctcaagggatcgggatcctcccacctcagcctcttaaatagcttggactacaggtatgcaccaccactcctggctgtcttattgtgttgcccagggtggcctcaaaactcctggcctcaagtgattctcctaagtcagcctcccaaagcgctaggatacaggtgtgagccaccctgcccagccccattgctgttgaacttttttttttttttaaagacaggctctggttctgttgcccaggctggagtgcagcagcgcaatctcagttcactgcaagccacccaccgagctcaagccatcctcccacctcagcctcctgagtagctgggactataggtgtgcaccaccatgcctggctactttctttgtaatttttttgtggttcaaataggaatcttccacgtgcatccaaaatatttttggtttgtgacactcagtgttattattgactcatttttccattggaaggtgtgcctcagagtgggtgagcctttttgccctcagtcttctgtcagcactctaagactccaagtactctaagagattgctcactaaaaataagaacagctggccatctacctcaaatgtgagccgtcacttttgtgatataatcagtccttatctttagtacacagatttatggaatatcacactcactgtctgcctgctttggggtgtttctcctgtgtcattcatttttgtatattggcatatagcaaatataggaatgctgtgtcgcagctgtgggtcatgtatgtacttgcagttagctcttgctcccaagaatgcaagaaatttatcaacaaactcgtgtcataaaaatagtttacagtgatttttttcttaaaatatttcaatgattaagactttttttaataaccacaagtgtataattgtaaaacctaagcattactcagcaaatctagcaattgttgaattgcataagcttcttgttcattggaacttttgctaaagaattatgacctttgatttcttatcaccatgacctatcattatgataaacatgcccctcttatgtatccttatacccattataaggataaacaagggatagctccacccaccagatgtcatagacacaactggtattttggggattttgctgtagactaatcctggaaggaagagaggttatagataaaataagattggccatgaattgattgttgattaaagctgggtagggaacattgggttttctctggttttatatttatttgaagtttttcaccataaagttttttttttttaagataaaaaataaaagcatgaatagtgtaaacaaagttttgaaggagaaggaaacaggttagtagctaattaacaaaaatgttcttgttccattcaggcacaggagtttggactagcccaataagcattaaggaaaccattatttgtagatttcagataatgcaatgatagtaaccaaagttatgctctagaagggataacatcatggaagaatatagagtagattggagggttcacaccccagaggtagtgagaccagttcactgctattatataatgctaccttgaaatcatagggaggcgactgatgtggtttgctaaaagtctccaaaaatttcaaaggagaatagctcttcagtcaggtgctagtgccagcacaacaaaaaagagggttttttccctcatttggccagggcatggatttggaccatgtgggtgtcataatggagtataccaagtgattttgttcctatgatgaaagtgaagtccatattttgtctcctgtcttttagtaaatcagtatagataagtcttttttttttttttccccccgagacggagtctcgctctatcgcccaggctggagtgcagtggcgtgatctccactcactgcgagctccgcctcccgggttcacgccattctcctgcctcagcctcccaagtagctgagactacaggcgcccaccaccatgcccagctaatttttcgtatttttagtagagacggggtttcaccatgttagccaggatggtctcgatctcctgacctcgtgatccgcccgcctcggcctcccaaagtgctgggattataggcgggatccactgcgcctggccaagtctttttttttttttaattattttattctttatttttttccccacatattctaaaataagtctcttacagtgtctaggtttctttccaaaggtgattaaaaatgaagcatcatattttaaacttctgaggcagaactgctagaacaagagttttgttttttttttttttttgagacggagtcttgctctgtcgcacaggctggagtgcagtggcgcgatctcggctcactgcaggctccgcctcccgggttcacgccattctcctgcctcagcctcccgaatagctgggactacaggcgcctgccaccgctcccggctaattttttttttttttgtatttttagtagagacggagtttcaccgtgttagccacgatggtctcgatctcctgaccttgtgatcctcccgcctcggcttcccaaagtgctagaacagagttttgataatttgtttgaaacgaagcactcaaatcttctagtttatttgcatttgcagtcagacctctacagatgccagctagattacagatggctagcataagtttttttcattacagaaagaagaaatttagagcttagtgcggtctattaaaagaattaaaggttatgtcaaaggacaactataagaaagtactttggttctgaatattgcttcagctagggtttattttgaagctcctagcccaaatttgtagaaatgcaactaagatctaatatttagtgtgtaagaactttacaggacatccagtcagtagtagtcttaaaagtgaatcacataggctgaagcaggcagatcacctgagcccaggagttcaagaccaccctggccaacatggtgaaaccccgtctctactaaaaatacaataatcagctgggtgtggtggtgggcacctataatcccagctactcaggaggctgagacaagagaattgcttgaacccgggaggtggaggttgcagtgagctgagatcctgccattgcactccagcctgagcaacaagagcgaaactccgtctcaaaaaaaaaaaaatgtgaatcacatacataaacattgggaatttgcagataactttcattttagggtttctagagcgcagtggtgtaatcttggctcactgcaacctccacctcctggattcaagcgattctcctgcctcagcctcccaagtagctgggattacaggtgtccaccactatgcctggctgatttttgtatttttagtagagacggggtttcatcatcttggccaggctggtctcaaactcctgacctcaggtgatccacccgccttggcctcccaaagtgctgggattgcaggcatgagccaccacacccggcccacttacaggatttttctcccccttcatggttgtataaatgcagtacttggcacataggcaaacctgaacagtttgcaagttgcctacccttttctactttggataaaataaacctcttaaaatagcacttaacatagtaatatatgtatattaatagtagttacttcatgtttgttgaatgaatgaatgaaaaaagtagcaaatctacataatataaatcccaagacagccaggaattttatctggacctaattgtcttacatagcaccaattggtacttaataaaaacaaggctgggcatggcagtatgcgtctgtggtcccagctacttgggaggctaaggtgagaggatcgcttgagcccaggaggttgaggttgcggtgagctgtgattgcaccaaagcactccaacctgagtgacagaccctgtctcaaaaataaaaataaaaacaattagttataactcagatgttgctatctaaggtaagtagtaattactataataaacaagctatatattaacatcttaattttctttcctctgaactttactactgtaggtgtgtagtgaacttcatacaagttaatctttttgtagctctatttcttcatttctgtttgttcatcggttggagaaattttgcttaaattaatgaaagtaaaaatacagatattaatggctcataaatgtgcacaacccacttcatctatagtaagtaaaagtggctcccattttggggtttgaaaatgaagaagatctgaattcacagagaggaggcacgtgtagagatatgagaagttcttttcctactctactttggtacattggtctctaacacatgttctgagcctcagaacacagtagaacagaaccttcagaaagtgttgagagtataactctttaaagaggtttagtcagtctaaattatttgagggcatcatctttatttggtacttagaagtctaaaatcttcctgattgttgttaaggttacaaagagtctgtgtattgttggttagttgagcagtaaatacctttttatcattgttaaatgggttgtaaataaaatatttttcttcagtgttaaaataatttatgatcacaatatttagataataataataataattctgttatttatgatatgtagtcttatcctactgccactcccctcttctgctccacatactactaagtatgacttggtctctataatacgcactaattatgaagttttttacggagaaggaaattcttaatatagactaggattttttttcagttgtcttttaatggccttttattctagtaaacttagatttcttatagacatcggtttattgtgccgagctcagtagctcctagagggagtataaatttaggcaaaggaatcaaggaataaactggtattgtagaagagatgggagaaaaggaaatttttatttttgctttaaattactaaatcatgatgtttcctgtctctcagtgcttaccccaatcagtgtttctctcttttcttttttcctttcagtcccgaacccctaaaattctttgcttgcattaacttgcttcagattataagcctaattttactgttccaaatacatgaacttttcactgtatctccaagtgctcttttagagttcatctctttgttttccagtaactcatatttgtttcttcttatgcttaacacttctctctcatttttttttttcatgtttctcacattttttctttccacattatctgctgtagcaaacttgaaatatatgcttttggagaagagtaaaaacagtgtttagccatattcaggttattagcagcagctcctctttcttcacatatacttaaagggaccagaaagttatttaagctcttacttgctacaaatgctgttccatgtgctcctatgagtcagcacaacaggtattttttttttttttattgtacagatgagaaaactgagactttgagacattctatgaattgcctgagctagttggcagcagtgccaggattcatagaaatttggagcaggaagacaacacaatgaagattttactttgaggaatttagggttcatctatgtaaagtgatttttctgaggtcactaattatgttgtaggctagaactcaagtctcctaactcctaatatagtgccttttttttcttttctttttttatttttttaggagatgggtctcactatgttgcccaggctggtcttaaactcctgggctcaagcaatcctcctgcctcagcctcccaaagtgctaggattacaggtgcaagccaccgcacctggcctctaagagtgctttttcctagcatacttttcttctcctaaggtaaaaggctgtttgtcatggtacagctacggtgattttacttgagatatttgactttgagatggagatgaagataagtatataatgcagctgccacattcattctcatacaaggtaaagtcattcaaaagataaatcgaagaactatagatgtatttaagaagaaattcagcctatatgtaacaacaaaattttgaataatcaagttcagaaattggatttttaaaaacttattagctactttaacccttttgaaatattcccaaaaagtgttttctcttcctgagttaaatttattcatttattgacctattaaagatttttttagtgcttcagagctattctgtatatctgttcattttcgttatttagtagtatatagaagtaatagattgggctgaatagatttatttcaggatatatcttagatatttgtgttttttcatgaatcccagtttaagggttattgctttcaaaaggaagaaatttggttagtcatgacttttggctagttgaagtttagagaagtgctttatacaggatcttttatttagtgagaaaaaaataactttttataattttataatactgtgtgaaaaacctgataccaaaacttctgaaaaagaaaccaggcctaggagatgaggattctagggaagattattaaattgaggatatttttaagttagattctaaattagtaaatcgtggctaataagatgaaaataatctgatcctttagtaagatctgaagtaatattgttgccctgcaaaaaagtggttgttatcagcataccttatatgtcagcctaagcaagattagattttctcttttctctgatagatgccaatatttaacattgacttttatctactttcaaaaatatctatgaaatatactttctgtctctgaattagagtgtatgtatatttgtgtttacttgaaatgttatagctggatgatagatttcagagcagtttttatgcttagggaagccactgcctcccaaaaaggttttcttatgagaatgaggaaaataagtataaattttcatatttatgttattactattgatgtgcttggataattgtatttataaaagtaaaaaatgttcagtattttatctgaaatttaataatggatattgtacagcctaaggaattaaaagaaaaaggaccctttgagaaaatggcttgttcttatgtatcttaatatatactgtgttcactttatgttttgtcagacactgaaattgaggaagagagattttggcgttctgttggtttatggagagagttgatcagagattgctccttggctgagttgctgtctgcataggctgttaacaattgtttctctggcagcagatcttgttcatcaggattgcatcatttctgggagaatggccaaggtccacagcctcaatacaaagactgtctgaagcatatgaggcctgttctctttctgaagcggcactcctcttcctgccagtcctcttcacaggattactgaagcagacttgttctgaatttctttcgttggattggttgtttattggacttttgtctgccagctgcttccgcctcacctgtctgatgcaatttcttcttctgaaatctgttggaattgttcataaaacactttttgtttgtcttctctgtgagtgaccagggagatcatacaggtcttgtgctttcagcaagtcatatagagaagagactgtcagaatgatgatacagagactgttggccatttctgaaaccaattaaaaagatggggtaattaagaaacatttctggcatgttctatttaacatccttttccctagaaactgtatgtaaatggcacctcctaaagagagtactcggtactactggaagatacaggctgtgtctgtttctgaatccaagaacttactagtgttcctgtggattctgatggattgttctggaaatagttaaattaataataaattgaaactgtgatgcattcatttaccccctactgtacactcacatctatttcgctgttttcctcctttcctttttttctttcttatttgctattgcttcttccttgatttactttatttcttccttccttttactgttactttgatacttttatttctctaattctgggtgtactattttaaatcgtttctaaaaaatagtttattttccagttttttaaaattagaaatcataaaacatcaacataaatgaaatgcatgcgttctaatgcttggtaactggaatcctatgaatagctcttttcatgtttatgatatgttaatctttaaggtgttaataactctggctagcgttaaatttgacttttaggaaaaaacaccagagacttaaaggatactgatcattttcccttcctttttggaaggtagaaaattaatttaagcgccattttttaagcatgtttccatttgaccgcaaatagaactgactcctttttatcactcttttttatagtaggacaagaaactagatggtgtggaatgaagggaaagaaaggagtaataaatatggacttgtaatttaatgggtgatgatggccccttgtctggctggacagttgtcggacatcgggttaaagaaagaactctgaatttgagaagtgttcagtgaagaagggaagcaccttttaggagagagaaaaagaagggatcccttggaaaatgagataattctaatttgaaggaagaggaaaaattagccagtgacataagtatttaccatttaagtcaaataatttccttctctaccatctcgtttctggctttatggaaaaataaaaaattaaagggcaaaaaattcagtgccggatggacgtagggtggtaaacgagatagtatagatgtaggatgataaacaagacagtatacagaaacataatatagctgtagaattccattctgtgtgttcatcaatgttatttctttctgtactaatttttgtctcaactttttctaggtcttcagaactactagcagataatttggggggacttcatattcagaagtctatataaaggtgactgacccaagtaaatccttttaatttctgttttattttttgcattttaatgactgctggaatcatgttgtagtaaattgtgattataatttacttagcagatatttctggaacttctctacgtgtcagttattgttttggccattgaaactacagcagtggataaaaatccctgttctcatagagtttatattctggtaggaaaaaacaaacaaattataataagaaaatactgcatttagatgatctgttaaatgttcctcggttaacattttaatagctacattttacagagttacttagggaaggaactattcttagggtaatatttgagaaatttgggattattaacagaatttgaattaagaagcctcatcattattaaagcattagttagaatgagatggtcaagctaacctattatggttgctttcatcagaagaatgaaacagtcatgttaaactagacacaaggaaaatggaataatttttatgaaatagaaatttatagttaccgacaatgtttctttttttttttttttttttttttgagacagagtatcattcttgttgtccatgttgaagtgcaatggtacagtcttgactcactgcaacctccggctcccgggttcaagcgattctcttgcctcagcctcccaagtagctgggattacaggcgtccgccatcgtgcccggctaatttttttgtatttttagtagagacagggtttcaccgtgttagccaggctggtcttaaactcctgacctcaggtgatccgcccacctcagcctcccaaagtgttggaattacaagcgtgagccactgcaccgggctgacttaatgtttcttaaggattcatcaactatccaaaatagctgggttggtgtttcattagtgaatgtagcaatcatttattcactcattaagatgttatctgaagtaacttttccatcttttccttttagtatatcttttaaaaattgctctaggaaaaatatcaactatcatcttgggtttataacttgtcttttatctagaaactgtactttttttttttttttttttggagaaagagtttcacttttgctcaggctggagtgcagtggccctgtctcagctcactgcagtctctgcttcccagattcaaacgattctcgtgcctcagcctcccaagtagctgggatcacaggcatatgccaacatgcccagctaatttttgtatttttagtagagatagggtttcaccgtgaaaccatgcattttttaaatgggtgtacagtcgtaatggctacaacaaagggtttttaatgatattaagtacggtttttggtttaagtcttttactgaaaatataaaacaattcagattccctttgctgatcaggggaggtacggtgataatcagactttcatatgattatctggtcagacagctttggggcttttcttttaatctgaattatacagtaagactaatagaaagagtagtgaccaacagcccccagtatttaactgtcttttgggtttacttgatgagtgttcttgttttatcatttacagattttacttcaatttcccaaaggcttagaagatgtactgccaaggtctctgtttggatatactgttagggaaaggaaacatacatgtgtaagactggcctaaaggcaaaaaagttcatcagtccctttttttttttttttttttttttttttttttttttttttggcaacagggactcactttgttgcccaggctgagtgcagtggcatgatctcagctcactgcaacctccacctcccaggctcaagcaatcctcccacctcagcctcttgagttagctgggactacaggtgcatgccaccacaccagatttattttttttttttgagatggagtctcactctgtcgcccaagctggagtgcagtggcgtgatctcggctcactgcaacctccacctcctgggttcaagagattctcctgcctcagcctcctgagtagctgggattaccagcgtgtgccactacagctaatttttgtgtttttagtagagaaggggtttcaccacattggccaggctggtctcgaattcctgacctcaagtgatccacccaccttggcctcccaaaatgctgggattacaggtgtgagccaccgcgcctggcgcacaccaggtaaattttgtatttttagtagagacaggatctcgccatgtttcccaggctggtctcgaactcccaagctcaagcaatccacctgcctcagcctcccaaagtgctgggatgacaggaatgagccacttcatctggcccagtcatttcccagcccagctatatgtcacctccaattgggtgtaggaacaggcgtattgtcatacccagaggtctcacttcatcatctaggctggagtgcagtgcatgattatggctcacctcagcctctacctcctgtgctcaggtgatcctcccacctcagctcccaagtagctgggaccacaggcacacatcaccatggctggctgatatttttttactatttttgtagagttggggtctcactatgttgtctcagctggtctcaaattcctggactcaagtgatccttccaccttggcctcctaaagtgttggtattacagttgtgaaccactgcacccagcccacaattttttttatttgcattaatatcaaagtaagattggagcatctcagaccatctaccatttacaatttacattaaccggccaggcacggtggctcacgcctatagtcctagcactttgagaggctgaggtgtgagtggatcaccggaggtcaggagttcaagaccgcctggccaacatagtgaaacttcatctctactaaaagtacaaaaattagccagacatggtggcaggcgcctgtaatcctaactacttgggaagctgaggcaggagaatctcttgaagccaggaggcggaggttgtagtgagccaagattgcgccattacacttcagtctgggcaacaaaagtgaaactgtctcaaaaaataaaaataaaatttacattaaccccctgggttgactcagtcggtatcatgtacttttcattcctttagtttttttagtattaataattgttctaatgtcttattatgaatcagtgtatcagtcatgactctctttgtagtcttttttgcaaaagtccttgttaacatgggtctttgacattcacattgactttattcccccccaaataaaatgctttttgtttcatcctttcaatgttttttacactactgtaaaactactaatgtaaagtcacacaaagaacacttgtttccctctgcaccatacctccaaatctcttaatctatttttgcatttttttatacttcagtaatttctgagtctttctgttcccagctttcactggtttatggtcaccatgtcaagctatcctcaccgctttttcatacacagttgtttagtctttatcatgaaactgtactcttcgtgatttcgggggtttttttgttgtttttaaaaagtagtcaacttttttagagcagttttaggttcacaggaaaattcatcaggagatacagagatttcccatgcaccctctgcacccacgcatgcatagcctcctcctggtttatatttttgttcatatctagcagcgtattattaccccacaaataaagttgctaagatgattgcatcttctcccaaaattatagttaagatgatttaaaagaaggaagagagtgttcaatgacaaaagaaggcactaagaaacagctgtttccaatcaagtataaacaacaaattgatctcttttaatttggaagaaataacattattgactgcttgtgaaactgcatttatttgtggcctaggaaaaaaacttaaatgaagatcttgaatttttaaagagtttaggtaaactgggatatttttaataaccatcctttatcttaaaacttgtttgctatatcctaggctgccagaaaattttgtttgggcagttttagaatggggagaatgtgttggttagtgagataggcagactcttcctttcccttcaactgaaaagaaaaacaaaagtaaacataactttttgccccctactttgtgaaacattaatgaaatgcatagtaaacatgggacactgtggctgtatttattttataattatcccttaaaagccttattcaagaatgcagaaaaatattcagtaacatttaagataaacttgaagaactatctgataactaggtatttattttactagatattttccttttctgttacaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagagtaagtgctactttctaggtagtaggtacattatcagtctgtgtggagacagccttcttatggatagctaataggataatatgtagtattttcttaaccagatcctattccactgtaattaacattagacctttccctttacccccattgaaggtggtggaaaaaaggaattagaaggggaaggaagagttttcagaggggtatttctgggcaaataattaatagaaccaaagttgcaaagtaggaattcattttcatttgttttaatgggtggagaaaattggaataaagtaggtgttactacctgcttctgtagagttaatgattctgatggagggagataagaaggtgttctttccaactgattttccttgaagtcctcttcctatgtacttcccattgttctagagtaaaggggccgaaactatatgggcaggttgcctagaccttctgacatctggggtagaaaacatggagaacagcgtcatctgtttttttataatattcgttgcctagaaagaggaccttcaaaatcagtggtaccaaacttttttttcagctaagagcagctttaggaattcagagtttgtccaaaggcccaatccctaaaattatactctcaattcttgaagaatgtaaatgccaaatgacaatgaaggtaggccttcattatacaactttatatatattattcacagttttaaaatttttagtcttttgtatcccttctcttttaagttgtccgagattccccctgctcacagattccccctcttgtccttttacctcccttgtacccaatcttccttgcttacagaaaggaagtggaagccccctacctttcaagacgaagtggcactacaccaggatgtgaaagtccagcgaaagagacccaaggggcctagggggcagcacacccccagaagccaagtctattccaggcagtaccagggattagggtctgggctggaaaaatcctggtgttttgaatatgttcaggtccagttcagactcttgatcccacagccacttcttgagtgaggtgggtgttgctctaattcccctgtttctcttgccattttcacagtccctggggattcttcccccttcagcaaagcaaagcaactgtaccagatttctgggttgaatgacatccctgattaataagtggttttcttccttaaaacagaatattattaaagagcatgtatatttcttcataaagccacctaatataacttacctgtttactgagttccttaaagaggaagacttaaagctaccctgagaaatagtatataatattctggggtagtctaaaatgaaaagcagtgtttgggcttattcccatataaaaaggagaaaggagggttgggggtggggaagggttgattttgtttcttctagagcttttttcttcttttgtttttgtttgttttgttttgtttgcatgcaaaaggtatttagttatgtcagtaactgagacttacttaaccattttacaactctttccccaaataaagtacttaaaactctccctgcattagtaggtagccagtttgtattgtgtttataggtttttataaagtcagctactaacctggtactatgtagattgtctaactgtatagatagatagcattaacatttgtgagaaatttcaacaaagaggttaaaccaatacgtttggaattgctggataaaagacccagagcagttaatcttacaattggtgttttccccaaagtatagacatgactgcccgtaaatactgctggggagtctaggactaattccagaaataaaaatacttctggtctacaaatgtgactgcgctgtctctgttaacaccaacatatcctaggatttcctgaaacattttcattcatgatctccagacagatttgtgatactgtggtcataactagctacatagttatgcatttctgcaaagggaaagaatgtcagtaactagctacataccattctgttaaattattaatgatatttattaatgtttcatcatgcctatttcgctgttctgggcactttaagattaaacctggtattaagtgcagcatactcaactagatgtagacttcacttcatagaattttaaatctgatggcaactatatgcaatacgcatttatttttgtgtgtgtttgtaggaaaatttgtagatgtaacaagcaaaacaaagatttttctgaatttccaactctaccataacagaatttcaggcattttccaagaaatggcatgatagcagctgggttgcatgttgtacttagaacactgttgatggagtatatctgttgtgagcctggtttctgtgtatgtgtccaattcagtgataggagaagaaagcctgtaattacatttgcataaagtggttggctgctaaagagatgtaattccattattccaaacttttaattcatattttaaaatataaaaactagtatatatatcaaggaatattttaggaaatcttgtagttacctgtaagtgtctaactgtgtattcaatcagtaaccaatatggaaattgcagagtttcttcatcagaagatatgagtttaaattttatatttggcatgcacagcaatatattaaatgctgtgcttaactagaaagtattgtgcagtgtgatggccttttaacctccacaatatacattttatttttattccctagacttgcacatgaagtgcatatgttcatatttacccgtttggagatgggtaagatacaaccagcatagctccatctccatggccatctttgatttcatgcaactttcctttttcctgtccccctcccaccaaaaaaaaatccattcctaataaacagctatcatgtttcactccatgtgttcagtggtacaaaacctatataaaatatgtacagctctttggaatacttgtttatctagtaatgtacctagtaaattaacaatgttgtataaatttattactttcttttaactgtccatcatagaaactaaattataccttcattttattaatgcttgtctgcctttggtttcatttaggaaaccccacctgtttcctaatactcagagatgattgcctctcagtgagccatgttcagatcatctttttctcaagaatactgacctgcattcttgatgtacccctcccccgttcccatcttgcagacacttttaagtaataaaatgcatgcacctcactaacagagaatactttcctctgtctaaagttcttcacttagaaatttcctttgctgttattaataagatcctttctcacagttttggagcatataactgggtgagttggatacatatctcagaattttctttgatccctcacttctcaattgacattgcaccacattgaactgcacacttattcctgctgtactatatattgtatatctttaagcaggaaaaaatgacttgttatttcaagcgaacaatatgcattatttgactccctgaaagacccattaatctctaagttagagttataccaatcatcggagtttctaatttgtgaatctgtgttctaattaatataaattacaaattactattctattctgcaaagccatacaaactttatatttttgaattacccttcagtattccctaaaacctaaccaggtaacaatcagagttgaagttctttcttcccataaacctgatttttatcctttgccatcaaagcctttttattgtaaaggcttatattaattttctaagtttgaatacatgtataattctacaataatacattgcgcttgaatagtttattttctactcacaaagggtacaaaaagatactaaaccaagcttctcactaagcctggttaataaaggtctcaaataattttctttaaaggactgaatgtcattctcatttctgtagtggaaagagcatagactttggagtcagacagactttgtttcaaatcttagctgtgtcagtgtgtaaccttggggaagtcatgtaatctcaccaccacatcttcccactctgtaaaaatggagtatataccatgtttagtggttgctgaaattaaatgaattaatatgtatttaaagcacctaacaaatattgggcagttcacaatggtagccattactgttgttattatttgtcagtagactaacataactttacagtttagtttttattttgaagttctatggtattatcatgcagctgataaataattttgtccttaatatgcttgcatgtcattggtggatgagaaattattactctaatatttgaaaggtgttgggggttcatcaagatgagaggtatgataaatataagatgccattgtttttacctgtactttcttcagggtatcctgtcttggtagtgaatggaagagggcctggtccctggggcagtgcagaaggcactttgatcatctcactcactgcaaatgtcatgtgaggtttcatggaagtattaagagatccaattaagaagaatagttctgagtctaaaccagcccagagtggcttctctaggggaaactccccgctcagctggtacgtttgtgtttgtcattagggacaccttgtatctcaggtgcctgccttcagacatctgcctgtactggcttcatgttacacacaaatccacatttaataacactcctactgttatttataggcttagttatgttaataagattgtttcaccgagttctttctcttatcctagtggctagtggttgtggaaagaggaggggttagaatgggaaatgaagtgttagtttaagggaagattaggtgttatgctatcatgcattgcttttcgcctttgtgcagccctgaatctgtggaggctagtccagcagttaatgagaagagcgtgtattccactcataattatgggaccactcagaggcatgggtgtcgaggactgccttatgctgtgagtatgcatttgtttctctccagaacagtgatcttcctggagtgtaatccattcttatacattgtgactttcttgaaatgtttatatgcagcatgacgaagttgccccttttgcacttccctgactccagcggacgtctagccctgcatcattgttcttgtttttatgtcccagttgaccttggcattttgttttatcactttcctggttgaagccaaaaaacaaagggtactactttcttctttctttccatatgtaccatactttaggggagagaggggccagtgtttggacactgttgatttaaaaaatcttattttcaggatcataattacggagcccctcctcctccgacacctcctgcttctccccctgtccagacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggtaagatcctgttccatctaaatttaagtctgggttgctgggattagggtttcttacaagtagggaaaagctcaaagtattctttcttgtgtttgttaatgtagatgattccttagtgctccttggctcgaattctctgcactaggtgagaattgctgacaacaaggaatgagagattgatgttaaagctattgaatttgatatgaaatttaatgtcctggaaacatttggtaggtgggagggagggggtagcatatgcagagacacttcgcccatgtgtgctatgatgtgatgcatgctgttggaaggactactttaagtttattttccctctttaggggaatgagcagggggaaggttattagacttcatcggcggaagcaggacaacatatcaggtgagcggaagatgggttaggtccacaatttgacataaaaatattctgtgatctgaatgttcattttaagaacccctcttggccaggcgcagtggcttacgcctgtaatctcaccacttagggaggccaaagcgggcggatcacctgaggtcgggagtttgagaccagcctgaccaacatggagaaaccccatctctactgaaaatccaaaatagccaggtgtggtggcgcatgcctgtaatcccagctacttgggaggctgaggcaggagaatcgcttgaacccgggaggcggaagttgccatgagctgagattgcgccagtgcactccagcctgggcaacaagagcaaaactccctctcaaaaaaaaaaaaaaaaaaaaaagaacccctcttacaagttcccatggtcccccagccagctcttttcacagaaagagatagaagtcctctcaagaccactgtatagttctctcattgtaaacgaaatgtgttgagaacagtttagtcctgtagcaaagtattccttgtgaacacaaaaaatatggattcctgttttaaaaattagccagtctcaaattgttatagattgagtcagcgaagcttagggactgaatacaaggggagaaataaataccatgaggaacagggtttatatgcttaatgccaatgacatagaatcttgttttcttaaggaagatgagtatttaacgttgctttacagatgataagagttaatagtggaagtaatggcttactgcatgtggggcacacctaaaagaataagctacttttaatgtacttttgaggctattagtacctgaactatgaaatcatcatttttcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaaggtatgcagggtaaaaatatcttaaatagaaattgtctgaaatagcttaaattttggagcaagaatgcaccaaaattcttttaagaagtttgatccaggtgtttgaagggccacttttgttctacttgcaaaaatcagctaatctgtgttatgtacatgtagaccaacctctcttctgccacaccatatcatcaccactggctcaaagtttcttctactccagtccccatcccaggtatgaaattccagccctacctggcacaatcccgtatgtgttgcagcctcaagtctaggcttccactatccttacagtatctccccacctctcaaccccaaagtacagtctgaaattcttgtcctggttacatgcctcatgtctttgggttgattgtttttccttgtttcaaaaaaaataaaaatcaggaaacatctcttgtatggtctaggtttcctcagtgtcatggtcactttcctgtattctcagctaaaatgtctacgggagaaacttcttctggtttgtgttctttcttccccatcacagcaactttgttgcttctaggtgacttgttcatcccttgttaaggggattggtctttgtttccttcttagtttcaaaactggtaaatctgcaactttaaagtttttttttatttactttttctcttagtatcagaggtgcatataggatttaagagatgcatgctcttccctgttaattacctagcttcacagtagaaagtattaaaattagtctcagagttcattggccttgagctacccctattcttggtaatagtttggggaattccattgtattttttacctagagaaagggggacagaatagaacactagtttgtgccttagttttagtctcagataggtataactgtcattcttggtaccaagttttgtttgttctacttgttttcctccttgggataggcatttcgagagggatcccggaagtccttgcggatgaaggtaaggggtaatcttcgctgatgctgtgttttacttcactgtgatcttgcattttggtcagcttctttcctgacattgatggtctgggaatcttggactctgcttttcattagtttgtagttgttgccattcagttttcatagagcttttctccaaagtagattttcttggccattttctgaaatattttccctttctgtaatcagccttcattgattggtttttcattcattgctttcctagggggtaagtgacatttttccaaacaaaatgaggctagtgtgttctgtcactgtgattgaactcaaccttaggagtggagtttttctggtaatgatacaggatctcttgtgcatctaccctagcactgtgtgggctttaattgcaggacgcttgtattattgataagaattactgttttctcttagcatatctgtttggtggaaaaaacttaggtaatgctagcatgtttcttaagatatcaaataaaagagtttatgaagtatgattttgtaaagaacttggagaatagagcaagtatgtggaatggtttaaaagaagtgtaaggtgctggttgattaaaaatagcttgccaaaaggagatttgattatgctgtctggtatcctcctttacgtgtgtgtgtgtgtgtgtgtgtgtgtgtataaatatatatatatgaggaaaacatgcctctcaaattattactgggggcttcaaagcatttaaatagaattaaattcaagtttatgagtattcatattcctaaatgatacaaaagcaggatctttcctattgagagttatagggcataaatattaaaatctttagtaaggccaggcgcagtagctcacgcctgtaatcctagcactttggaagaccaaggcaagtggatcacctgaggtcaggaattcaagaccagcctggccaacatggtgaaaccccatctctactaaaaataccaaaattagccaggcgtggtggcaggcacctgtagtcccagctgcttgggaggctgaggcaggagaatcgcttgaacccaggaggcagtggttgtagtgagccgagatcacgccactgcactccagcctgggcaacagagcaagactccatctcaaaaaaaaaaaaaaattcagtaaggataagctttttaggattgctttatgtgcagcaccagtgtgactggtgttagcaaagattacaggtagcactttacctaaagtttgaaggccccacttagtatctatctttaaacagacttgcacatacctgtgaaagagttgggagaggactcagagctacagagcatcagaggcctgggatgtgtcttggaagacaaatcaatcatgcctttgctggatccgtctcttgcaagtggccaagtttgctttagcttcccctttatttttgtctcatttgcttagagaggggccttttaaatagactttggaggcagataatagccctaatcctggctactaaatgcttttctcttatcaagcaactatcataacttatctccagaagctcgaaacctttcaaaagctataaactggctctaccagaaaactgcacataaaccccatattttgcttacagttttgggaggttgacagcctcacaggtgtgttaaaatttagaaaaaaaaattactagtcattttgattcttttaattctaaattgagttataaattttatgctcagaattactagtttaaaactcctccagtgatccaggtgggagccataagaattagaaaaaattatcatttggatttttaatcccagtgtcaagagcagcttccctactgaagacttaattgtaaatcagggtttctcagtcttgacactgttgacagtttggaccagataattctttgttgtggaagggactgttctgtgctttcaagatgtgaacaggatccctggtgtctacccactagatgccggtaacactcatacactcagttgagattatcaaaaatgtcttcagatattaccaaatgtcacctgggtgcaaaatttccctcaattgagaaccactactctaaacccaactgaggtagagtctctaatgccttgaaggatgggacagcagagtaaacacacagtgagattagcgaacaatggctaatactgtgacagaggcttccagaatacagtacacttatcaagtgtaagtttaacaattgccacttaaagctgggaatattgtttggacactgccagtccccctagtctgtaagctccattaagcctaaggttttgcactattcttttgcgcaactgctactgatgtcaagcaggcgatactctgattgtcagtatgttggctttaggtgtttctttagatccctttgtttattgttcagtcttttggactctagtaagaaatgtggagacaatagtgttgattttttttcttctatactcctgttccttgcagaaaggatagtagacaataatcagtcagcaacagtgatgcaaaagtggtaaaagaaagtgttatgataagcatcagtgttttctgtgccattcatagaaagtatatttaattttattgtacctgtttgcaagtttaatgtggacatggattttcaagtagctttggtactacagtgtcttttccttctaatcatcactagcatgacatcatcactgtcagtgtttgttttgttttctgatggcacttaagtcttgaacaccgtggaggagaacatgtattgggcttatgctttgtctctgtagctcaggcactgtctgcctaggaagctgttcctgagttgtagtaatcttttctcaatactgtcaccatagagggcaatggttttcctagaggagtatagcaaagtacctcctagacattttctatattctccctacctactcctctcccctcacttcacctcttcagattatttagaatgtggtaatttaaattgttgaaaatagagtgttagaaagatatactcaaataataactttttatatgggtagtaagattgggattggattaatgagattgattgattaagatcacatctaggtttagaatgaacatgtattatgaaaataataagtgatacaaaaacatgcattctcctggagaatagtcaaaaaaccagtttgggctaacacttaacacagatattcagtgagtatgaaaaatttaagcagtgataaatttgaggtctctactgttcatttgtatgaagattttcttatgaacttgatgtcagtcctttgattagaaaattgatttttatgactttaaaatggtcataaaatcacagtgatgggatgaaactatgatccagattaatttcttactttataaatggagaaactgagcttccccatttaaagaagttattcaaggtctcacctctcattggtaacaaaagcatgatagaaaccagatcctctgactcccagtccattactcttttatgccacatcaattgccaagtgataaattttctctggaaccccagcttgtcccacccccattcccaaccctctatttatgcatggactttactaacctccctgaatttgttttctacagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcaggtaagcaccaaagggttgaggactctctaagtagctgaaattttaagaacccaggaagagggtaatggattggaattactgttccttccaaatgtacaaggccatggaataacagattagccaggtgttgatcatatgtaaccaaaagtaggttatattaactggaaactacctggatacatatttttaaactacctttattaataaaaaaatagatgaattgaggctgtgtgcagtgcagtggctcactcctataatacaacactttggcaagaagccaaggtggaaggattgcttgaggccagcagttcaagaccagcctgtacaacatagtgagaccctctctttacaaaaaaaaaaaattaaaagccgttgtgatgatacacacctgtaagtcccagctactggggaggctgaggtggaaggatcacttgaatgaatttgaggttatagtaagctatgattgcaccactgcactccagcctgaatgaaagagtgagaccctggctctatttaaaaaacagagagagagatgacttagtatgggaaattctatataccctaggtaggaattatgtaatatttatagaaagttaagcatgttctttctcatctttattttagagatagagtcactgaagtcttaatcatgtattttttttttttttttaatattttcttgccgtttctggggaggcaatttcactagatgtagcatgtctcttagaaaaattgagctttcatcacattttaaaatttctcatcattgatctaaataacatgtacagataaaacctgaaaatattagcatgttttccttaattatgaagtaatttgagtgtctactaaggtgttcttgctgttgtttaatgttattgctctggttttattcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaagtaagaacgtcattcattgagcagtgagggctaaggtggacctggttgaccagtgttgttgtaaaaatcattctgtttgataagacgctcttgggagaaaaaaatcacaactcagataagctcacacctgtctgctatttgtagagaagtgcaagtaaatcttcaaattgttcaatgtataaaatggtgacacctcctttccaagccaagcattccttgctttgtgcttgttctttaatcaaaagcagacaaacgtgatgctttcccaagtttaggcgttgcaaaagactgctgctgcttctctcagcatatgcttcatatttggagtcatggggtggccttcttatttgtgttgagaattacaggaattttaattgtatccctagaccatacccctttgtgctcttctactcaaaattcaatggtgtagagatgtgtgtggatgcccgtactttcggtaatgatgctcggttcatcagaagatcatgtacaccaaatgcagaggtaagatatctgtagcaacttccctttgactggaaccatcaaatgacaagcttactgaagaagcagtgtgaaaacttcactcagataaaggtctgtagataatagtcgtgatatttcatcgtgggaggtgaaaaacaaaagtaatggtgcttttatacgacaaaatgggcgcaaggaaagagttttctttagagaaggcagaaatagaaaagagcaagttagcatttgctaaggagaaaaagctagactggataagaaaatcaagtgtagttatattaaagagattgccatacggtggaagtagatgttgttaggcctaactaagctatttggttgcagtttttttagattttagtgagtaatgttttatgagaggatctagacatttctagaattcattactcagagcaaccacatcaaataaagcaagaaaatccacagagctttacttactggctaaggaattttaattctctggtggagctggaaacagctataagatgtgaaagcggctgggcgcagtggctcatgcctgtaatcccagcacttcggaaggctgaggtgggcagataacaaggtcaggagttcgagaccagcctggccaacatggtgaaaccccgtctctactaaaaaaaaatagaaaacttagccaggcattgtggcgtgtgcctgtattcccaggtactcaggaggctgagacaggagaattgcttgaacccgggaggcagaggttgccgtgagccgagatcacgccactccactccagcctgagcgacagagcaagactgtatctcaaaaaaaagatgtgaaagtagagattttaccctgatttctaacatctcaaggtttctccacatatttaagaaagtattataaattttcaagccagtgcagtataatagtttcagatgaaatgaaggggttaaataacagattaccataactccttaaataaataatagattaccataactccaaatggagagaaagtatggtttttttctctcttacggaaagttcatggtctttatgaaaaatccaaccagaagccttttcacacaggtgcgacacatgattgcagatgggatgattcacctgtgcatctatgctgtgtctgccatcaccaaggatgctgaggtcaccatagcatttgattatgagtatagtaactggtaagacctcagaaacctttcctaacaggaatatccatgtcttacatattaagctattcactctatttaaagtctgctcttgtttcttgccttttcctttgtttacttaatcttttcatgactaatgaattttctgcctagaaattgtaaaggaaaagacaggcaagattttttttagagatacggataccttgtatgatactgctcacaaatttcctgacagaagtgttttcgcttatgcctttttagcaagaatagcaaaatggatatatatgtatgtatgagacactcctggaaattacaatagcatcctgttgttatgcacagagtacttatgtcagggaccatatagaatgagaatttaggccaggcgcagtggctcacaggcctgtaatctcaacactttggaaggctgaggcgggcggatcacgaggtcaggagatcgagaccatcctggccaatgatgaaaccctgtctctactaaaaacacaaaaattagctgggcgtggcggcacacgcctgtagtcccagccacttgagaggctgaggcaggagaatcactcgaacctgagaggctgaggctgcagtaagccaagatcacgccactgcactccagcctggcaacagagggagactctgtcttaaaaaaaaagagagagaatttaatatgttacctctacttttaatttgtcaattatacccttataaagctaggggtgagatttaaagatccaccctgtccacagaaaccatgttatctagctgtatatgacagtgcagaaaaccataaagggcaattcatagatgaatatgtgggattttttaaagtatatgctttttgttctttggtcatttggggcaaaatagaggttatgtggtaaagtgatgtttggcccaggtataaggaaaaaagatgttctgcttaattcatcaaggaaaataaaaaaggttttaagaaggttataaaaggttttaagaagtagggaattagtaggtaaaagtgaggacatggtaatcgtgggcacaagatgagtatggccacatcagactttatcattgataaactgcctgctaaatagccaataaaccactggggggattgaatttagggagggctttcttttttttttcccactgaccatggagtagaattggggttacacaaagaaagacagaatattgaaagtgttacgtcaggcgcggtgactgacgcctgtaatcccagcactttgggaggctaaggctggaggatcacttgagcccaggagttcaagaccagcctagacaacatggcaaaaccccgtctctgccgaaaataaaaaaattagctgggcgtgtagtcccagctactcaggaggctgaggtaggaggatcacttgagcccaggaaacagagattaccgagagctgtgatgcaccactgcactccagcctagatgacagagcgagattccgtctccaataaaaagaaaaacaaaagtatttataggactctctaatgtctctgtttaacttattcagagacaatatcagaggaagttactgtactgatattttaagagggtgaatggataatgtaactgaatttcaagggtactgagacaggcattttggttgtttctttggagcagtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggtaatcgcccctggtcaaatgatgatgctatggcatcaatcctccaaaggaagaggaacccgggttgccgcatggtttaagtaggggagctatagtaacacttagtgccctttatatcaatgtgggtttattgtgttcatacatttctttctgttttacaaagtcaaaaacatcctttgctggttttgcaccagagaataggggttagttatcatctgtgtttaccatgtggcctcacatgagttaacagtttaaagcactagagattgttatagagagttttaagctaccagaataaaacagattgattttttctcagagcttgagtacagctgaatattgcctctatcttaaaggaagtagacaatccagaagaaaaaccagaagaagagaaagaagaggttatagatgaccaggagaacctagctcatagcaggagggtgagtactgtctgacattactttgctccttctcattcctgctacctccatcatgtgaacctcttctgttctcttgactttgtatcatctcattgatttgacctgaaggttataatttgggctttttccgtaataaagattttattataatttttttatttatttttctctatacacacagtagttttgtagtgattattatctagtgatggtttgaagaggttgtttttttttttttttttttttttactaacaatctggtttccgctgggcgcggtggctcacgcctgtaatcccagcactttgggagggcgaggtgggcggatcacgaggtcaggagatcgagaccatcctcgctaacacggtgaaaccttgtctctactaaaaatacaaaaaattagccgggcgcggtggcgggtgcctgtagtcccagctactcgggaggctaaggcaggagaatggcatgaacctgggaggcagagcttgcagtgagtggagatagcgccactgcactccggcctgggcaaaagagcgagactccatctcaaaaaaaaaaaaaaaaaaaaaatctggtttccgaaaaactggctggtcagaatcaaaatgtattatagttggtttgctctgaattaggaattttctaggtttttgtgagttctgaagtttttttaaacccttttagtcatatgaactaaaattttctacttttatgctgaaaccaatcctgtgtgtttatgaccctgatttgatgacttttttttttttctttttgagaccgactcttgctctgtcaccaggctggagtgcagtggcgcaatctcaactcaccacaatctctgcctcccgggttcaagcaattccccttccttagcctcccaagtagctggcattacaagcatgcgccaccatgcctgggtaattttttgtattttagtagagacggagtttcaccatgttggccacgacggtctcaatctcccgacctcatgatcttcccacctcagcctcccaaagtactgggattacaggcgtgagccactgcacccatcctgtttttctttcatattaaagtttcaaaataactgaccctttttgaaaagtttatgtttgaccttgcctttatttacaactattccccacatttaaaatgaaatattttatttttaatcttctgttttccaagttatatgtgtcatcttactggtagttaaatgaatttctgtaaatttccattaaaaatacttttataaaagctatccactcgtcctcatttgaagcttccttctacaccagtactatctctttctagaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggtaagagttgaaaagacttcagcacttagacatcctcacctttgctaatgtcaatacctaacttttggaatttttaaaatcagtgttttcagctttgctccatatcacaataaataaggccattaactgtttaactggaaccatttcattggcctattttataaatgcttattagaaataacgcaaacatttgtcgctagcctctttagctcatttaagtgtatacatttttgtatttaaaaattagattttaaattagtgtttctaatccttatatttttcatcagtagacattctgaatgcttaaagtgaataggaaattagactgtttgctgataaaacatttctggtaagcatctgaccctactattgctacaggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaaggtaagtcacaaatgcatcctttataagtccagtctggcaagggctgtcttagtgaaatgagaggacctataatccctagaagaaactaatctcaatattactagattgaaagttctaaaatgctttgacacaaaaggctggagtcatcctgctacctgtttccttatttttagtcagcttaaatcactgatagctgaaattattcctctcttagtgggcgtggagagggtgaaggaagatatccttgtgttctagttgctcaattcattcttactgcagctgctgcatctcctcctgtcctagtttctagatgacgtttgtctttatgaactacactgctacctcttgatttataaactaatgatctcttttttaccttagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaaggtatgtctgtgtttttgtgtgtgtgttgtgtttatgtgtgtgtgctttatttttttaagcctaagattcctatcatcatgacataaataaaatgttctctagatagccactctgcccatgtgagtttataatgagttagttgttcagccataaatactgattcatcaagagtctgtgagactgtggtggaatgaatgtactgcatttttagtgctcagatttgtgactggtcactgatgtctcttctgagaacccttgaggttcctgagtgagagcacacagcagtggatgactgggtagagacggatatgttttgtgtgtgctcttgtgatatgggttaacatgtccatttatgattattgtgtgagattaggccctgggtcctctagaacactgttgcataaatgaaaaaaattaaattgttttgaatcaattcaaccgttattatccactatcatcacttgaaggaaattagaggaaaaatcctattgtaattggcataattcctgttccttgatcaaatgacaagtcggactgtttattccaagagaatacagaatctaccctaaaagactctctttccctctctgtttctgcctctttctcctctttccagttacttactgtttttggatctagtggcagtagcgtttggtggtgtttttggaatgctctttcttaattcccagaagccctgcatattttccaaaggtgtctcttaggaatagatcactccctcagatctatgatgtcgttttccatgtttctagaagtataggacaccctttcatttggtcttcctttgaggtagagtctgttccctggaacacccttttctcttatcctcagatctggattcaggctgccttcctcagtgtctgccattgccctcctccactggcatcacgtacatgaggatgctgcatgtagattatttgatgtgatgaagtctccaactccaggcaggtcttccctgactcctccaaacttaaaagcttttctctttccccaaagaacagaagttatttctccgggggaggggggcatgaaagatgagccaaagtggtgtgggatatggaggggaggagggcaataggaatctgcaaaaaggaaggacactactgctgaatgagcagcacattgcagaaagtcttttcctaattgcacatcttacctaaacattggaatcactcattggtttgttcggggaaacgctcgtagaattcctaaagagaaatttgaccatttctaaggatgttaactgttgaagcatcttatcaagccaggtcgtacaatctcctattttggtcctttaaggagtgtaggcaattatttattacagataagtaatgaagtctgagctgcaaataatatgaactaggctcttgaattgaaattccttcttgataattctaatgctgggttgcagtctttctgtttccatcttttccaactagcagagacttaacgaaaaccaaaaacgtgtctaggactgtaacttcagatctggtagaaaatgcatttctttaagcttttttaacttggttctgcttttatacttgtatctatagcacatccttaaatttctacgggcaacagatagaaattccatttaacacaagtccctgttatattctccaagtgtatctgactatccttaatctcatttatacaggctctactcaagcacttttatctatgtgtcatggttagtctttaggaagagtttaggctgcatacacaggattatcataacaagactatttaaataggatctttaaaaactgtttaagtcattgctttattgtgtgctgttcacatatcaagattctattttttaaaatacagctttttatgaggcaaaataaaatgaaatggaatgttttagctagaatagaatttggctttatagcagtgaagaagagttcttcttctaatattggtcttcttctaatatctcctaatattggttagaaaggacttacctaatgcagaacctaagaacattttcattattcaacaaaattgtaataaaattctgaaaatccctcagagtataagttaatcagatagataagaaaaccctccatgggattatttagaacaatgtatatttctaataggctcactgtttcatatctcactaaagaggtaagggcctggccttgtaagttaaaaacttaccagtataggacaaattaaagttgtatctgtatagttgtactcagattcttatgctatttatttttatttttatcattattattctgcaacttctgaaaagaagaggagttcaggtatttgacagaacattttatgatatccctagagtttctaaattgaatcatagtttttaagaagcattttgcattttttagttcctcagttggtattttaaaaacatttataagtggccaacaaggctctcagtagtgtttcaccttgttctctctaaactcctcttctaaacacaatgtgtatagggcatttggtctccagacttcttagaaaaaccagtctgactgataatgaaacagtgtgctttgcattgataattaatatttcattttatacactggagcattatctgtaaatctccaaacatagcattgaaatttagttgaaccgggactcggtgaaaatctgctcagtgttcagtactgtactataagctttcttcacatacattatctcacttaccatgcatgaaattgggatcattgtcctaaatttatatatccagaagctttgtctcagaaatgtttggtaacttgtccaaagtgaagcagctaataagtgacacagccagatttcttctggtgggggatagtaggggttcacagggtctcactgttgtccaggctggagtgcagtggcatcatcacaggctcactgcagccttgacctcctgggctcaaatggtcctcctacctcaacctctcgtgtagctgggaccacaggcacaccaccacgcctggctaatattcatattttttgtagcgacagggttttgctgtgtttcctaggctgatctcaaactcctgagtgcaaggagtctgcccaccttggcctcacattctgctgggattacagatacgagctactgagcccagcctcacagccaagtgtcaagccagggcttctggactccaaaacctgtattgcttccttgctctttcgccataatagcgagacctttaaaatatttatccatctttgagcctcccagaaaactcctttgcaatatattttaatagaggttcagagaagggagaaatgttcttttgattttaacaacttgctgagtaggtgcatctaaaattaacttattatccatgaggttaattgtatcttgttagatacaaacaaatgtccatgttccttttttatatgagtcctgaaatattgtaaaattatacaacagaacctggaggagtaggtttgattgtatttgctgtgtttcacctcatagctaaccatggtagcatctttcttctagaatactcctgttctgattttatgttccctttttgtagtcatcagatccagaatgtaaattattttacaagtacatctactagaccctggaaatattaaaaaattactcagataggaaagcttagtgaccccaaatgagtgttttctgctttgaaaagaaaaacttaaaggtggccataacaaaagatttttcactcctgagcctaatttttccatttataaaatgagtgctttggacaagatgacttctaagttctcttctaagctttaaggctatatgtatggttctgacaattcatctttacatcattattctgtatctaagatagttcattcttcggattttttattttgtttttgtgtttgcttttcagagacctggttgtatcctaaaatgtttacgtgattcaaattaccattgagagctcttttttatatccttgttcactcttccttccaagtgtttacaggtttacagtttcagttttgctttcatttggccagccacaatgacatttgtatgatgtaagatttttttttttttttttttttttttggtaaaatttttgtggattgtttcctaggtttctaagagggaaaatctatgagaattgctctctggtgaagagagtatttacttacctgtaatacatgttctctaaaggtataaattataataattcacctttgctcttcctattgggggagggtcttactcagaaattgatgtttatcaaaattcgatctgtcttatgtcagggcaggagagccacagagtggtgagcaacctacaactgtatatcttaagagaacacaattacaggtaagaaattttctgtcttccacaggatacataatcttattatcctaatctttgcaggtttactatctggcctaaatttatttcttgtcagtttattattctaatctttactaccaaaaacttgtgactgataggtcttctttttgactttttcccttttttttgatttctactgaagctcatttcgtgatttgcattactcatgcataatttaaccaaactacttgttggaggggggagtcccataggttatttcatttgaaataaaccttttggaaacgcttttggtacctgtagtgaagagctattaatcctcatccaaaatcttccaatgaatcttttttattacctcttcacacgtctctagcacggggcagacaacttttaagagatctttatcttccttctaggcgcttattttatatattagttttattctatacgatcacagtctctcctaaataaatgttaagatttcttcctcagtcttgccattttacaccatcccaaatggtatgaaaagttgaatagcagtcattttttattggtttttgtcttttgatgggatctcattatatgtaatccagatttcctcaagtttttcagttaaaaggaattgataggacaatgttccaatatgctgagacacaagacaataaaatgcttgactgtgtaactgaattagtgtgttgaattgtatcactcaccagttgatgtacatttaaaacaggtgcactaaatagttttagataattattgataattctctggttcttttcaattatagcgctggataaaacaagccttagaagaagggatgactcaaacatcatctgtaccccaagagactagaactcagcacctataccaaagcaatgagaatagtagctcttctagtatctgcaaagacaatgcaggtacgtatctaaaacctttctgattatatgaccaatgattgtttcaggtctgcataaaaaatttaagtatgagtatttctgatacaaaaagaaatggcgtgttttctaaatagttactttacatctgtctttacagaggaagagagagatctcaagtcagggatcagttttcccaggacgacaaagaaggactagacagtgtacagataacagcagaaatggttataaaaaaggttagatacatttaaagtagtaagtttaggaaatttatattcatatttataagatggggcaagggcaagaaagtggtggaacactaatattcaggaaagaattaaaattctgagtgattaagttgggtgggacatggttgagggagcaggggatgaatgaaataagtgaaaaattattatcaattgattgttttcaaaggggcttgtataattagcatacaatttttaaaagaacagccgggcgctgtggctcgcacctgtaatcccagcactttgggaagccaaggtgggtggatcacctgaggtcaggagttcgagaccaacgtggccaacatggtgaaaccctgtctctaccaaaaatgcaaaaattagctgggtgtggtggcaggtgcctgtaatccctccctaaacaggaggctgaggcagtggagaatcacttgaacccgggaggtggaggttacagtgagccaagatcacgccactgcactccagcctgggcgacaagaatgaaactccgtctcaaaaaaaaaaaaaaaaaaaaaaaaaaaacaaattttttaagacagctttaaatctaaagtctttgtgcatttttaaactagatgtcaatgaaaaatcatctgttccattggttttgacagtgacttgcaaaggatgtaattgaaagcacttgtgatatcttaatgtattttgtgacaatctttttaccagtttctcctgcaaatatcagcttaattgaaaagttctttgtgattttcataacttttctctaaatcagttttttaaatattagacaatcaaaataccaaagtaaattagatgctaaagcaacctttcaggttgcaacaaacagaatatttcacattttcataaaaaacccacttcattgttcctgtttaccaacttgctgaataaatgtaatgaacttgaatttaattagataaatttttagtagcagatattgcaactaaaatcagaacttttcttaaagttcttacttcatttggattttacttctttttagattttatttcagaaaacgtgaattgcctttttttctttttttcttttttttttttttttttttttgaaatggagaatcaagcgattctccctgcctcagcctcccgagtaactgggattacaggcgcccgccacctcacccggcaaatttttatattttgagtagagacggggtttcaccatgttggccaggctagtctcgaactcctgacctcaggagatccgcccacctcggcttcccaaagtgctgggattacaggcatgagccaccatgcctggctgtgaattgccattttttaaattatggatttagtttattcttttgtctctagattagattatacctcataagttaccacctatatacctcaggataataaaattccagttatctgaaagataaattatactgtttatttaaaatattttcttctagtattcaccaaaaattagggatatttagtcaaatatgaatagtataaagaaatcttggtaccagatttccatttgtattatttcttttttaacagcttttaaggtgttagtaagaatataacttagctgaaatagactatcatgtttgtgtatctatctggtgtgtgtgttaatgcatgtgtatagttaaggttgggaacaggagattgcatagcagttcacatcctgactagcaaaggattataggaaaagtgtctttgttatcacatgccctggttggaaggaaattaggattcctagtcaccagccttttttgttattgttgagcttctgccctagtctaacagtgagaaacactcacaggacacaccttgcccttaaaaagcaatgtaggaaaatatttgattttaaaaatcaagcagcagtcaaatgcgcaagttatattgctacaaaattagcataaattctgaggaattacttttatttgttggctctcttttgtttttttcaagaataccaaagagacattaagaaaggggaaaggatttctataatagaaaaaatcaaacagacctttacttgaaaaccagctgtcccctttactaactatatgatgttactagaagtctctgaggctaggcgttggtggctcacacctgtaatcccagcactttgggaggccaaggtgggcggatcatctgaggtcaggagttcaagaccagcctggccaacatggtgaaaccctgtctctactaaaaatacaaaaattagctgggcctggtcacgtacctgtaatcccagctatttgggaggctgaggcaggagaattgcttgaacctggaggtggaggttgcagtgagacgagattgcgccactccactccagcctgggtgacggagggagattctgtctttaaaacttaaaaaaaaaaaaaaaaacaagtctctgagcctcatttgtaaaatgggaatagcaatacctgctttatagagctaacattagaatgaataatgtatataaagttctcaatatagtatcaggcccataagagtaattattatacggtcattattctacacagaatactctttcttgtagagtatttgtggattaataaatacattaaagattctggctgggtgtgatggctcacgcctgtaatcccagcactttgggaggctgaggcgggcagatcacgaggtgaaaagattgagaccatcctggccaacatggtgaaatcccatctctactaaaaatacaaaaaaaattagctgggcatggtggcatgcacctgtagtcccagctactcaggaggctgaggcaggaggattgcttgaacctgggaggcagaagttgcagtgagccaaggtcacgccactgcactccagcctggcaatagagtgagactccgtctcaaaaagaaagaaagaaagaaagagagggagggaagaaagaaaagagaaaagaaaagaagaaagaaatacactaaatattttaagttcctaaaagctgaaactttatagaaataaaagttattatcaaagtagggcaggggcatgatgttcattatttgtaaatgatgtgggtctattcttagaagagcctaagtaatcagctgaaaaacttagaattaataataagagtttaggccaggcgtggtggctcacgcctgtaatcccagcactttgggaggccgagatgggtggatcacaaggtcaggagatcgagaccatccttgctaacacagtgaaaccccatctctactaaaaatacaaaaaattagctgtgcgtggtggtgggcacttgtagtcccgctactcggggggctgaggcaggaaaatagcatgaacccaggaggcggaggttgcagtgagctgagatcgcgccactgcactcctgcctgggcaatagagtgagactctgtctcaaaaaatatatatatatactaataataataataagagtttattaatatcactggatagaaggataaatatataaaaagtgtaaatatattttaaaaaatcatttatataccaagaaagtaaatgaataccaattttttttgttcccaaacttaacaaaactaagaaactgcctaggaataaccttagttgggtatatggagtaaactgttactgagaaatatttttaaagtctgaggaaatggaaatttctttttctttttttttttttcatgaatcatacgtgagcctttgataaatttcatgttcattatggaaagaatatatatatgtgtatatatatatttctttctctttctctctgtctttatatagttcccatgaaactgccttgtttttggaatttgattaaatgattctgaagtctacctttaaaaaaataagaaaaaaattgaaaaaataataatgaagtactttctcttgaggtgtaagacgagcttctagtatgaagctaatagttaaatttagtataatattgatgcaagaatggatgtatatatggaacaaaatagtcagaataggcctaaatataaatgtaaaagttggtaaattgtcatggaatttttagttaggagattgaaaaagaattagaatctagctggacacggtggcacgtgcctgtaactctcaactacttgggaggctgaggtaggaggatcactcaagcccaggagtcaagttcaacctgcgcaacacagcaagaccttgtcttcaaaagaactactaggtcctttgccaaagaaaattctaggcacattcaaatatatatatttttttaattcaaacttgggcctggcatggtgactctcacctgcaatttccagctctttgggatgccaaggcagaaggatcacttgaggccaggaatttgagaccagcctgggcagcagagagagacccacatctctacaaaaaataaaaattagccaggcatgatggtgggttgcctgtagccttaaggaggctgaagtaggaggatgacttgagcccaagaatttgaggctgcagtgagctgtgataatgccactgcgttccagcctgaatgacagcaagacatctgtctctaaaaataataaaataaataattcaaactgtattaaccatgtttttgtgtctatactgcctctgtattaatagaggattagtacattggggaaaggatttgcagtaaaactgccggggagtaatatccctgctagcaatctgataaaatttatcatgtgcattaaaaatattcataatccttaacctagtagtcgttcatttgttctgcttggtatctttcctacagaaatagacaaagaaaccaaaatttatatataaggttggtgcaaaagtaattgcgtttttggaccattaattttaaatcactgtaactagactcagacacatctttattaatcaaaataggaaccactgcaatcaacacatttttgccactgagaaataagtttgtttattcctgtagcctaaaaatctatgcttcaggattcgacaaactcttggaaaatattttctgcatcctgctggttgtggaagcaccttccctgtaaaaagttgtcagatgcttgaagtggtacctggttggcgagaggtcaggtgaacatggcgggtgagacgaaactctgtagtcaaatttgttcagcagcttcagaagttgaatgaattgtttattagaataattaattcttagttattaacaattgcaaaaactataggttaaaaataatctgaattccaaccccaggaatggtagaatttgtaattttatctgcttgtgcacatacttgtaatggagtatcatatactatttattgaaaatcttatttttgattcattttatcaaattaactccctctacccccaaaaacagcgtagtaccacttttgaattagatttgtgatcttacctagcaccttgaatttgtaagaatattaaaagaatagccaggtgtggtggctcacgcctgtaatcccagcactttgggaggccgaggcaggcggatcacgaggtcaggagatccagaccatcctggctaacacggcgaaaccccgtctctactaaaaatacaacaacaacaacaaaaaaaaaaaccgggcatagtggcaggcgcctgtaatcccagctactcgccactgcactccagcctgggcgacagcgagactccatcaaaaaaaaaaaaaaaaaagaatattaaaagaagaatatacgatgactaaggttccttctaggaatgtaaggatgagttaatatttgaaaatttaataatcgtcatttgttagcaggtcaaatgggggaggagaagtcataacacagtgacttttatcaatttaatgataaaataacatactatgatcttttaatatctagctgaaaaattgccagttgtcatgcatcatgaaaactagttaaacatcaaaataggctatcaaattatcccactattaccattattatttaatatagtctaagtaattgttagccaaagtaattacaccaaccccctcccccccacaaaaaaaatcaacataagagatataagtactggtaaagagggttaatgtgttatcatgtacaaatactattatctacctagagagttaattgaaaaactggtagagattaatagggtaactggataaaaaataagtatgtaaactttttaaatgttaataacatttagataacaaagggagagatacgttttattcatagtagtaaaaaaaaaaaactaaagaactctggagagtaaacttaattagacatgtggtatatatagatgaagagggacataatatgtgaataacaaagattatgccatgttcctgggtaagaatgcttctcaaattactcctgaatttcatctaacaccaatcaaaatcctaacttttttttttttttttaatagtatgagcatggtcattgaatgacttctatagttcattgctagaatagctaaaatattttggagaactagaacagaataactggaatttccctaacaattttaataaaaagtatgctggtgttgattcagtattggacaataagtggaaagaataacattcggaaataaacattcagaagataagcccagtatatgtaagaatctaataagataaatatatttcaaattaatagggaaattatagttattctacatttacagaagattttggaagaaggtgctggctatttgttatggggaaaggatggattaattgctaccccatatttaagtatgttcttttttccttttttgtaatggcagtttgtcagtgtgaaataaaatgttcttttttaattaaaatctaaattaaaaattaaacatggagacaaaaggaaaataggctggcatttttacagtgtcagggtgggttagcaaagacatgatatcagaagcagaaaataaagtgatccgtttgactaaatagaaacaaaacatatagcagagacttgtaaataaaattgaaggcaatcagtaaactgggaaaatacatttgtaattttattgacaaggggtcaacattcttactatttaaagagcccttacagatgaagaaaaagaccccaacacctcagtagaatgcaggctgaagaacatgagccagcagttctcacaggactaaatataaactacacatatatagatattcttttgatttaataatcctacatgtagccatttgttctaatagcaaaaaatgaaaaaaaagttggttaaattttgataatactaatgttgtgcagtcattaaacctgaactgtagatttctattcattgtcataaaatgttgaccatgtatttctgagtgaaaatagttactgagtagtttaggtaaggcaagagtcagtgaagcaatgtctcgataaaaatttaccaggatattagcatgcgtttatttgtggatatgattttcaggttgtgtatgtgctgtataaccttggtaattttttgagtaaaggtgaaaaataataataataaaagatggatagatttgaccacataaaatttggaaactatatatgcaggaaaaagagaaaaagtaggcaaatgacttggctttctttggcctgtaaacttcttaagggcagacatcaggtctcttgttgaatacagtatcataataagtactcagtaaatatatgttgaatgaatgccttgtacattgatttgcacgtggcagatttcacctgtatcttataactcctttctacaactaacttcatcacttaacataattgactttgatagttatagtgttggacctagcagtacagagatctgtaagattccattgtttaagacccttgaaatattaaatatataaaagttattccgaatataagccatgaattacatgtttgtttctgttttatacctaggcactttttaaaaggaggaaagaaaatttagtatctggaacaaaaggaagatgtgaatatacttccaatctaggaatattaaaaatcctgagatatcagaaaggaaaaatatgcatcttcaataattttttgcatttattcttccctcttcatctaaacatctcctaccctagtttagtgcctcataattctttgctaactactgtgttaactccagatggtttcccagttactagtctcatactgaccattgcttccagataatcttcctggcccaaaaattttccttgaaggcctggaataaatgtcactccttccatccaccaagccttggggatatactttaacctattgattaagaatatagatagatggagccaggcgcggtggctcacgcctgtaatcccagcactttgggaggccgaggcgggtggatcacgaggtcaagagatcaagaccatcctggccaacatggtgaaaccccgtctctactaaaaatacaaaaaattagccgggtgtggtagcgagcacctgtagtcccagctactcgggaggctgaggcaggagaatggtgtgaacctgggaggcggaccttgcagtgagccgagatcgtgccgctgcactccagcctaggtgacagagcaagagtccgtctcaaaaaaaaaaaaaaagaaaaaaagaatatagatagatggggccaggcgtggtggctcatggctgtaatcccaacactttgggaggctcaggtgggtggatcacttgaggtcaggaattcaaggccaacatggtgaaaccctgtctctactaaaaatacaaaaattaagaatgtagatatatgggagcaagaatacctgttttgtctctctccacacatcaagtttctcacctttaatatggggatgataataatagtgcttgatttatagagttgttaaaattagatatttcacaataaagcacatggcatagtctgtggtatataatcatcatttagaaaatacagcttttttttttttttaactaacacatagcaatatgatcacctttcttgatcatgctaatactaatgtgttcactttttttgttgtgtcgttttgttttgttttgagacagtctcctccctctgtcacccaggctagagtacagtggtgcagtctcaactcgctgcaacctctgcctcctgggttcaagtgattcttgtgcctccacctcctgagtaactggaactgcaggcatgcaccaccactcctgcttaatcttttttgtgtatttagtagagacagggttttgccatattggccaggctggtctcaaactcctggcttaagtgatctgcctgcctcagcctcccaaagtgctgggattataggcatgagccaccacacctggccctgtttctatttcttacaaattttaagcctcttgaaaatagaatgtatgatgaccatttttcccttcatacctagttcagtaatcagtaggtattaaatatatatacttttaactgtaaatgaataaaactgtatttttattctgagaatcaagtgagaaaggtgctttgacctaaatggtcactaaaatatttagtgtagtgacttgctttttaagtggatctaagaagtacagaaaataggattattctagtcaaaaagaatgtgaacctaattttttaatggttgggagaagtttttgtagaaatcatttcatgctttttaggtagaaaaggggctagacatggatcaaggaatcatataagaatagaaagagcttctgaaaagggacacacatatataagagatggtgaaaggaatttggatttagcatcccagtacctttagttggtgatatagcagtttagtagagggtaactgtaacacagtaacaaagacttttcagaaactcaatgtaaaagaaagaactgtagcagtggctcacgcctgtaatcccaacacttggggcgtctaaggcgggcagatcacctgaagtcaggagttgaagaccagcctggcaaacgtggtgaaatgccatctctactaaaaatacaaaaattagccaggtgtagtggtgcatgcctgtaatcccagctactcgggaggctgaggcaggtgaatcacttgaacccgggagacggaggttgcagtgagctaagtaaatgccattgcactccagccttagcgacagagcaaggctctgtctcataaataaataaatgaataaatgaaagaattttatattttgcactggtagaaattaaattagagatcagtcacatttgatttacctggagtttgggagatagaatgttttcagagttattttaagcatggtaattaaagagtttctttgggattttggttggattggaggagataacttaatgggatgaggcagaaaacagttaagagccattgtagattacagattaatggctttactgtagagccttaaattaatctgtggtttcaaactctcatccaagctttgtgtttcacagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgaggtgatttgggtttggttgctgggagtgctggatatgaaaatcatcatttgtaccttctcatttcaaatataataccattccaaatgtttctttactatctttcttccccatctcagtaagagaatgggaaacctcagggtcattgtggcctgttacctggtagcctctcatcttggcagcccctatgcttcccaaaataggcatactgctaccacaaatcccattcatgtatcttttgcatgcagtccatcaatctccataagtttaggtagtaagcatgctagatctccatcgttatctttactgtatactttggtcaaaataggcctctagctgcctgtagtatctgttagtaacactagcctgagagcacagatgatattgattgattgtgtcttcgtttctaggcctttaaataagtgaagtgtctttcccaggttgtttggtattttcattgtggccttagcagagatttagaaaacattggggtatggcttatggcgaatgtgggttttttccactccaggttactttccctctttgttataatgtcttaggaatcagaagtagacaagaggctagcaacatgtattcatgagacaaatttattaccttcactgttggattaagttagaaatgtctgcctcagctgtttcaaaaagtaatcttgaatcactttagtgttcaggtttgggtgacagcaggtttcaatagaatccatgtatacttttttaaaacacttcatctattgcatgttactttgatttgtaattaaaatggacactgtctcttttttccttctcagaaaaatttgttctgaccactaaacacactctgctgctctgcccccttgtttgcacttctccagatgtgttttttgagaaaggtgaacattttaaccaatcttacgtttcctattcagcttttccaagtatgaggattcagaatacttagcttttatgagtaactaagaggcagctagcaacattgaaagcagaactgtattctttcttaccctagacctctacttttggagcagacctctttctgggtgagggaaaaaacctcctggttacatatcagttatctagggaaattactctttaccagattatttatgaaattctttcagccagataataaagcagctgattcaggcctttctaacttgactttgtctacttgcaattgactttgcagtttgcacctagagctttatagtaaggtatcatgagaggaattctccctggagggcataagattataggaatagagtgtcatactttatcaatacaggttttattataaatgtggaattatgaaaattagaaggaggccgggcgcagtggctcacacctataatcccatcactttgggaggctgaggcaggcggatcacgaggtcagtagatcaagaccatcctggctaacgtggtgaaaccccgtctctactaaaaatacaaaatattagccgggcgtggtagtgggcgcctgtagtcccagctactcgggaggctgaggcaggagaatggcgtgaacccgggaggcggagcttgcagtgagccgagatcgcgccattgcactccagcctgggcaacagagcaagactccgtctcaaaaaaaaaaaaaaaaaaaaaagaaaatcagaaggtaagtcactttgcaaaacaagcgggttcagtactcagtgtgttccttatcccttgtagcatttgggataactattaaacactgcaaatataaagtggttttggttttgttttgttttgttttttttaattggtgatcattttaataatacagtccatgcataatgttagaataccaggagggaaggaaaatattaaatagtaaaaggtccaaggcatggtttcacttgcaatttaaggaaattttacctttctcatcaataatagaacagatttcaccaccctgacccattctaatcaccattttaatggccatactctttgctgtattctagtacagagaggtggggagccttttttgtagcaaaggctgtgacacattgtgaaatatcaaaaaggtgtcacgtataaagaccagcttaggctgggcatggtggctcacacctgtaatcacagtgctttggaaggctgaggcaggaggattgcttgaggccaggggtttgagaccagcctgggtaacatcgtgagaccacatttctgcaaaaataaaatacaaaacttagccaggtgtagtggcatatacctgtagtcccagctacttgggaggctgaagcaggaagatcacttaagaccaggagtttaagactgcagtgagccattattgtgccactacatgccagcctgggcaacagtgagatcccatctctaaaaataatttaaagaccagcttaggccaggtacagtggcacacacctgtaatcccagctactcgggaggccaaggcaaaggaattgcttgagcctgggaggttgcagggagccaagactgcgccactgcattccacattccagcctgggcaacagagggagactctctctcaaaaaaaaaaaaaaaaaaaaaaaaacaaccttactagattagtttggggaaggatatttttgagaaggaaaaaagcattcaggaaaatggtgagaagtcttaagtgctaaggggaagaaggtaagaagataaacagtggaagagaacaagatcttcaggaggggaaagcatctagaaagaagagtggaagcaacattgggaggacaagcttagttagcctctcctttctaccagaataaccctcccctcctattcttgccctgagagccatactccacccgccatttcacacatacgtgcacctagatgtacaccacccactgtccatgccaagtaaaattcacagccaaaaccctgctttgctgaagcagcctcatttcccctacctcagcatgtgcctgccacctaggccacagttattcagagtctacattaggcaccctctccttacctcagccctagcacccctgagtcattgtcacactaccaccttcactctcttcacgtgttcccatttacatctttccattaagcactcactgctcagtctctgttatgggactgctgcctcacctgaaagtcccaaggtaaagtcctaccctctgtaggatacagggacctaagtatacacatacatgctttttctgctctgttgccaaaagtacaatggattttacaaaataacattaataggggtggctcaggtctaattagattatgccaagaaccaactctagcctgtgagctagggattccatcaatcacatttcctgtaactgtcattcaagaggaactggccatctccctaaccatgtcagcccccagcacactaatgtctccccctggatagcactgggagggcctgaggcatataagagaataaagaaatgtgacaagcagaagaggcattggatgaaggaacaaggtccatgtaaggaggaataaggggtagggtgcccctcaataacaaatactgtaggttgctaaactctcatctaaaatacaaagacgtataacactaaaatttcaccagtctaactctttccttgtatgtgcttgagatgtttacttacagcatgaaacattataaccaatttatccttaaatgctttcagagataccaggaagcattttaacaagtcattctgtccattgagatgagttctgcagttaaatatttcccctatgcattcttattcaacttccccgcccccgaaaaaagttatggctaacatctatgcttgcttttattttttgttttgttttgcttcttgacttcgagtagatgaataataacaagatgcttttccctcctctagaacatatcctcccctgagagttcccctgcgcataggcccgagtccctgtcacccgaggtagttatcacaccatctcaatcacacttggaggctgagagtgagtgttcatgaatgtgttcctgagtgtgtggggagggctggggatctgagtcagtggggtgatgggctggagggcggccactcagtcacagtaagttgaatgagtcttcctgtgtgactgtgactacacaggactgtcaatgtagatggaggaaaatgaaggtaggagcgtgtgtgtttgtgtgtgtgtgtgttgtgtgtgtgtttggtggggttggtttttgccgtttgggggagggggtggctggagttctattaaagaatagaatctagaagtcaagatgctgatatgtggtaggagccttgttaaagaaaggctaataaatcaggaaagttgagtcaaaagttgtaagagctgttttttgagttgggtggtgacttatgccttgttctagggttaatctaacagctctgtaaaccagatgttttgacctttggttgatagattgagcagcttcttcaggaagggaaagtcattctgtctttcagctttcctacattttctctgcagctccttactgggtgcacaaggaaaccaagtgagtccctggctttctgtcacaggccaccattctgcaatggttaggatatggttgctatacaagtgttatctctttaggatatcagtagagtggttttctcacaaaccctactgctgtggatatgtcaaactcagattttagtgctagagtttctattataagctttcagatttagtaacattaactctgaatctattaatacatgggaccttttttctcttgaagagaaagttagagtctctcagaaatagtcaactgaactttaaccctatccccttccaataaaaaattagggcataattcagtgacagtctactaagttctgaatcagtagtagttcacaggttaatatgaaactgaaaaaggttttattccactagtatattagagattttcttggtgttttgactctagcttgttaggaaagtaaagctctctctcctcagttgttaaagattctaagataacgtaatttgaagactgatatggtatggtatctggttttctggtaccattctttgtcggttagctgtagttgacctagtgttggaagtttggaggttatgataaccaaatagtaggtggggtttatttttggtacatttcagcatttcagaatctgcagtgatgagcattagtggtcttgtggtatgttgacgtacattagaggataaagaagaattgagtggccagaaagttgtatgagaaacacagcttctttaacagtgaaagtgagtgaagaactggttggttgatgtctttaatgccatcctcctttactgaaccagtaacttaagtacttgcctttccgtctaccttctccttcctccacctttttcccttccccccaccttccatcaatattaatttagaaattgataaccccggaagccagttatcttaagacaccagtctcatctttgttttgtgcatggggctaaggtaaattcctaattataccacttgtcccttagtgtagtacaaggtgactcagcaacctgatgaaaggctaagcaggcaaaatagtcacatttagccaattacctaattctaactttcccagtatttcccatccagaaagacttgaaagcaattttggaaaggccaggattctttagtactctggcccatgtacactgttgctacgtgggacttttacagaatataatggctttatctgctctacttccgtccctcttatctttccctgttcacctgtgtccctctcccctcctttctgccctttgactttttcctttctcccctaccccatgtctccgttgatttttattctttcagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtaagtgtttcatgttatatcggcgaacttttcaagaatgttaaccaagtagtttagtagatattcataagtttctgctatgtgttccgcactactctcagacaagtgagacatagtctctgccaaatccagtgaaagacaggctgttttagtacaacttggtgaatgttgtaaatattcagcaaatgtaaatgcctgtatgtgccatatacttgctaggcaattgagaggttagaacagtgaaaaagaaattttacctattatttagtgtgtcccaagttcgaggcactgtattaagctctttaaatgtgttttatcctcacagtaagcctataagataggcaattttctattttgcacatgaggaaactaaggcaagttgagtaactttcccgtggtcacacagctagtaaatggaaggaccaggatactacccagtttgagagagaaggctggagtgagaggcagcaggttactgatttaactgaatctcaaacaataagtaggagtcagccaaccaacaattgagggtgaggtatgttacagtagagggagtagaacaggtaattaggtggcactccattggccaggcagcaggcatgcagtatggtgcaaacagttggatgttgttgtatcaggtggaaggccgggggagccaggaggaaagtgcagagagtgctgggctgggccaggccatagagagcttgctaatgggttgggactccacttccaagtaatgcctgatcaagaagtcacaaagccaaaaatatgcttttgtataagtggttctcaactaggggtgtttgagaatgagtaggagtgttttgaattgtcccagtgacttgcatttattgagcagggccagggatgctgaatgtcctgtataggggacagtcccatgtaatggccaaacatctgtagtatcctcattgaaatgaaacctagtggtttttttatattttcattataatgatattaccagaatttattaacttctttccaaaattatttctagaaaatgcatatgcaaaactgtctatatttttgttccatttggacagaaaaatgagaaccctaaggggatagaaggaggaggaaacattggcagataatttggattaagataataattgatttcgaagattgttgcgtgaacagcattgactaccagaaacaaacatgaaaacaatctttggatttctggttttataatatttactatgtgcaaaagtcatagaaattatgatattttatttcagaaacacttctgaaatttattgggcacatttaagcataaatttaagcatatgccaaattctgtgctggatgttaaagataaaaagccagataaacttggcctttgccttcctagaacttatagtttagtcagggagcaatcaaggcatggtaataggttctacggcctgtgtaagcaatgtgccagaacaacaaagagaaggtgtactaggcagggcacggattatggtgggcagggtgggatgggaggtctgctgtcaggaaagaatgagcaagcattagggagatgaaggggaagttagggagaagttaccaagttgttttctagagctagcttgctaaaattataaactggaaataataatttcctctctttttacattaattacatctatgtgtaagacagaaacagtaataaattcctatttatatcttgaaaatttgaacatatttaagtatcctggagcattgggtttttcttctgttttgttttgtttttccttctctctctccctctctctctccacctacctctccccacctccctctcctccatctccttctcctctccctgcttctttctctcaaacagctaactctaggggttcccaaggagtacagaacagccatcagtcacctgggaggctttttaaactatacaagcttccaattctcccttctctaggtacttccattgttgcaaataactgtgatagcatgcttctgttactgtgtaatggtaacctcacaagtttttctgaaggcagaaaaaaagatggtggtctaattggcaaacattctttagagacttgcctcctagtttattatcttcctcttaccaatttccagctgccttaaatatgtagctgtgctcagatctctttcatactccccaaaaaaagttatcagggttggtgtctgctttgtttgcgtggcttggctagtggtttactaaggtaccatctttccttctttccctgttgctggtgatccactaatgatatccagatagagtaccgttttttgtttgtttgttttttcctttctaggtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggtaagtttatatttgatgttttatagttaaattgggggtgggggggagtatatatctaagatcattcccagttttacctaaaatctatgggaacacttgatgggaacatctgagacagccagccaacagtaccatctgtcctgttcagctgatttaataatgtcagctgcaaccccccagctttgcagaattaagaattaccaacatgcctgtggagcagtgctttggatgacatgtagttatggatgcagatgagctctttcatttggtgggcactaacactgcctttcctatttctcatttcacatgaaaggtgagtcaagaatccagccaagttccacatgaattaacaacagatgtctctcttccacacagctagcatatacagagcaaaaagacattctgaaaggatttgtctggtttaggggagaccacaaatttaaaaatgaataatactggtggcaaatactgaggatcaaatgtgtgaaatagagaatgaagcacaggagttcagggatcttgaactgaaaaaaataagtctgggaaagaacagtcctggctcaaatgtttcatgttcattaatctatgaaacctttattaaaccagtactgtgtatcaggcacatgatttcctaaaggagaaattttaacattttaaatgggggttaagggaagttaacatctttaacccactttttccttgatttctttttctttaaaagtggttgttgttgatgtttctcttttgtgcctgacatagttggaggcagaggaaatacgttgttttaaattggttctgaagaaagtaatgtttaagaggatgttttaagaaaatacactgtgcactggttagggcttcatttgttttggttaagtcctgtggcttgaacttgcaccctgttgcctttacaggatggttcccacatcagtagaacgactccgagaaggagggagcatccccaaggtcctccgaagcagcgtgagggtggcccaaaagggagagccctctcccacatgggagagtaacatcacagagaaagactcaggtgagcccatggccttctgctgccaccacattcagggacacatgagccgagtcctgtacagttcatgcctagtgctgagttgaggtgagtcagtttctgatgcagttgggctccaccgcatgctaggttccagcccacttatgctcatttgggctaccacatttgtaagatctagcattgcttgctctctgtctgctcttttttccccaaggaatacctttctgtaactctcatctctccaaagtcctggaaatctacctcgatgaaggatgaagagaaagaagacgggaatcacatcaggcatttagaacatagcccataattaaccactcattttgcccttctggcatgctgcactcacccaatttgtcacaaagagagcagtacgggttggtgatggcactggtgatttaaatgaaaaatggctctttcttacttattctaagaagccaagttgatttttttttatatatgttaccttccagaccctgcagatggagaaggcccagagacattaagctcagcactctctaaaggagcaacagtttacagcccttccagatacagctaccaggtgagatgagaaattgctggtctctagccataggagtgtgttctgggtcccaaattgtcctggtcatcctttgccattgagatgctgtctttgcatatagtttcagcagccttggaaataagtcatcatctgcttgtcctcaggtaataaattatgccagaagatgaatacggtgatcaaagacagacattttactgcctttggtttcctaaaaagaatacatggttaaaagatgaagaaaaaagaatgtagggtattataaatgttcaccagccatttaagggacttgttcgcgtccttattcgtttcctcccaactttgtctagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagattttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgagaa

SEQ ID NO: 6278 - DNA, 10290 bp, Homo sapiens
gattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtgagcgccgcgcacgcgagcagccagagggcaggaagggtggcagggctggagcaagttctcatttcggctaactacaacagcatgcccttgaaggacctgcgtctatgctgttatcctaaaaccggatgcagagggactgtctaaaccctgatgactgctgaccaagttagtggccggcagatttgggcattcgtaatgctgtccacctcgggtttgaaaggaatgaagagagctaaatgtagaaacagcgcttgagagaagccttcacgcggggattcagtgcccctagaagaggctgcgccgcttttaaccttgccgatgacggttgcttaggtgaaaagaaacgaccttttgcctctgaaagggcggtaatatgccttaaaaagagcgggctagatctcaggcagtgtattttttttttccttccaggttctaatgatagccggtgctatctgtcgaaaggacaaaatgggtttagtggttgattgccatcagcccccgagttgtctagacaatggggtattggactcagctgggtcgttcagcagtcagttcagaaagagggaactgcattggatttaaggaaaatcctctctaattccctcgaaaaagcctaatggctgttcatttttgacaagtgacgggagatggctaacctctgacacttagaaagggatcaaggaaggaaatcttatggggaagaaggccttagcaatgcttaaatttatggaaatatgattgatttccagtattatcctttgccagcagtgaactgccattctgtcacagctctgtgtctgatacaaggcacatagattctgtacttaccatccccaaattgcaatgtctcagactcaggcttagagcatggcatgaacatcaaaggcaggaacctgtttatctttgaattggaaagatacagcaaaattacactgtttggaaatacgaatagaggagtgaaaattgttgcagtggggtacccaaagggattcgagacctcaagttttttttcatcttgtatccttcaggtcctcttgcccctggccaatgtggcattaattgactacactctggaattcctgactgccacaggtgtacaggaaacatttgtcttttgttgctggaaagctgctcaaatcaaagaacatttactgtaaggccctgcaacttttctttccatgtttcgccatctttttccagttttttcaggatgaatgtaactaaggggaaatgtgagaggggaaaaatgtgtctacttagatgtcattgtaagttctaagggtattttctacacttatcaggaggtgagcagctgaaactttgtatctgtctgtcttgggttttctgtgacaaagattaaagaataaacttgggttttttctgaatctcattataaagtttggtgccagtggactttgcttttatttaatggcttcagtatggaagttacaatgataacatctttgttttcccactgagtttctaaatcttgtttgttctcaccttcaaggatataaatgagctccttgtcatctttgtattcccactgcctagctcagtcccaagcatatagtgagcacttacatgtttgttgaaatcttgaaaactagggaatcgcattgcttatggaagtccaggatgtaaagactaggacattagcatggtctccatcagacagttcctaaatgttatatggattgcagaaggggaaagctgacgtgaagcgtgttcccaggctactttgtgtaccctaggcttcagcaggattttgagttcaaattgatgtttagggacaaggggtcaaggtatggagaggaaataaccatgtttcctaacccataaaacaagactggtgacacaggatgctgaaagcattcattatagttcataatactctttgaagttgaagacgctggcaagaacccaaaaaagccatcgagaaggactgtgagtgctgaaagggggtgaaaaatggggaaggctcaaatgatctttatgcttgatacactcattcccctcaccctcccttcctttaggaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggtcaggatgggaaaatgacaggaacaagggttaaagaccagcagagccctgagactgcttttttgcagttctgtccctcctgtcctttataggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctggtgtgtggatatctggggtcctttgagatggggaagtgacaggcttcagtgggagaaacaaattaaagtccttgtaacttctccccacagagcctgtttcagggcagtagtgatggagtggaggttcgatatgatttactggattgtcatatcagcatctgttctcctcaggtgagctctttagggctggggctgcacacccaaagagtagaactctgtgggtctgttattgtccccttagaaggccagggtatatttcttctccctgtttattttcattatttttacttttattttttgagacagagtctcgctctgttgcccaggctggagtgcagtggtgtgatcccagctcactgcagactctgcctcctaggttcaagtgattctcctgcctcagcctcctgagtagcagggattacaggcacaccaccatgcctggctaatttttgtatttttagtagagatggggtttcaccatgttggccaggctggtctcgaactcctggtctcaagtgatctacctgtctcagcctcccaaagtgctgggattacaggcatgagccaccacacctggccttattttcatttttatttatatatattttttgagacagggtctcgctctgtggcccaggctggagcacagtggcaccatgactgctcactgcagcctcagcctcccaggttcaagggaacctcctgcctcagcctcctgagtagatggaaccacaggcatgcactaccactaatttttgtatttttttgtagagacggggttttgccatgttgtccggcctggtcacgaactcctgagctcaagcaatctgaccacctcagccttccaaaatgctgggattacaggcatgagccaccagttttttttgttgttgttgttgttattgttgttttgagatggagcctcgctctgtcgcccaggctggagtgcagtggcatgatctcagcttactgcagcctccacctcctgggttccagtgattctcctgcctcagcctctcaagtagctgggactacaggtacgcaccaccacatccggctattttttgtatttttcagtagagatggggtttcaccatattggccaggctggtctctaactcctgacctcaggtgatcctcccgccttggcctcccaaagtgctgcaatcacaggtgtgagcctctgcacccagcattttttttttttttttttttttttttttgagtcggagtttcactcttgttgcccaggctggatgcaatggtgcgatctcagctcactgcaacctccacctcccaggttcaagcaattcccctgcctcagcctcccaaatagctgggattgcaggcatgtgccaccacacccagctaatttttgtatttttagtagagacgaggttttaccatgttggtcaggctggtctcgaactcccaacctcaggtgatctgcctgcctcggcctcccaaagtgctggcattacgggcatgagccactgcacctggccttttttttttttttagaatctattgtaaagcaaagatcttgtctccagtatcccactgggagtctctttggaattctggtccatgttcagctgtcatagggtttgctaggtctctgggggattatctgtgctcctagagaatagtacttaatcctggccaagcgtggtggctcacgcttgtaatcccagcactttgggaggccgaggtgagtggatcatgaggtcaggagttcaagaccagcctgaccaacacagtgaaatcccatctctactaaaaaataaaaatacaaaaattagctgggcgtggtggcggacgcttgtaatcccagctacttgggaggctgaggcacaagaatcactttaacccaggaggtggaggttgcagtgagccgagatcatgcaactgcactccagcctgggcaacagagctagacttgtctcaaaaaaaaaaaaaaaagaatagtacttaattctagcccactccacttcccttccacaggtggcacaactctttacagacaactttgactaccaaactcgagatgactttgtgcgaggtctcttagtgaatgaggaggtgagaaaagtcttccaatgcctctttaggagagaggagaaggctatgattgtatctcatgctggtaacttttgatcttttttgtattttattgaggcttaggagggaggaaaagcaggggacaggaggaacagtacacaaagaagaatctttgtggcagtgagaggcagaggggaacttaaaaggattagaaaagttgtacttgggggcattcttcctgtctttcttgcttaggtgacctccctttccttctcattcagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgagcacaggtggggaatcaagccaactatcctaggaacaggaacctgggggggccacgtctccagaaacacaagggatggctacacaagggacagtccctgggaataaggaactatagagcggctacctcaggaaaggaggaaacagggatttgaaaacagcgataccttaatttgtagcctgtgggcctctcattggatgactcttcacattccagggtaccctgtagtcacattcaggagcaagtagataattaacatgcagtaacaacatctatttagcacattacagtttacaaagggcttttatatacattgttacatttaatcttcataatttacaaataaacaggctcaacaagattttcttgcccaaggtcattggtaataatggtgggacctgaatctgggtattctgaatgtaagtccagtgttcttttgagtctaccataactgcctggttggcctcttggtatctcattttggttgcaggagtgtgatgcgtctaatagtactgcccctttccaagaacaacagtaaggctcagattctaggggctgagcgtggtggctcatgcttgtaatcctagcacactgggaagccatggtgggaggatcgcttgagcccaggagttcaagaccagcctgggcaacatagcgacaccccttctccacaaatgatacaaaaattagctgggcatgatggcgcgtgcctgtaatctcagctattcgggaggctgaggcaggaggattacctgagcccagaggtcgagggtgcagtgagtcatgatcatactactgcactccagcctgggtgatggaatgagaccgtgtctcaaaagaaaaaaaagacttggtttctaaaatgtaccagaagaggtggaattatttggttctgcttgtaggcgtggatatgattctaataaggttttttgagttcagagggtccccagaaatcctgaaggttctcgggttcttaagctctgtgtgtagtctataattgttgtaaacttggtgaagtatcttctcaggcctgggcttagggggtgagtgggtgtttctggtgacttgcgggatggggaatgagagctaggtgggagctgtgctggtgtcagtcagccctgtcctctatgaagggctctgctctgcggttggaaccctgagttacccagaggtcttcccatcctgagccaggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtgagacctgatctatactgtgcacaggccctgaattgcatggcagtcacactgagccagaaggggcattatttccacccataatcctgtctaaaaaagttgctctcattatcaggatgcacttttcctccacaccctaatggttctgtgttttttttccccttaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggtgtgagactcaacaggtgtggggcatctgtgtgtctcgctgcctcatagaagaaccagtgtttcctcctggagggattggtgcttccgccgggccctctctatagatcattgccttttccaggttacaatccagcagaagtaggagctgctggcaagggctacctctggaaagctgcaggcatgaacatggaggaagaggaggaactgcagcagaatctgtggggtgagctaggcctgatgcctgcccttctcctcctgaatcggaatattttgaaggataatgaatacttcagagtcacattacttattcactcctttattcaggcagacagggcaggtatattgctctctgtcaatgactctttttttctttttcctcacccattatggcttctcaggactcaagatcaacatggaagaagagagtgaaagtgaaagtgagcaaagtatggattctgaggagccggacagccggggaggctcccctcagatggatgacatcaaaggtgagtggcaggggagaaatgcgctggaccagtttattctctgcctggatcaactagccagaggcttacgttcctcagaaagggtttggtatcgagtcaagactagatgacttagagcattctgaatgatgttggcccatgaacttatccttgctttgatttcagtgttccagaatgaagttttaggaacactacagcggggcaaagaggagaacatttcttgtgacaatctcgtcctggaaatcaactctctcaagtaagagcagcccctccctgttctcctcggggtgatcccgggaaggtagaggctttctcgtaagtgttttgtctccaaataggaacctattccttcgacatcccaaatggaaagaccagtagtatttggagcaaggagagcattattaagttctagcctcagcatagactttctccttcctaaaccctccccttccatattgttccatccagattcctctccaatgtctatcaaagtcatagttctaagcctgctgaaaggccagtgaaggccctggtgtcaccccagtctccccacaggtatgcctataacataagtctaaaggaggtgatgcaggtactgagccacgtggtcctggagttccccctgcaacagatggattccccgcttgactcaagccgctactgtgccctgctgcttcctgtgagcaaagattggagctgagtacaagggattgggtacaggcaaaggaaatcaggagtagactgtcttgttatattgggtgtatgtcacttctggttcctttttccttgcctctggaagctggttgggctctagagcagccttggctggttcagaggggtcagattgagttcaatactgactggcctttgagactccaggatttcataccatcctaggcccacaaaggtatattcagaatggacctggacattcagactctatggcagcaatttgacccaacacaagatcagcctctggggtgggaataggtattttgaggcagcctatagcatctgatcccctttcaccttccctaaggaatctctttttcccaaaccctgtcaacaactcccaagtccctctgacataattccacagaacctgtatcatctcccttttgtccacccatgtcatcagtatggatttgcttggatgtccaggtataggtgaatgcttaggaatatactgcagctcccttctttcttccatagctgctaaaggcctggagccctgtttttaggaactacataaagcgcgcagccgaccatttggaagcgttagcagccattgaggacttcttcctagagcatgaagctcttggtatttccatggccaaggtgaatatgacctcaagccccattcttctgcacttgctttcaaacgagggttggtgacccccttgggagacataaaatagaagctaatgtgaatccagtatggaccatccactcccaatatgcttattgctagaatagtacagcttggagccggactaataaggtagccatctggggggtggtctggaaatgtgcaaagctctccccagcaatagttccagaagttagacctgccccaggagcagagcgaacagctcactcttgtccgttttggaggaggctactcagtgcatagagggatctgagggcctggtagagtatcctgctggactttccaaggcccctgaggtcccctttattggccttttgcaggtactgatggctttctaccagctggagatcctggctgaggaaacaattctgagctggttcagccaaagagatacaactgacaagggccagcagttgcgcaagaatcaacaggtgcgtcaggctgtcctcctctcgccaagatggttatctcattcccaggtcctggcccctagactctagggtggttggtttctggggctctggttgttagagctgtttatctgccgaggggagcaggagagttatgtgcacctcccccagccgatctctcctctgcttctttacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagagtggtgta

SEQ ID NO: 6279 - DNA, 41509 bp, Homo sapiens
cgatcgatctcctccggctccgacgtcctcggcctgccgggtcccgggtcctttgcggcgctagggtgggcgaacccagagcgacgctccgggacgatgtggggcagcgatcgcctggcgggtgctgggggaggcggggcggcagtgactgtggccttcaccaacgctcgcgactgcttcctccacctgccgcggcgtctcgtggcccagctgcatctgctgcaggtaacctgccggccccgagccacctgatcttcagcctggggtcggacgaggccgaagcctctcagggacgcggcgggacaccggctgccacccgggcgccgccgaagcgcgcagagatcagggtccctcgacggcagggcccttctgggtagtctctggatcccacaagtccagtgcagccctgggctcgtcttatcccaggtcttttcacttggtgaaactgaacctagaaacgtcctaatattctaccactgtttttataaatattccttattccaggctggaaaagctcctgagaagtggtttgtttttattattttaaaaggtgttttccttgccagccatttccagttaacctgcgctgctgccgtccgggccgcgagagcgggacgcagagttgttggcggagcccctgtcggttcccggggactaagcaccgcgtcccatgagcgggaaaggttaatacaatgatggttctgccctgcgtcgctgacgcggaacacagctgtagtgtgttaggaacacataacgtagttaagatcacttgaagctctgcgatcagtcgcccttctggacgttgtggttaggatgtttcacagttctaaccactggtggagatacagcgtccatattttcataattaaaaatagaggcacatggtctcacgagtttgagtgtacttatgggggcaaaaggacggcgtatttgaaatcctcataaatcctggatgcatggtacccaccagtggctaatctatgcaatgaatagagtttgcaataatttcaagcatcccttctttccacttgagttacttccccatacctaggggaagatatttttggtccactgaaaacatgagttcagcagaatcctcctatcatcgtcgttattattttttaccactaagtagacaatcttttggtttttgatgggctttatggctagagacaaatcagtcactgtcaccaagttccaggtagaagttggttcagtgctctgtcagcttcgatgggatttttcaacatgttttcaaatctgcacttaatagtaggaatgctttcttacagtaactctaatttgatcctaagatgtagttgttaccttacattcatcactgtttaagaatttagtggtcttgatctttgttttaaattttgagccttcgggaagtacttataagaattaattcatgcatatctttttgaaatgtaaatgtctttagccctggaacaaattgctgtttctgttcagcccatattagcagaataggtcaactttactttctaattatcaatgtaataagtttattactttatagattccataaatctatacatttattcctcgatgaattatataaatttatagaatttatgttttatagaaaatttggaaagcatggaaaattattaacaagaaaataagttacccataatcccagaacttagaggtgactaatgttgacagtttggatcaaatcttccagttttgtttctaatctttatttttaacataaatgaggtcctgtatacacacgtacagttttgtgtcctggtgtttttatttaatgttattatgagtgttttattttgttaaaaggtcatcattttaagttgttaattagtattctagcacaaatttgccataatttatttaattgtttactatgattgaccatttagattgtacttaatttttaggcattagaagtgataaactatattttaatcagacgttgaaaataacacatctttgtttagaaaacatcattttatttctggttgtctaggatagattcccagaattcttgggttagaggccatagataattatgaaagcagaaagattcacaagttgggagttaatacttgaattactttatttggggtgaagcattgagtgcataatacagatcatgcagtaatgggaagaagggttggaacaatggttttctggcctatgtcagacttaccttgaagcttttaagaatacagatgttctgatcaaccctcagacctattaaatcagacctaaaatcttagggaataggctttaggcatctctaattttaaaaaatttattcaggctacttggatgcacaaaagagttgagacctactgtcctagaatcatagaattttaatgacgatagagaccttaagcatctaggtcgtttctgtacttttacatgtaaggaaactggcattcctaggccagtaccattgccatgcagctaatttgccctcttgtctatagctcactctgcatcacccaacctaccgttctcactgtttcttctataaccaatctccttcccacttctgttctcttactcatgccattcttccctcagtcatttttcttccttccatacaaattccatgtctttaaaaaggaataatcctacctcctccacatagctttccaattctctgttgcccacatttgtctccctttcaatacttctctgttgtgttatgtgacacatcacatttgatatactctgtactgtgtttcaagtattgtattctcttgtttactcaagtcattatttcaggactgactacccagtagatgctttaagtcaggatttctcaaccttggcactgttgacattttgagctggataattttttgttttgggggctctcctgtacattttaagatgtttaacagcacccttggcctctatccagtagacgcctgtactgcctccccctatctgtgacaaccaaaaaggtcttcagacattgtcagatgtctactgaaggacaaaatcacctctggttgagaaccaccgcttcaactaagttatcttctctgtactcagaacttgatgtgattgcagcagggggagaggattcatatacacagtgaatgcaaacgaacctaaatcaccattcggatatggccacacaattttcatttcccttgtgttagcaagagataccctaggctttggacctgattattcctaaggcattctgatgtatggttttacctgcagatttcctggtaatactgatacctcagtttgggtcaaagaaggtcaattaattgattgatttgatttgactcctggaaaagacgctcctttctagctgtctctttcttctctttacctgaatagccagggctctgtggttcaagtgaagtattttgacataaaaattaacttagaacattggtctgcagagtttgctcaatataactgagcacatattgtggctttatggagctggttactactttttgaccaaataaataattagaagtatttttcctcctcaataaggttcatttttccttttttcagtgagctggtagagtttccttttttgatatttcagggcatctttcatatttccatctcttaagtttcttcatatgaagtagaatttatctggattatgtattgctgactctgatgaaaacccatagaaagcatctggggcttgatcaccttcattcttgtaatagctcacacggttacagctgatatggtaacttaagacttttgattccaaatctaggcaaaatacactcagttgaaagaatttgtcagccagaacagttggactgttctgtgaaaattgtgagaaaaattacacaactaagtgatacatgatgatggctttcttaaatataaaattgtaataacatggttaatttccagtacgttatattgtcccagaagtggctccaacattgtttgaaatttgtctcatttaaagaaacataagctggctatggtggctcacgcctgtaatcccagcactttgggaggctgaggcaggcagatcacctgaggtcaggagttcgagaccagcctggccaacatggtaaaaccccatctctactaaaaatacaaaaattagccgggcatttggtgggggcctgtaatcccagctacttgggaggctgaggcaggagaattgcttgaatctgggaggtggaggttgcagtgagccgagattgtgccactgccctccagcctgggtgacagagtgagtctccgtctcaagaaaaaaaaaaaaaaaagcaagaaacataaagactgggcatgttggctcatgcctgtaatcccagcactttgagagactgaggtgggaagatcacttgagcccaggaggttaaggctgcagtgagccgtgattttgccactgtactcgagcctgggcaacacagtgagatcctgtctcaggaaaaaaaaaattgcatgtaaatgaatgaatttgatatttaatattttaaattatgaaaactgttctgtagagatgtagatcttgccatgttgcccaggctggctttgaacttctgggctcaaacaatcctcctgtctcagtctcccaaagtataaagattacacatgtgagccactgcacctggcctaatatttttaacttaatgaatttattttgatataaataaattaataacactgaagcttcctgatataataagtctttttgtgtgtgtgacgggttctcactctgttgcccagactggagtgtaatggcactatcatggctcactgtagcctcaacctccctgactcaagtgatcctcccacctcggcttcctgagtagatgggaccacaggcgtatgccaccacacctggctgatttttaaaatttattattgatacatattaataaaattatttttattttaaaaatgatatatgtggctgggcatggtggctcatgcctgtaatcccgacagtttgggaggccgaggtgggaggatcacttgagaccaggagcttaagaccagcctaagcaacatagtgagatcccatctctatagaaaaaaaaaatggctaggtgtggtggtgtatgcctatattcccagctactcaggagactgaggtgagaggattgctagagcccaggagtttcaagttacagtgacctatgattgtgccagtgcactccagcctgggcaacagagcaaaatcctgtctcaaaaaaaaaaaaagttcgaaaatgcttatgatgcaatataagtagtggaaaaggatattaaattgtgcctatatgaacacaactatatgaaaaacttgcacatagagaaaaggattaacaagaaatagaccaaattgttcacatggttgtcttgtttgtggagagaatatcagtagttcatttgtttccttccaagtttatatgttttccgaggtctctataatgagtttgtaattgtttaatcatagaaaacccttttttggtccttggccacaaacttacatgttttaatgtaattgcttttttaatgagaataaatgttatattttgcttttttaaaacctatattcccatagttatatgagcccttacaattattaagaggctgcataatataacgtttctggaagggtacagaagaaacagcagtaattacctctgagaacagagacatggcttcacattttacccttttgtacgttttgtgcttttgccacatgcatttattattcttccaataaataagtaaataaatatggattgtatactccatctggttggtgtttcataattctaaaattatattgctacatttttaaagatgatatgtgtttctacttattaacgtatatgttaaaatagtaaatttatatcttatttaataatttccctattgatagacatttaagacagtctcaagtgttcactatcatagaaaatactgcacagatagcttttgctatagtttcttttttctttgaatcgttaattgggaataaatgctcaaatagttatatgtggctcaactgctatttaagtttattgactgactgctgccattttgaattctgaaggggttgattaaatttataatgctgccataagaatataagggtattggcttcattagcatccaccagcattgggtgttggaaatgattatagatttttaaatgctacaacaaatgtagataacagagaactatctatagaactctttttggacatgtgaattgtaataatagtttattttcatgtgaatccagaaaaatgtatacgaaaaccttttttcctctcatttcttatatgaatagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtaagcacatgtgatggcaataactttcttctaatatcacataatatagcaatagaaataaaattaaaagtttagattttttgttaaaggaggtgagatgtcacctaatttgtatgctattatgtaactagtctaggatattgaagctgactatactctgtttttaggtcattatcttgtagtttaccatactccctacttgcttcttattctactatttaactcattttccacatcccctaattttggtttcatgaaattatttttccttctgaattactaggttctacttactattattaaactttatttctgacatattttataaccttccatggtctcacttgattaaaaataaaaaattcagctgggtgcggtggctcacacctataatcccagcactttgggaggccaaggtgggcggataatttgaggtcaggagttggagaccagcctgcccaacgtggtgaaaccccccctctctactaaaaattcaaaaattagctgggcatggtggcaggtgcctgtaatcccagctactcaggaggctgaggcaggagaattgcttgaacctgggaggtggaggttgcagtgagctgagattgcactgctgcacttcagctgggtgacaagagcgaaacaatgtcttgaaaaaaaataaaaaataaaaaattctacaacacagggttattatttttccatttttgttttcccttatgagtttaatatgtttagattataaacctgaaagcttgaatacctatgtctatcttttgttttcttatgtttatcaagttattcctttaaacattttctaaactgtaagaataatgtgaggctgggctcaatggcttatgcctgtaatcccagtgctttgggaggccaaggtgggaggaccacttgaggccacgagttcaagattagcctggctaggcaacatagcaagaccctatctctataaaaaaattaaaaaaattagctgggcatggtagcaaatgcttgtagtcccagctactcagcagactgaggtaggaggaatgcttgagaccaggaatttgagtgacctatgattatgcactccagcccgggcaatagcaagaccctatctcttaaaagaagaagatgtagtaataatacatattcattataactattttaccattgaaagtaaaaaatgagtttttaccttttcccagtcccatcctcagaatggggatctcagtagacctttaggattggaagaatgagatcattcatattttctgcaattattaccccacaaaatatttcagatacctttccatgtattacaaacaatgtgcatttaacatgtctctctctttctctctctctctgtgtgcgtcttcatgatcctctgttgcagccctgccagtaagacactatctcctgaagaatcactgataggaacagaaagtggactggctaggccaggagtccttagcttcttagggggcaggagctgctttgtgctttctcagaatcagatatatatgtggactgaaacatttaaaaacagaatagccaagggtgctatacgtttaaaacttatatagatggggctacattgctctctattactaatttcccatgacaatacacgagagtgccatgtctttttaacttgttttgagcacagactaatcttgtttatgcatgttttttgatgagaataggctactcatgagaaatctgtaaacctaacactagtcccttgcatactctaaattgttgctagaatcttaaaattttagcaccagacggaccttagaaatcattaactttggtgctttgttctacaatacaaggagatggaatattttacccaggattgcttagcaggttacagttctgccctctgagtacccagcacttccctgtgggcaacatcaacttcctgattttcaagtcttaattagtactctgaagaatcctacttgtttttaactcccatttgctttgaagtgactttacctgatttttttagatcccttattgcagcaatgccactaagaaactgagtctctagcttcttggtgggcaggagctgctttgtgcttgctcagaatcatccttttcagtaagggagatattgaagagaaatctactgaggagtctgggggtgaggcactcagggaaatcctgctccagtccacaaaagcagagaggaagggttggttacctagagtatttaacatgcagaggctttggattttactcctttaatccttggaaatgcctatggaaggggaaaggaagtaagatggtgactccagcttatagacatactagtgttacatatatttaaactataataggagggtattattagttttacttaactttcaactgtgaaggattatacttctcaatatttgtctccagtgtctatttcagtgtatttttcacttttcttgaagcagcatgtctgttgcaaaacttctagaaataatgagaatatttatatattagatcaagccataacttgatgatatagtcatttcttcttatattttttacttacatttttacattttaatgattactttcatttttgaaaaacatgtcatgctgagatgtatttttcttcattctgtaattagttatgaaacagtttttcctaaaatgctgagtatatcaagtcttggctaagaataagtaataaatatttgccacatgaaagactacacatatagccaggtgcagtggcttgcacctgttttcccagctacccaggaggctgaggcaggaggattgcttgagcccagggtttccaggctgcagtgaactatgattgtaccactctactccagaatgggtgacagagccaggccccatctctcaaaacagaaaagaaagattacatagactacatatacacccccatccaaaacatacacacacatctacttaacctaaaatggtaagaagataacttcttattttctaatatatgacacagaaaagtttttttaaagtagttttaaatttttaattttttctaggtatttctcaagccatgttcccatgtggtatcttgtcaacaagttgaggtggaacccctctcagcagatgattgggagatactggtaaagaaaaccaaataagaactatctcatttaaggttaaattacttcacaatatcaatgtctttagctttctctaagctttattatatattctgagttggttttgaattataagaatgaattggggccaggcacagtagctcatgcctatagtcccagcactttgggaggccaaggcaggtggattgcttgagtccaggagttcaagaccaggctgggcaacatggtgaaaccccgtatctactaaaaatacaaaaattagccaggcatggtagtgcatgccattagtcccagtcacttgggaggctgaggcaggagaatcgcttgagcccgtaaagtcaaggctgcagtgagtcaggatcttgccattgtactccagtctggaaaacagagtgagaccttgtctcaaataaaaaaagaatgaattgatagagatctaatgtacaacctgacaactataggtaataaaattgtattggggattcatgttaaatgagtagattttaactactcttaccacaaaaacacaaaagtgggtaactgtgagatgatgtatatgttaatttacttcactatagtaaccattatactatctatatgtagctcataacaccatgtcgtgtatattaaatatgcacattaaaatttgttttttaaaaaaagaattgagattttttttaactagatatggagtggacaaaatgtaaagtgaattgatcttttcgtctgttggttctaggagctgcatgctgtttcccttgaacaacatcttctagatcaaattcgaatagtttttccaaaagccatttttcctgtttgggttgatcaacaaacgtacatatttatccaaattggtaggtgctattgtaatatttgctgtcatattctacactatagcattgagtccaaagtagaaatgaatgtgcactaatgagctttattttctacacagttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctgggttagtataaattttataacttgggagaaattttatgtggcttaaacatccccaaattatgaattagaatagtatttcatatataaattgaaaatcaattaaaaagaaacacagtgcctaaaggcacttgggggacacatttacgctttgcagtaaagtccttgtttggataaagattgtatgttttctggccaagtaagcttgaataggtacaagcttagataggttcaggccagagaggtcaaaattacttgcctgagattgcatagctagtgttacaactaggattcaaacccaggcagattgacttgggggttcatcaggatggagtgccctacaaagcctcccatctttaatgcttgcagatttgttccccagttaccgaaagcaacttgttaatattagggaaaagggccagtgtagggagagatccatggcatgaggtaaccttcctgctgcatgtggtggcacctggattggaatgcatccaggagctgcttaccctgccggtgtctgctctttaatttgtgtataacggagaggaagtagacagggcaactagtgctccagcccctcatcctggccacaaatattaatgctacctttatatgacataagtcactagtccatttattggaacctaaatttgaaccactgtaaagtaagacttcatagtgataaagagaggaacttgttaggaaagagaataaaatagaaagagaaggttgtctccttttgtagattttttttttttctccaacagttttacctgtgacctttatacaaataactgacaaagcattaatctctttggcctacatcattttcttttctattttttttttccacaagatggagtttcactcttcttgcccaagctggagtgcagtggcatgatctggctcactgcaacctccgcctcccacgttcaagtggttctcctgcctcagcctcctgagtagctgggactacaggcatgcaccaccacgcctggctaattttttgtatttttagtagaaactgggtttcaccatgttagccagcctggtctggaactcctgacctcaggtgatctgcctgcctcggcctcccaaagtgctgggattacaggcatgagccactgctcctggccggcctacatcattttctaaagctccagaccattcttttcttttcttttcttttcttttcttttcttttcttttcttttcttttcttttttctcttctcttctcttctcttctcttctcttctcttctcttctcttttcttttctttttttgagttagaagcttgctttgttgcccaggctggagtgcagtggcaccacctccactcactacaacctccacctcccaggttcaaatgattctcctgcctcagccttcagagtagctgggactacaagtgtgcgccaccactcctggctaatttttgtatttttagtagggacgaggtttcaccatgttggccaggctagtcttgaactcctggtctcaagtgatccgcctgcctcagtctcccaaggtgctgggattacaggcgtgagccactgtgcctggcctcagatcattattttctgttagctttaaactgtccgttcaggagatcccactgcatcctcaaattcaaaatatctaacactgagcttatgatttagctggttctgtcattagatgggaatatccttttatttccttgaaattatatggtgagaacagggagaagtgctgatggtaaagtcctgtgattaagatagcaataaggactccgcccttcccactccactgaaggttgaagagccatggacaatgagaagtcacagtaggtgaaatcaggtactaaaatggacttggcttgagagatcaaaattgatcacttggtgatacaactaacaaattcatgttaacttgaacctttattaccctgtgaagcatggtgattaaaaaaaaacaacaaacaaacaggaaacttgattgttaaattctctttaagtcagaatatgtaccttagagtttttatttatgcttttgtctaccattaatatgtctgcacctgctctttagaagttaatagagagtaaagtcgtctttatgtctttcagtgcttacttatatttgggaagttgagaaaaatttttaacatcattattgatatatatatatatatatatatatatatatatatatatatatatatatatatatagataatttttttttttttcttgagacggagtctcactctgtcgcccaggccggagtgtggtggcgatctccactcaatgcaagctctgcctcccaggttcaagcgattctcttgcctcagcctcccgagtagctaggatacaggctcccaccaccacgcctggctaatttttgtagttttagtagagacgaggtttcaccatattggccacgctggtctcaaactcctgaccttgtgatccgcccacctcggcctcccaaagtgctgggattacaggcgtgagccactgcgcccggctgaggtaaaatttaaagtgtacaattcagtcatttttagtatatttatactagttgtacagccatcaccacaatctaagtttagaacattttcattagggggtgggagaaattttactctgctttttagattaagtttctgtctggatctaatcatttaatcagacaatcaggcagattgtctgtgattagttttggccattccagcttcttcattggttgttaactttcacaaataaaggctgctcaaagattagaaataacatttaatttgaatgtaaatgtgccatagtttaaaagatgggtttggtgaatacagtcaaatacatacatttaaagctctaattctgaagattatgtaaagaaaaggaaagaaatgtagggagaggattgaaatgttcatggtataacaatatctgaacatccatctggtcacaccgttggtatttgaatgttttgtcctcctcaaattcatatgtcgaaatcccaactcccaaggtgatcgtattaggaggtgtggtctttgggaagtgattaggtcatgaaggtgaagccttcatgaatgggattcgtgctcttataaaagagaactgtgagaaataagtttctgtcgtttgttagccacccagtttaggatattttgatatagcagcctgcatggactgagacaactatgagttattatgatagcttctgttatttcacctaaattcatagaagctaatatatcaatatttatgctatgaaatatttcttaaccaagctttgaatatatttatatttttgtttatttttaaatttcagattccagatgacctgaggaagagactaaatatagaaatgcatgccgtagtcaggataactccagtggaagttacccctaaaattccaagatctctaaagttacaacctagagagaatttagtgagttcaaatatatatgttacatcaaaattcttttacacgttttgtaagatttctagttgctttagctaagtaataagaatgttgtattcctttttgatacaaatctttttttattgtgttaaactatatataacataaaatatgccatgttcgccatttttaagtgtataattcaaaggcattaattacattcataatattgtacaaccatcaccactatctatatccagaacttttccatcaccccaaagagaaacttggtacccattaaacaataattccccgtccactcctttccccagtccctggtaatctctaatgtatattgtgtctctatgaatttacttattctagatatttcatatataagtagaagtatgcatttgtcttatgtatctgacttatttcatttaacataatgttttcaaggctcatctgtgttgtatgtatcagaatgttattccttttcatggctgaatactattccattgactgcatataccacatttgtttatccattcatctgttgatggacacttgggttgtttccacatttttggctgctgtgaataatgctacagtgaacattggtgtacaagtatctgtttgagttcctcttttcagctcctttgggatatacctaggaattatgtttaactttttgagaagctgagaaatctttaataaatgataacacaaatacttatatttgccaatgcaaatatgaatatttttggcttttaagagattgatcattttgccacgtggttgtaattaaaaaaaattgtcccatgttgtttcagtattaatattgtagcctaaaagagtgctagactgttttactttttactcagttaattctttggatactggtagagtcaggaaatgagatattgaacttaaagatctttgcaggtggggtccagtggctcacacctgtaatcctagcactttgggaagctgaggtgggaggattgcttgaggccaagagtttgagaatagcctgggcaacatagcaagaccccatctctacaaaaaaattaaaaaaaaaattaagccaggcgtggtagctcacgcctgttatcccaacacttcgggaggctgagatgggtggatcacttgaggtcaggagttggagaccagcctggccaacatggtgaaaccccatctctactaaaaataccaaaattatcggggcgtggtgctaatcctgtaatctcagctactcaggaggctgaggcaggagaaccacttgaactgaggaggtggaagttgcagtgagcctagatctcaccactgcactccagcctgggtaacagagcgagactctatttcaaaaaaagtaaaaataaaaattagacacatgtggtggcacatgcctgtagtcctagctactcaggaggctgactgaagtgggaggatctcttgagcccaggagttccacactgcagtgagctatgattgtgccactgcactccagcctaggcaatatctcaaaaaaaatttttttaaatagattattaggccagacgtggtggctcatgccagtaatcccagcactttggaaggccaaggcaggcggatcacctgaggccaggagtttgagaccagcctggccaacatggtgaaaccccatgtctaccaaaaatacaaaaattagctgcaatgtctataatcccagctacttgggagcctgaggcaagcgaatcgcttgaacccgggaggcagaggttgcagtgagtggagactgcgccactgcactccagcctgggcgatacagcgagattctgtctcaaagaaaaaggaatttgttttcctgtctttatcgtagagggaggaaagggagaatggggttggaatggttattgagtgagccacattatggtagatgtatcactgggcatagagaaaaggagcatttaaaacttttccgcctaacagatgtttcttcaggctacactgcactcattgtgctaactgtaatgtcaaatcccagacctgtgcctatagaacatgaacatccttcattggatttgtttggtcaggcttacactttattaggaagatcagatgttaaaataagggtgttaaagttaagttcagatatgaggataattcattactattcctttttctggcagcctaaagacataagtgaagaagacataaaaactgtattttattcatggctacagcagtctactaccaccatgcttcctttggtaatatcagaggaagaatttattaagctggaaactaaagatggtgagtacatttgttattttgacttttttttctatttaaatagttgtacatttttaattgttcttgcaacctgtcatacctgtgaacagtatgtgaatagtgaaatataattatgataattaaacagtagtttttatgtattgaaaaatatctttggccgggtgcagtggctcatgcctgtaatcccagcactttgggaggccgaggcaggcggatcacttgaggccaggagttcgagagcagcctgccaacatggcgcaaccctatctatacaaaaaaatacaaaaattagcctgacatagtggtgtatgcctgtagtcccagctacttgggaggctgaggcagaaggatcacttgagcccaggaggtctgtgttcctgccactgcactccagcctgggcagcagagtgagaccctgttggggggaaaaaaaaaaaagtctttaacttaaataaatttgacatttaaaatcttaaattatttcatctctgtttcagtactaactctgcatttattactttctttttaataggactgaaggaattttctctgagtatagttcattcttgggaaaaagaaaaagataaaaatatttttctgttgagtcccaatttgctgcagaagactacaatacaagtaatagcatgttattgaatatttaataaaatactatttgttacatatgattgataataaagtatgaagttccttgtaacaccttgcattgtgaagtgtattaaaaacctgctaagagtaaggaataacttgatttaaaatattttattctgtaatctctttaaattatctgtacaaattattgacttaacctaaatttaaaaatgaatgccttagcacaattaagttccaagaatagagttgatcatgttaactggtaaatggatcatgatttaaaattcttctaggattgaaacaaatgaaaacgtagttttaagggtttgattttttaaattcctatttttacatgcaattttactgcacaacccatcttattttgacagttcttaaattcgcaactcttcagaaatattatcagatcacttttctttgcttccataagtttttttattattatattattattttttttttttaaaagacggtgtctcactttgtcgcccaggctggagtgcagtggcatgatcatggctcactgcagcctcgacctcccaggctcaggtgattctcccacctcagcctcccaagtagctgggaccacaggcgaatgccatgatgcctggctaatttttgtatgttttgtagagatagggtttcaccatgttgcccagaattgtcttgaactcctgggttcaagcagttgttctgccttgcccacccaaagttgtgggattacaagtgtgagccactgcgcccagctattctagaagtattttaagagtcatcttttttttttttttgagatggagtctcactctgtcacccaggctggagtgcagtggcacactctcggctcactgcaacctccacctcctgggttcaagtgattctcctgcctcagcttccctagtagctaggattacaggcgcatgccaccatgccctgctattttttgtagttttagtagagacgagatttcaccatgttggccaggctgctcttgaactcctgacctcaagtgatctgccctcctcagcctcccaaagtgctgggattctaagtgtaaaccaccacacccagccaagagtggtctttttacaatattattttttgattaggacattcattcttgtcataaaattgaagatactctagtcatttagaatttcattgttttggaactagacattgtttctttatttttgaaatgttattgaaggaataccatttggagaagatacaaatgtaagaattgtgaaaaggataattgtgacacaaatcaaaattatagataaaaatatacctgtaaaatgtattaaggcaataacattctttctgcttgttgaccataaatatttatattccctggatgggtacattgttattgtcaagggtgtttaaataatgatcttgcatgcataatttattctctctggtataacagaatcagcaatttagttttctgggacccgagaaaaacatgcaaaagacatactttgaaatgtaaaactgatttttccttgcaactgtaggtccttctagatcctatggtaaaagaagaaaacagtgaggaaattgactttattcttccttttttaaagctgagctctttggggtaagaagttatggccaaactagcatgttagacatgtttttaacactatatctggcagagttttcaatgtaaatattaaagtagatgttaatgtcaataagtgatcttaataatgcatcagtagatattttttcaaggattgtctctatcttcacgcctagcttataatttgccttgtcgtctttttttttttctctttatttttatgtttttatccatccctggtggtaggggataaccttgtcttcttcgataacaagaagtctgaagcttattagaaattttactttgagaattgatcgatgagaagaaagcaactagatatcacgtggatcatatatgcttgaataaaacaataattcttagaacaaataaatacattttaaaagttaaagccaaaaacattagttgaatgtttaaaaatatttcaaattaagttattccttcactgtcttgtattactgtaataatttggattatttgtgtttttctcaacttttaaaacaaatatttaaaaaattcctcttttgattaagtagggctagataaaatataaaaaatattttttaaactcctcttaatttccatatttcttatataatatgagaatctcttataaacactacctcttagaagtctccacagaagctttggtagatgtagtagtagggatttgatttcttagaatggtataatctgtaaatgttttagtaaaaggattaaacgataaagtcaaaatgtttatagcacagtgtttattaatataaaataaaatctctttttttttttttgagatggactctcactttgtcactcaggctggagtgcagtgttgcaatctcagctcattgcaacctccgcctcctgggttcaagcaatccttccgcatcagcctcctaagtagctgggattacaagcatgcaccaccacacctgcctaattttttgtatttttagtagagatggggtttcaccatgttggccaggctggtctcaagtgatccgcctgcctcagcctcccaaagtgctgggattacaggcgtgaaccactgtgcccagcataaagtaaaatctcttcagactctcatgtgatcatgtaaagtggcaggcagtcacagtcaagaagtagtttaaagttcatgtttgtaaaatataatctacagattgatactggatttcataggtaatgtttaagagaaaataagtttttagttatcctcagtacttcaaaagcacccatttatgattatgttgattactaaactaaatcatttgggggctagaggtgtttttttatgtgttaagattccttaaggagttctattagggcaaaacttttagtaactgcatattttaaaagtaataaaactaattttaaaagcttggaggctgggcgcggtggctcacacctgtaattccagcactttgggaggccaaggcgggtggatcacttgaggtcaggagtttgagacgagcctgagcaacatggtgaaaccttgtctctactaaaaatacagaaattagccaggtgtggtggtgggcacctgtaatcccagctactcgggaggctaaggcaggagaattgctcgaacttgggaggcagaggttgcagtgagccgagatcatgccactgcactccagcctgggtgacagagcaagactccgtctcaaaaaaaaaaaaaaaaaaaagcttgaagtcagattcgacattaatcagtatactttctctcaagtaggggacaatttctaagattttagtcttttaaaatttattaactagtctgagcatggtggcttgtgtctataatcccagcactttgtggggccgaggcagatggatcacttgagcccaggagttggagactagcctgggcaacatggcaaaaccccgtctctacaacaaatgcacacacaaaaaacccaatcagctgggtgtggtgttacactcctgaagtcccagctactcgggaggctgaggcaggaggatcacctttgccagggcgtttgaggctgcagggagctgggttcacaccactgcgctccagcctggatgacacagcaagcccctttctcaaaaaaaaaaagataaaaaattaaattaaattaattaactacactgggaaggcaaaattcagcatttttttatagctaaattttatcctgcttcagtcttttatcatgtaactatgtatattttttacagaggagtgaattccttaggcgtatcctccttggagcacatcactcacagcctcctgggacgccctttgtctcggcagctgatgtctcttgttgcaggacttaggaatggagctcttttactcacaggaggaaaggtaagtggttaaggtgtgttcatttttctgtaacatttaataacttttcatttatctttctttgggttttgaccatctattatatagggtgggttttgaccatctattatatagggtttatacgacatatggaaagcattcatttattcactaatatttctgtgtgtctgcttttaggtgttgggggagtgatgacgaataagactgatgttctccatgccctttttctgtgtcagttgatacaattatatggtttttcttttttaggctattaggtgttgatagggttgagtaacttacaaatgttgaaccagccttgcatacctgtgataaataccacgtagttgtggtgtatcattctttctacattgctgagttttatctgctaatgttctgttgagcttttgtccatttaagtttgaaagtgattagtttgcagttttctgtttttgtgttgtctttgtctggttttgctatccgtgtaaatctggcctcataaaatgagatgggaagtattctctcctcttcttttgtttttttggaagaggttgtataaaattgaggctgaatcttggtggttgccacaatgacaggaactatttctgtgactgaatatattgggaattcctataaagcaattattttctagggaagtggaaaatcaactttagccaaagcaatctgtaaagaagcatttgacaaactggatgcccatgtggagagagttgactgtaaagctttacgaggtatgagtatggtaacactctatataaatccctttttcattagaaagacaggaatgttatacataatgctgtcaatctaataaatacacatatcatctagtctttaacttttctgtttatcatttagtcattaaaatttctttggctttctaatgtttttgataaaatttctaaaactctccatatttaatggaggcctatttttttttctagccagaactttttgtagactacatttctggaagtgctcactgacaccactctgaaaaattagtacttagaatatactctaattggtataaatgatctctgaattgctatggaaaactgggagaatggttgcttcaggggagagaaagtaggaggctgtggacagcaatgaggagaattacagttcaccatataacacttttgtacttttaaagtccttaacatttacattattatctattcaattaaaaaatattgggaagattttactttgaacagttaatttttcccccatgggtaccgctgtcatatagttccaactaatcatgaacttgtgtatttcctgttctttgtaaatttaaactttgtaactcaccaggaagtttgaagccaaatttgtgtttcaaatatagcaactccaggatctctaggcagatgcatttgcatttgattttaaatgaatcttgatcccttactctcacttatgttttcccacatcctactttttttattttgttgtaagccatctaaaattctcaatgggatgaaactgggtataaatgaatacatgcatacaggaattatagtagcatattccttttcttttttctttttttttttttttgagacagagtcttgctctgtagcccaggctggagtgcagtggtgcgatctcggctcactatagcctccacctcccaggttcaagcaattctcgtgcctcaacctcccgagtaattgggactacaggtgcatgccaccacacctggctaatttttgtattttttagtagagatggggtttcaccatgttggccaggctgatctcaaactcctgacctcaaagtgatctgcctgccttggtttcccaaagtgctgggattactagcataagccactgcacctggcctccttttctgagttttataaaatttgatactttactgcacgctttgagactgtattaattgaaccatgttgatgaacaagtttttgtgatgggtatattaataaaatatagatcaaatttttatagttaaatcaatatcgagcttttctagtgctttcaaaaggacaacctgaattttcccagcactgaaatgatactgaaaccatttcatatcttctgtattaaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatggtaaatgcatccaccactggcttaaggtcttgttcttttgtcagtcagcatttttagtcttaacaataaatctactctcttcagagaataatatatgtgttatgttaagtgttgtgtttgaggcccctgatggcattctacagttgtcctatagactgtaatagcaaaattggtagagtaaaaacagtgtgaaaattctgcaacttcatggttagtcctttagggtttttcattctcccttacttattgtttaatttacagatttactcttttgttcatttgacaaatatttgtcaaatgcttgtgcacagtctgtattctcaaattctaggagaaaaagaagggtgaacagtattagcgcagaacgatactaataatgatggctactgtgtatgagtagccagccctttcttggctttcttggattgctttgtattctacatgaagatattccctgggctttacaggtcaataaatggaaattcagagagattaatttgaccagggtgaccaacaaggagatgacagcatacactatgcgagaagtatacacagagtagtgtaggagcatataacctaaactgggggtgaggtgggataaggagttatcagggaaggctttttggaggagttgacaactgagccgagttttgatggaagagtagaaattagcatgaaccaatttcatgctaataaagaagcaaaggaagcgtggtctacaggcaaaagcacagaggtacaggaagtaatgatatgttggggaataccctgttgactggagcttagagtgcaaggagaggagtgctagggaggtgaggttggagggtttggcagcattgacttgcttcaaggttcttaagagctgaaatagatataaaatgcaactaagagtggcttggattattattacctagtgtgttaatctcaaattttgaaatctatagcatctataggactggtgttactaatcttacactcgatctgttactgttcttatactagatctattagtccagtgtttaagggagtggtgcagatttctaggtcaggacaggactcagatgtacattattaatgcctatttcagttctgaccttctcatatgaaaccttataagacctggggtaggaagagattgttctggaagtcataggaatatgaactgtattttgtttaacaaacaatacagtatggaaatttatcacccttccagaatatttatttcagagacaaatttttatcattcgttcatttatttcataagatccacgagtagggaacctcactagacattgctctgagtatatggtctgagtttgcagtacctcttgtgtctccattagatttattaggtcctcaatagataaatcagggaataactagatggattcattttttaaagacatgaaagagcgataccatacatactgcaccttaaaggtcaaccttagagtatcattatttttaatgaatgtataatttttaaatttcatgtttacttttcctaagcttttgcactatattgcttaattccagctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggtaatacactacttgtaaggattattgaattatgtcccttttatagaaattatttttcaattttattagtaattcgtggctttaaatttatgcttctcttaatgattttaaggatatgtaagtcaacatttggtgcatattgtgctagaggcataaattataatttatagccacctgaaatgttagtatgcgctttccaagaaaatgacttttttgaaaatggtatttctttgaatgagaaagaacagagagaaatagatagatggcttttaaacacttcattaattaaactttttttttccaccatcacataatggcacttagtcccctttgggaactcatgagggttttagtggtagtgagctgaaagaaatatgttccaggactggcaaacatattctaaattctttaaaattttcacctagcatctaccctaaatattcagaccctgtgctagttaactgctattgaagaacaaaggtattatatctattattaaggataatagaatggtatttgagatattggtcattgaatatgaatatgttttgagaaataagttttataggaaccaaaaaaaaattcttaaaggaaccatatattactaaaaatgcttcttattggagaaagaaatgacaatcatttattaatgtgattttttcacaactttattaagatataatttaagtacaacaaactcacataaagtgtacaatttgatcagttttaacatatgtagatgccatgaaaccatcaccacaattaaggaaacaaacattttcatcactccagaagtctcctagcccttttactacccattcctcccctgctccatccccagacaactaccaatttgctttctgtcactatagatttgtcaacctgattttctccaaatatacattcaaaaatatacagttgaatacaattggaaattcgaattttgtgtttttttctttaggaacaaagatgtgaaattctgtgtaatgtaataaaaaataaattggactgtgatataaacaagttcaccgatcttgacctgcagcatgtagctaaagaaactggcgggtttgtggctagagattttacagtacttgtggatcgagccatacattctcgactctctcgtcagagtatatccaccagagaaagtatgttttactattaaaacctgaacttggaatcttctttctattgtggagaaatgtaattgtagtaagacaagaattaaatatattccattgtagtatttgaataagcagttatttgagtagaaaattagtgtttccagctaagatgatggcatattttgaaaattcatatagtgaatataactagtaaaagaagttttgtttatttttaaacagaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaaggtatgtttaaaaaaagaaaaagtgaatacttactcccagaagaaccactgtattattggctttggctttatgtgtcagcttgcccaatctccgtgtgagtcaacaagtgtttactgagttaccaaataaatgtcttaacactattttaggtactttaacaaattttaattttattaattaattttttattagaattgagacctcactctgtcatctaggctggagtacactcacagctcactgcaacctcaaactcctgggctcaagcaatcctcctgcctcagcctccccagtagctagaactacaggcatgaaccaccatgcccggccaactctttaattttcttagagacggagtcttgctatgttgcccaggcagacagattttaatgtgtatgatgcagtctttgatgataagaaacttataatggaaagctgaggtgatagttacagtaaatacattttgatgtataattctgtttgctttaatcattcaaattgtagtaaagcaagatgaactgtctgctgggatttgagcagaaatggataggaataaactaggaggtagaagagttatcaaggttcacaggactgatgggtgaagctagatttccagacccgggatgtcagtccttgaaaagcagacttggcaggcatagacgaggcagatagcaggataaaggagacaaatgtagattgttcttcagaagatcagatggtagagtctaggaggtagtgtgttttaatcagagatctgagaggcaaagatcattgcatgagatcagggacccatgcaaaggagtgagaaaaaaaactgggttaaggagcctgctgcatggcaactcctgggaacagtggccactggggcctgggacatgttgattgcagcccaggactgttaaaaccagtgtgagagaacatgggtatggaagtactagctagcaggatcatgaccccgatgctgggatggggcatcaagcattagtacatggagattcagtacatccagatgcagtacatggagactatatgcgtaactgctgactttgggcttctttcagattggagcagaggtagaggtgagtgggaatattctcaatagagggaactaaataggcatacctaataaaggagaccaggatattgcagacagtagcctcatgtttggctcacctgttcaaaaagttctcttgttcttgagcagtggtgccttaaaaggtaacttgagaagcagtcgattatttgttcagcctggagactcttgggatattttactatctttgattgaatagatttaaatgtacacagctctcataacttgccccatgaagcatatccatgaaaggcactatacttgttaaaagattggtttgtactttttaaatgtagtacttttaataaaacaggaaaaatagaagttctgatgcagttatatgcattttatatagaatgtgttcttaattggaaaaaatttgtcgtagttcctttgagttcatttacagtttttagtaggaattgtattttctactgttgtacttgctgttactaaagaaagatggtcgtgattaccatctgaattttttttctatacattgatctttagctgctacttagtcatttctgtttagacttgagctctttttcatattttttttttttgtttctcagtatccagaattatttgcaaacttgcccatacgacaaagaacaggaatactgttgtatggtccgcctggaacaggaaaaaccttactagctggggtaattgcacgagagagtagaatgaattttataagtgtcaaggtatgttgtctacttatcttctttttttatttaggtaaaattaacataaatgcagttagccatttcaaagtgtaaattcactggcatttagtgcattcacaatgctatgcaaccaccacctctctctaatttcaaaactttttcattccactcctcctcttgcttatcccctggcaaccattcatctgctttttgtctctatggatttgccttttctgtatatttcatataaaacaaatcatgcaatatgtgaccttttttgtctggcttctttcacttatgtaatgttttcatggttcatccaggtagtagcatgtatcagtacttcattcctttgcatgactgaataatgttaccatactttgtttatccacttatcagtggtgaacatttgaattgtttctaccttttgactattatgaataatgttgctgtaaatattcatgcacaaatttctccacggatatgttttcatttctcttgggtataaactgaggagtagaattcttgggtcttagggtaattctctaacttttcaaagaaccaccaaactgtctttcacaccaactgcaccattcccactagcagtgtggggggttcctgattctccacatctttaccaacaccattatgtttctcaattgtgggctagtctcacatttggaaagctagtgggagcagcgatccatctattaaaagttgtatgaaattgagtaatgagccacctctctcttgtagggcttattatgttcttgcttaaggcaatcttcatgcattgtgaacagaattatacataaatgctcagataaaagggcaaaccattcttaaagggagtagacaactagaggcaggagaccatactgaggcaggaagctggggtttttatggttctgttacttttgactatatctcaccattgcttttgtcaaagtgagactaggtctaagtttttttcaggtataaggtgagtgtggtaattaaggggcatgctagcagatcattttgggtaatgcttcacagtccaccactggtgtgtcattgtggtcgcagatccagtatcttagctgtgtaatttcagacatcagcaatattagtttaacaaagggcaattagattccaagacaaaggaatcgtgtattattctagccttattcaaacttgatttataaatcagtttagtaatttatttatttgtttctgtatttatttttatttctttgagatggagtctcactctattggccaggctggagtgtagtgatgcaatcttggcttactgcaacctctgcctcctgggttcaagctattctcctgcctcagcctcccgagtagctgggattacaggctaatttttgtatttttagtagagatggggtttcaccatgttggccaggctggtcttgaactcctgacctcgagtgatctgcccgccttggcctcccaaagttctgggattacagacgtgagctaccgtgcccagctcagtttagtaatgtataactgggttttacccagttgtaaattactcttttgtcgtgtttttttgagaactggcaatgacggagaaactaaaagtgccaggctgttgccttgttcctgttattttgccttagttttttttttttttttttttttctctgagactgagtcttgttgtgttaccaggctagagtggagtggcatgatctcggctcactgcaacctctgcctcctgggttcaagtgattcctgcctcagcctcccgagtagctgggattacaggcgcctgccaccgcacccggtgaatttttgtatttttagtagagacgggattttaccatgttggccaggctggcctcgacctcctgacctcatgatccaccagcttcggcctcccaaagtgctgggattacaggcgagaaccaccgtgcccggtcttgccttagttatttcttgttccctcctctagtcctatagttctctgactgtattgaggaaatgtaattaaatattattatgttaatagatatttatgtggttgaatattagaaattccttattttggtcacatatcctgatcagtagttggtcttctggagatagtgatttttcactagagatgactttaggacctattcaggttttttttaagatcccaatttaaggaaagactattctcattattgattttgctatatgcagggaaatttatttcgaaaggtttttcagttggcttttagggaagattatatattctctttttttttttttggccttttcccacatgttctaaaaatgatatattctttaactcctatgaaaatacattgtttcagtaattgaagatgctgattaaagtcatatctctacacattttttaaaatttgagatagatgggactttgtcccttcttacaccattcacttattcacttggaaaaactattatccaatacttatgtggcagacactgtttctggcacaagggattcagcagtgaacaaaactgcctttttggagtttacattctactagtggaaagcgacaacaagcagatagacacattcagtatataattcactgtcagatggtggtggtaagtcctatgtaggaagaaaagcagggtaaggaggcttggagtaactggagtgagtcatagatggacttgtcaggaaagggtttctgaagaggtggtatttgggcagagatctaaataaaatgaagcaacaagccatgagaatatccgggggaaaatgttctgggcagaagcatcaagcatagaacttgtggtatgatatttattctagcacacattaattttaaaaatgtataaaagacatccatttaatcatattaaagatttccatgattcatttagacttagtcagaaaccaaatttatattttctttttaaataattttatctcaactcttattttacccaataggggccagagttactcagcaaatacattggagcaagtgaacaagctgttcgggatatttttattaggttggtagcctatgaatgtttttaaagtaactgactctgttattatttatcaatcagtgctttttttggtcttgttttttgaagaactgatatttgaaacctgtggtttatgtgaattattaataagctagaggacgtggattctctatttcatcaaataatacaaaacattttagatattaaattttggaaattatttggttttgttttacaatagaaatactcctcaaagtggaatcgaagtggttattcaaagaaatctcagagtagattcttatatgaagcaaataattgcccctaatttatctctaaattttgtaagttctaaattcttttttcccccagtttctaatttatctcttataagtcaagagtccatctggccaatttaatttcagtgagtgtaactattttgcatatattaaaaaactgtatatgaatacagaagatggtatttaaggatgaaaataattattcaaatgtgatagcattatggggagttttaaaataaaagttactgttttattcttccaaaaattttattataaagtatacagttaagagaatatacataaaatacatatgcagcttaaggaagaataataaaatgaatacttcatgtattcaccaccgagtttaccaggaaaaagcataaacaaaataaacctcttccacgtaattcctgggttaaagagaagttatagtggaaaatatttgggagcaaacgataatgaaaatactatccattaaaattgttagatgttgcaaaactgatttcaaggaaaatttatagtgttaaatgtttagaaaagaaaaaaggttagaagttaaccacttatgtatctatctcatgaaattaggaaaattatagatataaactaaaaaatatgttaaaagggaaataataaagataagaatgaagtttaatgaaacacaaaacagagaagctcacaaagccaagatttattttttgaacaccgagtacaattgacaaatctctaacaagtttgattaagaaaaaagaaagcatgaataaacaattttagggataaaaagggaaacatcgctaaagatatcccagaaatgtaaaagataataagggaatattatgaaaatattcatgccaatacatttgaaaacttaggtgacatagacaaaaacaaaattgaccaaaattgagcaaaaaagaaacaaaatctgagtagtcctgtaacttagtaaaaattgagttagaaaagttaaagaagtctttacacaaatcaaacatcagactcagttttctaggagagttttgccaaacattcaagtagcagataattctggtctatttttggccccagaagatatattttacttgccatgcatttaatgagatagctgttgatttttttcaatcaccgtgacaggtgttttatattaggtgttattcgccagacatctagtccacctgttgccagatatggaattaatattcacttattttgaattaaaatttgttaataaattaataaaacaaagtcaaagttcaaattattaaaaaagtaaaagaaataaaatatattttatagagagcccttacaaaacagtaccaacataatgagctttccaaattttgaatgggcaaaataaatgaataggcatttcacaaaagaaggaagggtggccaataagtatatattaatataaaaatggttacttgtaataggaatcaaaagtgtttgacttattgactaagagtcagtttttgttttgatccctgttagtctatccagaaggcatgggtcttaataaacaccttgacctcaacagtttactgaatacaagggtaatttcatatgccttgccttctttaagggtttgttgtaaagattaaaataaatacataaatatatataaatacatttatatgtatttatatgtaattacatacaacttgccttctttaagggtttgttgtaaaaattaaaagaagtatataaatatatataaatacataaaataaatacattcatatatgtatatgaaatcactttgccaactatgaagcctgattcaaatatgaaatgttgtttgtttttcccagagcacaggctgcaaagccctgcattcttttctttgatgaatttgaatccattgctcctcggcggggtcatgataatacaggagttacagaccgagtagttaaccagttgctgactcagttggatggagtagaaggcttacagggtaataattataaatacagaaatagaatgttataacaaaatgtcatcatgtcatcagattttggtaaaaaaatgttcttttttcctctaggtgtttatgtattggctgctactagtcgccctgacttgattgaccctgccctgcttaggcctggtcgactagataaatgtgtatactgtcctcctcctgatcaggtgacaatttcatatttagagtccaaaacccaacaaatgctacactctttccttgtgagctttacttctgccaggtaatggcaattgtccttagaagaccagctttcttagggaaaagctttagccactgtttgctcaaagcataaaaagattctgaattagatgcaaagcctttttttggcccagtgcaagtctgaaaactttgtaatccttctgtgttggctgattggggaaaaaaaaatgcaagaaacctaatgtattatattttcacattatcttctgttcaaagattacatacttccattatcctgtcaaaaaaaaaactctgatacagaatcaagcatgtgaatcgtaagcatgtaagcaggtttcatagagataatttttcaactcttccttgtcctgtgttgttccaactcttattctccaatttagaagcaaacaaataaatgaatgaaagaacagatagacaaatgaatagtcaaaggtataaagtatctgtatatatgttacatgtagctattatttaaattatttagattttccttttgaaataccttcttggcacacttgcctaaatctagaaaataagcactgtgtgaataagaaattatttacactgaatattttgtaggtttttgggtttttgtttttcagacaaggtctcactttgtcacccaggctggagtacactggtacgatcacaactcactgcagcctctatggcccaggctcaagcaatctccccacctcagcctcccgagtagctgggaccacaggcacacgctaccatgcccagataattttattattaatttttgtatagagatggggtctccctgtgttgcccaggctttcttgaactccagggctcaagtgatcctcccacctcaacctcccaaagtgttgggattacaggcgtgagccaccatgcccagccttaagagtgtttgattttcattcattttcctatatatattatttctgttggggaaaaaattccaaggaagataaatagtaggctgttggtacatttctcaacttacttataaagctttttagatatataaggttaatttatgaagaaaatcataagatacacaatttaagataatatttttaattttattttttatttgttaaataaatttttctcctttcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggcaagttatatgaggaagttgttatgacattttatgagtgataaaagaagtacaatgtcaaaatttccaccttaaaaaatgctattttttaaacaactttggtaaaactgtatagaaacataaatttacctttagttgaatgttccatagttggaatatgggttttgcagagaatttataattatgaagtttgatgtctgtttctttaacattaccttaatattggcaaaaacatgttggtgtttgcaaggatattatttaaattgggataccatgaattaaatactacaaacaaaaataattagagttttttgtttgtttgtactttaacttttaaaaaataatcagttaaagttgttgttttgaagctcacattgttccaatctggccaataggagccccttttgtatggctcctgtatctttatgacatgtcctcatcattcttgaatcacttcctcacttccagatacagtaagttattcttggccaggtgcagtggttcacgcctgtaatcccagcactttggcaggccaaggcaggaggatcatttgggcctagtttgagaccaaatcatggttgcacaaactgtacccactatggacaacagagtgggatcttgtctctgtgaaaaatttaaaaattagctgggcatggtggcacatacctgtagtcctagcttcttgggagaggctgtggcaggaggatcgcttgagtaaatccaggatgcagtgagccatgcttgtgccactgcactccagcatggatgacagaatgagaccctgcccccaaaaaagaaaaatattcttggtttatcttgtactttctgtatcccagccctagcatcagccttttctctaaagacagtattatgattttaatatttacagtagatatttgaactgttacattatagactttaccatatattttctaggaaggattattctattactcttctttaccacatttgtttggaatgtctacagaacctacagtttctaaatcagaaactccctaggtttttgctattttggcaagccattgaagttcttccctctccctttactaccagaaaggtgtgtatttgtagagctctctataatgagaaagcactctataacatggttgattcatcattttggagtagaaaagtatgaatggaaagtcagagacataaaaataaagcccagaggtctgagtcttagcttcattacagactttcttgggggatggttggtaaattatctacacattctatcttgtctttataattttaatagttaaatttttaccatgtgcctcaaaaccgttagagaattaatgagctctttgaaaaatgcttctaagtttcttgtattgctctaatagaatgctatctatgttattatttatttctgagactaaaattgtttacatctttaaactggttgtccttttgtgtattttaggatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttggtatcttgtgcagtcatcattatacagttctgaaatataaagctatatgttggtgtaaagttgcagtgatttctctcctaaccagccccacatattcttcctggttggttggttcttcagtaaaatagtcttgtttcttgcttacactaattggtaatttgcattccttgttaagattttcaagacagggctgggagcaaggaaccaaagtagcgcgtggttgtgattacctttggtttctttgaggtttctcttacctagtggctttaaaacatctttaggagcagttccattttatagtaaacttaaattctgttatcatgaacagttgaggataatgaataatttgatacaataatgtaagaaattcctgaaaacaaagtgttatctgtgatacttttgctgcatagtaagcacaatgaagtgtactgataatgtttcaacaggaaagtgttttgattaaatgtgggcagtatcactgttctactagcattcaacatctcttctaaaaattaatagtggttcactgtaattttattggtacatgtaacatctgtacatgtgtttggttatctatatgtttcctggttttttgtacatttgctttattaatttaggcttttttttttttttttttttgagacagtctcactctatcatccagactagagtgcagtggcacaattatggctcactgcagccttgacctcctgggcttaggtgattcttccacctcagcctcctgagtagctgggactacaggcacatgccaccatgcccagctaatttttgtatgttttgtagagacgaggtttcaccatattgcccaggctggtctcaaactcctgggctcaagctatctgcgtgccttgacctcccaaagtgctaggattacaggtgtgagccactatgcctagcctaactcagactttaaaaatataaaagcaattcatttttattcccaagaacagtaaggtggtggtttaattttagtctttaattctgtttttaatttattctatttagaaatgtcccagaaacttagtataactttactttctgaaaatgaagaaacctgtccttgggcattagtgtgttggatttaagcaacaaagttaaaaaaacctaccctgtgttatggcaattttcacttgatggtggttctataacacaggtatcagtgaacctttataaaagatgaacaacttttcagcttgcttaatttcagttaattaacatgtatacttatctatgttaatgttttattgcttaaaatgtttaatttttatatttggtaaacagatagttttttctctccccctcttccttccatctttcattactacaatttaccatgcagagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagtatggctttttccccctcattataattgttaaaacttcttaaaaattgtttcacccttttgatatatatttctttgacttataaacgagctatatttataaacaagggaccagaacacattaactcagtcatggttatgtgcttccttgctttcaatgtttcattatcttataaggaagagaacgtatggtctcttgaaaaaactgacaataagaagtaacaactggactaccacatttttttttacatccttaatttaactcttcgtcaatttctttttttacttaaggaggacgaatccatgaaccaaccaggaccaatcaaaaccagactggctattagtcagtcacatttaatgactgcacttggtcacacaagaccatccattagtgaagatgactggaagaattttgctgagctgtaagtaacagattctgttttggaagtacagctactattacaagtgacatagtattacacttaaacctttaaagttcgtgtttaaaataaaaatattttgaatatttaaaagctaattcaaaaaatatgtgtcgtagctatgcattaaaaaaccccaaaatgtcagaagtacagaagtcaaaattgagttttcattaaccagttcatttgattatatttgaattattcataatggactcatttaattttagtaactttgggctgggtgctgtggctcatgcctgtaatcccagctctttgggaggccaaggcaggtggatcacctgaggtcaggagttcgaggcaagcctaaccaacacggggaaaccccatctctactaaaaatacaaaaattagccaggtgtggtggcatgtgcctgtagtcccagctacttgggaggctgagacaggagaattgcttgaacccaggaggtggaggttgcagtgagccgagattgcaccactgcactccatccagcctgggccacagagcgagactgtgtctcaaaaaaaaaaaaaaaaaatttagtaacttcgaagaaataagaaggaaaattaaaagttgaaagtgattctaatgtatagtttataaaattttgttataaaaatacctgttttgccttcaaaataatttatattaatattttattgacctcaagaacatttaaatacattcagatttattcatttgtggaccacatttgttatacattggatttaaaggatccttgcaattgagtttatggccacctatgcatctgagacccatggactgggaaccattctaggtcaatgattcagtgtgattcaatttaagagatgtttattcctggtctttagaagctgctaccttttgttatctaattttgcagtactttgaagtatgtatgtatgtgtacatacgttagtgctatgtatttattaaagaagaatcagaaaacagaggtaaggaaaaataaggaaacaaatttctgttaagcccaccacctcccaaagcatatttgtttatatgcttatatatgttttcctattatggtaagaacagtctgtacatattgctatatagcagtccccctttatccacatacatcctgaaaattgttttacattttaaatgttaactactttattgtttttaaatgtcattttatagtgtagctatgccacaatatccaatttttagacatttaaattgctcccaggcaatgtggtaatgaacattcttgcagctgaatatatgcacatatctaattgtttcactaggatagaggtggaattgtataacagggagctcacattttttaaggcttttgaaatgtattgccaaattgcctgccagatatactgcaccatcactaacattgtgtgttgcagtatttttctaaacttggcccttttgattttagaaaaatgatatcaataatttacatttctttgattaaagtgtagaagttataatttttcatattattcattgtcatttgtattttatcttttctaacttgtctcttcatcccctttgctccgttttctattggagtgcaactttatttgtaagaattctttttaatttctgtgactggaatttttttttctagtttgttatttcccgttcatttcttaaaatataattgtgtttgccaacaatccattatcttttgttttgtaatggtagtatttatacatattaaattatctctttcttttttcagatatgaaagctttcaaaatccaaagaggagaaaaaatcaaagtggaacaatgtttcgacctggacagaaagtaactttagcataaaatatacttctttttgatttggttctgttaagttttttgatggcttttccatatgttgtaacaggaaaaaaatggtgtctatgaatttcttcttaatttaacaaatttggttaatttataaaatcacagattggtaaatgctataattatgtaatgatcaggattgagattaatactgtagtataaattgggacattataacagattccatattttatttcctaaaatctaaattcagtctttaatgaaataatattagccaaatggtggaactaatttatttcttttgaggaaaagataataaagaatgtaattaaatttaaatttcttggaattcccagttgtatattcatcacctttgtagcatttgacaaattttatgcttagcagcttcttcactgttttgaaataaaatatcctattacctactgata

SEQ ID NO: 6280 - DNA, 80510 bp, Homo sapiens
cccgcgcgcgccggcggcggggcagcctcgctctggctcgcgccgcgcccccgcgcccagtccgcgcgtcagtcggtccctagcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagagtaagtggagccgggatccttccagcaggcggggactgcggctcccgaggagccccgcgcggcccctgccggcagcgcccaggcctccgagcgggctgccggccctgcgccccgggcctgaggctcctggtccgtggggtcccgttattcaggcgccgcccgcgcgagaggaaggcttgccccgctctcccctccctcacctcatgtttcaccccagccctccccctgcagcccgccctcctccctcgccatcctccttcctcgcggtccctgtctcccttttccctgcatcctccttcccctccatccctccctccctctcttcccttcacccccatttctctcccctcgccccatccttcccccttcctccacccctccctcaccccactctctccatcccgcctctcccccatcccaccctccttccccctctttcacccccaacacccgtccctctccttcatctcgcctctaccccctgcagcccgtcaccctcccccgcacccccatcctcacccccgttaccttcccctcagtcccctctccccttcctcgtctttattccttgagcgcccagactccgctcccttttcctgcagtccctcctcctccccaccctcctgggtgagtcgtgacgagcgagatcctggcctgcgtcctcctcccccgccccgggccgcgccgcggtccctggctgcgagacccacctgggagactaggcgcagtggcttggcctggggaggagacgcctgttttccggaggctgagctctgctgggccggggccacctcactcctccccttcccggggcttggcttccagggcggggacttatcaggatcctgaacccctgaaatcactcgggagatgaggagagcttcggtgtccgccgcccagcgccgcagtctgcaatctccctggttgcggggctctgccctgccgtggccgaacgcttcgggagctcagaccacggtggcagggaggaaatggttgtttatgggtttggatgaaaggcaccacatgaatggatttttaaaagtgggtggcggcgagtggcggccgcagcggagcgagggctgatggtgggtgacatttgcaaaacggcatccacagtgctaaataagattggtgatatgtgtggaaaaacagtgccttgtcaatattttgtccatttctttataacaaaaaaaatgtgtaaggattgctgtggcttttgctatctctttggggattaagtgaagattaaaactgggcttttctctgtaggagaggataagaaaggaaaaagaataaaatggtggaaatctagtttcctttccaatgattctctcctatcgtagcgcgcgctcgctgtggaatgcttttggccatgtagtgttcttgttgggcaccatagctgttttatttcccctctccattcttttcattgatatataggaaatactcctactgaggaatctagttgtaaaaccttatctcacctattacatcagaagaaaattgttataaaaactgaacaccaaatgaaacaaaattttaaaaggtgctcatcgtaacaccttcattgtacccatgcagtacgggttctgatacttgtactcgagatgtttagggctaggaggacccatagggatcctctaatgtcaacatctcattttacccatgaataagaaatggagacttagagcagttaagtgacttgacacaatcagtgttaatttggtgaaacctggtgggcatttccttgcaacattagtaaaaaataactttcttcattattctgtatgtatcttttctttccaatatccttttaaagcgtgaaatatagaatagaatgttacaggttgtattctttaaaatgttacatttgtactttgggaggctgaaatgggaggattgcttaagcccaggaattcaagatcagcctgggtaacatagtgagaccccatctctataaatataaaagtaaaataaaatggtatatttgaacactacacattgaagataaaatcctcaagtgttatagaaatcaagttttgcatcattttgctggaacccttgtttatgcaagtggctccataatccccttcccccacctttaattagaagcaagcataaaggtaaaaaaaaatcaatatgcaagcatggtcagaatttactttctgaaataaagcaaacccattgtacacaaagataacaaagcaattttacataaaattggtgaggatggctaggtgcagtggctcatgcctgtaatctcaggactttgggaggccgaggctggcgggtcacctgaggtcaggagttcgagaccagcctgaccaacatggtgaaaccctgtctctactaaaaataaaaaaaattagctgggtgtggtggtgggtgcctgtaatcccagctactcgggaggctgaaccctcgcttgaacctgggaggcagaggttgcagtgagccgagatcgtgccattgcatgccagcatggcaacagagcaagactccatctcaaaaaaaaaaaaaaaaaagaaaagaaaaaagaaaaaaaaatggtgattatgtgaacagagttctattcctataacaattaggtataaattttagaagaaaaatgttgaaatcctttgtcaatgacgcaggttaattctggcttctaattttggatagggtttctagctttgcccttttctctaaaagaggctgaggcagaagaattgcttgaactgggaggcagaggttgcattgagctgagattgcgccactgcattccagcctgggcgacaagagccaaactctgtctcaaaaaaaaaagaacctaattatacattaaaaacaaaaatgacaatcaagtagagcttatttcagaaacacaatagttcaatattagaatgacattaagaaatgaaaattttaaaactatataatcttctcagtagaaactgaaaaacaagttaatctgcttttaaaaacaaaacaaaaactcctagtaatccagaactaaaaggagtagtttaaatgtccctgtagagaaacctctaacctccccaatcccatcaggcctccctgtaatcacggttccctggactttcctttgtaattcttatcacagttgcaattaataaattatttgtactaattgtaagaccataagttcgctgggggtaagaactagtgtctagcacagtgctgtcacaacaaactctaggaataagtctaataggaagttagcaagaccttcataaatggagaagaatgctatgttgctttatggaagaatatgaaaaaatatcagttcttgctaaattaacctatacatttaataaaattcctacaaaagtcccaacattcatctggaatggtaaaggctaagctaagaggagctaagaaatttttgaaaaaaaaagaaaatgggaattttcacctaccagattcaaaacatactgtaaagctacgattaccaaaacattgtagcactaccagatgagagggaaagtgaaaagatcaatgacatagaacaagaagtctagagtaggtccagataagaatcccatatatggcaaaggtagcattttaagtcagtgaggaaaggaaagaaaactcaacatatgatattcaggcagttggctacattttgatggggaaaataaatttacttctgtacttcacatgttcacaaaaataagtcccatagggattaaataaataaaatgataaaggtagtagataataacagatgtacttttccttatattattgtgcaggagctttctaaacattattagaaaacattaaggaaaagactgacagatatgactatacttctattcagtaaaaacaccaaaaagcaatttgaaagacaaataagcttgaaaagtatctgcagcatataacaaagggccgatatctatttatctatctatctgtagagagcttccttaaattgtttttaaaaaaaactaaataaaaaatagacaaaagacatctattagttatctattgttgcataacaaattacaccaaaacttagcagcttaaaacaatgaacatttattgtctcagacatcctgagggtcagggtctgggaggggagcagcctggctgggaggttgtggctcagggcccctcaggaggttacatcaatgggctgtagctatctcaagaccagaccagagctgaagaatccacctccaatggcactcctgttgttagtgggcctcagttatccagcaggctgttggccggatacctcagttctttgccacaggggcttcgcctgggaagccagccggcttcctccagagccagcgacccaaaagagatggagacctggagaccgcagtctctataacctaatttagaagggccatcatcacttttaccatatcctatccatcacacagaccaatgctggcacaaagtgggaggggactacacaagcgtgtgaataccaggaaccagggaccactggaggccatcctgggggctctcttaccccagaatgaaaacaagagctccagaactgggctaggacacagtagaaaagcggggaggagagcaagcccagcaaccagatgccttcactttacacacttctgtatttgattttcttctttaaaatgtatagtgtgctctacttttataatttaaaaaataaaggttttaaaaatatttttattaacaggaaaacagagaatgcctctctggttctgtctgggtatcaccaagttccccagattgtgccaggctctaagtcataataagaatgaccacctactgagaacctatgatgtgccaggcactgtcctagtcacttaaatatactattcctttttttttttttttttttttttttgagacagagtcttactctgttgcccaggctggagtgcagtggtgcgatctcggctgattgcaacctccgcctactgggttcaagcaattctcctgcctcagcctcatgagtagctgggactataggcgcacgctgccacgcccggctaattttttgtattttagtagaggcggggtttcaccttgttgaccagactggtcttgaactcctgagctcaggcagtccggccttccaaagtgttgggattacaggcgtgagccactgcgcccagccaaatatactattcttaacgctaaatgtcctaagtagatataactgtccccattttagagatgaggaaattcaggtacagataaagtcacttaacagtgcacacaagtagtaaggctggaattcaaactcgggcttctctggctccaaaaggctgagctcttcattagaccagtccccttgcccctcgatgccctgtgtaacccactagaagagtgggtaggaggaaagccatcaatcccggagcaccagggagacacacaaaaggcccagactccgggactgaagaactgctgctgacaaaaatagttataaacattcctgtccatttgggatcattgtgggttggtattagaacaagctggacatcctaatgttccaggcaagcagaagctctctgcttcagaccgtatactttctaataatgtaactagccaaagctagtcataaaaattctgaatcactggtcaagaaacacattttctcatcatcccctctatagccacccctccaacattttcccctgatgattgaattctaaggttccctcacccctgcttttctctgccaggggatgaagtgagtagaaggaggctttgtctaaggactgtgaactcctcttaccctctcactgcactcagcagcccgagaggtgagttcaggcatcatccacttagctcttctagggccaaattataagtggaaagcaggagagatcagaggtgtcagactcagtctatgaaagacagatactcctctttttcctcaacctccctcactaatccccacccccccgaataaatacactgacaaagcgttgaaagttgcactttccaagtcaattcagtctctcttatgaagtggcttcagtatttatcaggttatagattatgatcaattggtctgaactttgaatctaaatctaaaaattattgctttgcttcgagtaaaactgtaataataaaaactaaatctattgatcacttattaggtgccagacactgtcctaggcatgtcgtatgttgtcatttaatcctcaaaaagatcccatgagttactctcattagtcttcttttactctaaggaaacagaggctgagagagtttaggataattccacaaggttatcaatttgtcgttataatgtttgtatgtatgtatgtattattttgagacagagtcttgctctgtctcccaggctggagtgcagtggcactatcttggctcactgcaatctccgcctcccgggttcaagtgattcttctgcctctgcctcccgagtagctgggattacaggcgtgtgccaccacggctggctaatttttgtatatatatatgtattttagacggggttttgccatgttggcgaggctggtcttgaactcctgacctcaaatgatccacccaccttggcctcccaaagcgctggaattacagacgtgagccaccgccccagcactgttgttataatgttttagtaactaacatttacatcacatcaacaagtgctaaacactaaactaagtgctttgtgtatgctaacttgttgaatgtctatagttaccctgtaagagaggtgtattccctgcgctttatggatgagaacattgaagtcaggtgaggaatgtgcgctaggtcccataggtgagaagaggcagatgcaggatttggaccctggtagtttggctgcagcatcagtcttaatctcaacacctgtcttctcagatttggattctggctcacaggctgcagagcctgtacttcttttttttttctttttcccagagacaggtttctgttgcccaggctggagcacagcggcgcaatcatagctcactgcaacctcaacctcctgggctcaagcaatcctcttgtctcagcatcccaagtagctgggactacaggcatgcaccaccatgctcagttaattaaaaaaaaatttttttttcttcaagacgaaacctcgctctgtcaccaggctagagtgcagtggtgcgatcttggctcactgcaacctccgcctcccgggttcaagcaattctcttgcctcagcctcatgagtagctgggactacaggcatgtgccactacgcccagctaattttttgtatttttagtagagatggggtttcaccatattggtcaggatgatcttgatctcttgaccttgtgatccacctgccttggcctccaaaagtgctgggattacaggcgtgagccaccgcacctggccaatttttagaaaaatttttagtagagatgaggactcactatgttgcccaggcttgtcttgaactcctgagctcaagtgaccctcccgtctcagcctcccaaagtgctaagattacctagagcctgtattcttaacctctcttccttggtttttgatacttgaaaatcttttttccctaaatttttccaaaaatgtacaggatccaagtggcagacaggtcctccggattctattccgggttctgcccctgactcatgggtgacactgggtaagtcacaactctgccaacaagacactgaaacttgcactttccctctactaattatttaatgtactgcaaatcctgcttgaccttaagtacaggagaaatttgacttgtaaaaagagataacttaggccaggcacagtggctcacgcctataattccagcactttgggaggccaaggtgggagattcacttgagcccaggagttcaaaaccagcctgggcaatatagtgagacctcgtctctacaaaaaatttagaaattagccggccgggtgcggtggctcacgcctgtaatcccagcactttgggaggctgaggagggtggatcacctgaggtcaggagttgagaacagcctggctgacatggtgaaaccccgtctctactaataatacaaaaattagctgggtgtggtggcacacatctgtaattccagctacttgggaggctgaggcaggagaattgcttgaacccgggaggcagaggttgcagtgagctgagatggtaccactgcactccagcctgggcaacagagtgagactctgtctcaaaaaaaaaaaaaaaaatttaaccaggcatagtgtccccgatctgtagtcccagctactcaggaggattgcttgagcccaggaagtcaaggctgcagtgagccaagatcatcctactgcactccagcctgggagacagagtgagactctgtttcaaaacaaacaaacaaaaaaaaggtaactttaggctgggcgtggtggctcatgcctgtaatcccaggactttgggaggccgaggcaggtggatcacctgaggtcaggagttcgagaccagcctggccgacatggtgaaaccctgtctctactaataatactaaaattagccaggcatggtggcacacacctgtaatcccagctactcaggaggttgaggcaggagaattgcttgaacccaggagggggagattgcagtgagcagagatcatgccattgcactctagcctgggtgacaagagagaaactccatctcaaaaaaaaaaaaaaaaaagaggtaactatttggcagtgcctcaaaaagttacacatagagggacaggcactgtggcccacacctgtaatcccagcactttgggaggccgaagcgggcaaatcacgtgaggtcaggagtttgagaccagcctgaccaacatggcgaaaccctatctctactaaaaatacaatatattagccgggcatggtggtgcatgcctgtaatctcagttacttgggaggctgaggcaggagaatcgcttgaacctgggagttggaggttgcagtgagcagagattgtgccattgcactccagcctgggcaacaagagcgaaactccatctcaaaaaaaaaaaaaaaaaaaaaaaaagttacacatagagttaccatctgactcagcaataccactccagtgtatataatcaaaagaaatgacagtatacatccacaccaaactcatatacaaatgtcgcagcagcattattcataacagccaaacaactcaaatgcctatcaagtgattagtagatgagcaaaatgtggcctattcatacgatgaaatattactcagccaaaagaaggaatgaagcactgacataggcatgaagcactcacataggctacaacacagatgaaccttgaaaacacgatgatggccgggcgcggtggctcctgcctgtaatccgagcactttgggaggccaaggcaggtggatcacctgaggtcaggagttctcgaccagcctggccaacatggtgaaaccctgtctctactgaaaatacaaaacttagctgggcgcagtggtgggtgcctgtaatcccagctactcaggaggctgaggcaggagaattgcttgaacccaggaggtggagattgcagtgagccaaggttgtgcaattgcactccagcctgggtgacaagagcaagacttggtctcagaaaaaaaaagaaagaaagaaagaaaacatgacactaagtgaaagaagccagatacaaaggccacatagtggatgctcccatttatatgaagtgttcagagttggcaaacccaaagacagaaggtagattagtggttgccaggggctgggggagggcagaatggggagggatcgctagcaggtacggggcttcttgtcgggtgatgaaagtgttctgaccagctacagggagccaagatcatgccactgcactccatcctgagtgacagagcgagaccctgtctcaaaaaagtaaataacgtaaaatggcaaagcttatgtgaattacatctgaatagtaagctttcagatgtttaaaaaaaaaaagagagagcaagctaacttgaaaggtaagctattagcccagttgacacatttgtcctgaacttttccctgtagtatcgcttaaatgcacatcatcaaggaagtccttttaaaagagtgtcagttggaaacatttacattgagacagaggacttcaatatttaattgcatggcctgggtctccagggaggaggttgcttaaatatgagcatttgttttacttcaaagttaaatacaattctgtgggtgacctgtccatgtcacagtttctccatgcaactgagacagtttagggggaaagaaatcatccctatctgataacagatttactaggattttttttttttttttttgagacagagtctcactctgtcacctagactggagtacagtggcacagttatggctcactgcagcctcaacctcctaggctcaggtgatcctcccatttcagcctctcaagcagctgggacaataggcacacaccaccacatctggcaatttttgtattttttttagagatgggttctcgctgtgttgcccaggctagtctcaaactcctgggctcaagggatcctcctgcctcagcctcccaaattgctgggattacaggtgtgagacactatgcttggcctattatcttaagaaaatatcctaaatgtggttttggaagaaaaaagaaaacaattttcctaggaacaatgtaggaaggtagaataggtataaaagcaaaggtgaggctgagtgcggtggctcatgcttataatccgagcactttgggaggctgagacaggctgatcatctgaggtcaggagatggagaccatccgggccaccatggtgaaactctgtctctactaaaaatacaaaaattagctgggcatggtggcacgtggctgtagtcccagctactcgggaggctgaggtaggagagtcacttgaagccgggaggcagaggttgcatggagtcaagattgcaccactgcagtccagcctgagtgacagagcaagactgtctcaaaaacaaaacaaaacaacaacaaacaaaaaactaaactaaaggcaaaagtgactttaaaatacaaaatactcatccaaacagatgttgctgttacacaggagtaaaaccttggtgacttgggttgtgccagcattgctttcttggctgctgagttatgggaatagccaacaggtcccaggaaaaaggaccccacagcagggagatgaggggctcaaggcagcaactacataccaacccgtatggaagacttccactattttagtatcagccaaactgatgtgtaccatcaggatatcaactttgggttcaagaatacataatgttgagaaatttgggaaagacctgtaacagtctgggacctgagaagatgccatacatatgcaatttaattccacagagctatttgttgcctgcctgccatctataactattctaggcactatggggaatggcaaaagaaagaggacacagtccctgccttcaaagaacttatgacgtattatttaacaaggaagcaaaacttttgaccaggtgtggtagctcacgcctgtaatcccagcactttgggaggccagtgtgggcgactgttttgagtctaggagtttgagaccagcctgggcaacatggcaaaaccccatctgtacggaaaaaaaaaaaataatatatatatatatatatatatatatatatatatatatatatatatattagccaggcatgttggtgcacacctgtggtcccagctacttgggaggctgaggtgggaggattgcttgagcctgggaagtggaggttgcttgagcctaggttgtgccactgtactccagcctgggcgacagagcaagacgctgtcacacacacacgcgtgcacacacacacacacacaaacttttaacaaataactataacaggccgggcatggtggctcatgcttgtaatcccagtactttgggaggccaaggcgagtggatcacttgaggtcaggagttcaagaccagcctggccaacatggcaaaaccccatctctactaaaaatacaaaaatttgcagggcatggtggcacatgcctgtaatcccagctacttgggtggctgagacacgagaattgcttgaacccgggaggcagaggttgcagtgagctgagatcgcaccactgcactctagcctgggcaacagagcaagactttgtctcaaaaaaacacaaaaaccaaaaaaaacccctataacctaatgcagaatgcagaaagtgccataataaagaactgaggccgggtgcagtggctcacatctgtaatcccagcactttgggaggcggatgcgggcagatcacgaggtcaggagattgagaccatcctggctaacacggtgaaaccccgtctctactaaaaatacaaaacaaaattagccaggcgtggtcgtgggcacctgtagtcccagctacttgggaggctgaggcaggagaatggcgggaacccgggaggcagagcttgcagtgagtcgagatcacgccactgcactccagcctgggcagcgagcgagactccgcctcaacaataacaacaacaacaaaaaaaaactgaatggcgtctaaagagtgaaaggagaaatttatttgatttgatttgatattttttttgagacagagtcttgctctatcacccaggctggagtgcagtagcatgatctcggctcactgcaacctccgcctcccaggttcaagcaattcttctgcctcagcctcccgagtacctgggattacaggcacgtgtcaccatgcccggcttatttttgtatttttagtagagacagggtttccccatgttggccaggctggactcaaactcctgacctcagatgatccgcctgcctcggcctcccgaagtgctgggattacaggcgtgagccactgcagctggcctaaaggagaaatttctattccagataggaaagagaaaaatatcttgttgggaaaaacagtattaaccagatcttgaagaatggggacattcccaggatgagcaagctatattagaatccttttaaaaaatagaagttctaaaagtatgacacttttaattaataaactggaaacgaagacacaatcggaccactcaacaatagtgatttttaaattttaaatgaattatctaaaaagacataggccagacacggtggctcacacctgtaatctcagcactttgggaggctgaggtgggcagatcacgaggtcaggagtttgagaccagcctgaccaacatggtgaaaccccgtctctattaaaaatacaaaaattagcccgacatggtggtgagcgcctgtaatcccagctactcgggaggctgaggcaggagaatcgcttgaacctgggaggcggaggttgcagtgggctgagatcgcgccactacactccagcctgggtgacagagcgagattctgtctcaaaaaaacaaaccaaccaaccaaaacaaacaaacaaaaaaatatacattctacaactgtagttgtgatcccctttctcattctatcctgtttgtgtattattttcatggaaatacttgctggaaacttacttattttactttcctttaaaaaaaaatcacttttttattttttgagacagagcctcgctctgtctcccaggctagaatgcaatggcacagtcttggctcactgcaaccgctgcctcccaggttcaagcgattctcctgcttcagcctcccaagcagctgggactataggcacgtgccacgacacccggctaattttttgtatttttagtagagatggggtttcatcatgttagccaggatagtctcgatctcctgacctcgtgatccgcctgcctcagcttcccaaagtgctgggattacaaacattagccaccgcaccccaccaaaatcagtttcttctatattgtgtgtagctattctaatttattgaataaaatgctgggataatttattaatttttctttgttttctactaaaagcatctaaggatatgaattttcatctgagtacagctttggttgaatcccataggtttttttcccctgctccatagtttttatttttatttttatttatttatttttcagacagagtctctctctgttgcccaggttggagtgcagtggcatgatcttagctcactgcaaatccatcttccgggttcaagcaattcttttgcctcagcctcccgagtagctgggattgcaggcatgcaccaccatgcctggctaacttttatatttttagtagagacggggtttcaccatgttggtcaggctagtctcgaactcctgacctcaagtgatccacccgcctcggtctcccaaagtgctgggattacaggtgtgagccgctgcgctcagtcctgcttcatagtttttaatatccaatatttttgccatttctttttttaaaaaattattattttgttattttagagacaaggtctcagtctgtcacccaggctggagtacagtggcatgatccatagctcactgcagccttgaccttctgggctcaagccccctgagtagctgggactatatttgtgtgccaccgtgcctggctattgccatttacttctaaatatagtcctttgttttgaagtggatgtcactctcataactggtgataagtagtttaaattgtggcaaaatttccctaagaggtggtttgggactcaggcatcatcatcaaatgtaagagagcacgtatctgcctctagtatccaagaagggcttattgaacgtgcagtgaaaggttttccctctggcttttttggcgcacagcacctctgagacaaacaggtgcttgaaagctaatgaaatatctttagtggagtggtcaggccaaattttatagttatcactggcaatgtaacagccataaattttgagtcctggtcctgtgctcgcctgtacaggaagtgctttgggaatccccagtatgatcctctttaattgcctcaattagttgcttctctgcgaggctgttgcaagagctaaagttagagtgaggtgactgagactctgttttcctttcagcaagtatgaggtttacttacctttttccatgtcttttttcttttttatttgttttggagggaggggtggtggtgggagatagggtctggctctgtctcccaggctggagtagagtggcacaatcacagctcactgcagctttgatctcctgggctcaagcgattccagctgggactacaggtgtgtgcaaccacacctggctgatttttgtattttctgtagagaaaatacatgttgtccaggctggttttggactcttgggctcaagcagtctacccaccttggcttcccaaagtgctgagatcacaggcatgagagccaccgtgcctgaccttttttggttttttgtttgtttgtttgtttttgtttttttgtttgtttttttttgagatggagtctcactctgttgctcaggctggagtgcagtagcataaccttggctcactgcagcctcaacctcccaggctcaagccatgctcccacctcagcctcccaagtagttgggactacaggcatgcatcaccatgcctggcagatttttcttttcttttcttttcttttttttttgtatttgtgtattttttgtatagatggggtttcaccatgtcacccaggatgatcttgaacttccaagctcaagcagcattcccacctcagcctctcaaagtgctgggattataggcacgtgccacagcacctgccctgatctttaacttttttcttttcaacatccacccatctctatctgtcactttattttatttatttatttttttcttgtgagatagagtcttgctctgtcacccaggctgcaatgcagtggagcaatcctggctcactgtaacctccgcctttggggtcggggtgcaagtgattttcctgcctcagccttctgagtagctgggattacaggtgcctgccacctagtatccaaaaagggcttattgaacgtgcagtgaaacgcctggctaattttcgtattttcagtcacgacgggatttcactatgttggccaggctggtctcaaactcctgatctcatatggtcctcccgctttggccccccaaagtgctgggattataggtgttagccactacacccaacctctacctttcactgatgtctactaattatttagtctacgagcaaaccttattggaagtgaatgagatattaagtatttattacagtaggaaaacctgttttattcttggaaagaaaaaaatttagagggagataaagaaaagtggagaaaaacaaacaaaattaaaaaaaaatctttggagcctggatgtgtgaattcaaattcatgcagatttgaatctgagtctccagtagccaccccttatttggtgtccttctgagatgttagagaactccaggaccataaattatagtctgtgttcatttcagcatggctcagcagggtctgggaccaagtgttttcattcatccaaccaatatttgcgctgtctctacatgccaggagctgtgctgcatgggcagcagagatagtagtgtgtaagtagaccgggtccttgtgggatttagacagacagtggtgacgcagcaggaatgtgccctgacagggcaatataggtaatgctgaagcatgtgggaagcccccaggaaggcctgggcatgagcggggcagagtgagacctgcaggatgaggaattagccaggcaggagatggggtccgtggggcctgggggagaggaaggtctaagcttggcaagaaaatgagaaaggctgtggctggctggagctgtggggagtgtgtggagagcagtcggagagttgccagggcctgcttagccttggtaaggtcgtttatctctctattccagcagctgtgggaagctactgaaggttttgagttggggagaggcatggttagaattgagttcaaaatgctatctggttgctgtgtggagagtgggcgggaggcagtgggagggaagaggctgtggtgctggtcctagctggggatgtgatggcgaggatggtgatttatgccagggagagagcagcagtgttgggagggggaccccaacttgaaggcatcttaggatgcagaagggtcaggtcatggtgatggctgtgcaggaagaggagaggaagagtcagaaatgaatcccagttttctggctcgggcggccagttggaaggtcatgctgtgcattgagagatgaaaggcggagaagagacaggtttgtgggggaagatgaggttttgtaggcacaggcttcaggtcctgtggaccacctgcgggggatgctaatgggagcaggcagacatgcttgagattggcagtcacccggtgccagagtgtgggcaggtcagatgcacaggagagtgggagaagagggctgggatctcaccccgtgggacactggcatttacaggacaggcccagggagagcagccagcaggcctgagtgtcggaggggaaaggtgaggctcacagcagtgtcttatgattttgtgactcatgggacccaacctcaaactgagccagtgcaagctgagccagccaccaggaggctccagtttaggaacagcccccactctctaggctgggaggcttggccgctggaaacttctcaggagtttgcctgtctgtggtgttgcccctgtgttttagacaacacttgcctgtgttaacttccttgctcaggattgttttaaggaggaaatgaggaaatggttatagttagtcgacgtgcaaaactctgagcatttgggctttatgctgtgttaaaatggcatcagattggctgagtgtggtggcttatgcctgtaatcccagcacattgggaggccgaggtgggtggatcgcttgagcccaggagttcaagaccagcctgagcaatgtggcgagaccctgtctctaccaataaataaataaataaataaagtacgaaaactagccagacatggtggcacacgcctgtagtcccagctactcaggaggctaaactgggaggatcacttgagccaaggaggtcaaggttgcagtgagccatgacacaccactgcactccatcttggggtgcagagcaagaccctgtctgctgtggttttgttctgtgtccccacccaaatctcatcttgaattgtaatccgcctaatccctacatgtcaaggacaagaccaggtagaggtaattgaatcatgggggcagtttccctcatactattctcagataatgaatgagtccaaaggttttataagcgtcttgcatttttcctgctggcactcattctctctcctgctgccctgtgaagaggtgtcttctgccacgattgtaagtttcctgaggcctccccagccatgcggaactgtgagtcaatgaaacctcttttctttgtcagttacccagtctcaggtatttcttcatagcagcatgagaatggactcatacatcatttcaaaaaaaaaaaaagatggcatcaaattgtagaatcttggctctggaaaggatcttagaagaatctagtccagaccgtgacccagagtaggaagtcagattgtgctagtctattagcttgatcacattggccaatttttttcttctctgtggctgctggggatacagtattatcttcatgttccacaccagtgtagagtcacaatggcaagtataaaccatgaagagtgtgtggaggcagaaaggctgtggctctggactctagttggttctaatccagtcgcagttgagcctcgtgagcctcctttatggcagtaggaacaaagctgcttcattttggcagtgaagggaggaaaaaggaagaaaatttaggcttaaactgtttttggagcccccatactgggtacgacaaggtgaaccaaaccccacttatctcttctgtcagtttcttctgagcattggtgtggtcaggatagcattggagaggagccccctgcccagtctctggacacattggtattgatggttctatttgctaaggacttgaagaaaacaaaacactggtggtaagcaagagtcacccttcgctctgggagaatttcacactacaggctttaaacaatagactacagtgaggcatagcccttaaaaatcacttaatctgcagacctccttgtattgggggtcaaagtgctgcttcaggattttaggatgaggctattacttgactactcagaatgtttttcagtttgctttcccttagataatcttagggtggattaccctggggggtgactctggctcattcctcaataatcactaattgactagcaagaagatcccttaaaaaaagtcacgaggccaggtgcggtggctcacacctgtaatcccagtgctttgggaggccaaagtgggctgatcatctgaggccaggagttcaagaccagcctggtcaacatgttgaaaccctgtctctactaaaaatacaaaaaattagctgggtgtggtggtgggcacctgtaatcccagctactcgggaggctgaggcgtgaaaatagcttgaacccaggaggcagaggttgcagtgagctgagatcacaacactgcactccagcttgggcaacagagtgagaccctgtctcaatacaaaaacaaaaacaaactgattgggagctctcaccctgtggatgggcctgacctggataggctgtttgttggggaactcccggtgtcagcatatttagatttttcttcttggtctctgattccccagaaaggtcttcttttgtctgctgtctgggagataaaggtctggctaccagaattctgggaactgactggatgagatgagctgacagtgggttctcaacaagctttatgcccctcttattcttttttttttttttttttttgagacagagtcttgatctgttgcccaggctggagcacagtagcatgatctcaactcactgcaagctccgcctcccaggttcacgccattctcctgcctcagcctcccgactagctgggactacaggcgcccaccaccatgcccagctaattcttttgtatttttagtagagacagggtttcactgtgttagccaggttggtctcgatctcctgacctcgtgatccgcccgcctaggcttcccaaagtgctgggattacaggcttgagccactgcgcccagccacccctcctattcttttaagttccagaggcagctggtgctgccagttcctgaaacttttgaggattctgctgtgtacatttggttggttttcactgctccctaccaccagataaggattccgctttcatgggcctactaagtcagttacaacgcatctattgtagaaaataaggcgacagactcagaatgtaaaaacacaactttatcatttgtaataactgcattccaggaaggaaggaggggagtagccaccagccagagactggggaccaccacgcccgagtttctttcttttttgagacggagtttcgttcttgttgcccatgctggagtgcaatggtgcagtcttggctcactgcaacctccgccttccgggttcaagcgattctcctgcctcagcctcgtgagtagctgggattacaggcataagccaccatgcatggctaatttttgtatttttagtagagacggggtttctccatgttggtcaggctagtcttgaactctcgacctcaggtgatctgcctgccttggcctcccaaagtgctgggattacaggcatgagccactgcgcccagccctgagtttcttaacacagcagagcctctggctcttttggccacttgtttttctttctcactgagaggaaatagagtctcctaagagaaagagttttggaacaccacaaatccaggaatttaatactgaactagccctcagctcactttgaagcaggaaatcaggtgaggctaaggtcatgccttctgactggataaaccctcccggacccaggagacatcctcacctgcccggaccccgggaggcatcctgacccttgcggaccccaggaggcatcctcaccctcctggaccccaggaggcatccttaccctcggggaccccgggaggcatcctcaccggagcaatctttggtatagaacttttaactaaattacacagtgtggagagacaagcttcagtcatttctccactacccactcagtgcctggcggaaggcaggcagcacagaccttcatcccaacgcacgaggggaatattcaaatcatgccttaggggcacagggaagggagtcagagactgccccgcctgtgattttgatacaagtagacagatgatctgagagaacagcctctggtctagatgatttcagtggaaaagaagaagaaagatccatgtggaaactttgtaaacgttttatgacgggaaaagacaagtgtagcatttaggtaaagaagaccagcacagagaaaaccatttatcattctaacataaaatgatcaaccaagagctcaaatgtgatgtaatgtgagataacagaatgaggtggaaaatggcctagcaggggaattcaaaaacagcaaatcatggcattgcagaatgaataaaccaattttacaccataagaagcagaatcttcgctataaaatatggaaattgcttgagaaatcacgcagcctgcatattcatgagcattagtgctccccgtgtttcttttggatttttcgcgtcttctcttcctggagctccacctccttcccgtgctcgatctttggccccaaccccaaaaggatgttttcttttcctggtatcttactgtagccagttccacaggttggggaaaggaagccctcttaacactggccctttgtgtgtgtggatgggtgggtggggcatttcctgccttctggaagcttccctggggcttttgtcttatgtgggtttgacatcaatagcatggctgaattgagggttccagagggagcgtgagcttatggccttgtcatgttgtgtgggactaaacatttcctaatatctcagatctgtagacctgaagcaggctaaatcttagagcagaacagattgggctggtcagaatcttggacttgaaaataagacagagctgaacttggtgacatgcacctgtagtcccagctactcaggaggctgaagcaggaggattgcttgagcccaggtatttgaggccagcctgggcaacatggtgagactcatttcaaaaaagaaaagaataggatgactgtcaccaccatggtcatggataaatcatgtgatctctcctggattcagtttctttataagatagactgcatcagaatttctcagtgttggcactattgacattttgggccagatgagcttgtgccttgtgggatgtttagcagcattcctgacctctacttgtagattcccatatcatcccctagtcgtgacaataaaaaatgtatccagacaatgctgaccttcctcttgggggcgcaaaatcactccctgttgagaaccactggactaggtgatctttttttttttttttttttgagatggagttctgctctagttgcccaggcaggctggagtgcaatggcgtgacctcagctcactgcaacctccacctccctggttcaagcgattcttctgcctcagccttctgagcagctgagattacaggcaaatactaccatgcccggctaattttttgtatttttagtagagacagggtttcaccatgttggccaggctggtctcgaactcctgacctcaggtgatccacccacctcagcctcccaaagtgctgcgattacaggcgtgagccactgtgcccggccccactggactaggtgatcttatgtctcctgtctgctgctgggtttctgggattgtatgaaacactccattcttttcctctctctttagttttagactcatctttaagtccttagggaaactcccattcaagccaagagatgtgatttggagccattaaatgctgcatctaccaatttaagatgctagccacatcttgggttcctgccaagatcaagatacatattctgggtttctgcagttgaaggaggaattcctgcagccatcgcagagtctgtagtaggagcacaagcttttttcggagacacagatgtggctgggcgggtggctcatgcctgtagtcccagtactttgggaggccgaggcgggtggatcacctgaggtcaggagtttgagaccagtatgaccaatatggtgaaactccgtctctactaaagatacagaaattagctgggcatggtggcaggcgcctgtaatcccagttacttgggaggctgagacaggagaattgcttgaacctgggaggcggaggttacagtgagccgagatggtgccactgcactccagcctgggcgacagagtgagactccgtctcaaaacaaacaaacaaacaaacaaacaaacaataaaacagacacagatacaggttgacaggccaagtgggcattaacagatgaggactgctgctgttggtaatgtataagggcaatgtcttttctatctttttttttcctggtcagctgtagtcatgtatctttttttttttttttttttttttttttggagatgaagtctcactctgttgcccaggctggagtgcaatggcacgatctcggctcactgcaacctccgcctcctgggttaaagtgattctcctgtctcagcctccccattagctagggctacaggcgtgcatcaccacacccagctaattttttgtatttttagtagagatggggtttcaccatgttggccaggctgttcttgaactcctgacctcaagtgatctgcccgctttggcctcccaaagtgctgggattacagacgtgagccaccgtgcctggcccaggcttcccaaataactgaatgctggtatcactgtggtgtataaaaatggtcctcattttccagtcctttcttttaaagatgtccttatgtagcagagctttatgtggtgagagtagtgtttgctcccctggaaggttactatttcacaatttttgtctttctttggtatttttgcttcaaaatatcaacataactcaatagtgttgatgacaataagctgttgattttaagaagatatgaattattggatttccacttttgattgatttttccatttgtgtgtattttgtaacgtcacagctccttttatccaaggaacgttgtttcaggcaacataaggaagaaataatttccctttagaactgaggggaggtgactgctgcctctaacatatacttaggaactcctatttttcatctccactagccctggtttgagattttttttttttggagatggagtttcgctcttgttgcccaggctagagtgcagtggtgtgatctcgcctcactgcaacctccgcagttcaggtgattctcccgggttcaggtgaacctgaacctgaacttctcccgcagttcaggtgaacctcccgggttcaggtgattctcctgcctcagcctcccaagtagctgggattacaggcatgagctaccatgcctggctaattttgtatttttttagtagaaacggagttttaccatattggtcaggctggtctcaagctcctgacctcgggtgatctacccacctcggcctcctaaagtgcagggattacaggtgtgagccactgcgcctggctgaagttatttttatttatttatttatttattttttgagacagagtttcactcttgttacccaggctgtagtgcaacggcatgatctcggctcaccgcaacctccacctcccgggttcaagtgattctcctgcctcagcctcccgagtagctgggattacaggcacccaccaccacgctcagctaattttttgtatttttagtagagatggggtttctccatgttggtcaggctggtcttgaactcccgaccttaggtgatccacccgcctccacctcccagagtgctgggattacaggcatgagccaccgcgcccggccatggctgagatttttttttactaatcactttgaaggttcatgagtctttgcttagagattttctggctccttcactttttggctccaaaccttataaaacagggatataaaataaaaaatgggagtctctcttgaaagagaaagtaaatagtcatttctgtaaccctacccagtatctttatggacccgaggttaggatttggtttctcggatactaggcatttatcatcaggcactctctcggatattggcagtaacccaggttttgtatgttacagcgttggacatttgagtcttatgcaatctttgggtgtgctcagtaggccgatgtaatcaaatcattgttaacccatctctacacgttttaaagcttgtgacaactccaaacaattagccctcacccttttttctcactacccattacccaaaaatcaaacctaaatagagatgttctcagattataaccaggctaattagttgtcattcaacagttacagggagtgatacccagtgcttgccctgtggctgacaatttgagatctctattttggtctctcccacttcccacaaatacaatttagatataaaattatagtaaattattctagataactaatagttgatagagttactgtcttcaaatgaaggcactatggaacagttttatattaagcataactgcatttgttttgtttttgtttttaaaaattttttctagagacagggtcttgctttgttgcccaggctggtctctaactcctggcttcaagcgatcccactttggcctcctaaagtgttgggattacagccattgtgcccagccagttttttgagtttgaattttaattttttatctaaaattctctaatgattttagaaacagctttattgggatataattcacataccataccattcacccatttaaagtgtataattcaatggcttttagtctattcatagaacagtgtgtccatcatcacaatcaattttagaacactttcaattaccccagaaggaaactccatattccttatatgtaacccctaaaccccccatctctcctgctgtaggcaactactaatctcctttcaatttgtatggctgtacctgttctggacattgcatctaaatggcgttacataatatgtggtcctttatgactgcctgcctttttttgagacggagtctctctctgtcgcccaggctggagtgcagtggtgcaatctcagctcactgcaagctccgcctctcaggttcacaccattctcctacctcagcctcctgagtagctgggactacaggcgcccgccaccacgcctggctactttttgtatttttagtggagatggggtttcactgcattagccaggatggtctcgatgtcctgacctcatgatccgcccaccttggcctcccaaagtgctggtattacaggcgtgagccaccgcgcacagccatgactgccttcatttacttagtgtgttttaaaggttctttggtcttacaacatttattgtacttcactcctttttaatgactgaataatactccattgtgtggatatactgcacttacccattcacccgtcagtgggtgtttgagttgtttccactttttggttattatgaataatgctgctagaaacattcatgtacaagtgtttgtgtagacatatgttatttatttatttttaaaatttatttattattattttttgagacagggtctcactctgttgcccaggctggagtgcagtggcactatgtcagctcattgcaacctctgccctctgggttcaagcaattctcttgcctcaggctcccgagtagctgggattacaggtgcctgccaccatgcctggctaatgtttgtattttaagtagagacagggtttcaccatgttggccaggccgatcttgaactcttgatcttaggtgacccacctgcctcagcctcccaaagtgatgggattacaggcatgagccaccacgcccagccaacatacgttttaatgtctttaggatatatacctaggaatggagttgctggatctctatgtttggttatttgaggagctgccggcctgttttccacatcagctgtaccattttacattctcaccagcagtgcatgacggtccagtgcctttttatcttactgcgcttaaggtgtaattccttctttctcagactggactgtaaattctttgaggtaaatacattgatttatatgttgcttgtatcctctattgccttcaagtggttatgtgcattttattgtgcaattgctagatactttgtttctctcagcgtcagtgttttactttgtaaaatgagggtgctataattcttgacctctgagggctactgggagctttaaatgagatgatatatgtaaaacacatgaggaactctctcacatgtagtcaaccttcaatatgtttcagatattgctattattatgggcattttttttgttattgagagtaaattaacgattgagttttttctttattttgaggagtcttgctttgttgcccagattggagtgcagtggtgcaatcttggcttgctgcaacctccgcctcccaagttcaagcaattttcctgcctcagcctccctagtagctgggattacaggcacctgccaccaaacccagctaatttttgtatttttagtagatatggggtttcaccatgttggccaggatggtctcaagctcctggcctcaagtgacctgcccgcctcagtctcccaaagtactgggattatagatgtgagccactgtgcccggctgactttttcttttttttcttttttctttttttttgtttttgttttttttgagacggagtctcactctgtcatccaggctggagtgcagtggcacgaccttggcttactgcaacctccgcctcccgggttcaagtgattctcctgcctcagcctcccgagtagctgggactacaggctcacaccaccatgcctggctaatttttgtatttttagtaaagggtttcaccacgctggccaggctggtctcgaactccagaccttgtgatctgcccgcctcggcctcccaaagtgctgggattacaggcgtgagccactgtgcccgccaagttttttctttataagagctttgaaaaaattttggctaaggttgtaatatctcaatcagacactggttaaaaaattagcagtaggggaattatcagatggtggaccttcttccaagcccccagcaagttcattaaactgttaaatttcctttgggcactgatcactctccgaggcgatggtgtttatttctttgtgtttataggcagtctctcccttccacaccagagtgtaggcattttgtttagcttgctcatcatggtctttctgatgcctagaaggatgtctgccacatagcagctgttcaataaatattgtggaatagatgagaaaaaatgtatgcagagaaaaaattagaagacaggagacatattacaaaccccatggaggaacaataaatcactagattcttccttattaggaacgtaaaaatattatttaaaataggtgataatagggccagtgatagccaacagggttaagtactgttgtaaacactaagctaagtgctgtacaggcagtcacttatttaatcctcacgatacccctatgagacatttgcggtccttcccattttacagatggagaaactgtgacacacagagatttaataacttgcacaaaggcacagctaatgagtggagaagcagggagttgaactttaaccatctgtctccaaaacccatttgaatccctttgctttactctgtcaaggtgatcatagcaatgtagcacaacaaaggacagctgggttcagtgtcagagtctagcccatgctagagccagagagacgacatgtgcagtgggaagaacatgcggacaggggtccagagaatagttgctcatgctagagtgaccaattagtggcttacccactccagatggctgtcttctgcagggagtatctcaatccccaaattgagacctgagacctgggacctggaacctggccttagctgatctctgaggttctttccaatattaaagttttcaagccccaaagaagaatagttgaaaattactttgcctccccaggctacaaggtgacatagatcaaaaaattttattagcctcctgtgttagtgtttatgtttacaataaagtcctcactaatttgattggaataaatcagcaggtctccatgtagagactgtcttatgaatacatttaaggagatttgtgcaaattattgtatgttcatactatggaatgctatgtagtttgaaagcatgtggtaggtctgtgtgaaatgatacaagagaaagtctataatatattgagtagaaaatgtaattgcagaacaatgtgtatacgtgtaatatcccaaccaaagagctgtgtacatgtgcatacctccccacacctgggtgtatgtgcccaggaaaggatctgtaagggcacacccgaaactgttagtggctgttttccccgcaagagtagggggaaggagggaaatttcaccctgtatttatataatctattgtttgatttttttttacaagaatgtgctacttttttattattaagaactacataggctgggggtggtggcacatgcctgtaattccagctactcgggatcctgaggcaggagaatcgcttgaactggggaggcagaggttgcagtgagccaagatcatgccgttgcgctccagcctgggcaacaagagtgaaactccgtctcgaaaaaaaagaactacgtaaaggcaaaaagttaaagtggtttataattaggttaccaatagtgtgtgtataaatgatatttccaagaaaggaaacttgagagtacttggaaggcttgttttcaagtatttgtaccatttcctgcaatcttgttgaacattaacttattccacctgggaaaatgcagttgtttatcaaggagacccttcagccccacacgagacattcagagaaacttggttgctgtctttgctgtcaggaaagaggaagactacctagacatgttgctccagagcagaatttccagcagtagattgaaccttcggaggccgagtcccagcccagtgtaaactggtaaagagtgagccctcttcctacaatctggttattgctgctgtgtaaaaagtcctcttgatttttatgtatttatttcttatctgctgccttactaaatgttttaatgttgctaatcattttgatttctgcagatatatatcattattactaatattgtaactcattttattttctaatctgactgaatttttggatacatgttaaataataacaattttaaaatacagacctgtgtgccctgttgtgactaaaatgcctttgactttctatcggcctctgcttgtgcttcagattaactcacagatagccaggggccactctctgccctctcagaaggggacgggggtccttatgttcaactttatattttctttctttcttttttttttttttagtttgagacagggtctcactcttgcccaggctagagtggtacagcagcgtcatcttagctcactgtagtctctgcctttcaggctcaaagggatcctcctgcctcagcctcctgagtagctgggactacaggcgcgagctaccacacccagctaatttttgtattttttctagagacgggtttttgccatgttgcccaggtcaaactttatattttcatttaggattcgtatacattggtgctatagtgccattattccaaaaatgtattcatatgtttaccgcaggtcagagaagttttgaaatttttggtgaaatatccatgtagtttgctatctgaatatctttatgattatttaaaaactattttaaacatttgtttccttttttttttttcttgaggcagagtcttactctgctgcccaggctggagtgcagtggcgtgatcttggctcactgcaaactccgcctcccaggttcaagcgattctcctgcctcagcctcccaagtagctgggattacaggcacccaccaccatgcctggctaatttttgtatttttggtaaagatggggtttcaccatgttggccaggctggtctcaaacttctgacctcaagtgatccacccacctcagcctcccaaagtgctgggattacaggcatgagccactgtgcccggccacatttgtttccttttaagaggatttttacattatgttaaaaatcttgattggtagaagttatatttcataattttcttcttcctttgtatgaataatatgcttttatagtgatgtcacaagaggtgccttttgcagagtgcctcatacgtgtcactggactaagtaagcattttatctcattaatcttcacaacaggctattagagtattataattttaattttgcagatgagaaaactgaaacttaaaatgttttaaacttggcaaggcacggtagctcgatagctcacgcctgtaacctaatccaagcactttgggaggctgaggtaggtggatcacctgaggttaggagttcgaaggcagcctggccaacatggtgaaaccctgtctctacaaaagacacaaaaattagttgggcgtgatggcgtgtgcctgtagtcccagctactagggaggctgaggcaggagaatcacttgaacccgggaggtggaggttgtagtgagtcaagatctcgccattgcactccagcctgggcgatagagggagactccttctcaaaaaaaaaaaaaagtcccaaggtcacacagccagcaaatgcctgaacctggatgtcagccctggtctaactttagcgcttccttgggcatttttgggggtgatttctgcttgagcagccagcattaccccctcagacccctggagttcagtcaagaggatgccttttagaagaacgtctactgttgagtcagaataactctggaaattccctgtactctggattggtaaaaagaggcagggagttgtgggctgaggttggactctcttagttccctcagcagcatgaaggcaacttctcccaacctggggaaagtggatcctggtgcctctgtcctgggcagtgtggtgctctggggctactgtgtggaatcttggaatcgcctgtggtgttgactttggttgcacttctcctaagcttctggctcatctaatattagtcacgctacttcaggtgtttgcatgtgccctgggctcagggcatcgggcatctggcatatgtcactgtggagggcagttgtgagtccctcctgggctgtgagggtggggcttcatagggagctgcaagccttgagcagtccctgtagcgatccctggagcctgtgttttgggactccagttgaaatattgggtgcatttgaagatgtcccagatcatcttagaccaccggccatttttctcaggacatggcagagatttgccaaggttgggagtcacccaggacctagaggatgtggttgagaagggacctgctttcttactcatttggccatgagggaagcagagtccaccagggtcttcagtattacggaggaactgaagctgctccggtcttttaaacacatccccgtagactagctgggtggtggagcaggcatttggctgtagatacacatggtttggtatgcggaagtaagacctcctggctggacccacttcagaagtcttcattgtttctctccacatgaagaggacttaggaaggagatgaaatgagattgccagggattgtgaggaggtagcccaagctacttgattcttaatgctaaactgagctctaatccttgtttccttttcagtattggattagaaaaatgtagggcaggattagaattggctgttaacaatacccaggacaaacatatgccctgagaactttggaaaggaaataacttcctaggaatggtggcagctgcagtggtaatttatatgtgtcttttaacacttgtagtacttggttttatcttttgattatatctctgcctttccctatcaaaaggcaacttaagtgtaatttttttcagtgaatttatattaatttttagtggcaagaaaatatattcatcctcaataatataatacattcaaataaagagtgaactatactgttttctgctgtcattgtggcaaagattaaaataagtaaacctcaagatattttatcagttagtatgttaatttggagagccacatagtactgatgagggtgggagacataattttggaaagtaattcagcagagtttatcaggaccccagaacatttagatgttttaccaacttattccatactcagaaagctaccctaacggaataatttgtgctaagaaaagccctggccacaaagatggtcgctgacacattattttgagagcatttttcttatgcagaaagcttgggacaacattggaaggcacaaattggcaagtaaaggttaattataaatttattgcacaaaaataagcttttggtatgagtttttctaattttcctatgcatatctgctttaaaaatagttgtagcatgcttttttcacccttagccatatattttgagcattttcttcctcgtttgtactcatatatgaaaactctaaccttagttgaaaccagccttcctttcttgcacctggacagccgaacattattgggaaaaaacattactaagctgcctggtttaactttaaattcacagtcatgaccatcaaattagtccttagtactgtctgtaaatgctaaaacatttccacagtaaattgactttcccaatctctgggaagatatatgataccttctttcttcaaagcttccatatataacaccccttccccactcttagccaatgacttcatctccaacagggaaacccctcacctctgccaccgtgtctccaagcccatctgtggctttcctctccttcacacaggatgcctcctgtcccaggtcaagctttcctcttgtatctcagctccaactcctccctcttcctcagggacctcagtctttcattactccatcctctctcctgcatcgtcactctccccttcccttttgacttattgccagcatcactaaaaatgctataatctttcacatctttaaaaacaaacaaatcctacccttgcatccatgtctttatctaccctgttagtttttatgccttttctctgctaccttttaaagcaaaactcctttttttttttttttgtcacccaggctggagtgcagtggcacgatctcggctcactgcaaactccacctcgcaggttcaggcgattctcctgcctcagcctcctgagtagttggcattataggcacgcggcaccacgcccggctaatttttgttttttgtttttttttttttttttgagacagagtcttgctctgtcaccaggctggagtgcagtggcgagaattggcttactgcaacctccgcctcccgggttcaagcgattctgccgcctcagcctcccgagtagctgggactacaggcccgccacctaatttttgtatttttggtagagacagggtttcaccatgttggtcaggctggtctcgaactcctgacctcatgatccacccgccttggcctcccaaagtgctgggattataggtgtgagccaccacgcccggccaaagcaaaacttcttaagagttgttgtctgtcttgtcttcctcctctcccattttagtctggcttcattcttattatttcactgaaacgctcgtcaaggtccacaaagaccatgtccatccatctcactgctcctgtcagagtcattttctgcagccttccctcctgcctctatttgataagtccccagtgtttcactccagctgaggctgtgcttccaagcccaagagctaactctagctacctattcagcgtcttcccttgaatgtgtcttagccatctcaatcttaaaacaactaaaatagaactcctgatgttctacagaccagttctccttcctctcaaactctctgaatgctacatcaatttcttggcttaaaccaaaaatctgggagttggttatgtttcttttcttttctgccacatccagtgtatcagctagccctgttggttttacctccatagtgtatatcaaatctgcccacttctcaccatctcctctgccactgtcatgcctggactgttggaaaggcctcctgactccaccccctgcttccattcttgccccctccttcttgtctctctgtagcacatcagattacatccttaccttccatggctttccaatgcctttcagataaaatcatactccttatcaaagaccacgaggctctgtatgatccggcctccaacctcagcgtatatcatcttcagttcccagaaaatgtcaatctcattttcctttttccacaagactttgtactgttccttctccttttcctagttcttggctgacttcttcctcgtcaggtccaacttgcttagagtggccttgcctgaccccctatttaagtaggctgcccacacccttttaaaaaatcgtagcaccttatttatttaattcggagcacttatgagaagatgcaattgctcttttcagttagtggccgcctccttccctagagcagcagctccacaggagctgagcagcacagtatcttgttcattcgcagggtttagcacaatggctggcaagtagtggttactcaacaaatgtttattgagtgaaagcctgaaagaatgagtacatattttcccaaattattatttccaatgggttcatagtattccattgtacaaatgtaacctaattaagttaaccactgccctattatggatatattggtttctagtttttcactacactgaaacatgcgaagtaatctaaatggctattgggaatattgttgaccatgaacaattattcaggccttaaaatcctagaaagtgtttttattaaaatgggtgagttgagtacattaagtgaaaaaagcataatataaaattatatatctacagcatgatttttttttttttttgagtcagagtctccctctgtcacccaggctggagtacagtggcatgatcttgggttactgcaactttgcctctcactgaagcagtcccactacctcagcctcctgagtagctaagactacaggtgtatgccaccatgactggctaatttttgtattttttgtagagatggggtttcaccatgttgtccaacctggtctcgaactcctgggctcaagtgatttgcctgccttggcctcccaaagtgctgggattacaggcatgagccaccgcacgtggccaacatgatcttaactatgtaaaagtgcatagaaaaagctagtatgaaataaaactaaaatgttaattatgcatttcaagttgacatgattacagataatttttcttttagatttttttttttttttttttgagacaaagtctcactttgtcatccaggctggagtgcagtggctagatcttggctcactgcaacctctgcctcctgggtacgagcgattctggtgcctcagcctcctgagtatctgggattacaggtgcgcatcaccacatctggctaatttttttgtatttttatttgagatagggtttcaccatgttggccaggctggtctcgaactcctgaccttaagtgatccgcccccatcagcctcccaaagttctgggattacaggtgtgagccaccgcgcccggcctgattgttttgttttgttttgtttttatcttttttatttatttatttatttttttttttattttttttgagacggagtcttgctctgtcgcccaggctggagtgcagtggcacgatctcagctcactgcaagctccgcctcccgggttcacgccattctcctgcctcagcctcctgagtagctgagactacaagcacctgccaccacgcccagctaattttttgtatttttagtagagacggggtttcaccatgttaaccaggatggtctcaatctcctgacctcgtgatccaccctcctcggcctcccaaagtgctgggattacaggcatgaaccaccgcgcccggccgttatcttttttattttaagacagaatctcgctctgtcaccaggctggagtgcagtggcacgatcttggcttattgcaacctccgattccctggttcaagtgactctcctgcctcaccctcccaagtggctgggattacaggcatgcaccaccatgcccagctaatttttgtatttttagtagagacggggtttcaccatgttggccaggatggtctcgatctcctgacctcgtgattcacccaccttggcctcccaaagtgctgggattacaggcatgagccaccgtgcctggcctgattgttttttaagcacatgagtaatacattgaattttttcttttcttttttttttgagatggagtctggctctgggtctgtcacccaggctggagtgcagtggtgtaatcttggctcactgcaaccttcacctcctgggttcaagcaattctcctgcctcagcctcctgagtagatggtataacaggtgcacaccaccatgcccaactaatttttgtatttttagtagagatgaggtttcaccatattggtaaggctggtctcgaactcctgacctcaggtgatccacccgcctcggccccccaaagtgctgggattacaggtgtgagccactgtgcctggccagaatttttcctttatacttttctgtgttttccaagtttactgctgtgtgtgtgtgtgtgtgtgtgtgtgtgtgtgtgtgtgtgtgtgtgtgtatgtgattactgtgattcagtgattactgaagatagtcaaaagcagatttaggaaccatcgagccctagagaattgtctaactgtctgaaccatacatgctgacaacagctcttgcccttcaagttgctccaggtgtgtgttactcaggtttacagagtagcaagagtggactttcctatggagcctccacagctggtcaggtgtgtgtgtgtgtgtgtgtgtgtgtgtgtgtgtgtgtgtgtgtgtggtggtctaggtaacggggctcattaaaatggtgatttggggataagagtgctctggagatgtgctcagggttttgaacatttcacaactgctcctcacatctgtttttagagcttgaggagggctcatgtggcctgaggcattgtcacagcctttacccacttaactttaggcagtggttctcaaatctgagcccttctgggggttcatgaggtcaaaactatcttcatactaagaccaagatgtggtttgcctcttcattctcattctctcacggggcacagcgaagtttcccagatgttatatgtttcaggacatactggctgcagaagcagatgggagaagccagaagtagacaggagaatgtctatgaggccagacattaaggagggttgcagaaatgtaaaacaatcccagctgtctccctaaaaatgttttattatgacaaatatatttatttttcattaaaatgcaattaatgtaacatatgagtttattatcttaaatgaattaatattgttaaaaatttctcagtttagtttccaatacaataattaagagcgtaaagaagttatgagaccaaaaagtttgaaaaccactgaattaaggagacaggaagagaactttctttttttttttcaatttttgagacagagtcttgctttgtcacccaggctgaagtgcagtggtgtgatctcggctcactgcaacctcagctcccgagtagctgggattacaggcatgcaccaccatgcctggctaatttttgtatttttagtatagatggggtttccccatgttggccaagctggtctcgaactcctgacctcaggtgatctgccccctcagcctcccaaagtgctaacttgttcatcactgaatccctagcaccaattacaggtgtgagccaccatgcccggctgagagctatttttatggtgggttggttatggctcagtaaaccagttggtgaattgcatgattcagaaacacaaagcctaaggtgggaaatgaccttatctaacagagaggtgtagacgtctttgatattacattaatttcctctctctctctctctttctccttttttagagattatgcatgatgtgataaagaaggtcaagaagaagggggaatggaaggtgagtagaaagtacagttaatgggcttaaggtgagttcacatggaaaaatcagaaggggatggagttggaggaaagttgtaggcaggaatgagggcttttgctgtgtccagagagtacagaatgctcctggattggagaaaggtgatctgctctgcctcacatttcatatggtcttggttaagaattctgtttgtcataaagcttatcttaaagaccacctggtcaggcagttagcagtggaactcttttgttcaaacaaaatattacctggaacccgttagataaagcagaggaaggtataattctgctggctctgggagaggaagaagaggccctcttgcccctttgtggccataaagcatctccatggagtccatgtacagtttgggctcaaagccctcatctggtctatcctcattgaactgtaactacataagacaaaaatagtaagctcgtttaatcacgtaacattgacaggagtgctggaaactatagtgtacttgaaacaagtatttaagccaatcaaactgagagtgggccgggttcctggaatgggtggtacaggagtggcacctgctgccccctatgcatgaagtcagcattttaaggactgcttggttgtctaaggctgagaattatactggccagaagagtgtgcagttttacttgattttttctgcatgttgctgaagaatttataccaacctttcttgccatcaaggtttcctgcagtcaaaagcccatgcagtttcaagtgcattgggcctaggaacaacagagctgattagtacaggaggattttgaagtctcacccggggcctttgttttaaccagcacatctgtcctcgccacccagaaggggaggccgtgcagtgggcctccccaccgcatacctttagcatacctctttagcatacctttctcacttacccttcccatcagtgacgggcttgtagacatgtgaattttaaactaatcttgaggaagctgccttatataataaaaactaattgacccctgtactgcagcagaaagctttctcatccacactatctgccctgatgtgtcttcctcctgttgcccccttctcagtttatagcattacaaaaagagaggataaatagccttgttttaactgccagcttcctctccactgtgggctgaatgaagataagaaaggttagctgaagagttgcaggtctgaagcttttaggccaggactggaacgttcttgttcttccagcctagactaaggtacactatgtcccagctgacatgtgtgttagtggcacagttctgatgatgcttttcatcaagtccccacatgccagaccacatgtgcaggcgctagtgttcactctccccttaaacacaagtgcatgccgtgaaaaagtactcactaatatgattatgtctgaatgttggagctatagatgatatttcctttatttatttatttatttatttatttatttattattattattattattattatgagatgggatcttgctgttgcccaggctggagtacaatggcgcgatctcggctcactgcgacctccgtttcctgggttcaaacattctcctgcctcagcctctcacgtagctgggattacaggtgtgagtcaccacacctggctaatttttgtagagacggggtttcaccatgttggccaggctgatcttgaactcctgacctcaagtgatccacccgcctcagcctcccaaagtgttgggattacaggcatgagccaccatgcccgactgattttttttccttttttaaatgggtatttactttgtcatgggaaataaaaactatttttttttaagtttataaaattacatcagtgagaggaaactctaactcctagaaagttaggttagggtatgggaggtacaagtgagcatgtgtccccgtgggcttctggtccataggaaatatggtttcttctgtattctgtacttctggagctccttttggagtctgatgcggtaagctgagcgagaatcacagcagatgccatgaagcccatacgctgttctctttccttgcaggtgctggtggtggatcagttaagcatgaggatgctgtcctcctgctgcaagatgacagacatcatgaccgagggcataacgagtgagcatgcgctctgcacttgagcagtgctggagccttctctctgtggcgggcttagctctttcctattcattattatctcctttgattttagattcttccagcaacctgtgtgctaagaccagaagctcctgagaggcgcaaggctatcttgttcatcactgaatccctagcaccaaatccagggctagatgctcattcaatgtctgttaaaggaatgccaaaagaagggttaaatcaagaaagaaaaggcagcccacccaatagaaaaaagttctgagcaggcacttaacaaaagaagaaatccaaatggccaatcaatctatgaaaattgtccactgtcattagtggtcagggaaatgcaattcaaaccagagtgagatgccgatatagattcaaaatattagaatatttaatctctgataatgccaagtgacggtgaggaggtagaaaaatggaaactcctacgtgatggaatgtctgctggtgtagcccctttgaaaaccacttggcagtgtctagtaaagttgaaggtatgcatgtcctgtgagccagcaagtctgtggtcaggtgtgtgtcctagacaacctcaggtatgtgtgcccaggatacatgtgcaggaatacatgtgcagtgttgctcataggttccccaagtggaaaataaccaaaacgtccatcaagtgtagaatggttaaatcagttgcgtgcaattacacagtagaatactctacagggatgaaaatgggcgagccctgagcgctcacagtaacatgaatgcatctgatgaacaacggtgagcaaagacagcaagacacgaaagaccactgatagtgagccttcattccacagagttcagaccgcagagctcagctgtgttgttttaaaatgcagatgtaaggggtaaaacctcaagagaagagctcaccattcaagggaggataatgattctgtttgcggggaagagaggaaatggtgttgatagaggggaatgtgagctggagccagggcacttttgtggtgctgattgggtttcgtttcttaactggggtagcgcttatttagacatttgccttatggttatttgtatgtttatgttttattcacgctttggaatgtgtgctataacttttggtgaataataaggagcaggattgctggatcacatggtaagtatgcttagttttgtaagatactgccaaaccatttttcaaagtggctgaccattttgcattcccagcagtagtgaatgagaattcctgttgctccacatccttaccagcatttggagttgtcagtgttctgaattttgagcattctaccagctgtgtggtggtatggtattgttgttttaatttgcatttccctgatgacctaggatgtggagcatcttttcacatgcttatttgccatctgtatattgttttttggtacagtgtctgtaaggtctttggcccgttttttaattgggttatttgttttcttattgttgaattttaagggatatttgtatattttggataacagttctttatcagatatgtcttttggaaatatttgccctcagtctgtggcttgtcttttcattctcttgatggcatcttgcacagagcagtactttttaattttaatgaagtccagcttatcaattcttgttttcatggattgtcactttggtgtcatatctaaaaagtcattgccaaatccaaggacacctagcttttcttttatgtaatcctctaggaattttataatttcgcattttacatttaggtctgtgatccattttgagttaacatttctaaagggtataatgtatgtgtctgtattcattttggttgcacgtggatgtgattccttcatttttaaaaaacagatccagtatatctatcagcagaagcacagtcctgtaaatggcatacacagtttttttgtttgtttgtttgtttgagacagagtcttgctgtctcccaagctggagggcagtggcgcaatctcagctcaccacaacctctgcctcctgggttcaagggattatcctgcctcagcctcctaagtagctgggattacaggcacctgccatcacgcctggctaatttttgtatttttagtagagacagggtttcaccatgttggctaggctggtctcgaactcctgacctcaagtgatccacctgcctcggcctcccaaagtggtgggattacaggagtgagccactgcacttggcacacatacacaattttttatgtgacttttatgtcatttagtgacctaagtcagtgtgttttttgtttgtttgtttttgagacagagtcttgctctgttgcccaggatggagtatagtggtgcaatcttgactcactgcaaactctgcctctgggattcgggcaattctcgtgcctcagcctcccgagtagctgggattacaggcaggcgccagcacacccggctattttctttctttttttttttttttagtagagacagggtttcaccatgttggccaagctggtcttgaactcctggccccaagttatctgctcgccttggcttcccaaagtgctgggattacagacgtgagctactgtgccctgccccaagtcagttttaagactaggcttgcccctattttgagtttatgatgttattttcttcattgaatttttgaaactatttttttcgtctatcaaagcaaaaacagacaaaaaacacaaaagtaaaggagaaaaacactaaatggagctaacaaggatctaagaaaagagcagtgacctcctgtcctcctatctcccatcctcggggtctattaccccagaggcagccacctcgcccttcattctggacatcttttttatttttctacataaatgcttgttctattttctcttgattcagtgatattagatattattaactgacttcctgtgggagatggggattcagagctctccactatacacagactcttgcctacccccaaaagtggtttttaaaaaatgtccttatggccgggcatggtggctcacacctgtaatcccagcactttgggaggcagaggcaggcggctcacaaggtcaggaatttgagaccagcctgtccaacagagtgaaaccctgtctctactaaaaatacaaaaattagccaagcatggtcgcacgtgcctgtagtcccagctactcaggaggctgaggtgggagaatcacttgaacctgggaggtggaggttgcagtgagccaagattgtgccactgcactccagcctgggcgacagagcaagactgtctcaaaaagaaaaagaaagaaagaaggaaagaaaaagtgttcttacttaacaaaatttaaaagttagcaaccctatgttgaagctctgaaacattttggggggagatattagtggcctatgaaattaaacaaatctataaccactggtaaagtagatgtttggggatttttggtattaatttgaacattatttaaggtgaaagtctttataaatattccaagtctttataaatgttacaatcctctaaagtgatgcttttatctgcttaaatgatctgcatagaaagaatggcacctgtataattgccttgctctctcaatgccagaggacagtaggtaacacattttaagcattaccgggtgattggtaagattctcccaaaagctgttctttccaggtgaagtccctgacataactgtagaggaaacaagcaaaccaaagcctatggtttgttttaaccaaatagaacatttaatctttgcactattgaaggaagcaatattgtatagagaatgtggttggaatgccctcatttgatatgcagaggagagcaatgaaactatccagctgttgataaataaacccaacatggaaattccaaaggaattgggattatctagggcagatgagacaaagctgaagaagaggcaaaggacccattcttgacagaattagatatcattttccattttctctcagaacagatcaatgaatttacttaaactgaaatgggaagtgagaactatctagtgtgaagatttcagatttttctttgttgttgtttttgtcgttgtttttgagatggagtctcactctgtcacccaggctggagtgcagtggtactatcttggcttactgcagcttccacctcccaggttcaatcgattctcccacctcagcctcctgagtagctggaattataggcacattccaacatgcctggctaatttttgtagttttttagtagagatgaggtttcaccatgttggccaggctggtcttgaactcctgacatcaagtgatgtgcccacctcagcctcccaaagtgctgggattacaggcatgagccaccatgcccagcccagatttcagattctaacatcttgggcatgttgagaccatggaattcactcccaaggaacgtggtaaccttaaggaatgagtgaatgattccccccggtcccccactgtagatatttatctgcaacagtctgaaggtagcctgtctatattgcttctggttttatggtcacccatcatgttttcttattcactgtgggttgttttgttgtctagttgtggaagatatcaataagcgcagagagccgctccccagcctggaggctgtgtatctcatcactccatccgagaaggtaaaccttccaccagaggaggactctggctaaggttagatggactggcttgggatttatgtggcacagactgtctgacattgctaggttaagcacgcatttaacacactgctctgtttaagcatgcaatccacaatggggtggggtcgggggtggtgtttatgcagtgagaagtgatgaatgtattaagcgttcttaaacacagcagctgtgcagaaaaccagagcctgtgttccgtggccctggatcattctagttttcccccttgcactccctcttcaggtaggacccactctgtctaattagcagtccacctccagactttggtattttatgctttcattttattttatcaatatccagttactgttcacatttacctgtcttataattttggaggttacttcaaatcactatccaaacaaggtccaactccttgcttctgggtaatagttgtcttaggcatgttttcttttgttttgttttgttggttttgttttgttttttgagacgaagtctagctctgttgcccaggctggagtgcagtggcacgatctcggctcagtgcaacctctgcctcccaggttcaagagattctcctgcctcagcctcccaagtagctgggattacaggcacccccccgccacacccagctaatttttgtatttttggtagagacagggtttcaccatgttggccaggctggtctcgaactcctgacctcaagtgatctacctgtcttggtctcccaaagtgctgggattacaagcatgagccaccactctcagccttttttgtttttttgggttgttgttgttgttttttgtttgtttgtttttgtttttgtttttttttgttttttttttgagacaggtctctctccatcacccaggctggagtgcagtgttgtgatcacagttcactacagccccgacctccggggcttaagtgatcctcccacctcagcctcccaaacagctgggactacaggcacatgccaccatgcccagctaatttttggtagagatggagatcttgctatgttgcccaggctagtggcaaactcctgagctcaagtgatccacctgccttggcctcccaaagtgttgggattacagttgtgagccaccatgccagccttaggtgtcttagtctatataaatttcctccaattttcacacttttttttttcactttgaaaactggcttacatatgaatttctacagatgcaattaaattgccaaaaggtcatcaatatgaatctcctggaaggtttctgccgggtttccttttttgtgggtgtcttcctaacaactaattacagtggctccaaagaactgatactgtcattccagaatgagctaagaaggcctttgttcatctaaactctgaaatagtactaattttaagtcctcaggacttggttatggccaaacatgagtgttagaattatgcatcaaaaatcccctgattttgtgcaagtggcttgaagccattggatttaactcagttcagatacaggtcccatttggctctagaattggattcaggtccctctttttcccccccatccacagtccgtccactctctcatcagtgactttaaggacccgccgactgctaaataccgggctgcacacgtcttcttcactgactgtgagtacaaccaagagctgtccccagtcccatcaggcaggttagcatttctgtacagctgggctgagccaaaactaaggcaggtcaagagggaagaaatgggttgttaccatgcttgtcccgatctgctggtttctcttcagaagataaattgcataagagacaaaaataagtgcacgcaaatacaaacccactagatcatgcagtccttcctgctgaaaaatagcacacaagcacctcttctcaggactgacaggcttggtgctgagaatgaccttcctgaggcttggcatttcattatgtagacttccagttagcactgtatgctgtagtatgtttccatcaatttttcaactacaaagatattccaatccagtagtctttgtattagatagaatctgcatcattaccctagaattagttttcttatgttttgaggattttatgctcagatcctagcggagaagcagagggagatgaattgacctggacagctacagagtataaaacagtaagaattcacccagagatcttctctctagggataaactcccacagcactcaccactgagaaagtggaaaggatatagcagaagaaggattttggccgggtgtggtggctcacgcctataatcccagcactttgggaggcctaggcgggtggatcacctgagatcagaagttcgagaccagcctggtcaacatggtgaaaccccatctctacaaaaatacaaaaattagctggatatgacagcaggtgcctataatcccagctactcgggaggctgaggtgggagaattgcttgaacccaggaggcagaggttgcagtgagcaagatcacgccattgcactccagtctgggtgacagaatgagactccatccaaaaaaaaaaaaaaatcctgataaaatgaagagcccactgtacatgtgcagctgttaaatgaaccagcaaatggacaggaaagccaactgtcttttgtcatacttgcagcttgtccagatgccctgtttaatgaactggtaaaatcccgagcagccaaagtcatcaaaactctgacggaaatcaatattgcatttctcccgtatgaatcccaggtgagcctgagtagggggtgcaaaggaaatctgcatcctgtcttattctgagagggtggggtgggacctactaaagagttgaggagggaaggtaccatgctctgaattgccaaatgacaggttagaagtggatgtttactgaatggaaatagtattccatagggcctgccccctgccctcatcttactctccagttgtttctgactttgcttcagccttgtgcctttctttgtgtgcatttcatccttgctctcagtgttcactcctgtcggccgactccttgaataaccactaagtagccaatcagaaacgagcttggaaggagagcgagggtggggagcagaagcatcccatctgctgcgaaggagactgttttttacgtggagataacctcagcttgtcatgtgctgagagagcagatggcagccttcgtcattagccgttaacacttcaggtgccaaatgccaggcccataaagcactcccttggaaacaaacaaaattattaaacaaataaaggtgaagctgattgtgagagaacagacacaacttgtctcggtattttgagagttgttaaaatgtcttctcttaccagacaaggaaacaaaaaccacaggactttgatgcattttacggagctaaaagatgattgtggcatattggatctttacagatcagcttcgagacaccagagagtgacctattcttagagaaggagagatgcataatatatagtgtgaacatttaaaaacaggcttccttctcacttggcctaaagcctgtcacccgcttgggggaaggaatttttttttcttctgtgtgttccatccccacctggatagaacaaaatccagctttagcatattgaacaatcttatatttcagaaattttaagaaagtaaactatttttcgaataccattttttaagattaaggtagtttatataaacgagaatttaagagaatactgataactggaagactcagtcatttaagagagaatcttcaacttctagcatactccaaaaaaaaaaaaagaaacagaaaaagaagagacaaatacggccaggcatgatggttcacgcctgtaatcccagcactttgggaggccaagacgggcggatcacgaggtcaggagatcgagaccatcctgtttaacacggtgaaactccatctctactaaaaatacaaaaaaattagccaggcgtggtagcgggcacctatagtcccagctacttgggaggctgaggcaggagaatggcgtgaacccgggaggcggaccctgcagtgagccgagatcatgccactgcaccccagcctgggcaacagagcaagattctatctcaaaaaaaaaaaaagaaagaaagaaagaaaagacaaatacttagaacatgctactgaagataaggtattattaaatccataaatagctcctttatttgcccacagtcacagcacagtatctggcttgtctcttatttattgaaactaagcttacaatttccagtgtagtctcacactaatcccttctgctctcctcctggccttgtcactgttctccaggcaccctaggtacacacccgcccaaggtccttggcactgcctgttccctccatgtggaagtcccctgtaaacatcccaccttcaagcccttgctcagatgttaccttctcagcaagtcctggtgtcctccctgtccagccctcctggacatcctcccctgctctgatattttctcatatacttgccagtttctcaggaccacacaattcacttttcattatgtttattgtctgctttctcctactagattgcaaactccttgaggacatggatgttttggtcactaatagttcccaagtgtttagcacatgggcacatggtaggcacccagtacatatttgtggaagaaacgggaacatattctgtagactcactgccagggtcagagaatactctgatagttcacaatatgtattaatactttttctcctccccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcgggggtaaggcagtgcaccagtctgctggagtggcctcccgtgtgtcccccaagtgaggagctggcctggactcctcctccggccttaaggttcctctgacagttgtctcaagaagatcaggatttgagcatctcttacttcaaattactcttccagtggttttgttatcttctcaatgttatagtgaaatataataatacatgcagaaaaaagcataaatcaactattgaataacgaaaatgtgaacctctatgtaactgcaactcaggctgcctaccgtttttaatttctttctaatctttaaaaacaaatactatctttactaaagatgtttcagagtaagataaaatacaaagagagtaattctccaaaggacatgttcctcagattttatcaagccacgcatttctcacttgcttgctgagtgctgggggcacctgaagctgaagacccagcccatgatcagggaggatgggtgggatgtgccttccagcgtgtatgtgcatgagagatgcacccctgcaggctcgaccctgcgagataggacaggccaagtgctggggacagccacagtagggagagggccctttgagccaagggtgaagcccgtctgcagaccacaggtgacgataggctcatgaggagagagaggccagcattttgtgtgcacagttggctcttgcatttggtataaacaaaaacttgggagttgggaaaatgtggggcacatttggggaagatgggtagtccagcacagtgtatgtgtacggcagtggcgtgggatgaagccaattctggaggtcttggatgacaggtttgggattatgtccttcggtggttatcactggaaacctatgggggatttggacggggatgaccacagttctctgggagagtgaaggctggagtataagcaggagtcagggcaaggaaaaaccagaaggggtggctaaccaggaggccactgcaggaggaacaaagggcctggtcttggagtgatgggaacggggtggacaggtaaggacagaatctgagagcgtgcagaggtggattcggaactgccagcaggttagtagtagggcaggaagggcttaggctgccaaggcattgtgccgtggtaaccaagagcttggtggtgccacggatcatgggttcacccatcctgtgacctcattgtctcctggaagttgtggccatagaaaaacaccttccggttgctgtcccagtgcctggcttccctccactgttggtaatcatggacaaagccagccggcagttaagaaatgggacctaggtggcatctcctgactgacctgtgggagctcaggctggtagcagggctgctgcagtgctgagactggccaggaagcaggcagccgccgccccagcatcaggtcaggtggggcccagggagtgctgtcagacccagccatggggaagggttcaaaggttctcacattgttctggccatgccagctgaaatgtcactctccaacaaacacaacaaaacaagacccaagagaatgtgaactgagggaagtgagaatcatgggagtcaggctgggagcctgatcgtggcaaaaggttcactgactggtcagggcccccagtggaagtgcggcagtttatctgaagctgcttggaaagacatctgtttccacttagatcattctggataaaagcaataagaaaatcacttacttatggtccaggcactgagctaagtgttttattttgcttttcctttctaattatactctcattgtaaaaacacgaatacagacaatgctcacatctcccctaaccccgctgcactgcttggcttcctttcccgggggcagccagcaccatcatgggtgctgggtggttcatgctctgtcacccctcctttgtcagggaatacaaggacaatgccctgctggctcagctaatccaggacaagctcgatgcctataaagctgatgatccaacaatgggggaggtaagtctggcttggaccacgtggttctctttaccaaggaccgcagtgtttgtgtgacagtcccagagacagcttggttctgttgccacagagcatgtgtcagtgctgcttttcctggggactggcttccagtgaaatgcctgaagcccctggggcagggccatctacatgtgttcatcgtggccagggtgaccaacttgttctgtttgccagggctttcctggttgcagctctgaatggcccaagtcccgggaaacccccagaagcataatagcaaaccagaaaatcgacagacacacgcttcagagctcattcagcattcactggtttttacacatgctctgtgtacagccctgtgcgttttacacatggatagatattcactggtttttacacatgctctgtgtacagccctgtgcgttttacacatggatagagtcatgtaaccatcttacaatcaagatacagggctgtttcctcaccaccttgattttaaaactgaaaggcccaggtcctgggaacccgcttagtcccaggcacactggagggtggttgccccatttgtagttgaacttgggcagtttcctacagaaactcacttcggctcctagcgtttcatatctgcccctaagtgcgcttgctatgaaatagaaacactggagtcttttagggtatttttggtgatcttgtctagcagtagacttctgtgctgcgttagtaactttgcacctcagagtttgcttcctgctgccctcctttacaagaggggttcgctaggtggagaagccggagttggctgggtggcttgtgaagcatctccctgttttcccccagggcccagacaaggcacgctcccagctcctgatcctggatcgaggctttgaccccagctcccctgtgctccatgaattgacttttcaggctatgagttatgatctgctgcctatcgaaaatgatgtatacaagtaagtatagtgttacagaccccagagtgtatacggctctgcacatgagccaaaaatatgtctagaaaaagaacgggtttttttgtttgtttgttttgagatggagtctcgctctgtcacccaagcgggagtgcagtggcacaatctcagctcactgcaacctctgcctcccaggttcaagcaattctcctgcctcagcctcccaagtagctggggttacaggcatgtgccaccatgcccagctaactttttgtatttttttagtagagatgggatttcactgtgctggccaggctggtctcaaactcctgacctcgtgatccgcccgcctcagcctcccaaagtgctgagattacaggcatgagctaccacacctggcagaaaaagagagttttttttgtttgttgttttcttaagacgaagtctcgccctgtcacccaggctggagtgcattggcgcaatctcagctcactgcaacctccgcctcctgggttcaagcaattctcctgcctcagcctcccgagtagctgggattacaggtgcccaccaccacatctggctaattttttgtatctttagtagagacggggtttcaccatgttggccagcctggtctcgaactcctgacctcatgatccgcccgcctcagcctcccaaagtgctgggattataggtgtgagccacagcgcccagcaaaagagcatttttaaccctaggaaaaacggttcattgatacagccttgcaaattagcctgtaagttcttctgcgagttccccaaatccatgtggcatttctaggcaggaactcatgacttgtcctctttttggggaggacaagcactttaggtctttggttcccagctcacagcacctcaggtcatagcctacttggatatgttaatattgatttttgtgtttatgtgtgtatctcattcagagttgaaattttttctttctgttttattggttctgcctctctggaggcagagttgaaacttcttgtttatagatcctgaaatatgatgatgatgaaatatatcaacagaagtttcatactgaactttcctcacagaggagctgttttcttcatttgtaaaaaacatttttcttggtagcaatcatcagaaatttagtttctaaaaaccagtttttccttttgtggaaccagactgtataagaaacagactgtatgagaacagacattgttctcatggcatttaatagcatccatcataaagatagtggtttcaaaatgaagattctaaaaatatgagtgaatctcggttctccctgttggtagctataatttgtgcctcctccagctgttcacgatttcccatgtgattggtgctgagggcctattgcaggcagctgctggaagctatttaggcgccacacattgaggatgacatcccagtgcctttccagagggacagatgtgatctttgcctttcccctataaataactaaactcatgtatgacctgacttcatgccctggaccagacagctcaggtggagcttgtatcagctgacccaaaagattttaagacagaatttcaaattggttgactttgaagagagctttgaatctctcctacccgaggaattgcagcccgggtcagtgctgccacagcaagcctggctgacaggtccaatgttgtgacggcacttgtgaacatctggcagctgagggtggtgagctgctgctgctgtaagctgaagagggttcgatgaatgttgtggagacagtgcactccacctgagtcccgtctccattctaggtatgagaccagcggcatcggggaggcacgggtgaaggaggtgctcctggacgaggacgacgacctgtggatagcactgcgccacaagcacatcgcagaggtgtcccagtaagagccccctgcccccttctccagcgaggcgcctctacccagctgctattgatgatgcgttcactctgggcacctcgcgggggctcatcactgtgtgaattcgttttcttggcagagtcaccaacatgctaacccgtaatgataaatcccttctgttctctgagcttgagctactccgacttcatgaagttagaaaatcaattctgtattagggctgcttttaggattcttggaaaacatatgtagctctctcagaaaaatgcattacaaacattaaaaatttaaagctagttcattctattgaaagacccaaacaccacagtatacaattggactttcttttttatagctggtatacagccttccctgttttacctacagttcctgagcaatagctgatgtctccctactaaactgtatccagctctgaaaatgtttcagaatgtttctaatatttaaacattgttgtaagacctttaagctgtagataatgattctgctttttcagaaagacatattctgctacagtgagttggtgatatattcaggaaatgcccaaggaagagtgagaaaataatacagccttggatagttctgttgtttagagaagaggtctctaaacttttttgatcactcaacttaaaaagatactaacctgtggccaggcgtggtggctcacacctgtaatcccagcactttgggaggccgaggcaggtggatcacctgaggtcaggaattcgagaccagcctggccaacatggtaaaacccagtctctactaaaaatacaaaaattagctgagtgtggtggcgtgcgcctatagtcccagctactcgggtggctgaggcaggacaatcacttgaacccgggagttggaggttgcagtgagccaagattttgccattgcactccagcctggatgacagagtaaaactccatctcaaaaaataaaaaagatattaacccatatttcagtaaattaaatgtatttatgaatttaaaatatgctttattgtactaatgtgtgtatttacagcataaatatatatgtttgtatatttttcaaacatgaattatgtttcactatttatattccaatataaatttgaaaagaatgaggtaaaataaacataagtagatattctaatattttcttctcttttctccttgaataatctggtacaccccactctggagaccactggtttcaaatattaattagaaaagctatgtgtctctcttctctcttagaaaataacttctttttctttttctttttctttttgagactgagccttgctctgtcacccaggctggagtgcagtggcctgatcttggctcactgccacctctgcctcccaggttcaagcaattctcatgcctcagcctcccaagtagctgggattacagaagtgtgccaccatgcccagctaatttttgtatttttagtagagatggggtttcaccatatagaccaggctggtctcgaactcccaacctcaggtgatctgcccaccttggcctcccaaagtgctgggattacaggcgtgagccaccacacccggccaaaaataactttaaatgcataccttactggcaggaaaactcaccacatactcctaaaggaaaaattgcatgactcctatagcatccatagcaaggtccatggtgttgctgtgaaacttagctgcctccttttatcttccagggaagtcacccggtctctgaaagatttttcttctagcaagagaatgaatactggagagaaggtaaacccatgccagtgctcaaatgcccagtaaattagtccctgctttctctctaagagcagggaagctgcctcctccaaacaggactagtgggttagcaaggccatatccctctcttagtttatatcattttgccttatttttattttgcttttattattattattattattttgacagagtctcgctctttttcccaggctgaggtgcagtgacaggatcttggcttactgcaacctccgcattttgggttcaagcgattctcctgcctcagcctcctgagtagctgggattagaggcacgcgccaccacccctggctaatttttttgtatttttagtagagacggggtttcaccatcttggccaggctggttttgtactcctgacctccagctatccacccaccttggcctcccaaagtgctaggattacaggcatgagccaccgtgcccggccatttttacatttaagatacagatccaggccgggcatggtggctcacacctgtaatcccagcactttgggaggccgaggcaagtggatcacaaggtcaggagttcgagaccacccttgtcaacatggtgaaaccctgtctctactaaaaatacaaaaaattatcttggtgtggtagtgggcacctgtaatcccagctacttgggaggctgaggcaggagaattgcttgaacccgggaggtggagattgcagtgaggcaagaccatgccattgcactccagcctgggtgacagagtcagactctgtctaaaacaaacaaacaaaaaaaagatacagatccagagcccctacattttgatatttacagagaactgctttttgttactctgatggttaatatttactcttttggatcatgattcattttaagccagaagaatgaactgtgagacctttttttaacttgtggtaaaattataatctaccttatttatatatataaaattatatatatataattataacctaccttatagaatttataacctaccttacctgggcctctccctatcctgcctgtttatcagaggtggcacacctgtcttcgtcaagggaagtggaattaccaaaatacaactctggttgtgttactcacttgcttaaaaccatttagggacttcttgttccccttagaataactcccatctgcaacacacacacacacacacacacaccccccttccaaagcccagatcatcagccccacaggcctctctctggtctcatctctgcccctatccttgttgccctgcctccttgctccagccacaccagtgtcctcttgcctcagacctggccaggttctttggctcaggcatcatttcctcagggaaaccctccccgggtccctacccagactaggcagatgcctgtgccacgtgcacccacactacctggtgagtcccctcgaagggccctgatctctgcagtgctttggctcctctcctggatgctctgattctccgtgaattagagattcttttttttttttcttttgtccttgtatctccagcacctaatagttcctggtatatagtagtaattcagtaaatttttgttgggtaaatggatgggattagatggcccacacagaaagcacacagacctgtcttgcccattgggtgcagattcccaccctctgtgacctccctgtgctcctcccgtccacgtagccacagtctttctgccaggaggaagtgcaaacttgatgctaaggctgcttgagctgaggatgaagaaaagcagtgaatagaaggattttttttcctcagcaagaattagctctcaacagctttctagtccaataagcatagaataaaatataactgctagacttcagagttcagttcccaacctataagacaatcatatttggatcaaaaaaaattttgagccagaggcctggaaatctaaacacacatgattttgtgtttcacagattcattttgagtgttacagagtgtgcgcttgggaaccctagtgtgggcagctgtcctgtcctgtgcccactagccttgcaaagcctcctaacatcagggccattagagtgacaccatgtgctttcctttcccttacagaccaccatgcgggacctgtcccagatgctgaagaagatgcctcagtaccagaaagagctcagcaaggtatggcagccccaaatcatctgtttgaataattgagtagaaacagctgcaaaaagacttctcaaagccctactactctaattgattcatggaaattcacagatttagttatcttcaatttttattagaaaagaaatgaaaggctgggataggcaccttatttcctgtcactttcttttctcctctttatcttttccttcctattcccttgctgttggcaggaggcctcagttcctcaccacatgggcctctccacagggctccttgagcatcctcccaacagggccattggctttccccagagtgagccatctgagagagagagtgctaggaggaagtcacaataccttttatgtcccgatcctggatgccatgcattatcagttcctccacattgtttgttagaagcaagctactaattccagcctacagttaaggagggaatgaagctctgcctcctaaaaggaggagtatcaaagaatctgtggacacattgtagtaataaaaccatcattggctgggtgtggtggctcatgcctgtaatcccagcactttgggagaccgaggtgggcagatcacctgagatcaggagttcgagaccaacctggccaacatggtgaaaccctgtctctactataagtacaaaaattagccgggcgtggtggcacgtgcctgtaatcctagctactcaggaggctgaggcaggagaatcacttgaacccaggaggcaaacgttgcagtgaaccgaggttgcaccactgcactccagcctgcgcaacagagcaagactctgtctcaaataaaaaccatggtgccacctaccctcataaaggatttctcctttgtcttaactcttttagaatgtggtttgtccctctcttttgacatgtaacactttctactttgtgatgtttgtgtacccgcttgtacacactttttacctcctttctgaggctagcgactccttggtgcccagtggtgttttatacgtagtaggtgctcagtagatgttgcatgcatccatgattagtcccttggtcacaaactgttgtgctttttcctagtactccacccacctgcaccttgctgaggactgtatgaagcattaccaaggcaccgtagacaaactctgccgagtggagcaggtaggactctccttctgccacggcaagtttttgccaggcctatttacccagcagaattttaacatctgcccttgaacatcctgcagaatcataggaaatagagacgggaaggcctgctagatcatgctgtctcaactctggagccagtgcggttccactgtccatggtagggactagattggtctggaatgctgtgccgtttggattttgcatgcctattttgaaaggctctgttttccctggaatgagtgaagaaagatgtgtggggttctgagccctacattgacaggactggcagaattttatattctgaatgtgttctactcttgccatggccagaccagctttggagacctcgaggctgacagagggtagagcagtagcaatcagaaatttgcccaaagcatccctgatcacaattgggattgtaaattgagaatttggggtttgagttctgtctctgtcactgattatttgatgtgcctgtttctttgtgtttcatttttttcatctgcaaaagggaaatcattgctgacatttttcaaggttgtcttgtggagtcactaatcctggcttagattcatcctaattcttcaagtgtttcaacattataaaaccatggttcaaattctaagcgaagagaagatgttaaaagattctgaagccggctgggcgtggtggctcacgcctgtaattccagcactttgggaggccgagacgggcggatcatgaagtcaggagttcaagaccagcttgggcaacacagtgaaaccccatctctactaaaaatacaaaaattaattgggcgtggtagctggcgcctgtaatcccagctacttggggggctgaggcaggagaatcgctcgaactcgggaggcggaggttgcagtgaacagagattgctccactgcactccagcctgggcaacagaacgagactctgtctcaaaaataataataataagattccgaagcctcagcttggcctcttttcatagaaaaaaacaattcaggatctcagtgtgaagctaagatttcaatcctctggtttggtgtgacaggctcagtttaggattgtaagccctgtcctgtatctttggatattttataaggggaagcagccctgctaaaatccatcaattttataggggattatagcaaacacaaggtgtcctcttgaaaagaacctgaccatctagaaaataggtcatacctaaatcagtaaaaatgtagtttgggattaattttggaagtttacaaattttcagaagtgatcaaaagtattgttgaactagttgcattattaaaatcatgtcctgctagtcaaatgtctgttgaggctggtggtaggactgaaaggtgaacggcctgtgagaggtgtcctgccttcctgggacacagactggagagagactatgaactcgagatcagaatttgtatggactcttgggatcttgagagaaaaaaagagagccttcaggcaacctcctaagagccacaaaggaagctgcagctgtgagtcctggttggctgagaccagcgtgctgccttctctggatctgagtcttgcctgcatcatgaagcggggccaggaacttgtgttcacttcactctttttcatgtctagttctttttcagcccatatcttccccttcatctcctggggtttggatttgctggtttgggggctctttttttcccttcctcactcatgaaacatggtagaaagattaaaaacacgttaaaagcctggagcagttcaaactcaaaaagcatgtgcttcaatgtgaggggaagcagaatggaaagaatctacccacgcggaggcatcctaaaatcccagcacttttcatgggagggaagcacatccctttaagtcccgctccctcacagggccttgtacctctagagggcctaccaagatttagtcttttttttttgttatgagccagggtcttgctctgtcacccaggctagagtgcagtggcgcaatcatagctcactgcagccttgaactcctgggctcaagcaatcctcctgcctcagcctcctgagtagctgggactacaggcatgtgccaccatgccttggtaaagatgaggtctctgctgtgttgcccaggctggtctcaaaactcctgggctcaaaagatcctcccacctcagccttccaaagtgcggagattacaggcatgagccaccgcccccagccaggattgagtctttatctgagaagctggcacaagtacactggcactcacctacagtgaacagcctactttaaaacaagatggtaaatcattgtggtttctgttgggcaagtggcactcagggcttttatccaccctcactgatgctgtgggagacaatgctgatcacactcctgctaactacagtgcattataagaacagaagcacctgtttaagaccttccccaaccaaggtggcagttctagacatttgtggatcctgaatttcctaagaactactgttcctccacactgtcaccagagagatggagccaatgaggtgtgttttccttaggacctggccatgggcacagatgctgagggagagaagatcaaggaccctatgcgagccatcgtccccattctgctggatgccaatgtcagcacttatgacaaaatccgcatcatccttctctacatctttttgaagaatggtagggctgtgggacctagaggaaggcacagaccctgtcttggggaaactgagacaactgagaaagaggaaacaaagcagagaagtcatttaaaagacatggactggggaaggaaaagaagatcctaggggccctttttgtttggggaaatgcagtgtagtcagatcgttgcagctagaggctgaatgtcccccagtcattgtagagttaataaatggtatggagtagatggaagaggacagggctggggagagagggaaagctgcttggccttgtggccagtttaccagagctatgcccatcacgtatttttaacttgcatcacattggtaatctctgcctttaaagaactgacttttacccagttcaatcacagtttcccaggaatgtccattgtacaaaagatagataataagactcttgtccaatttgaccttgattcagggtgggggtgggcaggggttgctgagaagccggggggcagatggaaacacagactataggggcagctgctgatggtcctcactcaggcagagtggctggaggggaatcgggatcctcgtgttgtcctcacctatagtgaatctgatgaggtgggggagcaatgtccactaaccctgaggggagaagggccaccatccggcctgtcccattgggtgcatgggggctgtgtgtggtgatcgggtgtcttgtgccctcaggcatcacggaggaaaacctgaacaaactgatccagcacgcccagatacccccggaggatagtgagatcatcaccaacatggctcacctcggcgtgcccatcgtcaccgatgtaagaggccagctcagcttccgggggaggtgggaagggagctggcagatctgtctgcttctgctctgactgacatacagcatctctgatacacactcgtacgtcaagagagagagacacagaatcagagggataaaggtgtaaagctatatataaatcagagacacaaagccaagaacctagacgtcaacagcagtgagtcattcacagttgtgaaagctgagatgtcttggaaccaaaccataacaggggtccccgccattttatctgtcttgtctcagggtctgtctggcctcacctttggacagcttagcctcagtgtcccctgtgaagatgagaatatgacacttagagctagcagtttggccacctttgagtcttctgcactgggttggttcagagccaagtcagggcaggttgtctgggaggcctggaccacgtgatgtgctctagaagaggtggggtgaagcctccaggacccttgcagaggactctgccatgaaccttgcctgtcacagccccactgtgtgcttgtcttctataggcacagcactaacaaagctagggttgcaaatattctccctctggaatcttatagacaaaactgttctagtgccaccagaccatagccctgtaactagcaggagtttggcatttttaaacccttgttcacaagagggatcaaaatgagaatggagatgtgcattcattcagtgcaactgtgctgctgaaatccaatacggcatgctccaagcagtatgccctcctctaataggcagcaaactactgtttcaactgcctggagttttttcttttttctttttttttttttgagacggagtctcgctctgtcgcccaggctggagtgcagtggcgcgatctcggctcactgcaagctccgcctcccgggttcacgccattctcctgcctcagccttccgagtagctgggactacaggcacccgctaccacgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggctgagttttttctttttaatggcacttacatacttgacctatgtttgcccttttttataacttttttttttttttttttttgagatagagtctcactctgtagcccaggatggagtgcagtggtgagattttggctcgctgcaacctccacctcccacattcaagcaattctcctgcctcagcctcctgagtagctgggattacaggtgcacaccaccacgcccggctaatttttgtatttttagtagagacggggtttcgccatgttggccagactggtcgtgaactcctgacctcaggtgatctgctcacctcagcctcccaaagtgctgggattacaggtgtgagccaccaagcccggcctttttatgactaaagaacaagtttgctccaggttcccaaaagggcacatttagggctattccatggaaaaccatccccccaccattactctttgccagtgctgcctctgggttccttcagggaatttccagagagtagcagaggtcacctagggcccaagtggccctgactcaggttctaacctggtgtgtgtgtgcatgcagtccacgctgcgtcgccggagcaagccggagcggaaggaacgcatcagcgagcagacctaccagctctcacggtggactccgattatcaaggacatcatggaggttagtgctggggcacagggaggaaaaaccaggcccagggcccttggcttgtcagcctggatgcttccagcttcacctgcggcgaggtgctgctgacttcacaggtactgcctccacttgaggatttgcatccaggcctccttcggccctcatggtgccccttgcctgggggtttctgaagagctgagagactgtgaagcacagccccagatctatttgttgttatgtcttggaggactcagctcctataatagagactcctctagggtgccgcatccagaggggtccaagtgtatctcaaaggtcagatgagtgacatcacatctccacacaggtgcagtggctcagcacacttccccagcacggccctgcctgccccgccctgccctcctcctgctgttccctacctgagcctccacacaccagcaaatcggattctgctcctctggccaaagcagccccttgcctggcatattctcacccctccactccccttcccagatcctgctttccatccaagcccctcttgaatcttaccatttccatctgccgccccacctgtctgaccactcagcacacaggggcctcccctggactccttagtgcacatgtgcctcttggtgcctcgggtcgcctttttgtttgttggtcctgtcccctcagctgctgtgtcatctgcacagagcctctagtgcagcaggtgtttttgcagttgttggctggaaggtgtataaggtggtggccaccgcagtagccctgtggggtcactcccttctctccttgtagcgggaagagaccctgcatagaatcctgcaccactagatctttccaacttgattagtgaacaaaactggggtctagagaatgaaggggtttttctcgggatcccttagttaattcctggcagcccaggtgttcctattgaattgtacattaatataaatgtattttaaatatatagagtgagtcagctcccatttttaaaatccacaaactaaaaggatgggtgaacatgaaacatctagaaaccaattatatctctttgcttgttgggatagccaacccctctgtctcattccttcctttgttctctgctcccttttgctccccctcctctccgatcccctaaagagacatgtgtaggcttcatgtgggagctgtaaagaagagtgtggatttctaggcagcaggaggtagatggtgagagtccacccaccagataattagacacttgaaaaacggagggggtaaggcttcttcatgcaggagagacactgcttgtgcctggtttctacaaggctgatggcaagtatcaggaatttattggacagaatgcatcatttataaaacctcacatagattatgaaagtgaataaactggaagagaagcaagaaaaaacttctcttaaaaagcaggctatctcagtgtagcagctagttacaaagcatctgctataactgagccctgtgctaggcacctctggccgcagggaagggagctctggttgttgcaaacctggccatggctttgccaagtgacatgttctacagatcatctggccttggttcctatcagcacttttcagacagatggcaagctaatatctgtctcttttccttctaggacactattgaggacaaacttgacaccaaacactacccttatatctctacccgttcctctgcctccttcagcaccaccgccgtcaggtaggtgaaaatcccttagcaaggacagaggggagccagctctggttggatgtcagctctgcggcagacccactgtacggctgtgtgatctaccagagccctctcgctgctgctccccacagctgcagcgtgggccaggtctgcacagtggtcccacggcccttccccctccagcatcccgttcctctctgattcatccctcacacctcctccctcgctcactctgcatcagccatgccagcttcctcgcacttctcaaacagtcaggcttacgtctgcctcaggaccactgcacttgcttttccctctgcctgaaattatctgtccccagatatgtctgcatgggctgggcacagtagctcacacctgtaatcccagaactttgggaggccaaggcgggtgaatcacttgaggtcaggcatttgagaccagcctggcgaacatggtgaaaccctgtctctactaaaaatacaaaaattagctgggcatggtggcggacgcctgtagtcccagctactcaggaggctgaggcaggagaattgcttgaacccaggaggcggaggttgtggtgagctaagatcgcatcactgcactccagtctgggtgacagagcgagactccatgtcaaacaaagaaaaaatatgtctgcatggcttgcctcttatctcctttggtctttaatcaagtgttaccttctccaatcttccctcaccaccctgtttaaaattgcagtgcatcagcgttcacagctttactcatgcagtccaagtgtggagcagcccacatgtcccccagctgacgagtgggtaacacacgtggtctctccacacagtggctcctgagaacagtcagggctgagcacgcactcgggatggtagagttagcagctcgagagggcgaccctggcactgcagctgtgccacacctggcaccccaggatgtgcacatctctgtccctcctctcctgctttccccacctgtcttctcttttgcgtctcttctctctgtgttcacttttggcttcagctgggccagaggcctgtggtggcctctgtgtcattgtgcagcccttctcatggcagcagaggtaaaacgttttttgccaaatatggcataaaatacaaaatcccaagtagcgccacagtcaggctgggtgatgagaatgggatatcaaatgattgcacaaggaaagaaagcaactgtgagattctctgttggcccaaacggtgccccaaacggtgtcttcctggtttggaaagtgactgtaaagctgtcatgagtcaggaagaaaggcgacgcattgcagtggccagaaaggacttgctcctttcatctcatttttctcattttcttaacctgggaacaacccatttattcctgtttctcagtcaaaggtaaagagctattgaaggaagcccaggttcagagggaggcccctctgggagcagccttgccactgaagtactcttcctccctggcttcgccgcaatttccaggaggcagctcagggatggagaagcctccccagtggtgcccggacagggttccagggcttccctgtgcttggccctatagcacagagctcttcatcagaccaggatttgggctcacttccttctccccacctgccccattcaatgatgacctcttggtcaaggcctgtgtctccttaggatgtggtactggggaggccctggcctccaagaggcactcactcagtacatgttttcaagggatctatgtgccagcctgaaggcagatcttagactgtcatcactgtgcactgacagcagagtgtcccaggcaagctcagaggcatgtgtgacttggggtagacgtctgcatgagcctctagcagggggatgctacagaacttgacccagcaaacgtcagagctgaactgatcctgtctgttgcctgcatgtttctaagagtgacaaggtcacagcagcacaggcattcatagtgactcttctcctgggaaccaatccacttgaaaattgcattgcagtgaaatttcagccagcactcactaagcatctacactgtttggggcacaagtgtacagacctaataagtaaacaaaccactggggtatgaagcactagatgccgtgagtgcagataaactgactgacattctctttctctctctctttctcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggtgagtggccgtgcttccagcggaaggcgccgccgcatcgcacctcaactccattccacgctttggtgtcgcattctgtcatagactcccttgacccacaaaacttagtctttaggtaactgtggacagcagaagctaggggcaaagggttccctccttggtctgccctgctgcatctctcaatggaaggcagcctcatgaggtaggaagtgcctgatcccagggtccggcagactcaggctcagattcctgctctgcaaactgcaagtgggggaccttgagcaagtggttcgagctctccaaccatttccttactcagcaaaacaggatcagtcatactcattcacagccttgaactaggcccaagatgaggtctgtcagtctcctggcattggcctcatgcccaggcaggaatgggcagtgaatggcagtcaatcgctgccctgtcaggtggagatggacagacagctgtgagcaggtgctgcctgaaactactgcctgaccgctggactctgcccagggctcccccagccacctccaaccactttctaggtctgccatgccctttctcgtatttcctgttcgtttcccaaaagagaggaagcgacttgtaggagctagcttaacgcagcaggagccttttctcctttttcgtgccttttgggggcttctatgatgtttagggctggaagaagatgaacgagctaagaaaagtcttgctttctccagatgcctccctttttgtcctgttttgcccttaacaaaatggagggtacctgccagcctgggagtccctctcaacactgtctggcaagaagctgtcatgttcactaccctggctgggctctgtcctcagtggaaacaggctcacgctgagcaaggagtgaggccagggctcttggcctccttttggaagggggtgtgctctgcacagtggggaattatactctccagggccaaggatggcctctcaggccacttacacatgaagtgctacagggagaggccctgagctgccccagctgggaggcatcgctgaccttctcccataggtgcccaccactggtcttaatcccaggcacagtcatgatctcgataacaagtggtggttttatacctcctatttggggtgagcaagtcgcagcaccccccccctcccaagctatccaagtgagcagactccatagaccagtccacatggctgtttctgggtttttcaagatggatctggggctgtcagccgcctctctgatagcacaatccagtggggagactgtacctccccaccgcagccctcaagcttcccgtgtcaggtcaccagctctccacataactgtttttcccttctgttgtgtagccccggtgataaagctctctgctccctgcttgcatatgtattgcatgaatgtagtgagtaattctgagcccaaacacagcttttctggacagaagctgtcacagccaggctttgggtgtaaatcttccccttcatctttagacctgacttgaggttccatatatcgggaggtgggaacctgggggtatgcagttgcccatgaagattcatggaggggcctcgcgcagacagctgacgtccgctgtgtggcctcccctgctttgtgcatgccagcctccttgctaccatgtgtgttcatgcgcgcttgtgtgtgtgtgtatgcatgcgcacacatgtgtgtgtgtcttgctttctcatacctcattggctgcataaaatgtaggcctaagttggcatgttcctgtgacgtacctttgttcaagcagtcagctggcctctgttctcccacaggttctactcacattcttactcccaccaaatttctcatggacctgagacaccccgacttcagggagtcctctagggtatcttttgaggatcaggctccaacaatggagtgagagccaaagaaacaaagtaaaagcagcttattacagaaaagaaactcttccactctgaagggctttctttgattattccgtcactctttttctttatttcttcctttttagtttattatttatttgattttgtttcaacaagaaaatgcttgcagttctcaacaccgattgaaaatgtgtccagtgctgccctcacagccctgccatgaaccctctgggctctgacctgctggctcacccatgccttgggttccgcactgcttagtcagacgcctgcaggctgctgggtggaaactaaaaatgataatgactgctgtgaacagttgtcagagagggagctgaagttttgggggatgcctgaggcacagtgcccaaccctgctggtctgggatgaatttgtggcccccacaaggaatgtagagtgtcctggttgtgctgggtgtgggggtctgagagcgaggccagtggacattcagggaacaccatgtccaggaaggcaggcggtggtggagatggctggtcgtgagggaagcttggcaggcaatgtagaatagaccccaggtcagtggcagctggacggatggtgtgaatacctttttcctaggacaggcacttctcaaggaataagttaaaaggggtaattgggtcacaagccgccatctgcttggggaaccccaatctttagcgggaagagcttttgtttcatgttcctctgcaggaaacggcacttaacagtcatttgctcttttactaattacttttaattctgtggatcctttcaagagttgagtagtcatacccctctctctcccactgaagtcccttggtaaggtctgagagcctgtcagtagtaatgtatttttttttttttgagacggggtctcgctatattgcccatgctggagtgcagtggctcttcacaggtgtgatcacaacacactgcagcctcaaactcctggcctcaagagatcctcctatctcagcctcctgagtagctggcaccataggcccataccactgtgcccagcataaacctattattaatgctctgtgtggttttagagagcatcttctgtctcccaccaagcttgttacccagaacctattgtctgcttagtagactatccaaattttattttatttatttatttttatttttatttattattattattattttttttgagatagagtttcgctcttgttgcccaggctggagtgcaatggcatgatctcagctcaccacaacctctgcctcctgggttcaagtgatcctcctgccttagtctcccaggttgctgggattacaggcatgcgccaccacacctggctaatttttttttttgtatttttagtagggatggggtttctccatgttggtcaggctggtctcgaactcccaacctcaggtgatccacctgcctcagcctcccaaagtgctgggattataggcgtgagccaccgcgcccagccgactatccaaattttgatcttcaaaactgtcctcattccctcctctctctttccatccttcagatacgatagaaccttctatgtgtttaaatggcagccttccatcatcacatcagtgactccttagcttgttacatattctttcatgaggccatattttgtgtacctgactttgtgtatatcattgacaatggaccctggaaaagccccttcacctgagctgagatgtggcccagtgagtcacagagcatgagtcccctgtgagcattggagagagacctggactcagagccaggaggactggcctctactccagctactccatgggcacctgtgtggctgtgggaagataccctcgctctctggccatagcataggagcacagggagggtggatcgtgtgcccccaggcacgcaggacctctgacattctgtatattcagtgattacgatttgtgcctcaaaccatgcagtcctgctcactctctcactctctggtgatcctcaggggaatggcccttcagaaccttggctaggtgacatcagaagctgcttgtgtatgtaaggaaaatggggcttcctcctaaggtaggaacaggaggctacgctgtttatctcctcctctctcccttccttgatatgaatgtcagggcagcagtgtgctaaggaactgaaagtagttgggaacccagaaagtggacctggttatagccctaggctatagctcccatcctgcctgggctggccctccctagaaagcaaggccagtaggtggtgaataaaagccattgttttaaaaaaaatcattccttagaagcactgataggttgtaaatcagagacatctggttctgtgtgcagactgcaggtaggtggatggatttgctgcagtatgtattttaagacttctagaaagacaaatgttcagtcgagtctgcagcaatagcagaccacttgcaggatctgaaagagcacagactcaaactgcaaaggctcctgctaggatgagttctgagcttccctgcttcagaacaagcttctcctttgcagagtattttcctttgcgttatatttgctcagcagaggtctcagctgccatcaaaacaaagagaacgtaaacagactccgtatattcctggcttctgaaatcatttgctgagtggtgttgggttttagagcattcagttaagcaaggcacagagccctaataccagtgaggtcagaaagcagattaaggtctgacttgccctcttctgttgtgatcgtccaggtgaccaaagtacaggacagtgcagactgtcagaaaacttgagtgtcctaaagaccagtatcatggcagcatatcttttgtgtctttttttctttctttcttttgagtcagggtttcactctgttacccaggctggagtgcagtggcatgattttagctcacttcagcctggaccttctgggttcaagtgatccttccacctcagctcacctagtagctgggaccacaggcatgcgccaccatgcctggctaattgttttgtatttttggtagagactgggtttcaccacgttgcccaggctggtcttgaactcctgagctcaagttatcccccagcctcggcctaccaagtgctgggattacaggcatgagccactgcacctggcccaacatatcttttaggagaggatgagttttcctgcagcaaatgagagggttctcagcagacaccgtgcatgggtgatggtgccatgccctgtcttcccagctcctctccctcctgtagctgacgctggctcccccgaggtcagggttaaccaacaactctcactaaatcctcaccagtcatccctccacattgtctaaaaaatgaaatcttttgattagattttcacctctctgctctggttagtttatgataaaagtactcttctttggggaatgcccaagagactgtgagaagcaaatgtgagagagctgaagactggatcaagtctttgcagtacatgggggccacttgggagagagttggtgggtttttatattgattattttgcttcattccagattggggtcaggtatgtttcatttttctttgggactcagatttgaatctgaattcagagcccacctattgcctggctgctattcaagcatccacctgcccatcccctcccctcccaggggccacagggtcccgagaatcaagagcctggaggcactgcttctggacctgtctgtgccacccaccctgagcaagcacctgactgctctggccttcacgtgtcccatgtgtaggatgagaagggtgggccggatcacagttttccaaacctggctaatgatcatactcacctgggctgctctttaaatgtacacattttctggcgccgccctgcatattctgagtcagtaggtctgcttcagccaaactcaagaatgattggaccagctagcctgcaagaacacttttggttttcagattctgtccgtgtagaaagaaggattttgtcccatcagagcttgcggtgtctggcccacagctttgaaaacatgtagacagtcatgtagatgggcctcaacttagtttttagagaccactgtttacatttcataatcgtccagttatagggactaaataggaccctcagagcaatagggcccacttgctgctttattctggaaaaccaacatggtcagccatctgtggattcaaaatgagaactgtgcaaaatgtggattatggactcactcagcttaatttgcaatgtttatggtggtgaaaagcttgaccaatttattaaaacaacacagatgactgactttgaagaattggctttctgatgatcagcatttacaccagctagtctggtccccttaaagaaaccacgtaggtgaaggcctaggccacagcctgttgctgagggtcttcgaggcttcactgattgtctccaatactcagtcctagaattattgttcttcagtcaagactgggagcaatgaatggtcagtgattaaataatatcagagacttctagtgcattaattccctaacctctctttggcctctcccaaatcctagatttacatatcagcaaagatagggaggactttggaatcagcatctgatcagaggaaccccttcggatgcctcctttaaaatgagtctgccctcttatttcctggagtcatttggatggctaaggagggccttggggacattttctctggcacgtgcgctccttgctgttgcttgtaacgaggaagctcccaagcgaatcctcacgctctgcaggacaggctgtctttcagcatctggacacgtgggctacatggagttgcaatttggagggcccccatcctggcaatggttcactcttcagagtttggggcaagccttgtaatatgcgtcctttctcctcatttgtacagcagcctttggcctcttttaggactagcaggaggagtggtgaggtcacagaaatgagtggacttcaggggaaaggagtgctataaaaaagcccagggacacactcctgaaacctgcatcgcatttgctgaaggggcctcaggtctgcagaatgatgagtcagctttccagcgcagggcccctacaggctgcgtgcacagggcatcatgccgaggacaagttcctcactcagctgggagtgggcagctggggcctgaactgcagagaaagggatgttggaagaacagagacggctttccaagtttctgctagtctggagtgaccaggaagggctgcagttccagcagtcttcggtcagctgagcgagtagttagtggtcaaaggcatagggaccctggtattggagtcatgcccagtgagccagccaaagccttcttttgcctgcccttggggtggaaatccagcatccggtggtttccgctcccctgctcccatgaaggcccattcctttgccacgtctccagggaggcacattttcaagtacgtgtctcttttgttcagttcttgtctcccaccaggacctttctttgaagcacactgctgcatgcgtgcaggcctcatgctcacccacacaccaccccggtcacctctgttctgtttaagtccatgtccaaaccacacgacccatgcatctttttttactgcacttactagatctctctctctctccttatgacaaagactttcatttatttttatttttatttttgcagtagaagtatatctaattccattagcttaaatttttgcaagcatttctaatctcttacaatacgcggtctctgcaaggtaaggcctcaggtcccctggccctttccctctcacacctgaggtcccacccaccagggcagtaccaactggctggctcccagaggtcagtggattctcccagggggctttgcctatcaacttcctctcccaggcaccatgctttccacacatggtccccctaccaactctggccccattttcagcctttccctgccttgccatgtttggaatttctctccctggcttcacctggagtttaagagtgaattagaaacgcagctgcccatcacctgcagatggctctgcaccctgatggtgaggcagctcgttccttggtgcagcctgggaccctgcctgagccagaggatgtgttttgtttatccacagcccccaaatatctcccaggcctattgcgacgggaccccaaccccaattctgactcccctccctgcttccactatacccagaccagggttggggaggggggtgggtgcagatctgggaatcgagaagcgcaggaaaggaagtgttggaaaccagaactggcaagctcactgtcttctctgcctcctccaggatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccaggggg

SEQ ID NO: 6281 - DNA, 12754 bp, Homo sapiens
aagtgacgcacgaggtgctgtgactcgtgccagccccctaatctgcggaagtggagtgcggggagtgcgccggaagaggggtacggaagtgcgccggaagtggggtgcggaggtgtgcagcgcgctgtcagactggctcgcaggcggcgcggccggcggacccgttcgagacagcgcgggcggctcgggtcccctggggctccgcagcaggaggacgccatggacgacaagggtaaatcaagacaggccagggctgctaggctacagcagcgccgttcaggggtccccccaacctctcacatccaggctgagctcccgaagagatttcttttgaatttcaggctgctccgctggttgtgtttccagagtcacaactaaatccctcgcgctgctcttgttttcagggatgcgccctggcagtatctgcaggcatccctcccacacatacgctccttcccagtgccagtctccttcctgccttgttggatctgtcattaaaattagaatgaataaggcatatttgatgtgctcatctagtatggttattaagtgaaaaacaagggcaaactaatacacttttcatgtaaagaaataaaggggagtgggtggaactccatgtataatatttgtaacatatatgtgtatgtgaatagacatgtattagcatagactgtctggaggggtgcaggagaaattggcaagatggttgactctgggatcctctcagattttaggaccaaagaggctgaagagagaatgacttttcatcatcatttactcgggcttaatttttaggccttgcacaccagtagcttttttttttttttttttgagacggagtctcgctctgtcacccaggctggagtgcagtggcgcagtctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggactcccaaagtgctgggattacaggcgtgagccaccgcgcccggccaccagtagctttttcaaaataaaaaagagctcttgcaaacagcaaagtggtattttctctattcccatcaacatttattgcatccctgaaaccaaataccctaaaaagaaagtattttttaaattgtttgcttcttaaagtcaacagtcattaacaagctctcttgccttataggctgctaaatgaattaggtgaatcacttttttccctttttccagagttaattgaatactttaagtctcagatgaaagaagatcctgacatggcctcagcagtggctgccatccggacgttgctggagttcttgaagagagataaaggtatatagagagtcatctgttaacactctgggacttaggatagtcttttttttcttttctttttttttttttttaaagagacggagcctcactctgtcacccaggctggagtgcagtggcgagatcttggctcactgcaacctccgcctcctgggttcaagcaattctcctgccttggcctcctgagtagctgggattataggtgtgcaccaccttgtccggctaatttttttgtattttagagacagggtttcaccatgttacccaggctggtctcgaactcctgagcttaggcaatctgcccgctttggcctcccaaagtgctaggattacaggtgtgagccactgtgcccggccgtttgttttttttgagacagagttttgctcttgtctcccaggctggagtgcaatggcacaatctcggctcactgcaacctctgcctctcaagttcaagcgattctcctgcctcagccttctgagtagctgggattacaggcatgcaccaccacgcctggcaaaatttttttttttttttttgagacggagtctcgctctgtcacccgggctggagtgcagtggtgccatcttggctcactgcaggctccgcttcccaggttcatgccattctcctgcctcagcctccaggtagctgggactacaggcgcccgccaccatgcctagctaattttttgtatttttagtagagacggggtttcactttgttagccagaatggtctcgatctcctgacctcgtgatccgcccatgtcggcctcccaaagtgctgggattgcaggcgtgagccaccgggcccggccaaatttttttatttttagtagagacagggtttcaccatgttggccacagtggtcttaaactcctagcctcaggtgatccgtccgcctcgccctcccaaagtgctgagattacaggcgtgagccaccatgttcggccaggaaagtcttctaatgactcttagaaatgtagaaagtgagagatgcatgtttgcctgcataaagtagtaatacagctccaagctcagcttctgccttcatttcagacctttcaatctggagagagctcttacgttgtcatgaaaaggatccctttcataagtgaaacagactttgaatcgagagtgactatgttatattgtgttaaccatgatgcgtaaatttcagtagcagttcagctttataagtgtttattaggcctccaccttgtgccagattctgtacagatgctacagggaatattccagaataaattctggtattagtattatttattgtgatcccctaattcagcaccctaaatgtaagcatctgggtatagcatgaaatcttgtataagcaaaataataatgcagcctttaatctgaagggcttgcctagagacacatgtctttaaggcaacctccagtgtcttcccattgttcttaaaataacatccaaacaaccttagcctcacccataccaccttgcagacctcatctgccgctgctacttaatgtctttccatgcctcagcctcccaaagtgctgagattacaggcgtgagccaccatgcccagccacccagctttatttctatgtgtgcttgtttactatccgcttcctctattacaatcaaaactccatcacagcagaaccctacctgtcttgttcactgatgtatccctagcatctagaatagtgcctggtatatagtatgtacctagtaaatattcactgaatgaatgaatgaattgaagatacaggtcggggctgtggccctaatgtgaacatcacattccttgttggatcattccaggggagacaatccagggtctgagggcgaatctcaccagtgccatagaaaccctgtgtggtgtggactcctctgtggcagtgtcctctggcggggagctcttcctccgcttcatcagtcttgcctccctggaatactccgtaagtgcctgttctccctggggttacctttccacttctctgtttagtgacagacattctcagcattaactggatcttccctgtcccctcagtttgctcttttcttcctaggattactccaaatgtaaaaagatcatgattgagcggggagaactttttctcaggagaatatcactgtcaagaaacaaaattgcagatctgtgccatactttcatcaaagatggagcggtgagtggataatcatcatggtggtaaggaggagcaacggtttcgagtccgactgcctggggtaaaatccgggctctgccactcacttgctgtggagacttgaacaagtaacttaacctgtctgtgcagctttctcatctgttaaataaggatgacaatagtacctacctccttgggttgttgtgaggattaaatgaggcaagacatgtaaggggcaaggggtgtgagggcttggtattgtgcctggcacttagtaagtgctgcatgaatgtaggtcttgttattagagatggttgtcattgtaaacaggcagagagggacagtgggacagcacgtgtgattcttgatttattttatttatttatttatttattttgagacggagtcttgctctgtcacccaggctggagtgcagtggcgcgatctcagctcactgcaagctccgcctcctgggttcacaccattctcctgcctcagcctcccgagtagctgggactacaggtgcccaccagcaagcccagctaattttttttatttttagtagagacggggtttcactgtgttagccaggatggtctcgatctcctgaccttgtgatccacccgcttcggcctcccaaagtgctgggattacaggcgtgagccaccgcacctggccctgattcttgatttaatacagtgttttactaaagaagtatttttatgattgtatgtgtagtaaatctgaattaacagaacagctcttgtcactggttaacactgaggactttcttagtgaaggttagcaatagagggaaattgagggaaattttctttttaacttcattttagatgctattacagagatgtaaagccacgcagtgtttataagtgaggaaagacaggaggtgcaagttgaaccatcttccagtaaaggtgtaatgaaactatcataatgcccctcccaccagcatacgtccttttgccacctaggcctcccctgatcataaaatcatttacttgcattttgactcttaaatcttgtcctccattttattagccccttcccaacctttgaagtatgttattaaataaatggcataatagatgtgagtgaaacttgtagaaaagccagttgcaaacgaagccttttttgggcaagtggaggcaaggttgtgacttcctctcgctggggccttctccttccacagacctgctgtgccgtcagtattgtgcgggtttcgtttgctctagtgtagtgtggtatgtatgtactttacctgcagtcacctactcaggactgatttagacaaaatttatagcagagctgctcagatttgcacatgcagaggagtcagctggggtcttattaaatgcagatcgggattcagtgggtttgggctagggtccacgaacctgccttcctaacgggttctcaggtgagacccagaaaggagctagagagctggttctgcccccttgtcttattctgtcttctgcactcttccatagaaaagaggttatggaggctgggcatggtggctcatgcctgtaatcccagcactttggaaagccaagacacgcagattgcttgagtccaggagttcaagaccagcccgggcaacatggcaaaacttcatctctactaaaaatacaaaaagttagccaggcgtggtggcacactcctgtggtcccagctacttgggaggctcaggtgggagaatcacctgaacccaggaagttgaggctgcagtgagctgagatcataccactgcacttcagcctgggcaattggagtgagatcctgtctcaccaaaaaaaaaaaaaaaaaaaaaaaaagaggttatgggcctactgtggtggcttatgtgtataatcctagccggaggttcccttgaggccaggaattcaacactagcctgagcaacatagggagagaggccctgtctctacaaaaaataaaataaattagctagtcacagtggcgcacatctgtagtcccagctactggggtggctgaggtgggaggatcgtttgagcccaggatgtcgaggctacagtgagccatgaacactgcactgcactccagcctaggcatcagagcaagaccttggctcaagaaagaaaagaaaacagattatgtctaagtgtctacacattgcatccacgccacagataggttgtgattaccccaaacagtgtttataaattcaaaaaaattagttagccatcatttcaaaattggatttttgaaacatcacctggtctggcaatcttggggccacatgacgccagctggggctgaggagtcctggccctccttagccttttctttttgagacagagtctcactctcttgcccagactagagtgcactggcatgattatggctcactgcagcctcaacctcccaggctcaagtgatcctcccacctcggcctcccaagtagctgggactataggcacatgccactgcatccagctaattttttttgttgttattttttgtagagatgaggtcttgccaagttgcccagactggttttgaactcctgggctcaggcagtcctctcaccttggcctcccaaaatgctgggattacaggcgtgagccaccacacccagccttctgtagcctttcgctttgctgctggccccacccaacctgctgcagtgacttctgctacctacttggttcctgtaggcctgcgtgtgcaaaccatgtcttagaaataggaaaaccaacccaagggaacctcatggagccttcagctatccaggcttttgtatcctttgggtaacactgtgtgggagttccatttctgcacctgctacaggatgtgagacctggcagaaacttttttagcttgcacatgggatggaaactgtaccatcaggtctcctttctggttgtggttgatttgtgagaaagtgtacagagatgcttagggtgtcgggaacacgtgccgcagtgcagagggtgtgagtgagcagcaaggagcctgcccctttgacaaagctttctcggtccacagacaatattgactcacgcctactccagagtggtcctgagagtcctggaagcagccgtggcggccaagaagcgatttagtgtatacgtcacagagtcacagcctgatttgtcagggcaagtacctttctgttcagttatgtgcccagccataattttacagagcaaactgcggattacagtccaacaggatcagaaccagaatgtgcccccagcttgccagcagtcagcactgcctttcattgtaccttttcctgcctttggaagaaaaatcactgaatttgcagcaggccgcagtatatgatctaggggtttcacttaagtagttaactccgtggaagagcagagattgtattgatgaagatttttatcaaggaataggtaacttatatctccctctctctagacgataatcaaagcaaaacttcctccttttttcctgaatttacatctcttacccagagtctaagagtatagttttccaaaaatacttctttctaaagaactcaaattcttgtttccttagtccaaagtattgggatctgccccttaacccattagtattaatgtgagtttcaagcaaacatccactgtccacattaggtgacatacatcactgtggtactgtcttgtactttctctaacgttctcaaaatgtcatcttcagtaagaaaatggccaaagccctctgccacctcaacgtccctgtcactgtggtgctagatgctgctgtcgggtgagtgcccatcttccccagccataatcacctcccccaccccatgctggcttacagcaagttttcagattgaaagtttgagtcccgttcataaagccacaccaggtagcgtcctacttcttaattaatagctgccctaaaccagcaagcttgttatgaggttgtgatagcatacaaagaagacagagctgtaggatgttggggagagtgggagttgtgtctatagctttatggctgtaagtgttgagtttgttgttgttgttgtttttgtttgtttgttttttgtttttttgagatggagtcttgccctgttgcccaggctggagtgcaatggcatgatcttggttcactgcaatctccacctcccaggttcaagcgattctcctgcctcagcctcctaagtagctgggattaccggcgcatgccaccatgccacgttaattcttttatatttttagtagagatggggtttcaccatgttggccaggctggtctcgaactcctgaactcaggtgatctgcccgccttggcctcccaaagtgctgggattacaggcgtgagccaccacgcccagccagtgcaaatgcattttaagagcaaagtacaaaggtcagttgggatcagcagagggtaatcagggctctgtatttctgtgaagacctggctgtcctcagtggcatactgggatgctttgtctcacctagaagatgcagcttgtgtcgcaaagccaagtcacatgttcctgggattgtcagtgtatttcccaagaaaaaacaagagtagtgatctcttggaatgaaaacaagatagatgattaaggaaattaggaatgtgttcaaaagtaaggattttgaggaattctactaattgctcattttaaagactaaattggccttcatcctaccagaaagattcttaaggttgggcacagtggctcatacctgaggcaggtggatcgctagagttcaggagttggagaccagcctgggcaatatggcgaaaccccatctctagggcatggtggcatatgctgtggtcccagctacctgggaggctgaaatgggaggatcgcttgagcctaagaggtagaggtttgggctgagatcatgccactgcactctagcctgggcaacagagtgagatctggtctcaaaaaaaaaaagaaagatttttaaaactgcataacacttttgtccaacttcagatctcatcagattttaaaattttgtttggtttgtgctgaagtagaaaagaaagtagaggataccacacttggaaggaagactgctgtgtcaggacattcttgcttcacttacacacatatgtacgtgtgcatgcgccgggcggcagtgtgaagtgtatgtctcattgtagggtcatgaccagaaaacacccctggtaacaatgccaggggtctatcgcgtgttaagtgcgctttaaaaaaaacaggtagttatgggaggaacttaccttgatagaaatggaatattgatctttgcagatgatgatgctactcgttagagccaagaaaataaagcatgaaaagctttttttccccttagctacatcatggagaaagcagatcttgtcatagttggtgctgaaggagttgttgaaaacggaggaattattaacaaggtaagagcatcagttctccccagttccctgctcaagacttggaggtgtcttgctgacctaggacaccacagcagtgttgattatggttccttctaatcctgcttcacttcaggacttcatcatggtattgagttgttgcccatttcccgtaagtcatagcaatgggcagtccagtttcagtcaaatcttttttagattgatctacataaatgaagacaatgtaatttggtcaggtgtgatgccttatacctgtaatcctagcaatttgagaggccagggtgggaggatcacttgaggccttgagttcaagaccagcctgggcaacatagtgaaaccctgtctctacaaaaaattagaaaaattagctgggcgtggtggtgcttgcctgtagttccagctgcccaggaagctgaggcaggagtatcacgtgagcccaggaatttgaggttgcagtaagttatgatcacactactgcattccagcctgggcgatggtgagaccctgtctcagtaaaaaaaaaaaaaaaaaaagtgtaatttatatttatacaaaattggcttgaattggaattggggtttgtctggtttttgctttatttatgtgtatatgtatgttttatttatgcatatatatacacacacataatatatatacacaaatatttttaaaatattatttatatatttacatataaagtatgtatgtataaaatacgtgtatttatatataaatattatatatattttaaaatagagacacattcactctgttgcccaggctgtagtgtagtacagtgatcatagcttactgcagtcttgaactcctagcctgaagcaatctttccacttcccaaagtgctaggattacaggcatgagccactgtggccggcctgtcatttgttttcattttaattgagcacatttgacctcaatttattacaatctctctctccattatttaatttagaaaagcttcatgaaagctttttttagttaaaatatatgtaacataaggccgggcgtagtagctcacgcctataatcccagcactttgggaggctgaggcaggtagatcatctgaggtcaggagttcgagaccagcctggccaacatggtgaaaccccatatctactaaaaatacaaaaaattagctgggcatggtggcgggtgcctgtaatcccagctacttggcaggctgacgcaggagaatcgcttgaacctgggaggcggaggtctgcaggcagagtgttgagtcacatggtaactatatatttaactttcagaaactaatgattttccacagcagctgcactactttacattcccactagcaaagcacaaaggttccaatttctctacatccttgccaacacttgtttttttaaatttttttattttttgagatggagtttcactcttgctgtccaggctggagtgcaatggcacagtcttggctcactgcaacctccagtgcccgggttcaagcgagtctcctgcttcagcctccctagtagctgggattacaggcaccccccatcccaccatgcccagctaattttttgtatttttagtagagatggggtttccctatattggccagctggtctcaaactcctgacctcaggtgatccacccacctcggcctcccaaagtgctgggattacaggcgtgagccaccacatccagcctctagtggctgtttctatatcctttgagaaacatttatttttttgattccaaagtcagaattagatatatctaatatatgtattagatatatgtatatctatattatatacataactttctattgctgttttttaattgttcctttattgtaattgagacgaggtctcaccgtgttgcctaggctggtcccaaactcatgggttcaggtgatccacccacctcggcctcccaaaatgctggaatacaggcatgcaccactgtgcccggcccgcttttctgtggcttctacttcagatgcactctagagctcatccattccattttctgccttcccagattggaaccaaccagatggctgtgtgtgccaaagcacagaacaaacctttctatgtggttgcagaaagtttcaagtttgtccggctctttccactaaaccagcaagacgtcccagataagtttaaggcaagagttttacatatttgaaggggtactaaagtctaaacagaaacctttggaaattgtagtcctaagaatgttccagtaattttttcacttcctattgctactttccccaacacttggaatacaaagataaattggtgattggactcacacatttgtccctagaacttcagtctttcagtctctttaagtagcaccatagatgggtggagaggaagcccgaagctggtgggtaagtcccagctttgggcttaactgagctcagctcccatcaccacaacttacaaactgtgcgagttgaggcaagtcctttcatttcaacctctgaaccggttttcttgtctgtaaaatggcatagcagtatctgacagggtcatgaggattctaagataatcttagcacagtccctggcacgctgcaagctctctattgtgactctcgatcttcccttgagaggtctggagaagttaatccggcatgagaatgaggggacatgggatttaagtttgttacactacagctctcagccagcacactgccatgatctggctcatggccacaactctgccctcgtctctagtgtcctgcatagcttagtttctcccattttcagagagcagtctcaggaagtagcacactgatcactcacaccaaggccctaccaggtcagagcactaaatattcagtgccgactaatgtgtacttctctcctcagtataaggcagacactctcaaggtcgcgcagactggacaagacctcaaagaggagcatccgtgggtcgactacactgccccttccttaatcactctgctgtttacagacctgggcgtgctgacaccctcagcagtcagcgatgagctcatcaagctctatctgtaacctgtgagccctttcctgccaaggtgcagcttacgtagttgaggcagggtgagtagctgcttgacaccccagtgagtcaggccaaaactgagatgtgtttaatgaagatttatggagtaaggacttaaaatcatacatcttggagaacctttcttactcatttcagtcccatctaaaaatgtgtcagctattctaaatcccaacttaaattgttcttacggtttctagaaactttccttttcagtttccagaaatacaagttagataattggctacttaactgatgaaagatgagcccaagtccacctgtcttcatcctcccctgcactccagactgatctgcctaaagcacgcgagatgcaggcgaaaagcagccacacccctctgccacaaatgaccaacagctggtcaggacgttacacgcggtgccttgtaagaggcaagaaacacttgctgaatctgcatctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaagacgctga

SEQ ID NO: 6282 - DNA, 6683 bp, Homo sapiens
ctcgcccgccccggaagtgcaaactgtgtggtctggcaggtgtggattccgccggtgaaggctgaaggcagctaccttaaagatgccgggatccgcagcgaagggctcggagttgtcagagaggatcgagagcttcgtggagaccctgaagcggggtggtgggccgcgcagctccgaggaaatggctcgggagaccctagggttgctgcgccagatcatcacggaccaccgctggagcaacgcgggtgaggccggcctgcctccgccggcgaacctggcccctgtctgttcccgatcccagggctgaaaatttcccaggcctcacttcgcgttggctcctcttatcctctctcttttggactgtaggggagctgatggagctgatccgcagagagggcaggaggatgacggccgctcagccctccgagaccaccgtgggcaacatggtgcggagagtgctcaagattatccgggaggagtatggcaggtcaggctcacgtcctgggctcctggttggatccagtgacactttttgcacgggcccctctacctgctcggagactttattggagctgaacagcccttgttacctgcctgaccactcctccccacctctctctttgggtcttgttgcctctatagactccatggacgcagcgacgagagtgatcagcaggagtccctgcacaaactgttgacatccggaggcctaaacgaggatttcagcttccattatgcccaactccagtccaacatcattgaggcgattaatgagctgctagtggagctgggtaagaggcctgatcgctgggaaaatgggactggtcacaggcacataagggaacagaagcctctgaaggttgttcattagcagagatgggagattagctgtcttctggttctcagaggtttgtcctccttcctgattaggaaatgttgcaacaggtgacaggaccaaagtaatcctctctacttttccttacagaccaacccttgatagactacagatctgtggagtggaacagactctattaggacagagttttattttcattgtaaagaaacaaaatgaactccctagagagccaaggtcgatagacctccttcactatctgaatttttatacacacgtacacgtataccatttctatcccccttgtcattgcggtccaagtgacttgcagatattcattgtaatcagaggatgaagaagctgcttccaaattgctcccccattttttcttctctggccagtctctctcatgtagaagtgttgtggccaccttttggaggaagacttcttttaggccgaagctctctttaccctattctcagcactttaggatttcccagattgccattccttggctgaatctactgtcttcaaaatcagttgtaaggagctctgtagtgacagaggtggttcataggtaggggtacttctggaagagggcaggcagaaaatcccagaggagtggggcttttaagaaattgtgacatagctgggcatggtggctcacacctgtaatcccacaactttgggaggccaaggtgagtggattgcttgagaccaggagttcaaaaccagcctgggcaacatagtgggaccctgtctctattaaaaaaaaagaaattgtgacatttcactttaagcacattaaccctgtggtaccagggtctgctaggtgggcagtgcatgtgaagggcagacatctttttccgtatacgcgtaatgtgtgtttgtgatatagcaatttcatatatatatatatatatatatatttttttttttttttttttttttttttttgcaaaaccgttcttacagaagggacaatggagaacattgcagcccaggctctggagcacattcactccaatgaggtgatcatgaccattggcttctcccgaacagtagaggccttcctcaaagaggctgcccgaaagaggaaattccatgtcattgtagcagagtgtgctcctttctgccaggtaaggagactgctggagttgctactaagaaaaatgaaaaatgaagaagaaataaacgagagatgggtagggccattccaaccttgaattgataagcaagactttgagacactgagaagatcaagtaaaacattaagtgaattttcaaggtgttcgtcctgtgaacattcataaatagtggtttaagaaagttggggccgggagcgatggctcatgcctgtaatcccagcactttgggaggctgggcgggtggattacctgaggtcaggagttcgagagcagcctggccaacatgacaaaaccccgtctccactaaaaatacaaaaattagctgggcgtggtggcacatgcctgtaatcccagctactctggagggtgaggcaggagaattgcttgaacctggaaggcagaggttgcaatgagccaagatagcgccactgcactccagcctggacgacagagcaagactctgtctcaaaaaaaaaaaaaaagatggcgagctgctgggttcaaggaaagataacttgattcttttaggaatcaaagcagggtaaattaccttggggatgactaatgcttggtctgacctcacttgatcctaagtaaataataggtctcaaaaaggaaatatgtaaggatgcaggttgttttaaaataatgagccaggagctatcttgtcagcaatcgtgattatattatacatgcatgttgtatttccagttttatggctgctctggtgctgctgtggagcattagacatttattagcttcccctgggcttccctacagcttaccagagctatgagagtctgaaaaatcagttgtccgaaaaatgagttatctattggaaattatgtgctggatatgcccatatcacacaattccccagatccagttacatttgagagcacttttcactatttctcactctttctcttagaatcagcctttccctcccattgcagggtcatgaaatggctgtgaatttgtccaaagcaggtattgagacaactgtcatgactgatgctgccatttttgccgttatgtcaagagtcaacaaggtgggtatatctggagttatgttgaattcatgaagattatgtttctaaaatattgatttttatctcctcctgtaatatccacggtgagagaataaagtttctagcacctttcaaagtacatacttaggcctttttaatctgttaactgaatttcttttcccttttttctgcatcattgttcctctcttggagtagcctctaaatttggttgaagcattgaaaagaatgaagtattaaatagaactaaggcaagagtgtcagtttctagggattggctacagggctcctgccttatgctcaaagagcttggcagttgtggatagtgaatgaaaaagattcctggcttctcagaaggtatggcatctcaatttccagaaaatatgggactgagagcagtaggttttgcagtttcttgtcccattttacattcattctttccttggaaacctacttttaagctagaacttgtattgagccagggatcccttcacctctaccagtctgtgacccctcacgataccaattctgaggtctaagcatttagctttttgtggccagtggcccttttagggctccacccccaggatggctcacattttttgtcttgtcccaaaggtgatcattggcacgaagaccatcctggccaatggggccctgagagctgtgacaggaactcacactctggcactggcagcaaaacaccattccaccccactcatcgtctgtgcacctatgttcaaactttctccacaggtaagtgtgtctgtctctagctagaagccagcagaaaagaaggaagccaaagggtaggcttgaactctgggacttcaaccacctcactccagggcctccatttatctgcatttactcaatggattacacccagtggaggctggaaagaaccacagaagtcttgattcagtaaaacagttgagagttctcagctgtcaactttaggaagtcaagattgtaaggacaatatgtagttgggaaaggtcctttgcttacgattgccaccactccctgtcgcctgaccatttctgaaaatgccaagcaggttgaaagtaggatcatagaatcagttttgttattgttgcagggcctgtcctttgtaacctgaatacaagcaaggactaagtgaagagccatttcatcagtgatagaagctatttgctttgaaaacatcaacctatttataggtctctattttttaaattgaggtgaaattcacataacatacaattaaccattttaaagtatacaatttagtgatatctagtacattcacagcattgtacaaccaccactctctagtttcaaaactttttctccactgtagaaaaacaccctgtacccattaagtaatctctccctatttgtccttctccccatctcctccaatctgctcctgtctctatggatttgcccattttgtataaaaggaatcatataatatgtgacatgttgtgcctgacttttttcacttagcatgatgttttcaaagttcatccatgttgtaatgtcagaatttcctttcgaggctgaataatattccattatatgaacataccacaatttattaatccattcatctgtttatgggcatttgggttggttccagcttttggcttttgtgaataatgctgctataagcatctgtgtataagttttctgtgtggacatatgttttcatctctagggtacatacctaggagtggaattgctgggtctctagtttttataaattttttcctttttagttccccaatgaagaagactcatttcataagtttgtggctcctgaagaagtcctgccattcacagaaggtacagaagctgtgtgtgcatgcgtgcatgtgttgtgtgtattcggggtttgtgtgtgcatgtgttttggtctttttgttgttttgttggtcagtagaactgaatgctgtcaagttgtgttttttatcatacttcttgtggggactgttttctttagaagctcaaagtgcttgaggacctgaccaagtccatgttaatttgttctgagacaaatatattttagatttgttggggctattgtgggttggatcatttagcattgtctgggtttggctttgcatgctgtttgagatatagacaacaaccagttgggaaaatgtacctgttttcctgctataaggagtcattttggtgaattgactcccaaaggaagcaggttgtgaaatgttcctccttagaaaactcacctgtagcctggatagtctcatgtcttggggttcttttctctggcttcttctgaaggcagcagctcagctcattacgcgtgcagcctcatcagcaagggtggccttacacaccatctgagagcaacgcatagtagttggttggggtcctagttcctcttggaagttgattgacttcatccctttatttaaataaacattcaatcttcaagaaatagttattgagcacctacaatgtatccagcactcttctaggcactgaagataaaacaatgaatgaaaaagataaggccctgttcccacacattctattgtggaagacagatgagaaagtatcaggtcatgggatgcctgaggacaagcaaggctgatgtggtagaaagtggctaggggcctgagattgaggaagggtcttaatgagatgacatttcagctgagtcctgaatgaacagagtccaccatatgaagatcatagttttctatgagctggtgcaggggcttagccagttagaaaaggatggccatacatggctagacagtaatgagcaagggggagagtggtccaaattgtaattcatgtggtgtgtcagggagggcccagatcttaaacttcaatcctgagtttgaattttattctgagggctgtgcagaggcatgggagagttgtaagcagggattgtcatgatctgaagtcatctcttctggtttgcatttttccatagcttcccgtccttggggagctaatatgcctgcattctcgagcctggaatctatatgctacttaattatgagagagggagcctcagttttacctttagcatgtgtgcttgcctttcaggggacattctggagaaggtcagcgtgcattgccctgtgtttgactacgttcccccagagctcattaccctctttatctccaacattggtgggaatgcaccttcctacatctaccgcctgatgagtgaactctaccatcctgatgatcatgttttatgaccgaccacacgtgtcctaagcagattgcttaggcagatacagaatgaagaggagacttgagtgttgctgctgaagcacatccttgcaatgtgggagtgcacaggagtccacctaaaaaaaaaatccttgatactgttgcctgcctttttagtcaccccgtaacaagggcacacatccaggactgtgtcttgcctttcagatcttaacagagcagcagggcttaacttgttgattttggagcctcttagtgacctggttgcgtctgtgtcaggaacttaaactttctggttcagtagtgtgttaaacataacactgaataccttactgggatacagatttttgctcagaaatggctatgacactttttctaggctctaccaataaaagccacttgaaggttcca

SEQ ID NO: 6283 - DNA, 3794 bp, Homo sapiens
gtaacgcgtggctcccttgggctggcgggaggggccggaggctcgcgaggggcgggggcggcgacggcggcggagcgtaggggaggggaccggagaggaggggatgagcacacgggagaggagaagagggagacccgccgcctccctccctccctagctgacttgctccctcccgggctgcggctgctgcaaaagccagcagcggcagcgggagctgtccggaggccggcgtcgaggtgagacccgggcagactgaggctgcgggtaggagtggaccgaccgacggctgacgccgggcggactgcacgggaatgcgggtgtctggagggctggtggtggtgctgggcgggctgaaccatcgggaggaggcgccagcccaccgaaggcgagggaagccccgggagaggggctgacaggggatcgaaggagataaccaggtcccccagaaaggggcgggagcgtcctcgccctaaacgcgcagcaagaaaacccgcaccgcctgggagcccagggaggaggggaggatgcagagggagtggaatgcgaatgtcgggtcctctgcccagtcggcctgtcggagtgctatttgcacagctcgttgattttggggtgctgggatctgagagtctggatcttgttggatggacccagggagagaccctggagaaggtcctgtttacaaaagggttaatcttccccagggctctccaagcagaagactttgagtagagcactcctcccgcagggatgtcccaccctaaggcaaaggaaaccccaacttttcttcctctccctagaggcagtgcaaggctggccctgagacaggaatgtggcccaattgggcctgcagtgctgagcgccctcttccctcctcaccccaagcctatctcctcctcttccagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatggtgagccccatgggaccctagcccaggcctgctgtggctcccagcttcccgccagcgctgcaatagagcctctggagtaatcatgccttccttcccctctcctctctgcatggatcccacctccccaattccagggcctttgtttgcctctccctaggacctaaccctctgagccaccactgccctgcccctttgggtgggagggatatggaaacacgtgtcacacagcctcgctgacctgtgccctcctccccctgccccttcactcctccttcctcccttacccgccatctatggggctggcctctctctcttctggatgacttttccacctgatcccttctgggctggcttctcctgaccccggctatgtgcctccacccctcgccctaaccccagtcccggaacagcctgcagcagggggacgtggacggggcccagcgtctgggccgggtagccaagctcttaagcatcgtggcgctggtggggggagtcctcatcatcatcgcctcctgcgtcatcaacttaggcggtgagtgggggcttgggacaggcaggggaggaatggaagggttggcaagggcagctttactaacccctgcccctgctctctcctgtctgtcctccttacctctcctttgtctctccttgtctccccctccccccgtctgtccttccctctcctctcccacagtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaagtctgggggaagaaaaaaactaaaattcttaaaaaaaaaaaaaaaaggctattatcaaactgatttctccctttttgtatgccggatgctgcatgagtctgaaacaccaataaacggagactgcatgaga

SEQ ID NO: 6284 - DNA, 21383 bp, Homo sapiens
atcctaccctgtgccgcagccgcatcgccaccgcagcccggcagagccgagcccggcccaggcccctgcccctgcccggccctcggccagtcgcccccggccccgcccccgcccgcaggccccccgcagcggccgcggcgccccccggcgcccccagaccccggcctccggcacagaggcgggagacccggagcagcagcagaggcaggaggactaggaggaggaggaggagccgtcgcaggatgaaggatcggactcaagagctgcggagtgtgagcttgggggtggggagaatgggggggcgggaccccaatattgggggagcgcgtggggatggagtgggggaggtgctgggacgtgggggcgaaggatgagatcggaggttggtagccggagcaccccagtatcttcaggcgcctgatgtctctccagtgaacctgcattttggggacagtgcctggaaggggttggaggccatgaagacacaagggggcaggagaggtctcaggggcctcgaacaccccgcattcccaggagggccccggggtctggtctggggatgggagagagtggatatcaggagaaaccggaggagactgtcatcccctgggcaggtttgccaaagagaagcatgggggcggtgactgggccaggctgagagtctagcaggacccagattcaggggatgctacggggaaggacacaggttgggactgagatgccagcacctggcagtgaatgaagtgtgtgtgtgtgtgcacacgcgtgtgtcactccctatagggagggggcatctctccgagacagggagggaagaggtggcctccggagagagccagagggccagggcctgagacagggtgacccagaggtgggagatggggatgcagaggagagggccatggaacacgggccgtgctctgcttgggggaactggggcaccccgggcagtcaagggctgatgcaggccccaggtctgcaggcctgaagaggcccggctccaagagtctggccaggcagtccctggttttggggggacaggggaaggactgcagtggaggctgctacctggaggaactggggagtggggttcgatgagaatggtttcaggggcagggaggacgctggggtatttggagaaatgacctggggcccgaggaggcagcactgacagtccgcactgtgctgggctggtggtgttatgttaataagggtaccggccccggctgagctgcccaatgcactgagcctttacagggaactggtgggttgttaccccaggggttattaccccacttgacagatgaggaaactgagattcaggcgtgggaagggacttgtccaaggtcaccaagcaagtgggtggggggcagactgcaatctgggtttcctgtctgctaggttgacacaggtctctgcttttctggcctttgaaacagaagtttcagcactgggggtgaagagctgtcccctggatttgggggtggggacccaggttacagacagacgagaagaaggtgtttggaggcaagtgaccgctgtctctggggacagacaggttgccaaatgggaagcaaggaggagctggtggctgagggagggaattttaaaggtttctttattacatttttactgaatatacactcaggcatgaggaaagtgacagtaataataaacattgtttgaagtgttttatgcatattcactcattttgatcctcacagcaatcctatgagactggttatctcatttcatagatatataaatatctttttagatatatagatatatgttatctcattttatagataaggacactaagctcagagaggttaagtaattagaccaaagtcacacagctggtaaaggcaggattcaaacccaggcaggccggcttcagcatcggtgctgtcaattcccctcctcagtttgcagagcaggctttcatccgtgatgtcattagagccccactgacctcctggcaagtggacggggaggctctttcattttagagttggggaaactgaggcccagagtggttgaataactttccaaaggtcacacagctagcaggtgagggatccggacttgaacccagttcccctgctaccaggactattccatgactccaaaacccagggaaatggaagtgggttgggatcaggtggtgtggaattggggtacaattcgagaaagagggagggaaaaggctaagcggggtaagggggaggcaggggagggggaggcctcatgaatgagtcaggggcccctgctcagaggtaaggaatcctgttggctgtggctgccggaggtggtgtggaagggtgaaggggctgagtggatgtggtggctttggtattagtcacagctcagggaaactggagattcaagagggggcgggcggggtgggaaaagctgacagattcaggtagcgtaagggtctccctgctacagttgaaagcaaggagcctgggatgcaggagacacctggcagggtgtgggggacctggaaacggggtctctgagacactgggagggatgaggcaggggcggtggtgggaggggacattagcccaggggactgattgtctttccaacagtaccttggcattcccaaggggttctcaagtccgtttgtcacacagtggtttcgggagccagactgtctgggttcaaattctaattttgctacttcctgtgagaccttgggcaagttgcttaacctctctggtcctcaatttcttcgcgtatgagttgggagaagtaagagtgcctgtttcacagggttgtcctgaggactggaagtagttaatatgcatcaggtgcctaggagggggcctggcgcccagcagtgctgtgtgtctgttacccagcagatggcttgtttatttctcttcaacaccacacaagccccctgcgatgggcaggacatggcccctattttattttggagtacattgagggccagagggggtaaaaaaaacctgacttgtccaaggtcagatagcttttaatggttgaggtgggcttgaaccagggttttctgcgtccagtttaccaggcaaccttggttggtgctaggctggttgtggaggctgtgaaaaggagttaatcagctaaataggtgtcccagggtctaaggagtgaagccagagtggggctccagaggaaagagcagagtgagtgaggtggagaggaaggtgggttatgggagaagacaggaggggcacagggagggctgaggtctgagacgcagctgtggagtcgggtgggagaagtgcggagacaccctgggaggaaggtggggcctgcactgcaggagcctgaatctgaggctggacaggatgaaggctgctgagggaccgccccgtgccccaaaggccctcaggtatgaggcaggcacagtaggtgctttagaaacgcagccctgaaatcacagggtgcagagaccaacgaaccctgggtgatggatccatatcctccagctgctctgggctgcctttatttatatttaaaaaaatgtttttagagacatggtcttcctctgtcacctaggctggagtgcagcggtgcaatcacagctcactgcagccttgacctcctggtctccagggatcctcctgccacagcctctcgagtagctgggattacagatgcgcaccaccatgcctggctaattctttttgcttttgtagagatggggtctatgttgaccagactggtcttgaactcctggcctcaaatgatcctcccgccacgccctcccaaagtgctggtattccaggcatgagccaccgcgctcggctggcactgggcttctttctgctatccaaacacacaagtttacccctgtccaaggaccttcgcgcatgctgttccctctgcccagcatgctgttccctctgccctgaattctgtttccccagcactgtggcacagttggctccttcaggacctagctcagatgtcacctccccagaaaagccctgctaactgtcctgtagaaatccttccacaatcccccccaattcccatgtctctcaattccatctttctgcttatctccctcctgctattcagcacaatctgaaatggtcttgttcacctcccattgtctgcctcccccactggaatgccagctccctggaggcaggccctcctcgcctgtcttcttcaccaccacatcgccagcagcacccagaagagtacctggcacaaatcagacacatccgttagatgaatgaatgactccatgaagcagagggaggatgagaaaggggcagggggtaaggcaggaaagatggaggagagaggtcagggtgagagggccaggctgctcagggggagggagcaaggagaggccccagccagggagacagatggactgaagcagagggtgggggaaagggcgcagggggaggctgctgcctccgatcaaacgatgatgcttgcacccctgaggagcatgggaagcccgtgtgtgtcagtgctggggcacgcatatgtttacacacacacacgtacacacacgcacactctctctgacttttctgtcacccaattccagtctcttgccgcctctgtgtttttgtcaccgtctcaccatctgtctctctggtcactgacttgctggctctcactgtcactctcctccttccgcttctgtatctgtccttgccgtcgctccacatcgacatacacacaaggcccgtggtggctctggtgtggaagacctggacttagggggcccctgaggaggtcaggctgcagctggaggcttggatctgatgtgcgcagtccccaggtgcttctggaaggggctcaggggcactgcactctctcattcaatccctctcaagtgctcaaggagctgtgcgctgtagagcagagtgcctgagtttgagtcatcccatcagctgtgtgatcttgggcaagttacccaatctctctgcgcctccacctcctcatctgtccagtgagaataagaatatgacctcatggagtggtcgtgaggattaaacaagagatgcaggctgggtgcagtggctcacacctgtcatcccagcgctttgggaggccaaggagagaggatctcttgagcccaggagttcgagaccagcctgggcaatatagtgagatcccatctctcaaaaaaaaaaaaaaaaaaaggaaaaagaaaaaaaaagaaatgcaaagcacttgtaataggacccaactcgtggtaatcagcacatatatgttacatcctcgatttgcacatgaggcaactgaggcttgaatcgttcacctgtaacctgaggccaccataaagtagactggggcacatttgatcatcttttcctaggtagtctggtttgcccacagcctgctttctttttggctggcctaacttcttccagaaatggatgctgtactcattactaaatatgcatcactcagagcacggagggcccttcagagcagggtgggcacttgcaccagtctgctcatttcagtgatgagggaactggggcccagggaggagtctaagtttgcctggggtcacacagcaagacagacggaggctgggagggatggcctcctgtccaagctcttcctgcagccctgggcccctcctactgattttctgtcctggctgcaggagttcagcagtcctgaggacatggcagagtgggctttttaggaccaggagggactgccatctgtcagcaggacagaagggagagagcctgacatttagtgccagacagtcctgggttcaggtcctacctctggcctcatttgctgtgaagctttaggcaggtcaggcaacctctctgagcctgtttccttgtctgtaacatggaatcagccggtggtaggcattgttaccactcagcaaatgcagagactaggctcaggggtagagccaaatggtcttctaacagctgacctggggcaagttcttttttttttttttttaagaaacggggtcttgctctgtcacccaggctggagtgcagtggcacaatcacagctcactgcagtctcttgacctcctgagctccggggatcctcctacctcaccctcccaagtagctgagactacaggtgcgcaccaccatgcccagctaatttttgtattttttgtagagacatgatcttgctatgttgcccaggctggtcttgaactcctgggttcaagtgatcctcccaccagagcctcccaaagtgctgggattacaggcgtgagccactacaactggcctgagttatttagctctatgcctcagtttccccatctataaaagggggctataataatacctccaaggggactgttgtaagaatgaaatggatagatatatgtggagcacatagaacagtgcctggcacattgtaaaacatcatctaaatatttgcataagtataattatgttggccaatggtccttacagagtcctaatgaagattaaatgagataacaagaatgtaagacttacgcaaaaaataccatcaagtgctcttgttttgctaggttgtccggacacagagccttccccagattgggacttagcaggcgctcactgagagggaaagtaactgggagcggaaagtcagtgggggaggtagcccagtctggagcctaacagcggtctttgaggggctggatgcccatggttttctggccctatgtggcctgggtgcccttgggcaagtcactctccttttacccccctggcttcctgttccctcatctgtgaaatggggacgatgatgtttatgcagcttttctctcagggctggtggtgctgaggatcaaaacggattatggatgtaaaagtgtttgtaaatggtagaggattattagctcccagctctctttgtatttattataccaaataaaccacacttgggccttctatcattcttcctgtcttgagggcaaacaaataggtagcccagggtgctccagagatgaacctaagggaggtggctccaagaacaacaggagagattgaaattagattttaggaaagacttcctaacattagcatggggaagggagagacacagagaacaggaaagtcctcaggcacccgggccagggagaggccgcatgacctgcgtgaggctggtggctgagtgagtggttgaagggagagaaagggcagaggaaggcttttggctctaggggaaggaggccttgtagcacagctggattttgaggacagagaaagtgaagagcatcatggtaggccgatgggtcctcagaggtgagcccagcatcccagagcctctcagggtccccaacttatgccacctgtgccgccccactttctgggggcagctgtgagccaagacagaggaaactccctttccaggcggatggttgggattgtctggaaattcaacacaagtgctgaacacattttccgacacagtgtgggcccagcgtctgtgtgaagactccctggagttccatttgggctgggcttagcagggaggctggggtggctcaggagcgtggagctggaggccccccaggctgtgctggcttttcctggggctgtggggcactgctgatcctgagttttggctgtgtggactgcacctaggtcccatctggccctgtctaggttcaatctgagctgtctgggatctgtctgggatccgtgtgagcctcggctagttcagtctgagcctgtctggtttctgttaggccctgtctgcgttccgctgggaccctggcaagctcttctttttggattccaactgagtacacccccaggtggatgctgtttggatcctgtcttgatttcacccagcctctggggtttggattctgtctgagctctggctgggttctttttggaaatcagaatgaactctgtatacatttccactggggctgatcagggctccagatgtcattaagcttgatggactcagattttgctgtcagacctctgtcccaagcagagaaggactcaggtgtgtgtagcacagggcacctcccctacagcctctcctgtccagctctgagtgtgtgtgcagacatgaggctcggagaagctggaagaacaagcccagtgagccctcccaaatgtcctcaggggtgcagctgaaagccagtgtgtccacacatgtcagtgcggctcagctgtgagtctgcgtgcgggtgaacgccagcatcagtgcatctccgtgtgggtgtcgggggggcctattcctgtgtgccttgggtgtcagctcttctgtctgtgtctcgagtctgtctgtcggtggcagtggtgctgtgggtgggtaaatctctttgtgtctctgagccctgcgggtggagggttgagcagctgcaggttgcaactgggaaatccaagccagcaagagtaggtgggtgtgaagttggaaggggctggatgaaagcaagtgaatccactgcgagggagagccggctgggaggggagggagagtgggcgggaagaggggggcacagggcgcgagggaggtcggggtgctgcccgtatctcttatccagccctcactgcttgctcaacttggcgcctgccgctggcagtgaagtgaccttgcacaggggacatgtctggtcaggtggggcaggagaggaagagaaggagtaaagtgagatctgggcaggagagcaggaacagtagggagatccaggctcccgggactctagtccaggacccttcatggagcccagggtcagttactgcaagcctgacgttgagccgttgttgaaatattgaaatcatccctattggctggtcaaggctggctctgcgcccccaaggccacatccaccctgagagggggtctttttccaattccttctaaggaatcctttgggctgacaaacacttttggtgcctttgccatctaccctgcatgggacccctcccaggacccctcctctgagcctagagctgggagcacctgtgtgtgcatagcagggagagggtgggagagctggagagccagccttggggacccaggtagggcctgctcatggactcagccttccttgtccccaggcgaaagacagtgatgatgaagaggaggtggtccacgtggatcgggaccacttcatggatgagttctttgaacaggtaatgggcctccaaggcccccagccccagccccagccccagcacccagccccagcccctagtcccaccgcccagcctcagccccggcacccagccccagccccagcacccagccccagcccctagtcccaccgcccagccgcagccccggcacccagcccctagccaccgacaacttccttttccctgtcccccacttccctgctcctgcaccctccctggccttttatcagccgttctggggctggtccattcccctgaaccctggctggttcccctggaacccgttgtttggcctgacagcttggctgggtatagccgattttctgctccaggtggaagagatccggggctgcattgagaaactgtcggaggatgtggagcaggtgaaaaaacagcatagcgccatcctggccgcacccaacccagatgagagtgagtgtggctgccggtgactgtggggtgggaggagaaggggcctggggttcccacccagacatctcacttgccctcgccctcccctcagagaccaaacaggagctggaggatctcactgcagacatcaagaagacggccaacaaggttcggtccaaattgaaaggtgaggagtacaatccctcaaccaggaaggaaaagaattgtgggtggagcatggtggctcaggcctttgggagggcgaggcggggccaattgctcaatcccaggagttcaacaccagcctgggcaacatggcaaaactctgtctctacaaaaaatacaaaaattagctgggccagtttgggaggccgaggcgggtgaatcacgaggtccggagttcaagaccagcctggccaagatggtgaaaccccatctctactaaaagcacaaaaattagctgggtgtggtggcgggcgcctgtaatcccagctactcaggaggctgaggcagagaattgcttgaacccgggaggtggaggttacagtgagctgagatcgcgccactgcactacagtctgggtgacagagagagactctgtttcaaaaaaaaaaaattagctgggcatggtagtacgtgcctctgttccaactacttgggaggctgaggcacaagaatcgcttgagcccagggggtcgaggctgcagtgagccgagatcatgctgctgtactccagcctgggttacagatagagaccctgtctcaaacaaaaaaaaaaaaaacaaaaaacaaacaaacaaaaaaaaagggactgggcgtggtagctcatgcctataatcccagaactttgggaggccaaggtgggtggatcacctgaggttaggagttcaaaatcctaaccaaatcctggccaaaatggtgaaaccccatctgtactaaaaatacaaaaattatccgggcatggtggcaggcgcctgtaatcccagccacttgggaggctgaggcaggggaatcacttgaacccgggaggcagaggttgcagtgagccgagatcgcgccactgcactccagcctgggtgacagagcaagactctttctcaaaaaaaaaaaaaaagaactttgccatccattgagcaaaacaggcctttctctaaggaatttctacaaagttccaggagccagattattaaacagtcagaaagcacaaaaccccagctttcccccttgctccagttctttggagaaagatatatgataggaaatgagggaaaggagactgtctaaattgcatctgagccctgctggttccaccagcatgaaggttcaccagaaaaaggtgatcttccgagtggcttcgatttcattaagtcctcatctctcctgagcaggcccccggcatggcacagagcacccagtgggtgggcccagcaaatgcctctgaatcggtatccttggctcaggacagattggacttgtgtggctgacatcaggggctggcgagctttcaagagggacttgccaaatgttcatttattcactctaatttaaggacttgggtgctggtaataaccaccttcccccaaagcaccgtgggttgggaacctccttgtctgctcataccagggaaatagcagtgttactggcatgctgttttgcatgctcctggtaagtcagtatcagaaaacatatgctgagcacctccaatgtccgaggcacattgctaggctttggggaagaggagctatatcagctacctggcctggagaacactgaccttggcccagagagagaagggtagtaactccatgccctctggactggaggggaggccatatgtgagcctcagatgtggatttgtaaaaacaagccctttgtactcaggagagtctgctggatggaaactgtctgaatctgggagcatgttaagtgcaaatccaggcagacagagtctaacctccaccatcagctcaccctggacaagtcccctactctcagcttccttatcagtacagtaagacaaatgaaagcaatttcaaaattagcttgttttgggggtggggggtggagggcatcaaaatacttttttttccaaagtcatacaaagaatcccaatatataaaacataaaagtcaggttgttctagctgagctggagctgggagcacctacctgcctgacctctcttcattctctgcaacagcccctgaaattccttctcagaaacaaggttcctgctggcagtttaaaatcccctgggctcaatggtttctctaggtccatcaagccttgaccttgaacactctctgtaagaccctggggagggctctgtgggtgaggggttcaggaatagaccaagaaagaagctggaaaagtggccgtggtttagagaagctgacctttcagacctccaggaaaggagagaggattctcttagtcctcttccagctggtggcatgagctcaggctttgggtgtgaccttgagtgagtggttttgcccactggaaactgagtttctagtctaaaacatgagctgatatcactgaactcccaggaatgttgtaaaaagtcaatgagatcctgtaagagacccctccctccggacttgaccccagccccaaggctgacagtcgggccccaatctgggccagccgattccaatatccctgggccatgtgttgctgagccagagctgtcactcaatcgggggagccttggggtgccatccggccccgtacctcccccactgccaacagaacggaggagtgaggctcttaggaatggcctggaggctggtgaggtctgagagggccggtgattcatccctgctgcattttctgatctcaccgaggtagattttgccacaatctcttttttagaaaatcggaacgatagtgtcaggagtgcttgatccagaagcaggaatctcagttaatctgtgcacttttccagaacgtccttcagaagtgggaattcccggatcggggatcaccttacagggcagggagagggctgctttctcccttggaatatccatgtgtttgcccttgaattcccctgggaaagaggggccactagaacctgatccacctggaggtgactgccttccatcagaaaaaaggcaggctgtgttcttgccccctgtccagaggctgtaggaagtagggagcaccccacatacatggccccttcacgcgggctgggccggcacgccctcatggagttggacaggaattaccactgatgggactttccaagacccagttctgccactagaacaaatagcccccttctgtctggtgaccctctgaccctcagtatcccttcctgcctgccttcggaaccccctcaaacgtctgttcgtctgtttatctgctggctcctaacaccaccctggggcaccgctgcccgcaactcgccctggggatgacgtttctccccgggcctggcgctgccgcggggtgttgaccattcgtacgccccggaccctcgccccatgtgccccgggtctcccgcccatcgctgcgccctctctcccgcagcgatcgagcaaagcattgaacaggaggaggggctgaaccgttcctccgcggacctgcgcatccgcaagacccaggtaggaggcggcagcccattgggggtcgggtcgggacccagctcgggaggagcccaggctggaggccggcgggccagggccaagcaccggcgggggcgtggtcagggagggctggggcggggctctgggggcgaggctagagcgggcggggccctgggcggggctctcggggagggcggggtcgagccgcatctcagcgcagtagcagtgtctctagctggtgttggcctaagatgggggtgccgggcgggtagggaaccatgaacttgtcagggtttgggatcgcggccagagctgaagaagggaccgtaaactaattcagcgcttcctccttattccgcccatgcactgcctcctcacctgcctcggtctctgctccctgactccctccctgatccctgactacctccctgatccgtctgtccccccacccccaccgtagcactccacactgtcccggaagttcgtggaggtaatgaccgaatataacgcgacccagtccaagtaccgggaccgctgcaaggaccggatccagcggcaactggagatcagtgcgtgtgccccccaccccaggaccccgaactccttgaggctgcccaagcccccttccaggcatttcctctctggagggggcccctggcttaaggcggcgtgggagggtgggccccaggtccccgccccatcaccccacctcaggcccccaggctgtcccagcccccgagcagggagtcctttcttcccgcagctggaaggaccaccaccaacgaagaactggaagacatgctggagagcgggaagctggccatcttcacagatgacgtgagccgcgggtggggcgggctctgcttttggaaaatttttgcctcccctccctaagttcaggttgaactaaggtcctaagtccaccctggaaaaatgagcagcgggaagcctgagccgggaactggggaattccatgggagcggagcaggaaggcacccccatcagatgacggagtcgttcgtgtgccaggcactgttctaagcactttccatcttcacattcacccaccaactcatttaatactcacacatccccttcgaggaaaccccatttcacagatgaggaaaactggcccagagagatgaaatcacttggcaagatctcagagcgagggagagggccaggacttgaatcctgtctagtttcagagtcagaactctcgagccctaggatacacgacatactctgctactgaagcaagtcgtttcaccagagaactgatttgcctacattaaaagaaattttttttaattaaaaaaaactttttttcttttttttttcttcaagacggagttttgctcttgtcacccatgctggagtacagtggcgagatttcagctcactgcaacctccgcctcctgtgttcaagcgattctcctgccccagcctcccgagtagctgggattacaggcgcccaccactcggcctaaaaaaacctttttttgtagagatggggggtcttcctctgttgcccaggctggtctcaaacttctgggctcgaataatctgcctgcctcagcctcccaaagtgctgggattacagacgtgaaccaccgaatccagcctaatttgcctacattttgaatattttttttaaaacaagttttagttttgcttaggttttgtcccctgtgctgcccttgtccttttacatatgaaaggatgggctggccgggcccagtggctcatgcctgtaatcccagcactttgggaggccaaggcaggtagatcacctgaggtcaggagttcgagaccagcctggccaacatggcaaaactctgtctctattaaaaatacaaaaattagccgggcatggtggcacgtgcctgtaatcccagctactagggggctgaggcaggaggatcacttgaacctgggaggcggaggttgcagtgagccgagatcttgccactgcactccggcctgggcaacagactgacactctgtctcttaaaaaaaaaaaaaagaaagaaaggatgggctttccccgaacctagttcttgtttctctcagtggacttttgccccggcctgcccactcctgtctccgtttctgtttctggtggcaaaatgactctggttaagggttctagaccaggtttaaaggatgcgctatgactgtcttaaaagttttcagctcattgttatttggagaactgatctttgttgaaaacgcattgagcagcccggtgtggtggctcacatctgtaatcccagcattttgggaggccaaggaggatggagggcttgagcccaggagttcgtagaccagcccgggcaacaaagtgagacccccatctctacaaaaaaaatgtttttttgatttaaaaaacaatttcttttaatgtaggcaaatcagttctatggtgaaacctgctttaattagccaggcatggtggcgtgtgcctgtggtcccagctactcgggaggctaaggtggaaggattgcctgagtacaggaggtcaaggccgcagtgagctatgatagcaccactgcactccagcctaggtgacagagcaagaacttgtctcaacaaagaacaaaaaccaaaaaaaaaaaaaaaaaaaagacggggagactgaacactgtccaaacagccattgtatgatttcggcttatagaatggtcataggatgagcaggagatgaggggagagggagtctgggccttgactgctgaagggaaggtgtggagccttgggtagtggggagccatggcaggctgtagagcagaggagtggctcaatgtggtaagaacagtgagtaatttgggaagtgagtcacctggctgaggctgggtgtttgtggagaggaggcatatctgactgtgggtcacggtctcttccccactggctttctttttttttttttttcagcatggtctcactctgtggcccatgttggagtgaagtgaagcaatcatagctcactgcagcctcgacctcctggggtcaggcaatccttctgcctcagtttcctgagtagctgggaccacaggcgccaccatgcccagctaatttccttttttttttttttttttgatagaaacaaagtctcactatgttgcccaggctggcctcaaattcctgggctcaagtgatcctcctgccttggcctcccagagtactggggttacaggcctctccctactgactcttttttttttttttgagacggagtctcgctctgtggctcaggctggagtgcagtggcgcaatctcggctcactgcaagctccgcctcccgggttcacgccattctcctgcctcagactcccaagttgctgaaactacaggcgcccaccaccacacccggctaattttttgtatttttagtagagacggagtttcaccgcattagccaggatagtcttggtctgctgacctcgtgatctgcccgcttcagcctcccaaagttctgggattacaggcatgagctacctactgtgcccagccctgactctttttttttttttgagatggaatttcactcttgttgcccaggctggagtgcagtggcgtgatctcagctcactgcaacctctgcccccccgggttcaagcaattctcctgcctcagcctcctgagtagctatgattacaggtgcccaccaccacaccaggctaatttttatatttttagtagagacgaggtttcgccatgttggccaggctggtctcaaacttctgacctcaggtgatctacacacctcccaaagtgctgggattacaggtgtgagccatcgtgcctgaccaatgtgtacatattaactcactcagtcttcacaaccaccctgtgaggtgggcagtgttatgatccacattttctaggtggggaaactgaggccaagagcaggtgaataatgtgcctaaggtttcagctagtaaatgacaccggatttgaccctggccactccactgcggtggaggcgctcatggcggagaagggtgattgtagctctctccctcgtcaccctagatcaaaatggactcacagatgacgaagcaggcgctgaatgagattgagacgaggcacaatgagatcatcaagctggagaccagcatccgcgagctgcacgatatgtttgtggacatggccatgctcgtagagagccaggtactggctctgccacccatgccactctgggagcctccctgggcctgaggtcccctcttccagcccagcccccatccctccctgtgcatgtctcctctgtctgcagggagagatgattgaccgcatcgagtacaacgtggaacattctgtggactacgtggagcgagctgtgtctgacaccaagaaagcagtgaaatatcagagcaaggcccggagggtgagcggggcaggcggcctgggggtaggcgggggagcccaaggctgagcccgggctgaggtgagtgatggcagcgggcgggaggccttatctctggctctgacctcttcctgtttctgttttctctcccctcttctccctgccaccctctgccctgtctgtccctgcatctgtccgtgtgtcgatctctctcactgtctgcctgtctcactcctctttctgctgcagaagaaaatcatgatcatcatttgctgtgtggtgctgggggtggtcttggcgtcatccattggggggacgctgggcttgtaggccccccccacccttctctctcccagacccttcccccaccacatcgggagcaatacccccaccacccctttcactccatcccctgctccaggctcactcccaaaacagacccaggcagccccacccccacggcagaccctggtgtccctggacctcaccgggccatggaccccccccccgtccccgcacgtagatcgcagcaggcgtgattacacatgcacaccaacatgcatgccgccggcacatgctcgagacgtgtggacaccccagcgtgcgtgtgcgtgtgatgtgtgtgatgcaccagagcaccccctccacccccaccttgggtgtgtgtgcgtggtctgagcttcccccttcaccggggctgttgtgtagactgcagccaagtgtaacacagcagtccatcacgccctctctgtcctctgtgaacagtgtgtgtgcgtgcgtgagaccacagatctgtggacacaccatttgtgtacgtggaattttgtgtttcagtgtttgaacctaatgcaacagcaacaaagccactgatacctgagccctttgtgtctgctacaaaccaggcaggtggtgtgtgtggactcacactcacattctcagaggatccagggaggcccaggtacacacaggccatggcagacaccccatgtctttgttaccccaggggctgtggcatgtcccaggagggtgtgcatgtgtgtgtgtgtgtgtgtgtgtgtgtccaggatgtgcctgaagtattgataggtcttctcagatagagccctccacactgtggactggacacctgttttgggagggcacagaaatgtgtatttcttgctacctagaatgcagctgtgtgtgtgtggcgtgcgtgtgtatgcacgtgtgtgtgtgtgttaggggctctctacatggtgtgctttttaatttttttttgttttttgttttttgtttttttcgagacggagtcttgctctgtcacccaggctggagtgcagtggcgcaatctcagctcactgcaacctgtgcctccctgacgcaagcgattctcatgcctcagcctcccaagtagctgggactacaggcgcctgccaccacgcctggctaattttagaattttagtagagatgaggttttgacatgttggccaggctggtctcgaactcctgacctcaggtgatccgcccactttggcctccctaagtgctggcattacaggcctgagccaccacgcctggcctacatgatgtgtttctgtcctgcctgacctacatggtgtgtttctgccctgcgtattacacacacacacacacacgtgcgtgcacacacacttctaaggacgtggccccatctggctttgtctctccagttgtccttgccctgcccccctccccagaggtgctgcccagtgctggtgtggccacacacggctacatcattgtgcaggcagagctccctgcctgcccagcctcagggctctgcatgctcacacctagatcctcatcttcctccatgtctctgcccagcatagccccgagcccctggaagctggtacccctcagtgtgctcacacgtggcaaggccgaggtggccccaggcaggggccataccaggcacaaaccatgcacgctggcatgggtgcggggatcacacgaatgcctcctggaaggaaagggctacttgtaggaatgttactgatgaggcaagatgccaaggacttccctgcagggatcaaagatcaggacacgaccccttcctcacacacccacctcagacctgggagaggactgtgtgtcccccactgccccatcggatgctctgggctctgcctcagggaactcgggtttggggaaatgtctatttcagaagtactggagtggccagtgtggcagtggccactcagggtgggctgggtcctgagacccatccccgacacctctcctgctgaaccctcaggctgctccccacaccagggtgtgactgaggggtacacaggcctggatttctggtgtgaggaaggggctagcacctcccctgttgtgtagccagcacaggcacaatttgtgggtttggtggcaggtaggtggtgcgtgggagaaaggacagtgttagaggtccccactccgtggtctaggatcatgaaaggtgaacacacaagtacacaaatgtgccatgccctggcatggggcttatgtgtgcacaggcaaggcactcggtgtgtgtgtgcggaccccagggtcccaggtcatgtgaagcgtacgtgtgtgtgcattgtatgtgtgtgtacattgtgtgtgcattgtgtgtgcatgtggccaaacagatgtgacctcccagaacacagtacccctccacctctacccgagctcagacagccgagctctcccttgtcctgtgtgtgtgtcagtgtggccacgtgcgtaaccccaggtgggctgtcctgagctgggggcctgcctgtcccttcccagaacgcccctctgcaggacaggaagtctgccccaagtctggccacggccctcctgctcccatctcgggctgcttgggagacatcagagcaggccccagcccccagtcccctcttccggccgcctggacaggacccccattcagcccaggtgtttccggaagtcccacggccttggggccacaggagaagggttgaagcgtggctggggcaccactccccccacctggagtggcattgggcccacagctgcccatctctgggcctcaggtggaccaggggatctctaagggtctgctgtgccctttctatgcgtcctccacatcctatgatgtgcctgcttgttggctgctgtctgtgtgcgtcctggcatgttgtctggaggctggtgtcttttgcatgttcttggacaaatgtgtgctacctgcccaggcgcctgcaaccattgagcccacatgtgccccacgtgtgccctgcgggtggtcccgggcctggccagggctcagtgctcctcttccccctcctccctgttcccacccctcatgaagcacactgcgtgtccatcccatgtacccgtgggtcgacacacgctcttgccacgccctgagcgtgtacacatgatgtgttctatgcattcaccctgccccccagcccgccctgcagaggacaagatgggtggccccggctccctttcccctaaccgcccctgcccgctgtgcagccgtgtgcgttggcgtgtgtttctgtgtcactggcgtgtcacgtgatgtagccgtgtttgctgacatgagcccctgcccccttctctgtttctccgttggtttctagagctctctccctccccttctcagaggggacaggactcctggggcctggctggggcccagagccaggccgccctctcctgttagccctcagagtcccatttctgttagccctcagagtcccatttctattggtgaccaacttgcaaatggataaaacacaggaaaatcctgccccccccttcctccctgcatgtcctgtccccagagccccccaccccaccctgggccaggtcaggccctgtgggacgggagaaatagcaaccaatccaacagcggg

SEQ ID NO: 6285 - DNA, 129979 bp, Homo sapiens
cccgcggacaccaggcaggcccggccgggtgcgcggccaaggcccgctccccgcgtccccgggcgccgcccccgcccgcggctgggctccgagagacgagtgggagagcgagtgcagcgagggcgagaggcgagccgagcaggccgccctgcccgcggccctagcgccggcgcgaggagggggcgccgcggcccaccctccttcctgcctggccgcgggccggccgggccgccgcgccccgacccccatggccacccaggcctccgggccgcgaagtcgcagcgccagacccaaggcccccgagtgagcgcgggcgccgaggtgagcagcgagcgccggggcgcggggggcgcagtgtatcctgccccggggcgggggcggcgcgaggcgtcgggatcctaggccgggtgatgagccgaggcgggttcggacgccgagcgcgcgcgctgggtggagatgtggggtccgcggggtccttgctttgtgtggtgtggggggtgcgcgaggtcaccggatggacgtctggggagctgcagggtgggggcgccctgcgccgcggctgagggtcttctgggggatgtgcggccagctgaggtcgggtgggggcatgggggcgcgaggggcgagtgtggcaagggatctgcttgcgccgaggcgcggagtctttgcggagcgtggggtggggacgtggggtgcattcgcggggcgccgggggcggaggtgagctttgtgagtgcgtccgaggtgggggacggggagctgacttccccatgcgtgacccgggcccggcgtggccatcgcttgggagtcagggccggcgaaggccgtgcgtggcgagatgggtgctcgggctctctgcggtgtccctacccgggcagcggccccggggcctgtgcgcaggccccgaggccgggcaggaagcggcccccgcgacctggggagctctgtagcggccaggcccgggaggcacgggcccttcggggatgacgtcacgggcgggggccccggacacgcgagccttgcgccccacagacggcggcgcagcccgccgcccttttcgaggccggccccccctctcacgcgccttgaaggcagggaacccgggaggaggacatgggggccgagtgcggcggggacaaggggtggcaggacgcgagggtgacatttggagcctggtcgcgccaggggcctccgtggtggggcggaggggaagcgaaacaccagccaggccctaggccgtcgcggccccagcttcctggggcgcccgttttcccggctagcagttttctttcttggggctcttggtcgttatccagtccacgcaggggccggagtgcgggctgccgcggtgctctcctgcgcggagcccgggctggcgggggcgcggcgggcctcgggctctgaatggatgggagcgagtgtaacaatgcgccggtgggggctgggggaggggaggccgcgcgcctgaatggcggagccggccgggcgctgctccgcgcgccgcacactctcccgcgccgccttccccgcggtttcggcgggcccggattcagggacccactcgggatctgcacggttcctcccaccaatactgtcccccgccccccttttatgtctttccaatgcagtagtgtgttgagaattcaagggcattacatctggttgcaatccagtttcatgccgctgccgggctgttaagacctcgcgctgacgtcagagcaggggaattacttctttttattttatctttttttagttgtctgctgccctgggaggagaggcgggggtgggttaggctagctctgatgtggaggcgccagcgtgatgggagccccgagctgggggctctgcttctcttcctgcccctgcccccctccattctccatacagtcctcgctctgctcagggtcaggcccaccccaggtggggggcagccctcgctgcagactgaatggtggcccctccctgctgaccacacagctgggttttcagaggctttcctgggacgtggccctcgggatctagaaactggaaaggaatcttctagtttcccacccctccccctcttgacaggcaagccggtatattcggggcccaggagcaaggaaaagtggccttttgcgtgacacagaagtggacacatcattctgatctcagggcaggctcagccccataactctggcaaaagctctcacaagcaaaagccttggagaggaggagaatgtatcaaggtgagatccaggccccagaagccaactgtggagtgggcaaaataggacctttcccaccagcctagcatccctctggcttctgtggagataaagggaactcaggggtactggagctgcctttctcttccactagactgtggggctctcataggcagggaccctgtcttactcctctttgttttatttttgagacagggtcttgctgtgtggcccaggctggagtgccttggcacaaacacagctcacttcagcctcaacctccagggctcaagcgatcctccagcatcagtctcctgagtagctgggatcacaggcgcccgacaccacacgtagctaattttaaatttttttttttttctagagacaggggtcttgccatggctggtcttgaagtcctgggctcaagcgatcctccctctttggcctcccaaagtgctgggattacaggagtgagtcactgcacccagccttactcctctttagactcccaagcctagaccaattgctttcaaattcttgcccgtgacctatagtaagaaatacatcgtaggtaactacacaggtcacactgtatatagctgaaacaaaagtttactgaaataactcccttactgtgtctgctggtctgtaatcctttttgttcttgtgtatttgttttttttttaattactgattgctacccacgaaattaattttgcaatccactgatgggtcatacccagaatttgaaaaaaacaagcctaggaaatgaatttgccatctattcatgcaacaaatgttaattgcaaccctaataattcctctcatgttaaactactcaagtaacacttggatacttgggtgaaaaatgcaaataagccagaaatatatgtagtaaaagtaaaagttcccttggcaccctccctgcaggtaaccccagttaatagtttgaacgtatccttccagactttttgttactcacttaatgcatatatatatatatatatatatatatatatatatatgtatgtatgtatgtatattacatataccaatccatgcatagttttctttttccccaagtgaggacatactgtgggctcttcctcggcagcttcctttttcctctccgtttgtcttggagaggttggttgtgtggcgaagtccttcagggcaagttctgggttgactcctggctccaccacatactgaacaggccatttacctctctgtgcctcagtgtccccatctttacaatcaggagaataacagtacagacctcacggtactgaagtaaagatgcagtgagttaatccatatgaagtttagagcagtgcttttgccaataaatgctgattgctgccgtcattgttgtattgttattgctgttctatctccatggcagcccatgtttgaaatgcattgctttccacagctgcctgtggccatggcatgggtgtctttttcctcccctatccaacgtgtggctccacagggagggaggaggtgcaacagcaacggtgtgcgcagagcagcgtctctgcgggagaggcacctgggcactgggcccaagggaacagggattttccaaggacccactgtttccaaagttctgtgcttaatgtcggggtccaagcaggaagcatccctgcacttgaccacaagaaggtcacagcccagtgggtgattgggacccagctcatagccaaggcctcgaccagagctggaggcttcctggaggaggggcctttgagcaggtgcttcaggcacggcgaggtaagagtgagaggagcattcctggcagagggaacacagtgagcagagcgagtctttggaagctggaagggatgtggcctgtgtgctgtagccaaacaagaggggaggacttggctcagaaagaatggtggcggaagaggttgggctgttgctgggacctcctcactggcctccctgcctccatcctgtcccctcccaggtgctggccagcagcactgtcagagcgatcgttctaaacccagcagataacctccagtggctcctgctgccttatgaataaaggtcccatctgtagttcttcccatgctgtccagggccatttctggtgtcctctgcctgccctgtcctcattcagtcctgtcccctccagccacagctggcacctccttgttaaggtgcagccatgtgcatccttgcctctgtgcatcgggctgggctgttccttccacctgggatgcccctcaccttcctccctgccgccccagaccaaaacagacgtcctgtctcctcctcctctgacctccgaggcagaatgagtcatctccctttgtctatactcgtggcatagcgtttatcacggaattatcggcaattctgccagtgtctgtcctccccatgaggctgaagcatcgaggcctgaaagcacgtctccttgctctctccggcccagtgccaagggcgaggcctagaacacaggacgctcagaaatgcttcctggcaggagggccaggtgaggtggagagggtgagagccccaacattgtctcccgtgggcccctttgatctttagcaagggcatgctcaggtctgtgtggatcttgtgctgtcagcctttagatgagtggggtgaggggcttggtggggtcggggggcagggggaggtggcgggcagcttccccaggctgcttcctgagggggctgggagaaactggctcatcctgttccccagtgattgaggcagagctgtgccctgttcctggtgggtcactggggatctgagattggaatgtgacaccagggaaggggaggcagggtgggaggcagggcttggaggtacaggctggggcttggctggcaaaggacagatttcgctccactggttcttgaacccgtgtgtgtgtgtgtgtgtgtgtgtgtgtgtgtgtgtgtgtgcacgcgcgcgccggggaggggagagatggggaagagaaaaacatgagggcagagaggtggagtgggggtggaggacctggggagtggtgagcagggacagggagagatggaagtggggggacggcaaggagtgagggagaagttcctgctgctgctgctggagagtatgaagagtgtgcttagggccaggaaggaaagcagccaggcgcatcgtctcacaccaccatcagccatgccttccttcgtctgtccagcagacaaccctaagtgttctcttgcttggctccatgcttgcatggccccagacaggagcaagcctgtggtccaggcttcgcacccttgaagtctaggggccaggtgaacaatgagcatccggtttctttcttttttttgagatggagtcttgctctgtcgcccaggctggagtgcaatggtgcgatctcagctcactgcaacctctgcctcccgggttcaagcaattctctggctcagcctcccaagtagctgggattacaggcgcccaccaccacgcccggctagttgagcaacctctttctgcacaaagtgatcaggctgggggagagaaggtgcccagaatgctgtgcagaggcaggagaggagggtggagcaggcgagcatggggtagggggcagggaagccatgtgttaggcactatggtggggagccaggactgctggggagtcttcctttcctctctggcctcggtctcatctgtaaatgggggaagagtggactgctcttgcactgatggtctgtggacccaagtcacccactccttgggcatgagaaaccagggaccccgtggagacagctgatagaacagggacagcaggcatgctcagagcgtctgcaggcccatggtcagggggcttgagggagaacatgcagaatccagtggagcttgggttcgcctcctagagttcccttcttggagactgtgctcatctggaaggcgagatagggtcggggtaggggaaggagcactggattcggaatcaggaaaagtggttgagttttaactgcagcatccctcgggcaagtcactttccctctgtgagggtcagtttcctcttctgtcaaaaatgtgaacgggctttgttgtaagcattaaaggtgagctggggcgccgtggctcacgcttgtaatcccagcactttgggaggccgaggcaggcggatcacttgaggtcaggagtttgagactagcctgaccaacatggcaaaaccccatctccactaaaaatacaaaaattagccaggtgtggtggcccatgcctgtaattccagctacttgggaggctgaggcacgagaatcacttgaacccaggaaatggaggttgcagcgagccaagatagcaccactgcactccagcctgggtgaaggagactctgtctcaaaaaaaaaaaaaaaaaaaaagtgagtgttgctgtgttttgtcatctggaaagcaaggaggtcctatagcttggggccataaacaggctttggggtcacaccagcctgggttcaaatccaggtaccagctgctcactgtggggctccatttccctcccctttaaaatgaggataataggcagggcgcggtggcttacgtctataatcccagcactttgggaggccaaggcgggtggatcacttgaggtcaggagttcgagaccagcctggccaacatgatgaaacccatctctactaaaaatacaaaaattagtcaggcgtagtgtcacatgcctgtaatcccagctacttgggaggctgaggcaggaggatcacttgaaccccggggggtggaagttggaatgagccaagatcgtgcctctgcactccagcctgggtgacagagcaagattcagtctcaatgataaataaataaacaaaatgaggatagtaacaggcccctcctggttgctgctgcacagttcctcagctgggatatcattgctgggctgttaggcagttgttttttgttttgtttgtttgttttttgagatggagtctcgctctgtcgcccaggctggagttcagtggtgcgatcccggctcactgcaacctttgtctcctgagttcaagtgattgattctcctgcctcagcctcccgagtagctgggactacaggtgtgcgccaccatgcctggctaatgtttgtatttttagtagagacggggtttcaccatgctggtcaggctggtctcaaactcctgacctcatgatccgcctgcctcggcctcccaaagtgctgggattacaggcgtgagtcactgcgcccagccttgggcagttatttttattgctaaagtgctttgtatgtagaagagatcaccattatgattattattttttttttttgagccggagtgttgctctgtcgcccagactggagtgcagtggctcgacctcggctcactgcaacctctgccccctgggttcaagcatttctcctgcctcagcctccctagtagctgggattacaggtacgcactaccatgtctggctaatttttttttatttttagtagagatggtgtttcaccatgttggccaggcgggtctcaaactgctgacctcaggtgatccacccgcctcagcctcccaaagtgcagggattataggcgtgaggtgagccaccacgcccggccaattattcttcttccattcatgccaggtcacatctaacccttacctgtaataacattggccaaaatgaggagtttggtgcttatttcttttctagccaggtcaaggcagatggattgagtgggtctttttacacatggggcgggtgagaattactagttttctggccagagtttctgtatgtaaagggactttgccccagtggtgtaggtggaccccaggaaagcatccagcaacttgtgactttagtggcagtataaccacaaactctcattcattcgttcatttataaatcacgtgtagaacaccagggtactgagaaaacagccatgaatgagatgcagctctaatgtagcatagtgggtatgcatatgtattttggactttgcctgggttcagatccagggtctaccacttgcgaacttagccaagttatttatctcctttacttggttctgtcatctgtaaaatgggggaactgatagaatctacctcatagggtggtcgtttgttcaagtccagcatcaggtacatagaaagtgccagagcatggcccttcctccattgttgcttttatttctgccctgaaggatctcatggaccagcttggtgctggaggaggtcaccctggccaggcttctcagtgacggttggcatccagaaaggggtgccaaagccccccaactccttgaatcagacccttctatagtgatctaaagctgcttctctgcttgactgttggggcctgatgctggggaggtcctgtgaggccttattgacctgggaaagtccgcctttgtctggcgccaggtgtgcttgattttagaaggaatttcattcctagccgggcaccgtggctcacgcctgcaatcccagcattttgggaggccgaggtgagtggatcacctgagcccgggagttcgagaccagcctggccaaacatggtgaaaccccatctctactaaaaatacaaaaagatagctgggcgtggtggtgggcgcctgtaatcccagctactcaggaggctgaggcaggagaattgcctgaacctgggaggcagaggtggcagtgagccaagatgatcgtaccactgtactccagcctgggtgacagagcgagaccttgtctcaaaaaaaaaaaaaaaaggaatttcagtctcaagtatgaaagcagaaagtgtttcctgattgaggactcctcaccagccggaggcagcaggactgcctgcctctgtgtgtctttaggcaggttcctcaagctccctaagcccgtttcctccttcatcaaaggcgaaagtaatagtacctatttcatagttttgttaagaggatcaaatgagatagggcctctaaagcacttagccagtcctgggcacagaatagtgtgcttagtaaatattgtgcctattagtgataatcagaattctcagacaatgtaaagtaaaaaccacctgaaagatttcttaggagctacagcttcatagagatgtgaagttgtaaacctcccagagcccaagtggacaaagaattgttacagcagctggagagacaggagacccagagaagcttaactcctgtagcaaagtcacccagcattctggcttggggtgggcagggatggggaatcagagctggctttcagtctggtgctctctggtgctttgatagtgattccttcagcaaatagctatgggcaaacagcattgatgcacagctgaggtcatatgggcctgtcttctggaagcttctgttctgatagggaaaatgaaatttctacatgatcatgatgagaggtaaaataaaatcacatgttctattagaagggtaaagtcatcgggtattcactcattcaagggggctctgtgccaggctgtggagcagtgggtctcattcgggggcgatcttgtgtctcaggggacactgggccatgtcaggagacatttttggttgtctcagctggggaggtgctgctggcatctagtgggtaaaggccatggatgctgctaaacatcctaccgcacaaggcagcccccggaaccacacaccagctggcccctgatgtccatgtgccgagggttgagatccctgtcttgggaagcagcagtggccaagcagatggagcccctgcccgtttgaagcatagagcgtggtaggtgagcagacgttacagaaatgattgcctagatatggatttatttgtaatgtgagctatgaaggaaaaggtagcgggaagaaagagggatgcgagcccttctactcttttaagggagggcctttggggaggtctttccagctgagggcacagcccaggcaaaggctcagaggcagaaagtgcaggagtgtgttgtgggtggggaggctaccaggcacctggtgtgtgcccggggagaagtcagaaaaaggcctggcctcggggggcccaggaagtggcttccagaggtggggagaaggcaaaagagaggactaaaccctttagtctgtttgagggaactccagcccccagcatgttgctctctgggggatccagcagggccaggtgggcagtgggagcaccctagccccaggtgctaccttccagcctggggccaagccttttccctttctctcatttgcagctttctgataggtgggaaagagaagcaggaaaaaagagcagaggaaaaacaatattttcatttcaaacacagataggggtgagggaggcgggaagtaatctggtttatgatacctttgagacaagcacagaaaatccccaccgtggcccgaaatagcactaaaacagacgttttgccaaatcagacttaattgagtggctctcttcttgactccagcaggatgtggctggagctggctttgttcccttggggtgacactgtcccctggggcccctgccctggctaattaaacaaagaggacctggtctcctaggcaggacaggagcctggggagctgaacttgacagcccttggcctctgcctgagagggccagaaatggttacaggggttgggaaggtggggggttcctgacaggagggccaactgagtgaaagcattggtgggagaggcctggttcctctaatatgtgaatatctgtctctttggatgctgaaagggatggagaaaagccagcattgagtgcctactattgtgccaggcattgggtggtcctcgctaagtcttattaactgccctatatccattatcaaggaaactgaagcacagagaggttaagtgatctgcctgaggtcacacagcaaccaagtggcagagctaggattagaaatcacatccgcaggctccaaagccaggccctgcctgctgcttacccccttccccatgttagtcactcatccattcgggagctaattcctggctatgaaataatattgtgaccttgtgggaagtgaaggcttgcagtcagacagccatgagcttggcttctgaccaaagcagtttttcttttcatggttttctccctcagaacctcctctttcctcatctatcaagtgggcataatcatgcctttatcctggagttgctgtaagggttaaattcagcacagaaagggatggaaggggaaggaggaggtccttgggccacccagcttggcagggtgcaataaaagagtcctaggtagagggagccaggcaagattgcaatatctctgtgcctatcagtgttgggtttctttatttgaaaggggagagagggcagactccactctgcaggtagagaaggtggtgtggaatgcgggtatttatttttctttgcctgtgaaagccctgttttcgctcaggctgtgtagggcttcccgacactgccatgggtgcgcacatctgcacactctggggtgcctgccatgcagaggcatctgcccagggtgggcactgagggcatccaccatgtgacgcccccgtgcagcctgtaagctctcatcacagtgcctgggatacctgggagtccccagaaagagtgaggatgggtgagggccatgaaaccagggcatcattcctccacctcctctgatcaggccctcctggtcccattcatctccttatctcctggcagccagtgggttgctgggaaggcaggggcagccttcctgattgacaaacaaaacaagcttgatcacaaaaggagaggggagactggctgggcctctccagctcccctccccgtgccccaggcatctttcttgctccacccaactggcaccctacattctaagatgctgcgagggggctccaaagccattgtcgaaggtcaggccacccaggctaggagccccttgcactggggaggtggattcaaggagtgatggggttgccatgaggcggcgcttgctgcaatggccgcccctccttcccttcagctggctgggcaggcagcttggagaggaagccaggcggcaggtagctgagaaagacatcggatccagggggagcagcagagaaagcaaacaaacagggctttgtgtggctgcagattggcggctcagaagggaagccaggcctgtggtagggggaagggagaggaaggaacgggagaccaggccattgctctgggccagagatcggcggctggaccagcccgggctgggcggccgggaagtagcgagtgccactacgtgtggacaggcatctggagtcacagcctggccgagtcccagctctgccacttcactccttaacagatctgggcttgtttgcccacctaatctgggcagtcattcacacgtaggactcgctggcttaggaggagagtcacctgtcctggcccagtcagtgtctgctctcatcctacccttgtcccgtcattgctggcaggacacagaatcaaagggattcagggtctcctgggagctgctagccttgccgggtctcctgggagggcagcgacttctgcttagatctgtgggcactttggagtctttgaccggggaggcagccgtgctgaggggaaacgggttctctgcccaataacggatgcctggggtgtaggtgggcagaggctggcatcaggcctgaggaaccaaactgccccctcctcgtcgcggtggagacgcacgaggtgcggggaggaacatagccaggaagacgggccttcctgtggggagggaggggcatcttttctggggtgtgagtcacattctggatcccagcgagggcagcccccaacctggcccacctctcagagggctgggagggcccgggcctcgaggaaaggcataggtaggagctgtcaggccagacgcccgggcagctccacgctcgcctccgaggccatttcctttcctctctccccgacctcgagaaggggcggcgagagggcaaatgcccgcgcttcctgccggtcccgcccctccccgcccgcggcgcccaccatcttggccgcgccggagcctcctccgcggtggcgtcccacaggccgcggtcggggcccgcgacgccgacgccgggagggggcccgggaccttcggggcgctgaggccaggcggggggcgaggcggggcgggccgctcgcgtcgccatggcagcgcccggcccggcatgcttcgcggggccgcggggcggggcggggtgctgaggccccgccccctggcggatcccgggtctttttccgggaacgcgggggcttccagtcccagcgttgcggccggcgcttgcgggttaccgggccaggcggcgcgcatctctgggcctcgttctcccactccctggatgtttggggataatgaaagagagtctgtgcgggttagcctcgggacgggctctgcttaccgagcccggcaaccccacggcaggggcctcgggaagccgcttccgagggccaggataatggggagactggacccctaccgcttgggggctattaaaagtggaggccaggcggcctctcagctgcagtctctgggtctcgagctcttccccggaactgtccatgggtcagtgaggacctaccctttgccctagggcaggagaaagaagggggccgggactgcacacctcacccggtccaggcctggaccctgcaacctcggccggcctccctccagcccaggagcacaggcctcccctagttggcagtcgttggactgtctggctgggaggcacattcctacctcctgagctcgggcaccccgcctgccctgggggagcctcttccagaactttgctgccaacactgccctgtccccacccggccttctcgtgccctaagtccctagttactactccacagccgccttctttcccctggtctttctctctctctttttttttttttgagctagagtctccctttgtcgcccaggctgtagtgcagtggcgtaatctccgctcactgcaacctccggttcccaagttcaagcgattctcctgcctcagcctcccgagtagctgagattacaggcacttaccacggctaatttttttgtatttttagtagagacgaggtttcacctcgttggccaggctggttccaaactcctgacctcaagtaatcctcccaccttcgcctccctaagtactgggattgcaggtgtgagccactatgcccggcctcccctagtctcttaagaggcaccgattcagctaccctttgtcacctcctacctgtactgagtaggcagctaaattgaatgtcggcctttgggtctccgaagggaggctgtatgctggttgagaggctgtcctcgcgcctttctccctcctcacccagggcacatgcacaaagaggctgagaatcggctacagttgcagcagaagagactcagggttgccatcggaaagaacttcccagtcctaagcattttgttcttagtgaaattgtcagattattgatatgttggttgtagagatatccaaaaatacaagaaaaaagtaaaaactttataattccaccagcagtatataactactgtcaacatactttctgtagatgtatgataaaccacttatgatacatctacggagtcatgctgtatatttggttttgtaaggcacttggtggttttaatagcttttttctcactataaaaggaggacaggcttattatagacttttggaaaatatgacaaattaaaaaaaaattcacccgtactctcagtctccaaaggcagccacagttgtcttccctcaacccccccaccacccgttcatggggtttttcgctttgtgttttttgtctgtttaggtatgccatcattacttctgtatatagcagttgatattccgcttttcttacttaatgctgtttaagatgctcctgaaccacgttcttgggagaacttccgagatgaggcagacatttctgggggtgatttgttggactggctgttcactttctgagtttgtcctctccctacctgtagccccccgacagagcccttctccattgccagtaaccaatgatatgcagcttgggtcagggggtcctgcttgctgggggcccaggaggctgcctagtgtggacagggacatgcaagactcatggcccgatgctgagatctgggctccaatagtaaggggctttactctggcccagatatgccaggtttcagggaggtctcagaccttggcctcatcctcattcggggcctcctttgcctgggcacactcagacccgaggccccttgtcgatcctgtgacccaccttctgctttgacttcctaggagttggtttctgctgcccttggctcctcagcccctcttctctagcctctctctggaggcatgcaggcttggcaccagcacagcctccctctgcccagctgccccttggccctagctacaagctgcccttgccctgacctatccctactgccaggcctgtctcttctcccctattccagaacggttcaattctaacacatccaagccctgcgtgaaacaggccttgggaaatcacagttgccagggacggtttggcatttaaaaggcatccaaggctttggggaaaaagctgaagagacaagaggatgcagggccctgtatcagaacagcatctggatttactggatggaaaaatcacagaatgcccctttcctcgggaataacagtcctggccgaggggcagcgggtgtggcatgggcacgccatgccctgcctggccaccacctgccatcaccgctgtgtactctcagaaatgaaaagattagggaaaagattagggagggacattgtcagcctgcagccaacggcccgctctaacaggtttattcagttgtaaaatatttaagacctgtttcactttacctgtatccaggaggcagccaggctggggccgagattgatgtgctgaacatgatttatttatctggatttgctcttgtggtctgggtgttacctgggtgtggaatttaaccaaatgacaagatgggtttgcgtgtgttcctgagcttggggattgtgtgtgtgtaaaaagtgagttggggtttgtgtacatggcagggggttgctgttaggtggcttgtgtgtctgtttgtcactgggaccaacgtgtggttgtgtgtgtgtctgatttggggaaatgagctgagggtatgggtgcttacacaccaggcagtatccacagcaggtcacacgttctttgtgtgttgggggcacctctgtgtgtggccgagtagctgtttgtgtgcatgtcctgtggtgtgagacctggatctctctcacccacttttcatcagtggtggggcattgcgcactgactgagttgctggggcatctgcttttccatccggccctgggtgagcactgacaacacctgactgtcttccagtagaactgggccttcctgccctgcagtccagagactagagggagttcggtggtcaaggtggtccaggcccacagccatagccctaatgcaaagcatggctcctactccagtgcgctgctgtggggtgaccctgctcctcctccctggacctcagtttcctcttctgctgcagagggcaggcgcccaggtccctgtggctgctctcacacacgggcttctgggtggctcatggcaggcttagggcattgggctggggtttgtctcctgccactcaagagttgagtcccaccagtactcaagaacagcaaggaatgatgggaaaatccctgctttggggcccaactctggattctgggcgttgtctctgtcccccatctaggcccagccctggcccagtagtcaggaaagcggcagacaaccctgtaacagccctcggtctccccctccccccacacccctttatattgaatgtgtctgtcactactttcctaatgaggctgctgagggcccccctggggcagatacctttgcagaccggaggtgagggggtgggccagcctcagggtcaggacaggaaggggagctgagcccttcccctgcctgcacccccaggccagctcagctgtggaggcattgaggcccctctcagcccctgagccagctgtgagtgggcatgagagcttggggaggtaggaaagctcaccccaggcactgagttttctttggcgctgtgactctgtagtaataatacttccacctggtcgatatctatgtttggaggcctactgtgtgccaggcactgagatcagccatgatctggatggacacacaaaatccctgcccttgagggaggtgtggccaaaggaagaaagacattaatcaaagaatcaagtgatctgagtcgtgcattcatgcatgggaatgccggctgatcacaagccaagacagaggccaggcagagcttctctgatggagacagggagtcctgtgcttagactgggggctgatccaggcactgggtaaaggctcagccgggattgaaggaatcaggagacccagattcttgctgtgtggcctcaggcaactgcccaccttctctgggctcctagaggctggtggcttccttctggctcccgtcacctctgagtggaactcaggcagtatatgtctcctcttcagtgctttttgcgctccctgccagggccctcaagacatctgtcggcaacatccttgactttggaatgctggaggcactgccccaggggacgcctggagccaagcacagcaccgctgcctcaggccccacctgccagttcctctgggcccttttgctctcacagagccacctggatcgaagaaagcctggaaaacattaaattgaagaattagtcccctattttgccccaaaattgcagagaaaagcatttattcatgcattcactcattcatttgcttgactagtgtttcctgaacacctagtaattgctgggcacactgcactccatgttggactgagatggcaaagtggtggtcctcctgccacgtcctgaccacagacctgttttgaaagcccatccattgtcggggggccgggggggggggaatcaaatgaattgccagtgagtaatcgttgagtgacttcatttccaatttccagtttacatttcttctggattattctaccctgcttcccccggccacagttggtggagatggctactgtctgccgggtaggatggcccacccagcccaccagctggtcacggtcccatcccccaccactccaccccaccctgtgcctctcctggtcatgtcacacatgatagtgtggcttcctagttatgagcccagcctcaggagccagactgtcgaggttcaaagctcactgtggcttgtgggaccttgggtgtccccctccaagcctcagattcctcttgtgtaaaatgggatcacaagagcaagtatccactactcctggggctcttggggagattaagtgagaaaatttatgctaaatccttaaaactcacataagccttggctgctatcgttgttgaataaatgaaccacttgcaggctgagaccggggctgtgtgtcacatggcacctctaggcctcagtttcctcagctgcttctttgggaaagcacatctgctctctaggttgggcctcctccctcgtccttcaaagacctattcttggggcctgggccctgtgaaacctctggctctcggacgcagcctggaacccctgagacgaggtcaagctccgcggcccgcctcctgtcgcccggccccaggcgggactgccttggcaggactcgggccgcgagctggaggcgcggctcccggctcggggctccagcggccgcgccccgccgcccctcggcgttcgcgcgcagcccctgcgggggtggccgccatcaaagcgtcttctcgttcttatgctaatgagccccattaaagcttaatggctgcgaacgcgcgggtttaattgcacctgcccgggcctgaggcgcggccggccgcggaagcagctgcgcgccggccgggacggccttaattacctggaaaacgacgcccggcggggaggggaggggatgggagagaagaggagagcagcggggcctccgcgaggccgggcctcgtccgccgaggccgcagtccggcccctctcgtcctcggggcgcggcgcgttcgtttcattaatttatcgccctgcctcggcggagatccgctcgcccgctccccggcgttcaaccgcgccggcttcgtgctcccccgcgccgtcccccggccatcttgggcttggcattcaaggcccttcgggaccgctgctgccactgacccagtgccaccctgctctgcacgaacaataataatggtggttgcacattacgtgccaggcgctcttgagggttgaatgtgacctcgcagagaccccagatgcctcatctcggccttactcccctcgtctttagaagctggtacctctgcctgcaacaaagacccctctccctcctcgctcatcctccctgaaacccacccctgcgcctccaacaagatgagcccctgtcctcctgggatgggattggggatgggtctgggccctttgttgaggggtgggctagcccatggtgaaggttgtctgggtgtgtcctccctctggactgacatttcactgaggccagtctgcctgactgccctatctctgcatgcccctgccatctccctggggatggccctggggttgtgggggctgcactgctgccctgagccttctgcctaggcagggggctgtgagactgatgggaacctcagggaaaccttgagacctaatggtattctctgtgggacttccctgtgctcctccccaccccatcaagtgatcctgggataggcgcctgcccctcctctctccctcattcccttctctcactcttctctttttgcagagggaaggaaaacggaagagggaatagacagaccgctcatgcagtttttagatggtcccctttccctcccctctctcttccatgtccccttgtacccagcccctcttttttctttctttgaagaccgcatcttgctttgttgcccaggctggagtgcagtggtgcgatcatggctcactgtagccctcaacccgtgggctcaaacaaccctcccacctcagcctcccaagtagctgagactacaaggtgtgcaccaccatgcctggttgcccctcctttctgccccttccagtcccatccctcctccctttgtgcgtctcagagaccaaagcctgaagcattgcacagtgcccactgggaggccacccagccctggtcctgcctgtgtcaggcaatgctgagagcacagaggggagtcagacttgggctctgccctccaaggactccagtcggggaggcagcgctcgaaaggaatacttgtcctctaatggaaaaaggaccaatttaaaggaagcagagaacagtctttgagctcaaactgggaaggctgggagaggcttctaagctcagcctggaaggaaggataagtgtgagctaattggcaggaatagcattccaggtagggaaacaattggagttcagccctggctagggcagaacactggctgacatgaggggagagggagtaagggacaaccacagaaaaactgagctcactccaaagtgtggaggcatgaggctggagaggtgggcagagggtcctctgttgcctagcaaccttcactgcctccctattgccaagaggaccaaattcagacccttcagttggcacaaaagcttgtaccacccacctcatcccaggatgcagcctattatcttcagctgggttcctcactaccaggccaagcctcggatgatgattgtgagcctactgtatatgggaaggggggataagcagtgaccccatcagggctaatagcagtggggcctgctgcccaactccatgccccttctcccattcttgtccccagatgtccttgcagacaaaatggaggtgaatgggcaggctgccaggagcgtcaggtggcatcacagccgggtagacagtcgtcactgattaatgaggtggtagaaacctagagggaggtccctactggcatgcctcggggttctgcccttgctctggtcaaggcaaggaatgaggctcacaggggtttagcacctccctgccaggctatgtgaaactcttggtatccagtagtttatcaccagccatgaggtggcttctcttaatatctcattttgcagatgcagacactgaggccagtcggggtgaggagtgagctcaaagtcactcatctccgaggtggcaaaattaagcctcaaacccagggctgtgtgacttcaaagcctgtgtttgtaactgcggagctgtgcggcatcagtaatgcatctgctgctgctgccagacgtgaggaggtggggccctgcctttcaacttcatctctctgacagtggttagcactgtactttacgtgtagtaagtgctcaataaatgcttgtggactggatgattggggcagtaagcagtgagcagggctcagaagcagtggagaggctccatcactcttcctcccaacctgcacctccacccccaggagttggacagcggctgtaaggggacttggagactcaaggcttccaggcagggagtgggctcacaggaggctagggaggatccaacttcctgtccaggtcagggtcaggaggacagccgcgccccctactgccccgctgggaggccaggctgacgtaggaaggctgcactgcaagtcagaatcatcagcaaaacctggggaatagagcgtgtgagggtttccatgcagggtggggactgctttctgatcaagcccctaggccaaaaacctttggaagggactctctgagggcagtgcattcttgtagcgtcgggagcaggagttctcccataacctttttggggtggggacccacctgtggctctggaaaggtgttggctccggctctggggctcagggggagggggccattggtgggcaaaacaagcatagtgaaaactgaggctcatagaggttaaggtcacagagcagagctgggtctgttttctttttgtttctgttttagttgcaacaggggcttgctctgtttgccgaggctggagtgcagtggtatgatcataaatcactgtagcctcgatctcctgagctcaaacgatccttccgccttggcctcccaaagtgctaagattacaggcatgagccttcatgcctagctgggactgttttcaaactccaccaaccccttttcttttgttccattccactctgcccagaaccttcgtctggcttcccagagggcccaagtccttgtcttcagaggtcctggctggggagccttagagcatggtcttccctcactccaggcttctcgggtctccctattggggactgaccgtgggagcagtgagccactgtgcaccagggcagcccggctcctcggggggtggcccaagcagtcagggcggcaggcttgatgggccagggcctggggactctgccatggtggaccattgtgcccttgcctggcttgccaggaaagtggagtgcgtgtgctcacccttgcttctgaggggccttcctgaggcagaggctgtccctggacacccagtgctgttgaggcagctggggacactcagaccatggtggacaaagacttgaagtctcgtttcagccctgcacaaggtgtgaccttggctccagcactgctccctctgggcctgtctctttctcagcagaatctgggactggccacatcatctccaggggttctagcattggacgcctgaaagtggacaacatggcagtgtgagggggctctttgtggtggggtggtcagaatggccctccatgtggggggctctttgtctccccagggcagtccttaaccaccagccagcctccccaggcacccgtgccgggcagtggggtgtgtaaaggcctggcacacacagacaggagttccgatctcaactccatcctcatgagctctgtgaccttggtgagtcccttttctgtgtagcctttaactctcatctggaacgcaggatatgcatagtcctgacatcaggacgttaccatgagtagtaagtgaaactcccacttcaggtccttcgcctggtgtccagggcatgggaggagctaatacgtggcctctgctgcttgtgttgttattggtggtggtgtttgagatgtccttagagatgttggccaaagtttccagttccccaccctcccaagcccgtggggaaattgtgcttcctggtggtttttgggtgggggggccgggggagggtcatgtgaccagttatggcccgtgaggtgtgagcagaagtgacatgtcccttctaggccagagcctttcatggccatgaggatccacagaactcactttcctctggtagaccaaagtcaaggtggcaactgctcagtgagagggagcctccctgctaccccagtggatggtagtgtgaaggataaaccaacttttgttgttgtgagcccttgagatttgagagttttgttacagcaacatggctagcacatcctgactgattcttcatcatcatcatcatcatcactcaagcctgtcccccggccaggggtccatccaggagaacaacagccatggaggagacccgtcaaaaaatagaactttattaccaatctgtttctataattgtttgactcattttctcactcatttgtttgctttatcaccaatttctttacatcatttattccttcaaaaacatttcttggctgggtgcagtgggtcacgcctgtaatccgagcactctgggagcccaaggcaggcagatcacctgaggtcaggagtttgagaccagcctggccatcatatagtgaaaccccatctctactaaaaaatacaaaaattcggtgagctgagatcgtgccattgcactccagcctgggcaacaagaacgaaactccgtctcaaaaaacaaaaacaaaaacaaaaacaaaaacgagccaggtgtggtagcacacacttgcagtcccagctacttgcaaggctgaggcaggagaatcgcttatacccagcgggcagaggttgcagtgagctgagatcgcaccactctactctggcctgggcgacagtgcaagactccctctctcaaaaaacaaacaaaaaggctgggcacggtggctcacgcctgtaatcccagcactttgagaggccgaggtgggcagatcacgaggtcaagagatggagaccatcctggccaacatggtgaaaccccctctctactaaaaatacaaaaattagctgggcatggtggcgcgtgcctgtagtcccagctactcgggaggctgaggcaggagaatctcctgaatccgggaggcagaagttgcagtgagttgagatcgcaccactgcactccagcctggcaacagagcgagactctgtctcaaaaaaaaaaaaaaaaaaaaaaaaaggcaacaaaaaccaaacgccacttgaccacctgtttcataggccctgaggtagcgcacaggccagcagggagctatggatcattctgcagagccacggtgcttgcccagaggtcagcagccctatgggatgcttggggtggggcgtcagatttgcagagctggggcgagggaaggaatggcacttgggggagtgggtctgctggagaaaggcctacaggtaacaggaagcactaggcagttgggtccggccagcagggatgggaccgtgtagtggccaagctggagggggactttggtccctgggtcatggggtgtgcagtgctctgcactgaatgatgagagggcatgcataggtgaaacaagaggccagctgctgaagggaggaagaccaggtaggcagctgggccaaggatccaggtggacaagggctggcatgggtctgaagaggaagagcagggccagggaaagcccagggctggatggccagtggttgtgagctgcaccagcagccagagggagccggggactggatgggggtggccctgtgcagtgacggggaaagtttgagggatcagagtagagttggggcacccgagcggcatccaggggagatgtccaggatgtagggtggtgaatggacaggacattgaagtgagaatcacccctcctgcccatagacaaaccattggtttgagggtggggcctgccctgggagccgggaagcacacatttcttctctgtgtgggctcaggggaaaaaaagaattgaaactcccacaggggaaaagtttttaaagattccaccattggaatgctggtcttgtgtaacaggaatgttttaatccatgcatttgaaacacagttattgagatcctactgtgagctgggctctgccctaggtgcccatgggtgagcagacagacagcgatctctgccctggtgagctccttcctgtcttagtgggagacaggcagctaatgacgagcaatctggggcatgctccttagtcctaagctactcaggaggctgaggcaggcagatcgcttgagttcaggagttcgaggccagcctgggctacatagcagaaccccgcctctacaaaaaatacataaattagctgggcatggtggtgtgtacctgtattctcagctactcaggaggctgaggtgggaagatcgcttgagccccggagtttgaatccagcctgggtaacatagcaagaccttgtctctgaaaataactaaatacttttaaaaagaagatagatgtagtgagaaaaaaaagtaggtggggaaggggctcagggatgggggagatgcgtgcagttttaaattggagtgccaggaaaggcctccctgagaaggtgacaggtgagcaaagactcgagggaggtcagtgaaccttgcaatgtcaaagggaagggcattgcaggcagagggaatagcagtgcaaaggtcctgaggcaggaacgtgtttccatgttgcaagaacagcaggggagccactgtggctggaggggactgagagaggggagagggttcctggaagactgtttgtttatttgagacagggtctcactctgtcacccaggttggagtgcagtggcatgatctcagctcactgcaacctccacctcccaggctctagtggtcctcccacctcagcctcctgagtagctgggaccacagatgcgtgccaccatgccctactaattttttgtatttttggtagagacgggtttttgccatgttgcccaggctggtctcaaactcctaagctcaggcaatccacctgcctcagcttcccaaagtgctgggatcataggtgtgagccaccgtgcaggccagactctagctttcattctgagtgagctggagactgcaagaggcaggctccaagctgacttactatctcacaggctccctcaggagttgagggggccagacagagcttgaaggggagtagaaggctcctggaggctctggcagacctcagaagctgcagccacatcgaccaagctgaccccacccaccatctccaaggaatgggttaatgggcaccccaggcctctcaggtctctgcctctgccttgctcctcctccttcctcctgctgccaccctctgatggtgcttcagcctgtgccatttttctgggtcctctccaagtgtatattgaccctgaggtggcagcaggaggggaggcaggccccctccccaggaggagacccccttgatgaactctgagaagctggttgcttagcaagcccttttttctccaacaatacttgtgctaatcagcctagattgaatgagcaaggaattggcttttgcaccttcctgtcctctcttctcatatatatatatacacacacacacacacatatatatatatgtacatttttttcccttagagacagagtctcactatgttgcccaatctggattcaaagtcctaggctcaagcaatcctcctaccttagcttcctgagtagctggaactacaggtgtgtgctagagtgcctggctagggactccattctagaatcatggaatcttaggggtcccctgggttgcatcttgactcagtgagtgagtgggttactttttcacatccctccttgtacacctcctgtgactcctggcagctcactctctttctagcgactgagggcctctggacaaggtgagggggacagagcaatggtccagaagttagaagactgtggtcccagtcacaggctgggcaccataagtggacaccataactgacccatcctccttttgtgctcaaatgctgcagttcatccggaaacaaccaaaacattccagcttcacagctgccagggtttggagttgaaccctgtgtcccgtgctcctgccacccctgctccaggcacaaagggaacagttcgtcagtccaccacgggcctttcctatcctcagttgcagagtgggccaggacatgccgctttacagatgggaagactgaggcccagagagtggaagggaaggagaggagcccattccaggctcccggcctgggatttttcccatatgctccagcagccacccggggaccatcattatgacaatgatgactgatggagggcctagtgtgccgggcactgtgctgagagaccccaaggagggcgtagcatctgtgtccacaggaggaggctgtgaggctgagagtacctagggagagcagagctggagctggctgggctctggccatgcggctttgctgtttgctgtctgctgtttgccgtatcaaggggcgatactcaggcgggctcctctcagtctctcttctttggtctcacctctactcagaaaagccctttgctggcccccaaatactcctaccccgactctcttctccacccctccaggctcccaaggcccctgcctgcctcggcctccctgctgggttgaccacagtcagtcctggctggaagctgaccctctccacagctgccccaaaatacatgtcacagtggggcatttgcagttccagcctgggcagctgcccactaggtctctttccttcccttccctgggtctgcccccaggcccctggcctcattctggtcctgagctcccttctctgggccaaggagctgctgggcctcggggagggggaaccccagcactaggtccaaagtgatgtagcagggccactgtctgtgccggggcctggagctttcctctgaaccttaaggggcccccagatcagctccgtgcgggcctggggtgcagcttccagaatcttggaaacctgtttttcatggagccagatagaatgagcacccaggaggaggcagttccaagagctggtgcttcaggaggaaacctgcacagcagacaggcgtgcgcacattcctagatgctagccctgtggcggcgcacctcacgctcattcacagtacacggacatgctcacctgcccaccatgggtggtcaacccttggacacccacactcttctcacaccctcacacacacactctgcaccactcgcctagccccggccacgctcatgtcaggattctgaagacctcgagcacacacagacacgcacctggtcacgtgcactttcacacatacacttggcaccagggtggcagcagcggaggtgactgagaagcctgcttttcacagagaatcagaacccagcgggggctttagccacaaaaaaagagcatttcaaggagaagggctgcctgcatgccaagcacacgcccctcacctacccaggaccccttgtgggagctgagccccatggagaccccggggtacccatcccaccctccaacatccatccctacgtggatatacggccacagttgcagctgcggccatgaggaggggtttttgctcctttttagcagtgctccatcccccaccccagagtacagggggctgcccagagaccctcctggccctgggggcctgtgagtcagaggctgccagtggtggcctttcggctgttgctggggaaatggcagcacagtggccaccaagactaggactccctggggaggccctgctggccctggcactggtggcttggcctcacccagccccacctggcagatgtgccccttgtggctacccaaggactggccccctcctcatttcagaggtggagaaactgaggtaaaaaagtggagacagccagggcacccctcccacaaggccctgcctcatttgagacagagccctctgggaagcctgtgcattctgtaggtggggacctttggggccattttttccagaggcccagagagggccgtcttcttgcccaaggtcacacagcaagttcatggcataagctagccagcctcgtactccagagctctcctgagggcccccatgtgtctgtgcgggggtgttgatggggggcaggtgggagggaggaggtaaggctgatttgtttcccagcctcctccccctcccctgctcccttctctccctcacacggtttgtttggagaatgactcacaggaatgcagcaaaatcctgatggatgggaaggcagggccgcagtacccggaaaacctctccagggtagggaggcggggctgagccttggggcctgagaggctggtgataggggagccctgcatgcaggtggggcgactgaggccctggaagaactctggtcacgtcctggctgggggttgtccctcctcgacagaaacacacaggccctggctgccgcagcacccctggagcacccgtcccccatgatttccatctttgtgtccccgaggcatctggtgcactgtagctgacaaacacatgcattttggcactgagtgtgacccaagtcagaccctcctgtgtgtgccctgtcccccaggtcctcccagctccccggagttggggggcgggtgcttgccattcagtcctttcagaggcagccaagggcctacggcatgctggacactgccaggggctggggaggctgggatggagctggagggaagtgggaggtgtacacgggatggacacctcctgtgtatgttccaaatgtgctggaggcctcaacaggtcttggtacaaggtgaggcaaaccttagaggacctaggatgaagtttcacgtaaaggaacagtggctgtaagggctcccagaaagtgtagggaccctgggaaggtcccagtctttgaataaaggtgggtgggaccttattggtagcttggggcattagggcccagatatcaggcagcagcatgaggtgaggcccgggctctgtcccagggcaagccctcctcctgcgcaccacatctggggcctccgaggagggacaaagcattcaactcccgggacctgtgggtgggaatgtccccaggcccagccctttagtgcctgctgatggctgtcacgcggtgtccggccctgatgaccagatatgtgttttcaagagaagctggaatttggatttttatgtgaactctcctgattctcaaatgctggctccgttaacaaaaggcacagtgtggtttaaaccacacatgtccgcaggcagaggaccaccagtttctaatgtctgcgctgtggggcgcttgggtttttgcatttggttcttttacattccttattttattggaaacagcccaaatagtcactgagctgcaactctgtgctaggtgccggggctctatcagcgaataaaacaacatgtgacggagctgccattttagtgggagaagacagtgaataaacatatatcaggtgatatgtgttaggaagcaaatggaagcagggctccagaacagagagcggctgcaaggccaagcccacatttgggtggaaggggcagctagtgcaaaggccctgaggtggggctatgctaggtgtgttagaggcctgtgtggctgcagcgggagtgggtggggaagtgggaggaggtgaggtcagaaggtagcataggtcaaatggcataggagactgtgggctgtggtataagcttggttttaagtcttatgtgaggtgggagccatggaggattcctagggagggagggtcaggatcagacttggtttaacaggctctgtctgggtgttgtaatggctgagtggggcaaggatgggcctaggaggcccagaaggggctattgcacttgtctggctgagtgatgatgcggcctgaacaggaagggggtagtcaccagagggtgacctgaggaaactgtggtcaagcctctccatggtgtaaacagtaaacacgatactgattctaaggacttggtagtaacatggaaatggtgactgtgtataatgctatgtgaaaataggattagaaaattgtacattaaaaacacaccagcccagatgcaaaaggctgcagatcatatgattccattcatacgaaatgcccaggacaggcgaatccagagagacagacaggaggtgagcaattgccaggggctgggggtggggaaatggggggtgactgcctatgggaacaggtttctttttgggagggggatgaaaatgttctgaaattaggtagcagtgatagttgcacaacttcatgaatataccaaaaccctgagttgtcccctttaaaagggtgaattttatagtgagtgaattatacctcaaaaaaaaaattttttttaaggcatgtccagatttctaaccaaaattggatgcacatagaaaacattgcaaggagctgggcgtgatggtgcctgtggtccccactgcttgggaggccaaggcaggtgaatcacctaagcccaggagttcaagactagagcctgggtgatatagtgagatcctgtctctaaataataataataggccagctgcagtggctcatgcctgtaatcccagtactttgggaggccgaggtgcacggatcacctgaggtcaggggttcgagaccagcctggccaacatggtaaaaccccatctctactgaaaatacaaaaatttagctgggcgtggtgatacacgcctgtagtcccagctactcaagaggctgaggcaggagaatcgcttgaacccaggaggtggaggttgcagtgagccaagatcttgctactgtactgcagcctgggcaacgagagcaaaactccatctcaaaaaataaataaataataaaattttaaaaagattgtaaggaaatattcacagtaattgtcatagggtgaaggggattctggattttgtttgttttctgtgtacttttcaatttttaaaacttaaaagtaggcatttctctctaaaatcataaagactttgtgactagggccagagatgggggatccacttggaggggctcagcctctctctccagctcttgtggatccattcagctgcatggctttcacttgggaggttgggagcaggagcttgctctggtccgcgtctctgaccttctggaattccattcctgctcacatggccttggtcaagtcacaggaccagagatcccagcggccctcccctggagagtgtcccagccgcccacgatgcctccacccagaggctgccctgttctgcttgcatgccttcagccgcaggttgctcaccacctcccgagcagctccctccttccatttctgggcagccctgcctgctagcaagctcttccttatatggaggtgaaatctgtcttcctgttgcttcctcagctccctctctgaaccccagtttctgggtctgcagaagggggctcccaggcctctccctgcctaccttggccactgggaggttctgaagagactggaggaccagcagcccagagcctgtgtcggtggtcattcagctctcgggacaaagcgtgggtgggcctgtgccctggtggcataaccaagtaggatttccacattcagtgtctaggccatcgctgtgaaattggaatttgatactaatcctggagattgaaaactcaaacctctccataggccaggagggaatgataatcatcagtgctaacatttacggagggcttgtggcgtggccaactctgagtgacgtttatgcactcatttctatttatcaccagcaaatcccgggccctgctgttcttccccattttaaaggtgaaaaacctgaggctcagaaacgtaacgggaagcagctgggtgcgagcctcctggcacacattgtgggagtgctgtgggtcgaataaggaagctgagcagcaggcagcctctcccctgcagaagggcacagaagcaggactggaaggaaatcctggttgtgggctgagctcgggccatccacttgtcgtggtgggtgaagggtctggtccgcaggtctgctctccaagctgcctcgttgcaggtgctgactttgggaggattctccttgtctcggcctaggagctttcttgctcagcttggggagagaggtagtaatgtcgccttccacctcatggacttcccagtttagaatgctgcttcccatcccacccacatcaccctctgttaggtaagcaggagcagaaatgcagtccttcatctcagctctggaaacgggttcagagagggtgtagaactgcccaggggcacacagccaggacaggcccaagccaggaattgcactgggggtgagcaggggatggctttcctggcttaaggtatgtgggaggccaagagccatcatttttcccaatcctctcctggagagccaggggacatctgaagccaggggctctgcctgtttcctctgcactgtccctgtgctgggctgctctgagctgggcactggtgtggaaggtaaataagcagccccatgacaagctgtgagaccgggcagtggtttgggctccacccaggcccatgcctctctcttctgcttgcagagcctcagtgtctgcatctctcaaatgggctaaggacactcacctcagaggatggctgagaggattccatgtggggtgcttggcagagttagctccagctctgcatgccaccccctcccatggtgcagccacctgggttccaccagggcattctgggatgacaccagaccgggaggagaagtgcgaggagtggtgtggtcattggcgtctttcctctgcctctgcctcccccggccccttccattcacatggtagaaattcagatagcacagcagcaagtgtccctcccgctcctgaccttccagcagtttcttctccatccttccaggagtgatctccacagattcagatgccccccggaaagggctttccattcaaagtttcccctggactcattctggccccagagaggctgtgcccgatccgatcctcgcccctttgcgggtgtgaacttggaggctgtgagagggccaagttgcccctgggaatcgtacatattctgttccacatcctcctcctgttgtccgttccgtgccctcctatgtcaggagtggaggagtgctggaaggctgtgcaacacactgttacccattttgcagatgacaaactatggcggggggaatgggtttcccttagcagagagggaattgtccaagtcatgccaaagacttaagggcatgtcatagccagcttgagtccaggcaggagctgtagccaccagtcgggacaaagtcaggggacttgagaggtcttcacccagctgcggccaggagaaggcctggaaggagcatccctgctgccatcaagtccagggagggcagaagcccatggagctctgagctgagttgggaagtggctggaggggtcacttgtggggtggttaagccacccagagatacccatgagccctggggccagggaacaaaagatgtgtgaaggcaggtgactgacacttgggtgtgtgtggacttctacatagagaaatctccgtgttcttgcatgtgcatgtgtcatttatatgtatacatgtgtatatgtgtatacatctctgcatgtagctgtgtgtgtatgtctatatgattgcatgagtgtgtgtacacacagatgtatatgcccatgtttctggatgtgtgtgcccagcctgagggggggacagggttctgtacgtgtgtgtgtacacgtgtctgtgtgcatgtgtatgtggttttgtgtcttttcatgtgtgtggtgcctgtgtgtctgagtgcacattgtatggagggtctgggggctgcgtatgaggtaactgtgtgattctgtctgactctgggtgtgttttgtgttgggtgtgtctacgtgtgtgtctggcccacatgtgtctggcccacatatgctggcccagggcaggatggaggggcctcctgtgtggtgctgctggactctgttgtggtcaccacggccccgtgggcttagcgtggggcactggtggggctgatgttgccacttaacctcagggtgggatggcatggagcaggcccatcccgatgtccctgggtggcctggtggaatgtgcccacgggatgcccaccactgggggaccccaccagcgttggggctgaggcttaggctgtagcaggctaagaggtccgtctatagcagtggctagatgtctgtggctggggcctgtgcctgaggtcagaagtccatttgtggaagaggctgggagtcagtctgttgctgggattggggagggatcacagggaccagggtcaagagtcagaatgtggctgctgccatggctaagggtcagtctgtggctgcagttgcagatcagtctgtatggcacagaagacaggttaggcctcagccacaccactgtccccagccccttggtggcttcctggcccaggggtaagtttgagccctgggaacaaggggcagagagaagaaagcgcctgtgagtcctgctaccaagcaggcctgggcccagctgttcccatggccatggcagagaaccccagccagcccaacgtgtccagagtgtgtggcttcattgtagccaggaaccaagggtgcccaggaccgtgccagggtgagcagggcagtgcttcccaagtgagactgagagaagacccctgcctgcctctcagtgcatttcctcaggcaccctctggtgcctaaccctgtggctctataaccctccttctctcttctcctacccttctttcccctctcctttatctgctgtcatcctccccactccccaatctgtcttcctttgcagctgccctgtcctctctttcccccagccagcctcctgccccccacctgggccctctgaaccccagggccttgcctcttttaagttcagcagatttgacttcactcagacgctggcgctgaggaaggaagatgaatacccatagtctggatgccccaggagaaggaggctgcatggaggcccagtcacacgcctgcaggcgggggccgtcttcctggagcccatgtccagtgaagggtccacagcaggggtcaaggggggcttagactcggattctgccctgtttgagcctgaagctgcactgacctcatgggatggcctcctgcagtcaagtagggaaggatggacagacacacagatgacagggaaaactacagacagaaaagatcaaaggtcgttcagatcaaaagcaggcagaagacgcctcggtcttggcccagcaccagcattcctgtgcagaccccagcccagggcagagactgagatgtactccctctcccctctccccctgcttcccctggtcgggaggtggccaccaaggcaagccttctgccgtcactccagccagaacctgcatgggtcggggtgggtgggccagattagcctccatcctggaatcaggggagttgggacactgaggggacattcaaatgtttggaacatttgaaaatgttccaaaaatgtaagagaacttggatctctgtactcccgatgctctccacccccatcagctaaaatatcaagctctttgctttcaaagaaaagcattttctcgagtgttttgctctcagtttcacatggtagccccagcttgctcaggaagtgcttggcgttagagggttttgatggggagaaaagggaacagggctgtagttgttgaaggaccatgccagccccatgtgggcagggatgcctgttctgttccctgctgtcccacagtgccctgaacaacgcctggaacatggtgggttccataaacgtataccaaaggagatatgtgtgggcagttggtctgggagacaaaaccggatccatgggggcaggagggctggcagctgcagacctggatcaacatgctcataaaaaggggatattaaggctgggaaactgggaaggtgactggggtagatgaccccctgctgactcagacagggcacagctcctggtacagtcattaaaaatggggcctcttcagcagttttctaagctaccacattggcatgaagggcattaatgtgttggagcaggtacagtggaggctgaggaggggcagggttccttcctgaggcatttgctctcccaccagccccactagcatgaatggcagatcccagcagccgtatccatccttcttgcaagttgctcaggcaagatacatcagtgaatcctgctaaccctgccttcataataaatccaaaatccgaccccttctcatcggccccaccctggccaggcctcatcattgcccacctggactagtgtaggatgcaggcttctgtgctcctgccctggccccacatctgccctcttcacagggagaaactctgaccacccaagggaaagcgtgtcccatccctgctcaaaacactgcagaaatgcctcatctcgttcagtctaagagccaaagtccctacaatggtgtgtgtgcaagcccctgtaggtgtggccccccgtcctctctgcccacatctctttctgctcactcccctcaagccacactaacctcttggccattcctcaaaaatcccagcctggctgctgcctcagggtctttgcacttgttcttccttctgcctgcacagctttgcccccagacagctgcatgcctcactacctttgtctgtcaagtgtgttctcaaatgctcttaagtatgagctctgaccactcagtgtagaaaaacagcccctgcagatgctcccagcccgcttccttggctttatttatttttccatagcacgcttcacctaaggtaacatactacatcatttacttattcattctgtttcttgtctgtcaagactagaatgaaagctttgtctcattccttgctctgaatcctcaacacatagaatggagcctggcatctagtaggtgctcagtaaatatgtaccaagccaatggatgcatacttttgccaccttcaagttacgtgactgggagcaagtgcatttcctggacctcagtgatccagtctctcaaatgaggctgactgatggggcggggggagatacatagagatttgaagttgctgccccactactcaataaacatgtggaatagatgttaaaacctggcccacatctgacctcaggcctgcaggcttccagcgtgaggcttaccagaccagggctgagcttgaatgcgacttctgggtcttagtgtaccagcctggcctgatgggcctccccgtcccttgtttccacctgggtgtccctggtggcctgtcagtgagccttgtccttggctggctccactgcctgcattccctaggaccctgcttagagtccccagccctctacccaccctgcctctctggtcaacagctcctgtttactatttagctctggaatggcatctggacacacacttgcatgaaagcagctattgagatagtgcttggcaaacaaaagggctgacatgtccagacctaggttctccagaacacagcctcacctcaccaggaaggactgggccctttaaaacctgtgagcacccctaccatcccagcgaggagggaggatcctaattcccctggggcagactcttggtgaaaggtgaaatcagaacctagggagcaggaagcctgccagccaggcagcctcctctgctggtgttccagcaacatttgtgggtgctgggtgctggttgctggcaccatgatcccatggaatcctgccagtagggtctgatggagtaagcaaggctttggggtccatgcacacttaggtttgaattgtgaggttgccactccattctgctgcactgccacacgccatgcactgtgcttggtggaggtgagcaaagaatcttgaaattgagagtcggatgggatccgattgtgttgctgtggtcttggcaagttctttgcaggctctcagcctgggtttctcctctaggggatggtcagatcctgaccttggggtactgtcttgtgactctccatgataccacttgtggaagggccctggccaggtcagggtttccatcaccctctggcagatgtgaatggcagccctgctgaatcaagatccctccgtaccactgccccaggagctccagggagtccccagggagccagggaacaagagaggcccctggaacaaatgacaggctctgcccttttttgagataagccacccaccaccatcccatccctctacacccatccccagaatctggaatctgtgaagggtactcactgagcgacctggaatctgtgaagggtactcactgagcgacctggaatctgtgaagggtactcactgagcgacctcaggtgagtcttccgacatgtcctggccctgatgttctccatgctccaccccacccccattttatccaggggaactgttggctcaaagaagagaaaacttgggcttggtcaggcttatgggaggagggcttggtttaacttcattgttccatgcattcactcactcattcattgaacaagtgcttatggaatgtataccaggaaccattccaaatacggaagatacaccaaggaacaaacagacaaaaatacctaccagatacctaaatatgtaaattacatggtatattagaaggtagggaacagcattccaggcagatggatcaacaagtgcaaaggtcctaaggtgagagtgtgcctgctgaattcaggaactgcaaggggcaatgtgagtggggcaacaggctgggactgagggcaggagttggtggggacctgattgtgtgggctgtcatcaaccacctgggggactttctcctcctcatcactcagaaactgaggaggggagggaagacattccagccaggttggtgatccccagcgggcatttgggcttttccgttgccaccttaatggtatacacaatgcgcatctcctggttcactcagcagcctcaggactgagtgaccctggtccccaagacagatattgaagacagagactaagcagtctgacattttaaatatggggagccccgagtggggcggggctgcccaggaccttagggattcacttctggtagggagggctgctaccaggcttcagggaatgccagaaaaaaggtgcccgaggcccacctggcatgtaatgatgggcaggattggctgtaggatgtatagagactttagtatgggcagggttgggggttagtaggtggagaagggagattgggacatcattgagcagcaaaacccaagtgtgacaggtggtcggtgtgctcctgccagagcagaggggcctgagtaggaggaagtggaggtggaggccgaggagaatgagacagacagactcactggccagcgggagaaagtggtgggacgagccagggctgacacatctgtgtgatccctggtgcagtaactccggtagatggatggacacgtggatggatagaaaggtgggtggatgcagcgacggatggatggatgaatgaatgaatgaatgcatgcgtgggcggtgagcggccgggagaggggcgggccagctgagcgctcaatcacagccccggggctcggcgcccgccagctgcactcagaacccccctcaccgtggccctgccctgtggcgcctaattacgtgcccccagggctctggagcggctgctgggactgcagcgaagaggggcccgcgccacctccgccaggctccacgcgccggccttgagtgcgctcccctcggccgccgggaaacctagaggcgcggtttggccccaaggtccccggtcccgctcttctttgtctcggcctagttctcggctgtctccgggccgcgacccacctctcctggcggtccttgccgcatgcttctgtgctgcgccagaatcatcgagtctcagttctcgctgccttcccggccagtaggcgtctcccccagctggggagggtcccccaaaccctgtgcttctaggaccgcggggccggcaagcggcaggatctccaagctgcgtctctgatgcggctaggggaggcgcgcgatgaaggcccccctcttctccgccttctctctacgccccaccgctactacacgtcgcgctgcgccgcgaccccggcgctgcctgttggcgccttaagcggctcttctgccgcggtgcgatccccgacgccaggaggactaacccccacccgccaggcctcagaccccacgcagatccagccacacacgcaaccgcctgcagatacccaccacagccctttaagttaacccaaagccccgtacaggcgcactgcccctacatgcgcagccccacggccccacacacccaccagcccactcgcaaacaggcccacatggccacacaactgccctctggacactcagccccacgcaggcacaatcccatatacacacaaccgcacacaggcgcaatcccacccacgcagtacctcacggagtcacacaacccccctataaacaatcgcacagacacagccccacgcagcgccacatcattcagtcaaactgagacccagaaacacattcactagcttgtatccagacccccccccccaagccccgtgacattcactcgtaggacagaccagaaatatacagccacattgatacacacacggacctaaacgcacagccaagacctcacccgcaggctcgtaagtcactggaaaaatattaaagcgttccctccctcccctcctctatctttgacatacacacgcctgcgcgcgcgcgcactcttacactcacaccccccgtccctaagcgcgtcggagcctcgcagcgggtgaccccgaggccccgcggtgagagccaagggagcgtctccccggcgccccctcctcccgctcccttcccgagctcatctctcgcccccccgcccgcctcctccttccctgccccctcctcctcctcccttcccccgagtctggggcgcgggctgcgcgcagccaagccccctcatcgcgcgcccctccccgcgcgcgccccgcgccagcatcgcgcttaccgagtggatgcggccacggggccgtctctaattacctcctgacccccggcggcctgtgaataatggctactgagggcgctcgcaggggctgctaagaaggaaacgcggggcgcgagaggcgcggcgcgcgcgggagcgcgagggaaaggagcgagcctggggccgttgcaagcggctggcgagagaaaggattcgtgcgagcgctcacatttgtttctcccaaggatctcatctggccaccgcgttctggaagaggcgagagggagagcgtgcgcgagaggagagagacggcgggggaaagggagacggcgagacgcgcagcgccggcgcccgggagacccaggaggagcccgcaggtattgttggcggcggagctttgtgttttcggcgggctgctgtgggcgccagggctccccgagcccccggcccgccgccgcgcgcagacctgcccggagtccggggctgcaggctggggtcgccgcccgccgcggacacccctcccgcggcgccaggatcttggctggagttgcggatttgcatgtttgggggttttccacgctggttgagggaatcggtctcagaagaaggaatttctttctttcctttttttttttttttttttggccgcttttggccacagtttggttgtgctggggattcccccctcccctttcctccacaaagcattggtgagcggtcttgacgaatgtggtattggcggaaggcatggggctgagatggcggggctggtggccacggatggggaggcgagagatgccagagaaggaaggagttctgttcaagttcgcaatctgcgccccgaagctggtcggaccggggagggcgatccgcgcgtccgatcctgctccgggcaaccgatgggaaacttcccgagagcgcggcctccctggggactcggcgcccctgacgcctccaggcgcttcctcgggccgctgcggcccctcctcgccgcccgccagcgcttaaggtcgcgctctccccacccccgccttcctcccttcctcggcggcttccggatctggacagagctgcaggagtggcttcaaacacttcccctggagacccctccccactccccgcacgagagcctgcccagtggcccccctgccctgcgccccagtctcacgcgcggtcgagtggccaggctgacaatgaaatctcgcacctctgccggggggagtggggtggggaggaggtccctcctggggctgctgaccctgggcctcgggcagggggagggggctcctgggggaggggcttgttttggttagagacgtcgacctgggatggcgccggggcagggagggggctggggggtgggcgcggcgaaggcggcaggcttgggttcgcggccgggggtcgtggatggcagcccctcttgggcttggtgattggctggtgacttcaggcacgtcgagggcccctccaacctcagcctcctcccctctggtacaatgcgggctgaaagaggtgatcccgagggtgctgtgcttgtgtgacgaagtgtttgtctcctgcgatcctcagcagacgctgctccggtgacccggagatccggacgcctcgacccctccctcagggccgggaggagaggaggatgaagggggaggagagtggtgggaacttctcctttcccattgaggccatgggaagggaatgctagcccagaaaatttctggggaccgcagttctgaggcggggactcaatccaaggggggaccaccgggtcagaggcttcccggcacgcagaagcccccagattattttgctccatcgggggatgcagaggaaggggagaggtggaagagcgaagggctagctggactggcgttgcgggggtggagagcccgtggaaatcagccttaattggattcccaggcaagcagccaggctatcaaggtgccccctcccctttttcttcctggggtagagagccaggtccagagacaccaagctggcaacccaggcaggtgaaggcaattcctctccctacttaaaaagagaattcctgggggagaggggaggcaccttttgagagggaggggggcggctagactgtgttcaggctgttctgtctcttggtccaggaatagaaagagttaaccctcccccagaaatttgtcagcccccacacagcagggaaacattgttggaccctctgacatgctaacagtgtgacaccggctgactggagctagcagattctagaccctggactcccccttcaaagcccaacaggactcggctgggtggtgccttgttcagggaccttgtgggaggcggaaatgagagcccagagagggtcaggcagcaaagcagtggccttgtggcccggagggaagaggggttacaagccagggccatcggaaactggaagggaagtcgccatgggtctggggtagagggaagggagaggcccttctaccctttgcccagactcctgagcaaggctttgccctgctccccacccttcccacacacccactcagctgcaggcctggccattaaatgtgggtgtctgacccataggttggaccatgagaccctagtggctgagggaggcctgggtgaggctctgggaggcaggactgaaaccagcaagggattcactgctgctcatgccctatggcacaacccccttatttatggggctgccttcccttccccagacctcgagtttccgttttcaagaacctttttcttcctatcttccttagggcccccagggcctagcacacagcagtcactcacagtgtcctgtatttgtccagctaaatggagtgaatgaatcagtggtgaatgaatgaaaagggaaagtttctcaattggaagcatctagcccttgtggttttttttaaacctttttgaaatatatattgtaaaatagcattcacagaaaagctgaaaaaaaaagagaaaaataaggttattgacagtcttagagggctctgacaatgttagtattttgatgtagttcttcccagtccttttcgactcggtggttggtttgttttttaaagactttgtcgtcattctctatattcagatgtatatcctgcttgctttgccggcataatgtgagccttttcctgttttgtaaccaatgcttcataaacaccatggttaatgtcttcaggcttttccaatcaagtggatgtaccataatttacttaatattccccttttgtccaacattctggatgttcctgatgaatgatgtagtggatatattttgtatagcttttcttgatacttaaaatgatttgctcaaaatgccactgctgatgccgaaggctccgactgcctgcagtgggagaaacggcttctctagttttccttggataaatgggacactatttttccttccccacaatctagaaccttccatcagagccgaaaagagccttggcaatgaatcacctatctgacctccctcctttgacagaagaggaagccagagcccagagaggggaagcgagtcccaaggtcacacagcagttgctgggctatgcagcagcgaagacccagctactgatttgccatgttggttttcgcatctgaaaagattcctgaggtctttaaggctgaccctgcccatttcacagatggggggactgagaccccaagcttacccctggtgccgccagctggagccccagacaggcttctcggccctcctgggccacccccgactgggtgtgttcacgggatctggcggctacaggctccctgttgcccgccccacctgcccaccacagttccccttcctctttgccatcccattctccagacaaaaagctgaggatccaaagcagatgcagtgagggggtgggactgtaggtctctggggaccctagtggttgcgtccttgccccatgcctcagtttacttgtcagagacctaaccttggatctgttcaggagcagaggcagatgttggcacagatatgaggtatgaaggagtggtgtgggggatggggtgcaccttaaaatctctctctggcccgagattcaccccaggagaccccccggggagaagggaaggagagagagagggaagaaagagttgaagcagagacagtattccccatcagaggacagggactttctgccccctcccctgcagcacaccaaccatccgtgtgcctctgatcctgcttgtgtattgcttaaggggtttgtgtgccttccagcttgggcatgtgttgtgcatgcgtgcctctgtgtgtgtgtgtgtccgtccctgtgtgtgtcccctctgtggtgtcagtctctgatcccatttgtgcatttctggggggaagggagggtgcccccgagctcggtcttgtgtgtgcgcgtgcatgcatgtgtgcatgtctgtgtgtgagcacactgtttcctcctaatggccccaggagggatccaggcatcaggcttttgtgctgcttcaaggttgtggctgggtgggcgaagagagggaaggccttcgacagggaggggtggggttgagggaggcaaaagaaaatcttaaaagaccgtcttccctctggtctccaaggagatcaggctgtgaaatgatccgcacgttaattaaaaacgattatatcctgattgagccattcctgctcacatcccccagccagggagaggaagaggctgagagcagaggatgcaaaatggggtagggtccaatggcagggcatagccaggtggagccacagcccacggaggggagcacaggctgggggagtcaagtgggaaggtgttgaggggcacgtgcccaagtctgattggagcttctcctttgaattttagggactgtcttccagtggtggtctctgagatcccaggagtgggtggcagccacccagccccatggatctccactcatatgccaggcactgagcttgttgtttgcacagatcctgcaagtcagcgcttgtggttccagttttacagagaagtgacatgcttgaggtcatgcagccaggagttgggagccccagattggacccagtcctctgaccccgaggcccagatgcccttcatagctcctagctgcccccagattcccaccatgagcccctacctctgcaggacccctgggaggctggggcctaccatgacaagaacttctccatggcgcccctgaggtggttccttgctgaggtccgagcagcacagggctgggcggctgtgatgtccattcacgtggggagctgggtgactcactagcctggagcagccttgggctgactcaggtcacctttgccaacctgggcaaggcctgcctcgccccaccttgctcctccccaacactggctcatggttccacagcagaccagccacaggtgccccgtgaggctcaagacactgtatccacactgctgggtacctgtgccatgtcttttctggaaggagtctgggcctggtcacgctgggccttgcctggttatctgtctgctgtaagccttgtaaggactacggtggtagaaaagagtagtggtaacaataaaccagacgaccctccacctccaccccagcatcaggtgttgcggggttcacaagcgtggcagatctcagcatttgtgggacctgcctgctgccatacctctgcccactcccatccacccatgtgccacctctgtgttccctgagcccagcttctccgagaggaggagacccactgtggcttggccacacccagaagcaagtgagatcgctggccacgagtgggggctttttctgcttctctgagcctcagtttcccctttgtataatggggatgatagctttttccggagaggactgacaagagagtaaggaaaaccaggtcaagtttgttcaagtgcctggcagccctggaacgcacacagaggcccatttgtgcatttgtgcaactgtccatccgttcagggcacttgtgtgttgccacaggccttgggtttgctggcttctggggagggacacacactgtcacatttcagtgctttctaggagacagtctggggctcaggtgactgtcatctcagcatgagcctctagggggcaaagatgctcactggacccacctgaggctatgttagcaaaggtagagtgggagaagggagagatgtttctgctggggtaggtcctagtgagatttgctgaacctggtcccacatcttagcaggagccagaaacagtatcacgaggcatcagaggggcgggcagaacaggaagtcagcatccacctgttccccaaggcagaactgggagagaggcaggcagatgttcactcattccacaaaaagccctttgcactgaagcaggcagagagaccctgcctgcgctgggtcatccctgcaagatgccacctttcaggagaacagtttttgtgatgttggtatctgccttcctcctaaatatccccttcctgcccttcccagggcctgaaatgcttccgttagtcactgccgaggtcagagcatggaaggccctgattaaaatgcaaactgttacttggaggagtgatcagaagatgaactcatgtttgcataatgcagaggccacccacccctaggccccgcagggccgggcaggcagtgctgatggggttgtggtggctgcctggccctcatggggcgcggtagctcagctctgccagggcagcccatggggatgcagcccatggcgcctgttgcccactgtctcaggaacaggattagatgttgacatgacacttcctggtctgtatatgttgtcacctaattcagcagcacccctacgaccagatttagacctggggccactagtgcagcctcctggcttcaatgctgctgcccagtgatcactgtgaccatcctgcaatacaagtggggcagggacggcaaagctggggctcccagaggggagctcccctgcccaagtctaggccagtgaggccctgccagggctgaggtgtcatatgaggtgctgtcaccagactgggggaccgaggcacaagatgagactttgttggcccaggagggtaggctggaggaggcctttccaagtgtggcacggggcggagaggcagagaagctttgccggtgtcactcttctgtgggtgtcccagccacaggggccttacttcgggcccactcgcagcctgggaccttgggctagagtccctgagtggccgagagagagccctttctaggaagcagggcaggcgatgcccaaggaggcaggctctgcaggagctgggaactgccagagcatcaggcatggtgccagcctggtatgcttctcatacccacccagcccttggtagccctcctagaggtgaggacgtgggagcagaggggccacacacatagggtgtcgggaccagcctgaaccgggtcagcctgaccctgcacttggggtgcctggcggccaggcctgtcctgcacatctgattcatgcctcgtttacaggctgtgtttcattcccttcagtccttccacagtgtctgctgatggcgccaaggttctggcccagatgccctggcgaaggcacccaaagggacaggggctgggtctccaaggggaagcattttgctgcagaaggaagggtgttggctgcaggacacagcatgccagaggcctgggggtgtgggtggcgagcaggtgggattggggaggtggaggcagggactgaggccaaaaaggagtctgggccttgactgcttgaagggttttatcttgaaggcagtgggaaaagatgggtgctctgggcagtgagcaccgctggagcaaagtctcggcagtgggaacacacagggacaatgaggagaggcttaagaggatcagaagaggacccaggtggggcctcagtttcctccctgagaactcctgagtcctctggggtgtgggctggatgagagcagcctccctcctcctggagctgctgtgcaggcctagaatgctggtctagagggaagcagggacctgaccatctccccaacctcttgcctaagcccagagcagctcggcctagccctgcatcccctgtgagctgagcactgggagggactgttcagtctcggctgagaagtaggtgatggtcctgggggactgataattaaagctcagcagattataattccctgaaagaaagctcagcacagagagggaggaacagtgcccagagccttggcacaggctggaggaggattgctgggggaggtggtggtggggggaataagaatgatacctggaaccatcgtgttcagagcttcctctcggtgaggcctcctaggtgcccagccctgggcactttgctgtttccagtcttcagaccctccttgccaatgaaaggttcctgccatccccattttacagatgaagaaactgaggcttggaaaggtctggcaactgtggttcaaggcccatggctggtaagaagtgagcctgcggctaaaccctgggctgtgttgggagcgttggcctccttactgagaagaaggcactgcttaactcagagagaggctgtctgatggcagagtcctgggcaggccacaggcctgaagcaggaacaggttggagcagggaagacccctcaggacattccccatgtttgtggccttctgtctgggagagggggatgggatcaggggtcacactgtggtgactggatctgccattcacttagtcacctgttgtgtgatgccaggcaggtgacgtccttccttgggcatctcctctataaagggcttgtgttctcctggggtttgcaggcttctttaagaatctcttcctccctcattaatcctacaggtcccaactgagcctgttctcatgccaggagctcctggcacactcctttcatcacctgccggagctgggctctattatcatccctatttgacagaagagcacaccaaggcccagaggctactgctgcctggcggtcagccttctcctcaccagttaaacctgcttcgtgcagtcctgctgcccagcttgttgctcctgcctgtctccttggccctgcctggaagaccctcactttcccatgccctgtgcagagcctaccacctcctctgccatctcttccacagagaggccagggcttgagcacataggccagaggttgtcctctggcaatgcccccaggtgggcgctgtttggccagcccaggcttttaaaaataacattggatttcacataaaaattctacattttgcttccctgaaaaaaaaaatcaggtcggcattgcagggccacacacccacagggcactatcggcagagctaccatgggactgccaccttctgagtcacctggttccctgcagttcccactcatgtgccagctgggccctggcactctggagcttgccaccctgcttagacctgggttcctgccctggcatcctggctttccctgatccgaggcagattctatctttgaagctcatctagtaaatgtcaaaactgagaaactgattccaaactgggtcttagtgttttctgagaattctccaggccagaaagaaaaagaaagggtgcaccagatgcggggcactgcgtggggaaagataaggaggtgtgaaaggatgcagaatgcttggggaataataccatgttctccttgcctgttaagtacttggttggcaatgcctgaatactaacaccaatcagattctgcttgttctataagatgattcattcattccaggcattcagatgaccctcacagcatccctgatagagcaccattgtgggtgcttttattctcattttcagcagatgagaacactggatctcagggaagtgacatggcacgccccaggtcccagtaagggcaggaccctgacaagaattccgactcctgactcccagtccagtgctcgttctctctaagacactggaaaaattggctcttaggtgggcttctttctctggcacattttttaaatgctcctttagttaatatgcaggagggatttccatgttctcgtacataaccttttgctgaagtgacaacgtgcgataaaagggtcccaggagagccagtgtaatttgggctgtgagggacagagaataccaatgcagaagcctctgcagaaggcctggctgctcctgggggctgggagacccggggccccctcaccacccaatgcaaaggtctggccatcttgggccctgggaccacgtgtacgttctgattcgtcttccactgcttggtttatttttctcacgtttttgggtgaggatcttggttcctagaggagggaggtctaggcagagagaaaatgagcatccaggacagggggagagattgaggaggatgcctgaggcagacgttgaagccttgtttctagtcaagcactggctagttggggggtatcagacaaaggggtccacatagaaggcaaactgaagggcatgttcaagtgctgttcacgcctgcctttagcccccaacgaccaaaagggggcttggcatagcgagaccctctctctacaattttttttttttaatttagccaggcatggtggtgggtgcctgtggtcccagctactccagaagctgaggtgggaggaacacctgagcccgggaggtcaaggctgccatgagccaagattgtaccactgcactccagcctgggtgaaagagcgagaccttgtctcaaaaaaataaaaagttggggggatgttaaggaggttccagttaattgtggctgattctaaattgggaggcctaacaaatggtacttatcctcccgtgggagcagaccagggctaaccaaggccgctgggaatgggggtcatggagacagagccccttttccctcccacccacctgaaggctccaagaacttccactgcagaggtgtcagggacggacctggtgcagaccagtgggcccacacctgctttcctatgtgcgggtcagagcgtgtaggtgtattacatgcctgcctgtgtgtctgcgtgtgagctccttggacacacacaggggcacatatctgtgcttgcatgtttgtacatctaagtgtgtgcgtatctgtgtgttctgacaccagctcgcgacaccagctcgccctccacaaagctatttccaggccccattccccaagaacagccatctctctctcctttcccacctgacatggggcagggaggagagaatctgtttgaaatctcaacaggacatgggctttgcacctccagagagcaggacttgcttgtgtggacagaggtgacatagaaaggtttcagtttcatccaaatagaaacttactttttttttttttcgagacggagtcttgctctgttgcctaagctggagtgcaatggcatgatctcagctcactgcaacctctgcctcccgggttcaagcaattgtcctgcctcagcctcccaagtagctgggattacaggctcccaccaccacgcccagctaatattttgtatttttggtagagatggggtttcaccatgttggtcaggctggtcttgaactcctgtcctcaggtgatccacccgcctcggcctcccaaagtcctaggattacagatgtgagccacaatgcccagcctttttttttttttttttgagacggggtttcactcttgttacccaggctggagtgcagtggcgcgatcttggctcactgcaatctccgcctcccgggttcaagtgattctcctgcctcagccacccaagtagctgggactacaggcgtgcgccaccacgcccggctgattttttttgtatttttagtagagtcggggtttcaccatgttggtcaggctggtctcaaactcctgacctcaagtgatccacctgcctcagcctcccaaagtgctgggaatacaggcgtgagccaccgtgcccagcccaaagatgcacttcctctcattcagaagtgatttagaagtggcctgggctgctccaggaggtagtgagtgccccatcttaggtgggtaggtgtgcaagcagatgcccaacctgtgccttcctctcttttgtggtcccttctaagcgcaaagtgcctagggctgtgtatctcctggcggcagttctgaggtggccctattttgccaacccagcctggttggagggactgacagggcttctgcccctaggtgtcccctgaacttggcccacaaaaggcctgaggaatataggggactgtgattgtgtgtgtggtgtgtgatgtgtgacagtggacttgtttgtgtatctgtgttatgtgtgtgcatctgtgtatggtgtgtgtacttgtgcgggtggggcttcaagggttgagtgtggatatccatgttgtgagtgtgcattgcgcatggccctggaggatggggggacatttctgggctgtgtgggtattgactgtgaactgtgagtatgtgcacttgggccagtggaggtgtttgtggctagaacgtgtctggagggaactgtgctgagacccccaccgcctctgtcctggttcattccttcccaccccaggctcctctcatggcccctgcccccaggtcagacctgggaggctctcagtcatcccaaactctgaccattcatgctctccctcccagagaccttggcacctgccagcactgctcttgactttgtccttgctctgggataagagcaggcccagcagatggccgagaggtcccaaggaacagaggaacaggcggggaggaggcccagtcactgcttagcttctctgtaggagatgtagaaggaagtgggtctttgtgtttctgcagcatctggaccagatggagagacctttctggagatggcatgcacacttccagataggagctggaacatttccagaaatggaatgtttttagaaatgagacatggtgtttctggagacaggatgaggacgtttctagagaagagatgaaaagcatttctggaggaggggcatttctgaagatgaaatgagaacatttctggagatgggagagggcatttttgaggagtaaagatgaggcttttctggattctgagcattgctagagatggaacatttctggaaatggattctttctagagagaaactagaatacttctggaagtggtgtgtttttgaagatgatgctggagtatttctggaaataaaatagggcacttctgaagatgaggtatttttggagctgaaatgcaacatctctggagatgggatatggcatttctggaagtggaacattcttggagttagggtggagcctcagtagaccactggcatttctggagatggattacatttgaagatgacggggaatatttctggagataagatggagcatttctggaaatggaacattttggagctggggaatttctgggttaaaatgaagcatttctggggaagaaacaggtcattctcagagaagggacattttttggattgaggatgggacatttctagggaaggagttttctgaagatgagggggtcatagctcagcctggctgtttcaaggccacttgaggaggcaataggggagggtctcaggggcccagagaccccacctgtggtccttgttttgcacatggcccgagggagggtcttgcccagactcactcctgctgagctgcagagtgggcttctgaggaacctttccagaatgcagcctttgccaccccctggcccaaaaccctggcctgtgctggaatactaccagagggaggccagagctgcccagtcttactcttggggtccctacctgcttctggtggggtcctggcagcctctaggctcaccacagggataggcagtgactgaatggttaaatttaatttaattcaattttgtcaagccagctgaggcttgctccccagccccctctgccagaagcctgtacctttcctccagtcccccgccccatatccccctaccatggggatacctgagggtggccttattgcagcagacagatggaggggggctacaaggctgaacatgggcaagggtccagggcccttctcgggctcagcctgatttcagggcggggggccccagccacctccgcctactccagagaagcagatattgaggcctgtcaccacttgagcaggcctggagccccagagtaattatttctcttccttaattgaaatttcagcctcagtgatccagcctcagaagtgtaaggcaggcacagagaccctgcccctggtggggggagggggcgccccccaccctggccccagaaggagggaggcagtgccatcccaggggggcaggtggcttcacatgctggtgggtgggcatgaggtggacggctgctggtcaaggaggcagggtcaagggggccagtatggcatagtatggcctgagcactcagtatggcctgagtatggctcaggccagtatggcagctgccatgggaaggttgggcctctccctctgactcctgacagaggaaggtgagggggttgatctaggctaaggtagcatgagggagtgagtaccaggagactgctgcctcctcccacatctggcgggcactgaggggtgggctggggtgggtgaggggctatggtgtgagtggggcgggctggctggcggcaggcccagttcctggttcagggctgggtgaggcggctggcctggcggggcggggtggggtgggcaggagggtgcagctgaggagcctgttttcccggctgctgcggtcaggctgggaggagcctccgccacctgggtggtccctgctgccctacacggccttgggcctggcctgtctgcgggtgaaggcgggggcagaggactccagggaccagcaggaaactgggagaagccatgggcttgaaatgagcctggggtccacccctccgtgagcttctcaaggtggctctgaggtgctggggtaaacgtagcaactgccagcttgcagctgtgtgtgtctgagctcaggcaacccaggcaccacacaggaagctgctgtactcactggaccctgatgggctgcagagggccagagagtctacttgtgggcccttctgggtgtcagtcttctccatctggggaatgggttggcttggtgggagttttcaggcctgcattaccttcaaagggctcatgctgcaagcatgggctgtcctccctgtttttataagtacacgggccccagccttacccagacagcccagcacgctgcccgtagtatcctggggaagggcagcagctgtcatcagtgttatttctgaggtgtgttttcctggcaaccaggaaatttctgtcagtgggaacagcctgcccaaggcctcctccacccctggggaagacaagttgtatgacaagggagacagaggcaattcaaagtgaagaacgggagtgaggccgcctcctccgtgcatattgctcacacactggggcagccacgtgcccagtaaaggctctcttgaaaaccgtggagataggagccaagctctgcaaggccctgactagctcacctgacccctggcatctagaagctcacagcctattcttggtggaggtgtggctatggctgccctccaaggaggggaagacagagatggctggacaggatgggacaagccagcccccaggagctggggaagcgaaggtgggtgcaaatgaaaacgcagaatcccatttgcagtccatttgcttagcagccctgaccaggagggagagaaagaagagggcagagcagggagagatggggagggataaggatacagagagagaatctggcagccaggggtcagggagcctttggccgtaaggcctgggatgcctgctgcttactgaggctgtggcccctcctgccttccagagctaagaaagctttgctctgtctcagctccagacaccgcatccccaccacacattccagcacctgcctgcttcccctgacctctggctgccccacagaccccatccctacctccactccttggggattttgaggtcttatgccaccactccactctgagcaggctcagtctccctgtgttggtggtggtgcggggtggtgagagtggtcctggagcagtgggaactacccggaggccacctggggtgggtcccaggcaccagtccagctggccagtgggccacgggggctgaccttgtcaccttgggcccagatggagggcagcggtgctcggcccttcccccaagcacatacagccgctgagctaacatgactcaccgcgtggcagctccctctccccactgggagtggggatggaagcctccagatgctgcagccccaccctgagggaatcacaggccaggctgagcccttccaaagtggggatagctggggatcagacatcagcatccattgaagggggtgttcacccgcatggggtaagccctgtgcctgggactctgggcttagtgcccagctagggccttgggagacccttgggcttctctgtgctcagggggaaaggagctgtgcagcctctaggggtcctgcctgccccaagctgtgctggtggtccaggccccctttggggaggaccctggccaggggtccctagctcctcctctgtcatccagagaacccttaggtcccaggggctggtggtgttcctcttcctcagaaacactacctgcaagactggaaccctaacacagccacctctggagagttgggggtcacccatctcttctttgctccccacccaccctggtggaagtggttcatctgctctgagccctaaagaggaccaggtgggaaagaggcctgatgccgtgctgggggcttcgaataggtacaggcacttctctaaggttgctgtgtagggcaagaaaatcagctcagagagtgaatgaatttgccccaggccacgtggccatcaggtggcctggctggggtttgaacctgtcttctcagagcaaagctgacttggctgcacctccctggacttcagctttcagggagggaggtccaggcagcaggagcctgggggacaatgctatttttcatattgatttttgtattgacctgcatcctgttgcccaccccggcaagccccaggacagatcccgttttggttttcgccagaacaaagcaggctgtgctagacctgccaaagcagatacttcctcagagcaggtgaaaggaaactcaatcttgtcttttgttactcaaggagggagtgagggaatggctttgcccttgaacagggaggccgtgggcgggtgggaggggtgggtgaggcagtgtggggagagggcaggggcacacatacctgagccgagacaccacccccgcccgccgtcagagcatccggagtgtggtgaccatgttagtattcagcacaagcgcgcgcgcacacacacacacacacacactcgcgcacgcacacacgcacgctcacactcacacacttaagcgcacacgtacacgcacgcctttctttccgtctctccccaccaccctcctgagtcccctctaaaccaggaaggtagcatctgaccagcagagaaaaaaagagagagaaaggaaaagagaaaaagagagattagtgggaagaaaatccgattctggagttaccttagttaccagctcctaatgactcgcagggcgggctcggccaccttcctgagcagggggaccctccctcccgggcccctccatcaccccattaataagacggggcccttgttcatgagttctgccacagaaagggaagaatcaaggacttttcaataagagagaactccctgggtggttttgaatagttgctttttgtgtggcagtgcgggactcgtcctcggctctctgccctggccgcctccctcagctggctctgtctggaactgcctgctcctgggtctccagatggatgagcttgtttctccgggagctcaatcctttattgttcctgcctttcccctcctgacaccctcagcttagcagaggccacaggcagcctttgcgtctcaggaaagcaagagaatccccgaggtggttctaaaaaggcttaaagcccgggagtggggctcagcatgaaggaaacaaaagcacactccccacatccagggtgctgggcctgtcggccagggccaagctcacggccgttgcttcggtgccagtggaaggggaatgaatggaggagagactgggtgagggagatgacgatagaacaggagggagatgggtaaatccgttttatcagacgctgcatatcttaggaaagcacatttcagctcttttggcttttggcaagctggtcctaccctttaattttctaataaaaaggaattacgtttgctgaaaaggcagtaaccagcttcatgtcagtgtctcttgtggagaccataattcccgtcttgggtgcctgccggctctggggtgggaggtgggcttctgtggccacgggtgatgatattcaggagtcaaggggcagggacgtcagggcccacagcagatgccaggcagtgccacatggctttgccctgcttgccccaccctggcctgtccactcccagcccagcctctgatcatggttccaggctcaccacagacagggctggcagaggctcccaagactcacaatagacacttaatgaatatttgtggaatgaatgaaggaattcttactgccgaggcctgaggtagcaggcaagttgctcagagggtcagatcttggtttgaatgaatgaatgaatgaatgaatgaacgagtgaatgaatgaatgaataaaggaatgaatgttctccagagtctgaaactatctatctggaaggactaacctccaaccaaccccactctccctaagctctggcactgaattcactggaaactttgccaaaaataatatcccctctgcttttaacaaataatatgcactcgttttaaaagagagagagagagagaagtgtgtgaagtcgcaagttcatgtccatgctgtcccacacctgagtcccccagagccaagggtgggcacccttagaaggtcctttagaccttcctccaggctctgggaatcccctgcatttcttatctggtttgggggtccttgcacacgcactgttctacaaccctatggggcccctcggccatccctgtccccagtgagatctggatgtggttcagacctccctgggctgcagagtgtcccttcctgctctccaacctgggaacaggagccaggtatttatgtaagtctctgtggggtgaatgtaggaaaacatttttgctattacaactcccttcattccagtccctgatttattgatttttgagacagggtctccctctgcagcccaggctggagtgcagtgacatgatcacagctcaccatagcctcaacctcccaggctcaaaccatccttccaccttagcctcccgagtagttgggacttacagtcacatgccaacatacccggctaatttttaattttttggtagaggtgggatctcactatgttgcccaggctggtctccaactcctgggttcatgtgatcctcttgccttggcctcccagagtgcctcccaatgggctcacaccccagccccagttttaaacaagatcctgaaggcagaacactcaccatgggtaggcacttgataaatggtagcctttgtgatttgggaggaatctgtacccagtgctatgcttggttccacatcctaagcattgcttgtgccatactatatgccaggcccccagggcgcaggaacacacggttccagaggggtgtggaggcccctgagtggcagcgtccaggagcccagtcgctgcccctgcccgcagcagcccatcactgctggtatccagcctccttcagactggtgtatgccactggaaactccaggacatgtgcgcagcagaccccacacacgtggtttctctggggctgcctcctgaccccaatgggcaggcaccaggtctctgaagctcagctggcaaatgtaggagcagcccaggatttggctggttgggcacatgcacggctcccgtcctaggacctgacttaatctcaatccttagaggtggcctgggaatctgaattgttactagcctcttggctgccatggatcccttccaggatcaggaactggcatgaggcataggagggccaaggacatcttttaggctgcatggagcccggatccactctgcagcccctggctgggccgtaggagagcgggcaggctcagggcagggaggggagctaaaagggaatggaggggagaccagcaggagctctgtctgcccgattctggtttgggctgtgagacagtcattgcatttttttgcacagttctggccacacagtatttaagaggctttgcctacagacctgagtgactgtgtgaatggtggcactggtgcatacggggacgcctgaggaggaacagatttgggacttgtccacctaggactccctgtgggattgccagtatcacccctcttcgtcattaattcccagcttgcctgggggaggccagggggtagcatggggttcgggttcccctagggttcaaacaccagcccatctgccctgggtggcccttccctgctaagagcctcagtctgctgttctgtaaagtgggtccagccatttctgtaccctcagggtggccatgagggtcagtagccagaaaggcaaggccccacacagaactggttcacagaaatagcaggcagtttgtcaggggcagccttggcgtggttttcattcaaaatcattttttaattccaaaagaaaggaaatggttgtaaataaagaagggaaggccgggcacggtgggtggctcacgcctgtaattccagcactttgggaggccgaggcggacagatcacgaggtcaggagttcgagaccagcctgaccaacatggtgaaaccctgtcttactaaaaatacaaaaattagccgggcgtgatggtgcgcacctgtaatcccagctactcaggaggctgaggcaggagaatctcttgaacgcaggaggtggaggttgcagtgagccgagattgtgccactgcactccagcctgggtgacaggttgagactccgtctcaaaaaaaaaaaaaaaaaaaaaaaaggaaaactgtagaggcacataaacaggtcagagttcctgtctaggcttccctagaggtctttacttttactagtgtaatctgagtctttgactctgtttgtgggcatttacatacacaattaaatctttactgtgtacctactgtgtgctgaaccccgaggatttcagaccttgagccctgctgttaggggctctcacagtcctggtggggagactgacccctaagctgataaatgacccctccatggggagtgggcctgtaaagtgatgatggaagagggtccacaaaggagggaactaactgtgggttggcaggacagggaatggggatcggggaaccttgaagggacatggagtgtgaactgggactccacagagatcacaagtttttaggtagaagaaaggagagggaaaagcttggaagagcatattctaaggaaagggaggtatttgggatgtgctgactttggagtccctgtgggatggccatgatcaacccactgtagggagccaccaaggggttctggatcttggatgccaggccatggagtttctgttttattctctaagtcagggagccattgaaggcttttgtgtgtgtgtgtgtgtgtgtgtgtttgtttttgtttttgttttttttgagacagggtctgttgcccaggctggagtgcagtggcacgatctcggctcaccgcaacctcagcctcctgagtagctgggattacaggcacgtgccaccacgcctggctatttttgtattttttggtaaagacagggtttcaccatgttggccaggctggtctcaaactcctgacctcaggtgatccacccgccttggcctcccagagtgctggattataggcatgaccaaccacacccagccctgaaggcttttaagcagggaggtaagtgagctggtccagcatgtgtttttaaaaactctttctccagcagagcttacagaagggtgagcagggtgtacccggggggcttgtgtggagtccaggccaggcagggacggtggccagcgggtggaggaagccgtgaggatgtggccggaggagaggggcaggcttgggccctgcgaggtgggtgctgccctgggccatgattgggcatgagtggggagccgagccataccatggccggggacagggactgggtgcgttgttcccacatgagcgttgtggagttggcatgcattgggaggcatccctctgggctcagcccctgcctaccaggccaccattgcccctttcttggccagcagatcctccaccagcacctgtcagccccgagcactggaaacggcagccggcggggcctttgtgcttcaggattccttctccagggacacgggtgatagccaagcccggcagatgcccccgggggtgccaccgtgcccccactcgccatctccgatgctcagctgctccccagaatgaaagaccttgtcacaaagggaggcagggagaggatgcgcttccgtgccgcagcccatctgggagccaacgttattttcctgattgaaggaaacatctgttcagtcctctttcagagcgaggcaggcagcggactgggtcggtctggctctgggcaggaggtagagaacctgggctgagcccagagcccctgccctaaggggtttaagaggagctaccaccgttctctgtccctccctaaactgggagttcaggagctcctgccatccccttaagaagcctcggtcactgcctcccccaaggatgggggctgctggggcaaaagccatcgcctgtcccagagcaccatatgtgttttctttttttttcttttcttttcttttttttttttttttttgagatggagtttcgcttttgttgcccaggctggagtgcaatggtgctatctcggctcaccacaacctccgcctcccaggttcaagcaattctcctgcctcagcctcccaagtagctgggattacaggcatgcaccaccacgcccggctaattttgtatttttagtagagaaggggtttctccatgttggtcaggctggtcttgaactcccgaccttgggtgatccgcctgcctcggcctcccaaagtgctgggattacaggcatgagccaccacgcccagccccatgtgttttctgaggactccttcattatttcacacacacactagagccatgtttttgaaagatacggctgccaaacaaactgcatttattacataatgattaattcatcgcccccatttcttattaatcaaagacatccataactgcctatctgagctttgagttggggagagaaccagcggggcctcaagctgacagccttcccacccagatcaggggcactggtagatttgtgtcagtggagcctcatttggggtaaatgcacagtacccctgaggtttctagaagaaatggagacagctcacagacccccacacgtcacctccccaaacccctggggctgcctgggatgttttataaccccttctccagccagccctgagctcaggctggctgcttggcacttagccactggctgactagtggcctgtcagaggatgtggaagatggggtgggccagtccctgttgctggaggctgcaattagtggcagcctgggaaggagactgaagcctgggctgaggtcaggaccactgggcagagcttgaggtgagggcaaccgacatagggctgtcctggcagcccatcctgggctgagaacgaattctagggttccaggggcatttgacacgaggccggccacactctgaggttaggggctttttcaaagatagtttggtggcaggggcctagagtatggggagtgccgactgattgggttggagctgccctcttgtgcttagtcgcttctagatggaggccacaggagtgcttggtaggtccaggtggagccatcaattgtcagacatgcaaaaaacttgaaaagatatctcaaaagggccagtctggctgggcacagtggtgcatgtctataatcccagtgctttgggaggtagaagcaggaggatctttgagcccaggagtttgagaccatcctgggcaacacagtgagaccccatctctacaaaaaatttaaaaaattagctgagcatggtggagtgtgcctgtggtcccagctacttggaggctaaggctggaagatcacttgagcctgggaggtcgaggctacagtgagctgtgatcgtgcgactgcactccagcctgggcgacagagcaagaccagttctacctggctagggtggccccagagtcatggcggaaggcgaaaggcatgtcttacatggtggcaggcaaagaatgaggacacccaatcttctttactcattcatctaacactgactgtgtggcctggcacccaccaggaatgtccctgccctcaaagtctttacaggctgttggagatggggcagatgcccaaataagtcattgttgtcccaggtagtgccatgccaggggccatccagggagctgagggcccagtaaaaaggcacttaaactcaaatgcatggagaaggggacagccagggtgtgattagggaagacttcctgaaggaggtgctgctccgagaaggttgattgggtggtttttgtaggggttttcttgtttccactttttaaataactacttcatgccacatgctattaggtgcttttcacatacatcgtcatgtttaatttgtaccaacaaccctgtgagataggaaatagcttccgtatgttagcagtgagtaagctaaggatcagagaggggaggttgcttggacaactggcttagccatgattagaactccaataggttcttaaatgatgatagaaaaggtgtaggaggatgggagccgaggctggcatacctggcagaagaaacagtgtacgcacgcgtatgtcggtggggcactgtggtgtggagggctgcagggcttggtagcactggagtgagcagaggcgagcctgaaagctggcggcagggacctcaggggccatgacaggtatgtgagtcaagggagtgatgtggtcccgctacaaatcactgggggcttcagcccctaatgggacctcctctagctgcacccccctccctgcctgtgccctttttggcacctggtggcaggcacacctcaaagaactgctgcatctgttcctgcttctgacctcaggagacagcagcagggctggcatggagcatcagggaaatgcacaacaacacatcagcccctgggggcctcctggatctccccacgaatcctgcaatacccttcacaaccatccccgtccagaaagaggctgaatggcggccagcatctgcccgtcagcagagagttcccgctcttagcaccagctcgcctgagctgcctccagggacagtcctgcccgcctccccagagagccagtgcttccgctgccgcctaatagctctcccggctggagacgactcttgatatttagcctgcgtggcaggagccttaatagcagcaactctccctccctgctcctgcctcctgagccccagagacagctctgctcacctcctagccggcatcctccacgcactgcctaggcatcaggcggaggtctttctgcccactcttggtaacatcaaggaatgaatgagcatccaggagcacttcgagtgtgctattttctcctctgagattcagagatgccctttgagaggctattagcatggccacaatttaaatatgaggaaactgaaattcagagaggggatgtgatggagatggctcactttcgcttcatcttccccccctcttggtaccaggaagtggaccatgctccttcaggcctcaggatctttgcctctgctggtctttcttgcctggaactctctctcctccttctctctcatagatctcatctcagagaagccttcctgccctggtttatttactaaggttggtccttcttgccatactgtaagctccatgaaagtggggagttcccctaccttctgttgctcccctctgtatccccagcacccagcatagggcatgtagctccactagggcctcattaagtatttattgaatgagcaaatgagtgaatggataagcacatgcctgtactagttagggtaagatcagctgcagcaacaaaccaacctagcatttctagatggaggtttgtatttccggaggatggtgagtatttctggtgggtggaggtttcctccacatggcaatgtggccggggcatggtctgcatcaagctggcttagtgtggagggtccaccctggaaggagatatcacttgcattcacattccattggctggagcacagtcatgtgaccatgcccagctgcaaggaaggctgggaaatgtagtccagctgtggctccaaggacggagaacaggttttcgtgactccaaatcttcccataggttgctgtattggtctctctaatcagcagagccaaccgttaccgagtccttgtcactataccctgttgtaagcccttttctcaaattagtccattttattcttacaacagccctacaggagggtattataattagcccagtttactgatgagcaggcaggggctcaaatgacatgttaaggggaaaatacccattagaaacatgatgggccgggcacggtggctcatgcctgtaatcccagcactttgggaggccgaggcgggtggatcacctgaggtcgagagtttgagaccagcctaaccaacatggagaaaccttgtctctactaaaaatacaaaattagccgggcatggtggtgcgtgcctgtaatcccagcaacttgggaggctgaggcaggagaatcgcttgaacctgggaggcggaggtgagctgagattgcaccattgtactccgtctcaaaaaaaaaaaaaaaaaaaaaaaagaaaagaaacacatgatgggtgtctggagatgcagcagccaaaggctgagaccctcacccctgactccaccaaacattacagatattcaaatagacaggccagtgtccagaagaaatttatgcgggctgagccacagttgctggcctttgttttctctggttttgtgcttgtccaagggtggggaggtggttgagtacatctctctgagggtctgggccagggctcagcacttcatcatttcagctgtccatatttggagggcatctgtttccttccgccttccacagaggaggaagatgggtacacatgtggctagtaaccattagccgtcgacttccggttttgtctttctggctctttatgattgacaagtgctggcatgttggcctttctgccccttagcagccctccatgcaggaaagcgggagggaggggtgtgtggccagtgctaggatggggtctgtatggaagagtagctccaggaagtggagcctcatcaaggcaggtagcccacgcttcccgaggaggtgacatttggtcgggctttgaaggctaaggtgggagtctgtcagactgaaaaggaaaggcatgccaggcagaggggcctgtgcaaaggctaagagagcctggcttctcggctcctgtgtctgctttgcccctagagcttgcccagaacagtgacctaagtctgagatccttccgacccacactgcagagggaatgtctcctaaaactactgtttatctcacctcaagctggtgttttccccttgtccgtagagaaggaaagggtagcaaaaaaagaaggaaggtgaggagggaaagtgaacagagagcgactggactgagcacctgctggcttgctctgctgtgtcactgccataactcttccctagctatgcaccgtggccccttgctctcctgcgggcacactactgccttgggcctttgcacgcactggccgcctgtcctgcctgcagtgctcttcctggagagccacagggccgattcctccttctccttagagtcttctctcaaattacctctcttgatgaggcctgccagaccaccttatttaaaactacgaacctagtacccgttccccttagcgaatgtttcccccagagcactcagtcgcggtgtaacgccctgtacaatttactgatttatgttgctgcttattggctgcctcccttccgtgcgtctccccaactcctcccatagaagccaccaagggcagagtttttttttattttttgtttttttaatctcttatagtggtggatctcaagcacccgaacatagtaggcactcaataaatgtttgttgaagtatgagtgaattcagccctgggcaaaacgtgaccccatttcacagactaggaagtggaggcccagggtcttgcagccctgtggggagagggctgcccagcgccccgcaggagcctcccgcccggcatacccacgggccagtgccgggactgggcgcggggcggcgcgcgggcgcaggtagccatggtgacagcgccccagactactcgtatttcctgccttttgtgttcgcacatgccccagcccccagcccgggcagacgcccctgattggccgtcacactgcggaggggcggggcggggtgagcggaaaggggcggggctgacctgtgggcggggcccccggggcgaggctggtcttgtactggcgcgcgctgcctgtgattaacaggcgggcgcggccgcgcgcggctggaaaggggcggggcttccggaacagccgccccgggagcctgggataggggtgagtgctccttgatggcggccccgaacaaaggacgcctccagacccgggcttcctgtccgtagtttttcttggcccttggagtctgagagtgagaggcctgctaggccagcgccccctaatcctcatccggccgtgggtggccaggcactgcagacgtgtccccgggggccgaccaccttacttgccacgctggcccctccctctcctcaccaccacagggcctttgcacgtcattcctggacactcttaaagtccttctttccggccgattcctcaccccctcaggaggctctccacacagaccgtgacctgccctgcctggcactcctctgcccagcgtttatatctctttttgtgcactctccgccctcatcacacgtgtgcctcagggcagggccctgtctgtggcctggcacacagtaggtgctcggtttgtgttgttgaatgcctccattcatcaggttgcctgaggcttccttggtgggtggtgccggctgtactggcccgggacttgggaggaagggagacagatgtgccttcagacccagacacagaagagtttgtctccaaagccagggcactgggtcagtgtctggcctggaccccaggcccgaggagcctggtttggtgtgtgcccttggtgaatggcctactgtgctggccagacaggagccccaggggctggccctgcctcaggaggaaggcagggtcacagacacaggctggaggggcctggagtgagggctgctcaggacccctgccgaccagacctgggagccccagcatctgactcttcgtttgtgtattacttgctgtgccttgtcctggcttgacagggttggagtgggggttggagtggtagagcagcgagaaaatctccacaccccttacccccatggcactcccacaaaacaaaagggagctaaactcatgaaatcggcttcacggttatacatggatagccttttgggagttgggtgatctctggggtatatacattgtttcctcaccaacaccaaaagaaaatgcaatttgagccaagctaataacaatgtattaaatcagagcttcctgagctttgctgggtgctataaaccaccccgaagtttgtactaggagcagattcctgggctcaggccaccctcaaatcacagattttaaggggtggggctcaggaatgcccttttattcaaactgcctgtgtgtggttttgatactcagtcttaagtccatcatttgagaaatggaatgacagatatctgtgtctcagaacacatttgaactcctctccaggctctagaaagtctaccgttctctgccccagaccctggctccagattcaagtctagactggaggaactgtggatcctttgggatttggaaaaaagttctagaccctcttcagaaaaatgtgcttgtccacacacacttcaactttgcattggatctcaaggtctcatacctgggctgggtggtctgtaaagcaggggagacctatttggggaaaggcctccatgctgacactcacctgaacctagggccaaagtgtatggttgtacaagttgtacattgtacaaggatccctggaagaaatcgagccactggccagctgtgcagcctggcacctggggtgtcttcctgttttgtacaaaggcattttatgccattcgcctaacccaatcttttttttttttttttttttttttttttttgagacagagtttcgctcttgctgcccaggctagagtgcaatggcgcgatctcggctcaccgcaacctccgcctcctgggttcaagcagttctcctgcctcagccccccgggttcaagcaactctcctgcctcagcctcccgagtagctgggattacaggcatgcgccaccacacctggctaattttgtatttttagtagagacggggtttctccatgttggtcaggctggtctctatctcccgacttcgggtgatccgcctgcctcggcctcccaaagtgctgggattataggcatgagccactgcgcccagcctccctaacctgatctttaattcccctcctgcctcccatgacaactcaagttagtggcactagtaaagttacagaaattatgtgccttagccatgggaaaccggccctctgtaaactgttattaaagccataacaaataatatccgacagcctgtacctactagtgttcagttcctggtactccagagccctaagcgtttttgggcagtggttggggggctgccaccaggcctcaacttgggttaggaagatagggcaagggtgcaaggcccgtctctgcacagagggtgggagagaggagtaactacatagtaggtgcttggtaagcactttcccagtctacattcattgggtccattttatagatcaggaaaactgaggctctgagagggctggtaatttggattagagaaggcccacctgtctggagcggctttatgaacacaggctttggagtgcgacagcggggaggtcaggagaggagaggaaatagccatagctgtacccccacaacattcacaccatgcctccccctgaaggctttgcctgacgtttggactgtttagagggctcctctgagctcccacagcctgagccttcctgtcacggtgctgccaccctggtttagcaggcctgtttacacactgtcaccccaagagcctggcagcaccccagtgctggactgtgagccctccacacagggcccagcgcatggtgtgtaatacagctctatggaatgctgagtggctgattaagtgggctctagcttctggcagctttgctccctgggtggatggggcgggagtgatgcagaaaggagaggtgtaggcctagagttaggagggcagggagagcactgggcactggaaccacttggcagggtgagttggcattccctgtttgccacgaccttggggtcaccctcaccaacttgccccagctgggcctgactgaagggcagggggcctggacattggagcccagggagggcagagggtggtagactcaggagagagctctttgtttgggggcatttctccagcagagacccttagtccctccaaggagcatgtcctcctccatcagtcagtgtcctagccagcaggggtgcgtccccccagatccttccctgcttatcctatcctgggcccagccatgctttctcccatggggtcatgtcatcctgaccctcagatttggctgggtcgccccagggctctctgacaaagcccagctcctcccctggcacccagcatccctcagacccggcctacaccctgtcaagcccgccttctcttcaccccaaggcctgccgtgcctcacagcttgggcagggctgtaccctctgcacacatcacccttccctatccccaaccctctccctttagtgataaatccagctggccgctctttgcagctcaccagggaccagtgtccccagtgcggccctcggtgcacccagtccttacgtgagccctagccaccatggaaagccaggagggcctggccagcctccatgtggggtctggttggttattgcagggcctgttgggactgcctgtgtccctgttcccctgggacaggagttctggagcctgcgaaacttaagcatccatcatgggacctggcacgggggtgcctggccacagcaggagtgaatgaattttttttttttttttggagacagagttttgctcttgttgcccaggctggagtgcaatggtgtgatctcggctcaccgcaacctctgcctcccaggttcaagtgattctcctgcctcagcctcccaggttgctgggattacaggtgcctgccaccatgcctggctaattttgtatttttattagagacagggtttctccatgttggtcaggctggtctggacctcctgacctcaggtgatccacctgcctctgcctcccaaagtgctgggattacaggtgtgagcactgcacctggcatgaatgaatttttttatttttggaaactcctttgaaatagtgtgtttgctttccactgtcttgttcttcacctttacctcccttacgtataaaggtagatgcagtcaagtaaagtgtgctagcttcaaatcagaaaatctccatagagtcttccgcaaatccttgagcgcctactacgtgctaatctgtcccaggtgctcaggacacagtgtgaacaaaatagaccaaaaatcctcttagtgaagcagacgcttgagtcgggggcactggagaaagcaaatcagttcgtcggtaacgaggcagggaagtggacggggaggaagaggggcttctgtgaaggtgtgcttggccaggcctcaggcttcccacctgttcactggggtgatgtgcttgcccggtgggaacggtattctgttcatgactgttgccattgttattaaccgcatgcccattgcctttcagagtttgtgggccctctcgggcagcccccagagggtgctgaatgccgggccctgtgtacacttcaccctatctccgcggggtcaggctggccacctccatttacagaggagcagatggaggcccagggagggatagggtggtgtcacatgcttggagcggggtccagggagagctcttggctccctgaggcagggagaccctgagcccagacacaccccagtttataagtggggacagctgtggaggtgttgggtgctcagccctgggcctggcttctctggcctgaagacggcagctcatctggctgcagagtcaggaaagatttcctgagcctggactgagaggccaaggtgggtttgcggaggcaggagagagctccagatcaggaggcagtgtgggccaagccggggggcggcaggatgtgagcacagagagggcagcaacccttctacagaccagttcaattccagtaaccccagcctgccgtaggggtgggggacagcctggctgcagcggggcccacctgccagtgtgtgccttgcctgcgctccaccttccccctcgggcactgcggctttcttgggacagcaggaccccagttaaacagccctgtttcctgcccagccgtggctgccgcctcttctcggaggatttttttttcccacaactcaacaaccactaccacttgcagctaagcagaagggaagttaggactcgcattttgcctctgtagcgcctgtaatcagccccacacagcccccgccgcaggcgcccatcagtgccacttccggagactacttgagatacacctgctcacgctaaaaggagaagcagtaatccatcaaaacaaccccaggcgccggggcgggagaggctgagactcagtttcccctcccatggaacagggcagtgttgggcatctgaagtccccacgggtcctggcattctggaagaacacgactcagtagctttccccttctgggcctcggtttccctgtctgccaaaggtgcagggagatgagctcccagctcatgcctctgggcctcctacctcgcccccaccctcatctctccctttccagagacattataaatcaaacggcttagaacgtaaggcatcagaaattctgaaaccttcatctattattaacgctgacagtaaattccccctccgagcgttttacatagcaactgttaccaagactcggtggtggagctgctgctccagcggccgcatcccagcagctccgggcaggatggcagggccgccacaagccctaccaacccggccaccacctgggcactcagcaaaccctctccaggggatgggcggggagggagcctttggcagaggaaatgggtggcttacagctgaaaggaggtcccagctgcttttggtgagccctgaagaccccagctcctgcctaggtgaagacaaggggccctgaagctcccaggccttcagaggcagcacctatggacagggacgggctccgggagcctcccttccttgctgccctggttagaggaagcttgtgagatggaggacaggaaaaggcttcgtaaactggaaagggctgtgcagatgttgtttaccgactcacccacctgtcagctagacgttcctgagtgcctgtttctctgcaggcagtatctgggcaccagagatttaaaacaaagacaaaaggcccaatccctgtcgcatctggcttggtaggagacagacgcgccaacccctaattgcagttgtgcaatgatcaacgtatgtacgaggagcatactcagggcggtgaggatatcgcagagggcccttcacgggggctgatgctgggcagggttttgaaggatgaacaggggagggtctgtgtgttctggacagagggactggtgtatgcaaaggcccaggggtatgaagctgcccagctgacaggtggattacaggctgacctgttttggtggggaggggggctggtagagggagcaggggtcagagggtgcaggaccttgaatgcaagcaagagagtttttacttagaggttctggtcgccatggaaggttttcagctgaggaggaacaaagatttgggtttggggagtatcaccctaattgcgcagataaggataccaaggcctgcgcaggtgagaacacctgcccaggcaggaagcaggggaggctggctgctctctgcaagctgttaagatgcacctgctgtatgtccatccccacatggggaagggtggtgtgacctcagaccctgggacagcatgcctagagaagaagaagcgggcagggagcttgtgggctcttgccaggtcagagtggccaactacgaggagttgtctcactctttgcatctccagaaatcaggacacaagttgagacacagacttcagcccagctatggatgcgtccgttggcagtctctccacctagtgacaaataatatatatgttcattgcagaacattcagcaaatagaagtctcaagaaaataatgtttccctgcagtctcaccccaccacccccaccctctgatggccaggtcacattttgggcccagttgctccagaaccaggtacagatacacattttttaaaacagaagttgcatcatgttctttctgcataccctcagtgacctgcttttcgcccttcatacgctggaatagttccccatgtctgcacatatttcggggtgaggtttgccaagagccacgctagccagaggggacccagctgacctagaatgttcggtgcttgtcttcaagggcagaggccgtgcctggcctgcccactgctgcactcagcaccaagcatggagacaggcccccagtggatgctgaatgcagagctgtgaaaagaagtggaagctgtgtccgtgaagctgagtacaagttggacagagcccactaggatgctgtaatcttgatctggggctaaattgagtcttggggtaagatttgtgcttattaagggctctggatgcttggggtaatagatggaagtttttcagggagggcttcctggaggagatgggctgtagaataaagcagaagggaaataaatgcataactgtccattcactcatctaacagacatccccagagggctccctcctggtcagagccctgtgctggacaggactaggcacccagacagagtactgcccccacctgctgccagccctgggggaaagacagacaagtgcccaggtcactgtggctgtgtgctcgagcagtgctgtaatggtggaagggtagacagtgaggggccaactttactgatagcccccactttactgatatcccccacctcctagccaaagaagttggggattgatttatgggagggagcagtttggcatcaaggtgtgcctgtagatgatggacttagagggctcaggagggaagcccatacatcctgcatactcgggatgggcttggcatcagggtcaaggtcacccagactgtacccagaagtttggctcagcccagtgtccctggcctgggaactcctggatgccgagggtttatggcagctcagttagtggcctagccctgggtccccgccatggagaggggcccctgacgtccaacgtccactcccagagtcccacaccaaggaggcccccagccccacccagaagtcaaagggtgtatctttccagagtctagaagctggagctgctgtggggcctgggccttggtctcctcggctgtcaaatggtggcaccaccctgcagggaacgtgtggagctaaaataaaatgtgttccaggtgctggtgccacagggcttagggccacactgcagaaaacccttcctcctgcttggtcctagctgcccagggccaggccaagaaaggcttcaggaagaagcccccacctcctagccaaagaagttggggattgatttatgggagggagaagtttggcatcaaggcgtgcctataggtgatgggcgtagagggctcaggagggaagccccgcagattacccccttgccaagaacctcctagaactgcatactcaggggataggcagctcattcacagtgaaagtgttttggagtcaaacagacctgggttcaagccccagctcattcacttcccagctgtgtgaccttaggctagttccttgtcctctctgtgctcagagtcctcatctttacagtggaaatgataatgatagaccagtattgtcctgagggttgaaagaggcgacccatatgtgagtgcctcagcacagggactggcacatagtaagtgcttggcaaatgaaaatggttcttctaaggctttttttttttttttaactagtgcccaaggaagtgggggtggcagattcctcactggtctcttaggttcctggcacacatgcagccaccagattgagcctctggaatcgtaccaatccatttaccagcccacgtcattagctttttctgagcacctactctgtgccaggcacaggggcaccatggtggaactggaagcagcaggctcgctgggaggctgacagctgtggatcctgacctgtggagtggccagtgccccgggggatggtggaaggggaagagggtatctagggcaggcatcagttggaaagtcacagtgagatttgagaggaggtgatccctgaactagtgacaaggcctactagcattttgccaggcaaactaggagcaggtggaaaggttgggaggcacaaaaggttgggagactcccagagggtgccagtagctccttgtaagtcattgttgctgggcatgaaatttgggagctggggaggtgggtgggaatcccctgtgaatgccaggccaaggaggcagggacagtgtctgattggtgactggggcctgggcagcatctgagcagggaacacagttgagtgggagaaaggtggtggtcactgaggagcgagggcaggtggggggatggaaaggtctcaggacagggggcccagcagggagggaggcatgggagggaggtctcagggcatccaagggacttttggttgaaccagaagttcctgagtgtgagcgcggcccagaaacagccacaggcctcatccctgcactgggctcgaggctggagtgccaccagcagctacccatccattgggcatgcgtgtgtctgctgtatgccctgacaagacagatggactctgccctcacggagcttaccagtgcagagagaaaagagagtgaataaatatacgagggaggtgattttggagagtggtaagagctagggactaggggagttcccttaggcagggcagtcagggagggcttctcagatgaggtgactgggctcattggagaagacccaggaggatggcgtcccaggcggagggaacagcatgtgcaaaggcctgggggtcaggggcatggcatgtgtgaggagccagtgggagccagtgtggttggagtgtgcatgggagcggggtgggaaatgaagctggggaggagtacccctaaccttagacagctaagaggttcaaatttagttgagggaaagttctgactctacccccagcagcaagggagcttccccaccaaagcaggagatctggctctcagcattcactttactttcctgtgtgaccttgagcaagtggcccaccctctctgggcttccagagtctgtggcaacacagaggaaagtgaggtgcttgctcagagactcgccagctgtgactggccaggggtttgatcccagtcatttctgctctgtggtgggggacttgtcgggaggggcaggtagaggtgagctcagtagaaccaagagcccccaggacacagggcatccaggaggcctgtgcttccacagcctgttcactccttcatgcacccgcctccccctccccactgcactcctgcccacactgcccactccccaaccccctcctctctctagggctgaaagcaagaggctcccatgggggctggcccgatgattggcagagtcgataaaggccacttggaaaccctcctgctccaggtggttccccgctggcatttgtagctgggattccgaggccagagctgaacccagagatcatttatcacacagcctcaaatggaggcttttctggaaaaaaaaaaaaaaagttctttctctgagattccaacttgcattgtctaaaacaggttaattggcaacaccgtttcccccagatccttccctgcatccccccgctttcctggggtgggaatggcagcccctggaagtagagaagggggacaggtttaagacacgccgcattttcagagcttgctagccatgtggagactgccagaggaatcctagagatccacccagtgaccacggctgctgggctgcacttagctttgtgatccagaccgggagctgcctgtgaagtccctccccaaggagctggaggtcaggagcctgtgtgtctcactcccttccttgcttgttcctatgggaaatgacaattgaccactgatacacgcccgccctcaaggagctgctggcagcagcaagaggggtgagctgtgctggggcagagggggcaccgagggaccctgggagccaaaagacggggccagcccactctgccggagtggccaaggagcaaaagcagtctgcctggaaggcaggcagggagaagtgtgctgggcacaggtacgggggcccaggtcataaaagaacctggtgcatttgaaaagctgtgagatcccagcatgcctggagtgtagaatccacgggactcatagtcagaatgtttctgtttcacaaagccagagaggttgggagggtccaggccacaaaaagcctagaatgcctggttgtactcctcaagataggctgggcgtgctgcataacaaatatccccaaatatcagccccttcaaacagggtttgaccctcactcatgccaggtctctgaccagacagctgggaaactgctcactgatgtcactcaggacctgggcagacagaacaacagccattagggctattttcgtggcacagagggagagagacaggtgtacagatgcatggagcttcctaaagcagcatgtggcacttccacttgaatttcactgcaaagtgggccacatggccatcctccggacatctttatgggctagtgacacgcttgctgcctttggctgaggaggacaggaaatatttggtggtggtgccgacactgaccacaaagaccaagaaggttcagcactttaccctgagcaaggtgaggagccttgggagggattgagtagagtaggctgcagcctcatttagttttactttttaactttttattgacttgcatacagagaagagcacgaatcataggtggacagctgatgaatttctgcaaaccaaacacactcgggtataactgaagttcagatcaagaaaaagaacatcaccagcccccagatgtcccttatccccctcatcaggcatttcctgcccaagagtacttttgtctgcctttgagtttcacagacatgaaaccttttctgtccaacttcttttcctcttttttttttttttttttgagacaaaatcttgctctgtcacccaggctggagtgcagtggtgcgatctcgcctcactacaacctccgtctcccgagttcaagcaattctcgtgcctcggcctcacaagtagctgggattacaggtgcctgccaccacgcctaactaatttttgtatttttagggttttgccatgttggccaggctggtcctgaactcctggcctcaagatatctgcttacctcggcctcccaagtagctgggattacaggtgcctgccaccacgcctaactaatttttgtatttttagggttttgccatgttggccaggctggtcctgaactcctggcctcaagctatctgcttacctcggcctcccaaagtgctgggattataggcatgagccaccgcgcctggcctcctcttcttttactatttatgagacctatctgtgctgtgtgtggcagtggtttttcattattgtgtagtattctattgtgtgcatatgccacagcttatttctccctcctacttttgatgaacacttggattgtttataatcggaggatcttcggtggcttgcgcctgtattcccagcactttgggaggctgagacgggaggagagtttgagaccagcccaggcaacatagcaagacctcatctctcaaacatttttttgaaaactaaaatagttggaggatcttgtgaatatacctgccgtgaacattctccaacacattgtttggttcctgtatgtggagttcccattcaatgtgtgccttggaagtggaactgccatggtctcatttgcatttaagaagcctctactggacacacagaagagaccgaggtacagtccaggcaggaggtggaggggaaggtatgtgggcccagccctagggctcctccacctcagaatccagaaacatccccagcgtggacttgtcttccaggcgacttgggggtctgtattgtacacacaagatgaaaatcgtgtaaagcaaggcccagacacatgaggctgagtgtgcagccccaaacggcaagacgtaggccttactgtgtgagtcacacggtggtgttatagcacattctagtacacaggcaagaatagttgtataatatttgaatgcactgaactcacttccaccaggtacacgtgtgaggaatctccctgcaagtcacccgtttcacaagagggaagacggcccatcttttaagtcaggggaggggaccacttgccctggggcctcgggctggggttcagcctgcctctgttccccactcttggacacacaggatgaagggccccagtgctgatcgctcacaggggtggtaagacttaccctgttaccctcttggggtgtggcatttcttagaagccaagcatgggtaatcctttgcctggaatgaagccaggagaatggtggggcttcaggctctggttctagaagacagggcttcttgggagctgcccctggagcctcccagcctgagcggtaggtgctggagctggtgcctttgaacttggattcatcacagggaagacctggggtccaggcctggttccgaggtgcccaggccagcccctgagcagccaggcggccttcttgtgaactcacattgtagtgtcccgtgcagctgtcctggtcctgcaggatgcattccccacccccaagcccttaagggctgttgggttttgtttttaagaaacatatggcctagttgttactttggctggcctccccaagcctcatgtctctgagacccccactcctaaggaagggggccaggcattgatgggggtgtctgggaagccgagggaggatgcctgccagttatgagaaagatgcatctttgtcgcagacacatgtggggcgctctatgtaaattgtttcagcgcctaacaggaagaagaaaaatgaggctttgatgcgagccaccacctctcagccaggcgtggtgtcactcaggcgcgtccgaggcctgcttctattaaggagctgtaagctcttctcaggccagagacccagggtgctctctgggcaggaggtggctctgctctgtctgccgaactctgggcgtcagcactggggcgtgctggggcctcaacccagccccacctccaaggcaggcggagagcactgctgatggattccccagcactgcactgtgcgaggcccagggcggggaccccagcaggcagcgtggtagggtttgctggggatgacaggcaggcgcacaggcggcggcactgttaggccccatgtgatggccacagcctggcacaggaatcggtgctccaggcagcagacagcaaaggtgtggaggcaggaaaggagccactgtctctgaggcctgggagagcactgcgggtgctggagatagatggtggcaggggccagctcaggggagggcaggaatctggtcttgtggctttggaagcccatgggttgcgagcaggagagggtggggtggtgtgagtctgagggaggtctcagatgggaggggagggcggagtggggcagggaccagtgagggccagagtggagactgggcaggagggcatagcacacacatggacatgcttcccaatgagccctggcccagtcaactcccagctccaggaaccccccacagccctttgctggggtgcacaccgtccagagcactgacttccccaacgagccaggtggaaatgtcccagggaggaccccggggcctgaggagcctactgaatcctcaacaaagaagggaagagaggcctaggccacagcaggcccagaattattgtgttatgctctggatcttggggaatgtgtaatccccacaccgtatctatggcaactctccattaaccagaatttggttctacaaattcctgttcccattcattctagaaaactcagagctgttggtctttttaaaaaaactcgctgaaaaaaaaaaaaagatactaaagaatgtaaagaagaaaatgaagtcagctccagcccctctgctgagaacacactgatgttagtactttcgtgcatttccacccagtttgtttaagaaaattgggattgtgttgaatgcctgcttttgcatcctgccttttccattgtgcttcagatcatgagcatttggcaggtcagaaaaaaaatgtctttggaagctgggctgtggggactggggtttggaaggcttgctgtgtgctgtgatccttcaggggtcatcgccctccctaagcctcagcctttgcctctctgcagggagagactgaaggacatttctcaggctcccgccaagagtctcagtgttttccttgcaatggtggccttgttattccagccttgctactcacaggtgggcctggtgatgtttgtggcagggtgggcacagggctggcactgccaccaagtacgtagttgagccggtaagctcagaaacgtgggctcactccagccttgagcactttcccatctcgtgatcctgggcaaatgactttgcctctctgaacccctatctcttaagctccagaaccgggtggttgtgatggttcattggcttaatgtaagtggaactcttagcatataataagtgctcagtaaagaggaactgttgctaccctgaggattgctggtatctgtgatgtcacaggtgtaatatgaggattaaatcatgaccttcttgcagcattcagcagaatgcctgggacgtaggggacactgtcagggggtggcacctggtcccatggtctagccaggactatctttgtggcccttaacttgtgcagctgcccagggctggcgctcagaaatggcctgtgcttggtgcatgctgctctgctgttgctatcttgagtttttattactttgtgagcaagaggccctacattttcattttgcactgagccccacaaattctgaggccactcttaacaagaggattaatccctagggcagactggcagggcaccccacacatccacggtgctcaatagctatttggagggtgaaggcaggactgaatgggccttggttcagaggagaacagtaccccagcgaggccaggtggcttgcccagtttacacgccagacatagggccaggcagtgctctgaccatcacgtgaggggctgtcagggcgacggtgtgtctgtcaagggcaggaagtgggctgtgtggagtgccagccaggatgggcagggtagcctgcgccctgctgacctgcagccagacacactggggagacacaagacgactcaggttggaatcgattgaaaccaagccaagagcttgggccttggagtgcatgggagggggaggaggttcagacccaaggtggcggctgcggctggtgttagcacttcttcccggcagggtgggcagggccccattaggggaggcaggcctggatgccccccagcaccctttcatgagggggagagaggagaggagcaaggcccaggccacctggtattcagaaggctgaagtgacagtgtcaggcagtttggggggcagatgaagccgtggcaaagggtggccaggaggccagagcagcactcacagatgaggtgggattggggccacctgcatgtgtggggaaggagcccccaggactcggtgtgtgggcctctggctgacaaaggccactctgcagaaaggaaattagaaagaagaaatgatttcttggctcatgtcttcacgaacaagggagaaagttgctggcgtggtctcctcacagaagagccagggtatctgaggggagccctttctctgccagctgggtcaccctcagggctggaggtgctggatgccagagtagaagtggatggatgggggtgtccccccaaaaggagagggagacaaggtgaggctgtgccttttaagccttctgcgcaggcctccttgggacagcccgggtcggatctcagactgcagcatgtggggctgggagccagctcccccgaggcacgggggctcaagaggtctgagcagcatgctgaggtcagggctggaggagcagaaagtagtagggagccactgatggcgtcataatgaaggagcgacatgacaagcttgtgaggggccacacagggcagaggctagggacgaggagatcccgctggcagctgggcatggaatttctggtgggtagtgaaacagccagacctaggacctgtggcagtgaggatggggagggggccagatgggcacacttcaggcaggggaaccccaggacttgggggcctcctcagagaggccttacagaaggactggggcagcaagcaaggcctgtggggcgaggaggcctaaggacaccatggatgcactggagccaagccattaaggaccctgcaccccggccagaggcctcactcaggatggctgcagtggagactgaagagatgggtcgggtggagggaaatgggctttgccctcaggaggtggttgtgggaggagatgcggtcacccgggaagagaggccagaggatgggaccgaggagcagcgacacgggaggacggcagggcgggtgagcgggggggccctgcccagggtgacagggctttgctgggccctccaggaccctaggcagggtctcccctggaaccaggcggtacaaggcctgtgatgggaggggcgggaggatgagggattgctggcaggagggcctgggaccagaagtctccactgcagccatcctgagtgaggcctctggccggggtgcaggatccttgtctacctgcggggtagggagacagcctgtctcccaaagggcggtggggtggctgagcctcaaggacaaaggcaggcgggggcaggggaaggagcctgtggctgggagcttaatggccccgaaaaaaaaacataaaaccagagaattatggggagacataaacagagctgtcaggcattagctgcagggagacggctcagcctgggtaagagatgctggcggctgagctgggatccttgcgtgtgcataaaaaagacagaagttataaaaggagggagattaagaagatactgcctcttccatgattgggctccccggccaattcctttctcacgccccggctgaggccccagtcgcacactgaccctaggggcctggcctgcgaggcctggccaggtcaggggccagggcctgccagcggccagggaggtccatgggggtgggtgggggtgggtagcgacttggcccaagctagtggaggggccggggagccaggcccaaggacgcaggcggcgccagccccagcaatttatgggtgctcacacaccctgccgtcttcattttccccgttgctgctgctgtcattagccaagcactaatgggcttaaatttcaccttaaaccatccccactgtcctcagcagatgacaaacgccctactctcgccggctgcaaagctgctgggcggcctccaagcaggcatgtgccctccctctgcccgtgtcctctggccctcaataaggaggctcctaaggacccagggcctgggatactcacaggccgggagaattcctgggggtgtctgggagcccaaggaagggcagggctcaggaaagggggcttcagggggatctttggagaccctgggatgataatggatggggagacaggagcccagggtccaggggcaccccactgtttggccttggcagggccatgcccctgaccctgcccaggtgtcatgaagaagggccctaggagctacccgccatgtttttaaaagccttagggaaatcatattttgcttaggctaacaaaaatagcagtggctttgcttggggttagaattccatccatccatccatccatccatcaaattcgttcactcattcattcagcaaatgtggcccatgagcccctggcctgagcaggtccatgaaaggcccgactagctgttcatttgaggcccatgagagggaacaagtgggtgatctctaaatgcagttcgtttgggagacaaaatcctttagcagtggctctgaggatgggaggggaagtgaccaaggggctctagaggctgtggggacagagtgcatcaacctggggtgcatccagtccatgaggcgggtgtttgcccgaaaaggagacaggaatagagatggagctatggcagagatgcagggattgctgggggctccctgctcatgtgtgcacatagccatggccaccgcctcccgcctttgtttcccagcaaggggcaggtgcccgaggagctgctggggttgatccaccatcaaagccggcctgtcgggggctggtatgcagagtcatccctttcccatgggaatctcgctcccttccaagcccccagcacccgcctttcatccctgtgctgagagccagtactcccactgacacccaaacagtgatgccaaggaggcactgccagagggaggccaccaccatacaggcctggaatgtcacactctctgtccccaccaccccccacctgcagtgagcctaggggaaagaacaggctggcacaggcattaactggagatggagggtggtgcatggctctgggccaccatgctgtgtgtccccttgtcctctctgggcctcagacatgcaatctgtcacctaagggtattgaccctgccaggctctggcacaccaggaaatgtaagccagactcaagggttggcaatatgtacgggaggttgggtgaggcatcttctccagtccaggaggaagggattcctaactggtgcttaggaccatggactttggagaaatctattcctccccaccagtatctagaattggctgtggagtcctgccaatgctctgttcctgacatttctagaatttctccctgcatttccagcccctgccaccactttggtctggccccattattgctctctgggggacagtcccagcttcctgttcactggcctcctggcctcccctctcacccccatcaccaatccatcctgcctcactgcagccactgcagactccccaacacacatgtgtgatgctcactgttgctcactctctggggctccccgtggccctcaccacaacatctgtgctctccactgtggcccagagggccacacaccacgtggaccctgcccatctctcatttcttgcctctcacttccactcgagagccagcctgcattctcactactatctctcactctctcctgccttccaggcttttcctctttcccttgctaactccggcacatcccctaggtctcaggtgaagtgtcactcccctgggaagcccctctgccctcctgttcccactcaggtatgacgtagggccctttcccatgcgctggcacttacttgccttctccacgaggctctgagcccacagctgtctctgggtgctcagtctctagcaggtgtatggcatacagtaagcacttagtaactgcttctgagatggacagatgggtatgtgcaagggtggatgggcaggtgggtatgtgtgcatggatgcatggatagaaagaaggtaggctggtgagtggatggatgggtgggtgattgtgaggtatacaggtgagtgagtggatgggtggatggatagatgggtgtgtgtgcatggatgcatggatagactgatgggtgggtgggtgggtggatggatggatggatggatgggtgggtgggtaggtgaataatagatgggtggactgttgtgtgggtggatggagaggccaggtggtctatgaggtgagtccagaggcattagaaaatggagttctaagcctttggctttccatgggccccaatttctctgtctgtaaaatggtcagctcagctcctgtgcccagcgtggaggctcaggatgagctggagagaaggtggaggcttcagcaggcagcacatcaggcgctccacagacagtgcatgggacagaacaaggttgcttggcgtccctgcagcccaagggctcccttcttcagggggacaccgatgccctcctccatccctgcttgctcccaggatccttgcccaggtagcagactgggaaccagacccatagagttcaaatctaaacgttgctgctcaccaggaaattccctttgcctcctaggccttaatggcacatctataaaatgggggtgctcgtgtattcatgttctttgcagtttctctggggatcaaaacaatgtgacgaagggaggcagagagaaaaaatgcaatgtgacagggaagatggcacctctcctgatgcccagcacacagagggtacccaggaaatatggggcttagaatctcaacacctgaaagagcagcttctgctgcagcccctgccacaggcgccacactggccacagtgctccctcctagcccttcttcccctggccaaagctacctctggaaactgagttcgaagtttccaaaccttatcccagaccccatagccatgagttataataggcacataattaataatcacgtaattataatgtctatattatttataatttgtatatttatatataatttatttaactgcatctataatctataatttaaaattacatcaggtaagtaattacttacctactatagtgcttctgccacttacaagctgtgtgactttggataagtgccctaacctctctgtgcctctgctgcctcctctatgagttaaaatgtgtagactgcttctcagaacagggcccaacacatgtctggtaggtgtgggaattagccccgaggatgctgatgacaaagcatttctgtatctgttttgctcatgggttctttgctcaaccctgcaaggtgggcatttaatcactatccctattttatgggtgaggaagcggaagcccagcaagttggggtgactcacctgaggtcacacagcgagtcagcagtgggcgtcaggtactcggtgttctttccaaagactcctgaggccctggtctggaaaaagccagctctggaccaggccggaacacaggggcctttctgaaccttcctttcaggggcctggggccgcaggggcctccggcccgtcagccaagtcttttcctcccaacatgccagccagggaacacagacagccggaccccgctctggccactgccccgccaggcccctgtgccaggacagcgtgtccgcccacccgggcagtgaccagctgttcctgaggctgtgggctggagccaggtttctgtcacttcaaggagctcctgtcttcccggccgcacctccacagccagcaaggaccagtcagggattttcctgaactttccctctgttataaaagagtatataaacatttaccttttaaaagtaacagctaacttagttgcgccctcctctgcccagcattggtctggcagctgcatgtacgttgtctcctggcatctgcgcaccatcgtctgaggtgcataatcttgtgcctgtttgcagatgaggaaactgaggcacagggaacttgagttgcctgcccaagcccccacagcaaggcagtgtctgggtggggatttggacctagacagggagcctccctaccaatcaggccttcagggcagagtcttggggcccagaaaagcccagcccagcttctggttttaaattttataacgtgttcctttgttcagatgattgaaggaaagcatattgcaggtagaaatagaatgaaaacattgtaacacatgaaaccaggagtgcctttgtgtgcagctgacccttgaacaatgtgggggttagggacgctgacccccacacagctgaaaattcatgtgtaattttttttttttttttttttgagacagggtcttgctctattgcctgagttggagtgcggtggcacaatctctgctcactgcagcctggacctcccaggctcaggtgatcctcccagctcagcctcccaagtagctgagactacaggcatgcatcaccatgcccagctaatttttgtatttttagtagaaatggggtctcatcatgtcacccaggctagtcacaaactcctgggctcatgcagtctgcccgcctccacctcccaaagtgctggaattataggtgtgagccaccatgcctggcctcatgtgtaactttcgactccccagtcaattaacacacattttgcatgttatatgtattatttactgtagtcttacaatacagtaaactaaagaaaagaaaatgttattaaaatcctaaggaggagacaatcgaatctatttactagtcatgaagtaaaagcggatcatcgtgaaggtcttcatcctcgccgtctttgtattgagtagactggggccaggagaaagggagggtcttgctgtctcgggtggtggagggggaggcaggagaggcaggcacactcggtgtaaccttttgaaaaaactatcttgggatcttggctcagttattccgatgctgagtatgctaatcacatctaattttcattgattctgagaaaaacatccacatataagtagactgtgttgttcaagggtcagtcatacctggccctggcagcagcaggtccccacacagcttagcgcttgagccagtcctggctgctgcgtcccccaaagctgtgtacccactgaggaggacgcagcctgtacaggaattcaggtttggttctccttcccctcttgggggctgtttcctcatccgtaaaatgggaggctgatccctatcttgcgcattgcaggacgcaggggagctgactcctcttggcagctgggtcttgtcccatcctactgagggggaaactgaggtcaacccaccagcctagagtcaaacagctggaaagtggcagtgccagatttgagcctgaaaccaggttattttttcagtcaccttgcctagccattcatagaagtttttaaatcttttaggagttatcacatgctcatggtagaaaaattcaaatgcaatttcctttttatacaaatgttttgtacacacttttttttttgagacaaagtctcactctgttgcccaggctggagtccagtggcgcgatctcagcttactgcagcctccacctcctgagttccagcgattcttgtgcctcagcctcctgagtagctgggattacaggtgtgtatcaccatgcccagttaatttttgtatttttatacagatggagttccaccatgttggccatcctggcctcaagtgatcatcccaccttggcctcccaaagtgctgggattataggcatgagccaccgtgcctggctcactttttttttttttttttttttttttttgagagagggtcttgctctgtcgcccagactgtgcagtggtgcagtcacagctcactgcagcctgacttcatgggctcaagcaatcctcctacctcagcttcccaagtagctgggaccgcaggcaaacaccacctcacctgcctagttcattttttttcttgtagaggtaggatctccccatgttacccaggctggtctcaaactcctatgctcaagcaatcctcctgccttagcctcccaaagtgctggcattacagtgtgagccactgcacccggccctgtacacactttctacactgcactttttttcaccaacttgaagactgctccaattaatccatgtggtgcttccattctctgagtactcagccaatagaacctcccagatgtatctccctcatcccccttggatggacagctaggggatcccgtgttttgctgctgcaaaggacattgcagttggtagccttgtgcagatgacttcgggcccaggttagagggcacatgtaatttgcatttgggtccatattgccagaaagctctccaaagaggtagtaccattttaccctcccatccccaactagattgggcacctctttccccatgccctcaccagctaggcagatgctctgtgccaagaaaaccaaacagctgcttcccttacaaatactcaagggcctgggcatgtgtgggggcctgagtccagcctgcacccgttaccaactgcaagatctcaggcaataggcttcaccccgtggggctcagtttcctcatctgtaaaacagtggtgattggattatggtgagaagtttgtagatgcaaatgcctaggacagtgcctggaacatcgaggccccaggtcagaagtggctgttcttacgagtctgcatgagtcttgtaccccatgactgcagtcatggggatgggggcccagcccctaggatggatgctcaggcctcagacctgtgttttgggaagggatgaagggaagggaagagcaatgtggggaattaccaaggggaaagggtgggattagcttatcccagcttcccactgtgccagtggggaaactgaggcccagaggggcccaggccttgaagtgattgcaagttcagcagcatgaaactgctctttatccgtgcactgctgtcaggaacaaatgctgaatggagagtccggagggttgcccaggccactgcaggacccaagctctgagactgagggcttggggacacagagccagagccttgtcctgaaatcctggagggtgctccttggacaggacaaaacttgtattctctctctgagcccagcctcagcagaacccagagtcttccagggctgagatcttgccgtaccagctgcggtcacagacctgccacactggcttgacctgggagttccttacagctgcagaacccctgtcccacctgacccgctgcatcaaaatctgcgtctcaccaggatgtacactttaatgtttgaggagcactgagactcagccaggatgatactctacctgcctgcaggtacaggccgctgctctatgggcagacctcaaccctcagccccagaatgtcctccccagctctgtcgcagacatacgtggctccctgggaggcatagaaagtacaagacttggacctggctccccatgaactggtggccctggaagttgctaccttttattgagcccctgccagctaccaagcacattatcccatttcgtcccacaacagcactgaaagtttgctgtttaatttagagtatcttgcagcttaggcacacaaagcacagagaggttaagtaaactgcccaaggtcacccagcatatacatatgcaggagctgggatatgaatccagagctgaccccggcaccagagtctagccatttacaatcagagtgggcatgggggcagatggtggctcctctcacccctgaaaccggagccccagcccctatgagccctcacagttcattggtctggctgtggtgaatctgacctctcaaaagcctccctttccggagcagaggcctgcgattctccatgctggagagcccgccaagagggattctcctacaactttccagaacacagcagttctggggccaggccaagctagctatgtacagctggaagaggctctctcccccagatgctgagtgactagaagccaagagggagggagttctggaatggtctgcagcagctggaggtgaggcctgagggggctggggcggggcctgggaagaggggccagtgcacagagtattctgaaccgcagaaagtattctgttcactctgggagaaaaacaagagtgttgttcaaaacagctggacgccaggcccagttgccctcgcctggtttttactcttaaacaccttcgcatttcatggctgttccaaagagagagaaatcagccagttgtccattcagacacaagacaaggcatcagccgacaaccaaaggcaaatattttccgtggtgaggaaagcctcccgggtggccccaggcctgcctctggagcagtggctggctggtggctggctctccccgaaggtcgctgcttctggtcagcagactgcgtgtctgggggactggccaggatccgcacccacccagggagcgctgggggcagcggggcggccatcctaggcccgtagtaaatggaagctcccttcctggcatgagagcagccaggcctccagggaggccaggacagcgtgggccccacagttccctgtcttgaaaccccagcccttgatatcaaaatgggacctgttagtctgttgtcggggagggggatttaactgcccaaagctcttaggccctgagtgaatttttttcagcacaacagtagctacacacagttgaagagtgtggcacatggctacatagggtttgtatttggtctacagatgaaggaacaagacccatgtggacttaggcctcattatcataattctgcagccccaggagccaaatccccacatggaaacccttagtaggtagcctggccaagtgggtagcgggaaatcagtgatggtaggccctgggacttctctctagtcccctccccaccctttttttttttttttttttttaatagacggagtctcgcccttgcccaggctggagtgcagtggcgcgatcttggctcactgcaggctccgccccccggggttcacgccattctcctgcctcagcctcctgcatagctgggactgcaggcacccgccacctcgcccggctaattttttgtatttttagtagagacggggtttcaccgtgttagccaggatggtctcgatctcctgacctcatgatccgcctgcctcggcctcccaaagtgctcggattacaggagtgagccactccacccaggcttttttttaagacaagagttttactcttgtccccaggctggagtgcaatggcgcaatcttggctcactgcaacctccgcctcccaggttcaagcaattctcatgcctcagcctcccgagtagctggaattacaggcgcatgctaccatgtcaagttaatttttatatttttagtagagacggggtttcaacatgtttgccaggctggtctcaaactcctgacttcaagtgatccacccaccttggcctcccaaagtgctaggattacaggcgtgaggcatcgcacccggccacccaccctttttttctcccaagaaaaccagttttctgaaattttcagggggaaccaggacctcctcgcccatgtctttcacccctgggtgcctgtatcctgtattcaccaaagccccacgggcatctccccgattgaggtcccacccctcagggcctaggacagggggaccagggagggcccccagaggctggagtttggaatacccccttctcttctctggagctcagtttgcatgtctgtgaaatgacaggtgatgtcacctcccagaagggcagtttgagagaagtaaaatctattgaggcaccttggacacaggagggggtcagacggcatcagcctttgagggtgctgcagttacacggctccagcagtctgagccttatcaagacctttccagatatgagggaagtccatgcccagtgtctagctggctgggggagaagccccttgagaacccccactctgtaatgctaggctctgcatttgcttaggaggctgtgtccctgtctctccccttctgggccagccttgctttctgggcaggcccaggagtgtcccgggcccagcactcagagtcagcgctgtctttaatctgtattccacaggcatcctcaccccctcccctcccaggagctaggaacctgccaggcttcttacctctctgctggaatctccaccccccaccagaggctgccctcttggggaaggggcccagcccttgaggcctgtctcctccagactagctaaaccacagagagaactccatctcaggttcccaaataggcggtattcttccccgccaccaagctaggcagctcctggcggctggaatgccctgctcctttctcagcccaccacttcctccaaccttccgtcctctgtgctgcagcagggagtcttaccccacctccttcaggagggaggtgctcacgggttcctatgcctgtgggtctccaggattgggcacggagcagtctgcaaaatgtcaagtgagggagagatccagtcaaagccccaggggggcctctgagctcagtcagctcctctgctgctccccacctcttgggggaaggacaggctggggtttgcatgggtggccttttggagagcagagtaatgggagcctacttgaacttcctgcggcctcattccctgactgggggcggagggtagtctgagctgctggcctggggtgcttggccgcaggggaaggggctgggagggaggggtctgggtgagtctaagggagggtgagcctgaaaaggggacggcagcactaaactgccttcggggagtccccactgtgcgcccctggcactttcccagtcccctggcgcggtcgcaggcacgggtggggtctgcctcaaagttgttggtacggccagcccgctgctgtttaaatggtgtgtttgtttagagcggcttagggagggaactggaaatggggggcgggggcagcgccccacttggcgccaccgctgccggagggtctgcgtgttagaagccccagcttcgtaaatgaccgaagaagggtgggcgttgaggagggaaggccgaaaaccaacggagggctcggggccccgggccggccgccccctttttgcggggggagagcaggagccgcctctcgcagccactctgcgcgcggggtgggagggagagagggaggcgaagggacgacagcgccgggctccccgcccccatcccacccggttccaatatttcgcagaaaggcacgcggctcctaatcggtcttttccaggctgagatttagccgtgcgatgcccgcgcaggggcgggggccgcgggccaggggaggcgctcagagtccggagccgccgagcgaggtgaggagcccgcgtcctcggctggtggagcgggcgggcgggcgcgcaaacccgagaggcagatatagaaaggggggcaggttaaaaataaccctctccggctgggaagctcgcgcgcgctctctcgcctcgttcggtgccagaggactccaggggaggtggcgttggggagggcagagcgggattccccctcctccgccgggcggggtgcccgcctgcgcgccgcggttgcacgtgtgcggggccgcgcgcccgggccccctctgcacccggtcggtgggtgccccctccccaggaccgggcgcatctggcagtggccccccgcccgcagccttgcgcggctggagggaagcgctccattattcattatttacgagcgttaataggtttgagccacgggggcggggggttgggggggcgacgaggacccagtggggaccgaagcattagaagaagggatagggagggagggggaagggcgggggcggggctgtgccgcggcctggaggaagaggtctcggcctggggcccggcgagccgggcgcacctctccgtcaggtttctccacaccgccggccgtcgaggctgctcagggcgccaagagggcagcacgggccttagattttgctctcggcctctgtccttcgcgtcctcgcccttaccgaggcgtggggagggagctgcggaggccgtacgccccgccctgcgcgccccttgccgccgccgcgtccccgcggcagccccggcctcatttatcatcatctttggtcaagtggagtgtgcaaggaacagctgcttcactcggctgacttcgagggcggctacgggagaatcagggagatgaatgatgggggctggtggcagccccccgcggtccccgcgcaggcgagagggaggcggggacgtccagggccgcctccgcctcatggcgagtgcagcgcccccttcctctctcctggcgcctgcagcgaccggggaccgggggaccggggcaccgaggaccgggcccgccccgggaggggactgggcgcggggacgggggggcgcccttcgccggcggagaactggcgggcgcgctgccggcagagcccgaggttgccgtgaccttgctggggtcagcgggctgggctgcggaggcggcggcgcggcgtctttggtgcgctttccggattggcgcagaggccgggaaacaaggcgggggcgggcgggggaacacaaatagaaggtgaaattttacctgcccctgagggagtcctgcggattttctccggcagcagcaggcgctctgcctttgtcttacacggctgaaacatctgttgcagaggggcggagaggccgcaacaacccccacacaccctgcgctgctccccgtccccctctgccccagccgggctgcaggactccaggcgccgcgttaaccctgctcgcgctggggcgcgcgcccgcactcgctgccgcagtccagcgcctcgcgtggggctcctcgcccccgccccggatctggtcctggccggggcgcccggtgacccccctccacctcgatggggtgctgaggtgtaggcggggggcgggggcggaaagggttaatggcctagtcgcagaccctaattgtcagagccggccccgcttcgtttcaattaccctaagtagagactgaatgcgcaattaacgaagtcagcttgccaactggaaagccggccccgctttcacgttgagcagaatactccaccagctgacttggacgaagcaatttcctcctctctctctccccttttttctctccttctctcttccaatccccctccctctttttctctctccttaataataaaattataccaagcagtttgcggtgtggcaggcggccagaaaagcgtttctttaaacgccgccgtctcacaattaggcagcaagaggatttgacacgccgtggcggcctgacaggcggcttcctcccctggggactggggggagggagggggtgccaattccccgctcccccaggtggaacggggactgggaggggctggcctgctgtgcctccccggctgtcagaatggctgcagcgagggggtgtcaaaggcagggaagcgaggggcggttccgcctaggctggggaaggcggaaggcagcggcacattccacgactcctctgggaagctggcgtatccaggagggagaccttgttcccctttctgtttgacagacaggcactctggggcatagagctgtagacggatctcagccctgctgggcgtcctgcacaagccactggcccactctgggcttcttccattaatccctcggcaaaatgagggggagatttgacctagaatgtgctctgcaaaaagtgtcttcccgtggctcgttgcccttaacagctggtcttgtaggccaggagagggggggtgtaggcagcaccacgtagaagcaagccggagacccctatgccgtttgggtggcagacccatgggcctcaaggcacacaggagggtggctcggcggggagccatgatgcaggcagctaatagatggggtgactttgcaggattgccagggattggtgccatgaggacagaggatactgaacactagctgcagcagccgggccacttgagctcggggaaggcccagagaatttggcagaggtgggaggtaactgcaggggtccccatttgctctttgcagccccccagtcccacccaggctgctgcttacatggggtgccttcatccttccccacatagttaagcccttcttccagccttccctgatcacctcctctccccacccccatgggcccctgggtgtcactacatctcaacaccaccagggcagttgtatgtgtgtctgcctgcctctggagagcaagggccatgtgctgtttcctgtgtgtctccggcacccagctcggcccacatccagactgtaagctgagcagaaatgtgctccacaggtgaaccagtgcaggcactaggggctctggaggagacagcacacactttgtctctccttcctgattggctgttgcatgcatcctggcctccaggcccctcatcctcaaacctgtctctgggtatcatccctttggtctgtgttgggggttaaatgcactcaacacagaacccagcaccccaatccatctcatctgtttatttatccaagtaatactgaagggacatcgactctggggccagtttctgggtttggagcttagggtcaaacagaggaagtctctgccctcctcaggctacgttctagtgagggaggcacatgtgaaacagctcattgtaccatcaattatgtaattaccgctgccatgagagccaccaaggagcctggcgggggacccaggagagttggggtggcgcctcgcccggtgtctggtgtggaatgccacagaggttctcaccgcctctggaagcctccagcctttccagtccccctcctctctgcacctcctttccaaggccgctgagtgcacctcctgcacgggtctgccctgcctcccccctgagcccagggcactcgcctttctgctctcctgcgttgctctgcttatctgtgctggtcccagagcttctgctgggcccgtgagcactgttcctcctgctctgggtgccatcgagcccatgcagatcccctttgcatcggttctgtcagcatttgaccccaggagcttgtgatcaaattcaggccacagacagtgtctcttgaattctcaagtatgaaagaaaaaactttgtacttggttgataatattttcttaaatgagagctgtccctttttgtaaaatcctgatttctgtctttttcaagggaaaagctcagaagctttggcaccctggcctcccactcccaagtggccgcagtccgctggtgctgagaggggctgctgctgcccctccccccccactttatttgggagcaggatcgccagtttgtctccatacccacctgcccacttccctgccaggcctcgggaagatgttctttgtcaaatgaagcaaagcagtggccacccctgatctcccgctgcctggcccacccacatgtgctctgtgtcgccactccactgctctttctggatattttcacagagttactgtgacattttgtgcattattgattcagtaaatatttattgttctggacaatggggagtagctgtgaacaaaacaggcagaaatccttgctctcatggaacttttgttctaaagaggagaccaataataaagcaagtcaagtttgattacaacaaggtcagtcgtgggggtgcaaggggtgctgtttcaaacagtggtcagggaaggcttattgagaaggtgacagaggtgacagaggagccaagacttggagccagggtagaagctgtgtagttatctgggagtggtatttccagaggtaaaaggcttgcccaaggtcacacagtcagccagcagtcagacaaacctgcagacacttgacacctctgtgtttccacttccccagggaagtaagtcatggaccctctgggcatgtggggtagggaggacaaggctggggccagacagtcctgtgccttcccttagcagccaggccaggagtggtggctcacgcctgtaatcccagcactttgggaggctgaggtgggcggatcacctgaggtcgggagctcgagaccagcctgaccaatatggagaaaccctgtctctactaaaaatacaaaattagctgggcgttgtggcacatgcctgtaatcccagctacccgggaggcggaggttgtggtgagcccagatcgcgccattacactctagcctaggcaacaggagggaaactctgtctcaaaaaaacaaacaaacaaacaaaaaaactagcagtcacacctagcctatctcatccttatcatgcagcctcctacaagggcaggcactcctggggcttggggtggggagaatggagctggctgggagcacctctgtgggtcccatctgacccctgtgccagggtctgggccagccccttggtcttgctaggcccaggactgattgtgtctgatggcatcagcctggcctcgtgggggaaggacaggggctgtgtcccccagcaggacccagacaactgcctgggccaccagacccttgccctgttaactgtctgcgacccagcaatcagcaccccccaccctttttcccttttcttcattttgacagagacacagagaggtggtgacgctttttgttcagtggtgaataaagtgatctaaaaaaaaaattattgtccacaagagactgatcagtacagaactgataataggtgagctcctcccggcagccttccctggggggcctaggaatgcctgcagctgctgtggaatcccatgttgctcccccacacctcacagtggaggtgggactgctggccatctgcccctcgtccctggactgtgggccctgcggcccaggtctcccggcctcttgatagctgtatcccaggaatcggcaccaaggatcggtggggtgggagtggagagcagggcacagctttagagttaggggacctgggcacctaggcagggggcctggctgtgcccatgaacagcaggtggggccaggccagcgggtgggcgtggttaggccctgcagggatcccattcagctggcttagcaggtctcagctgtccccacagctgggtccctggaggagatggtgttgggggctgtgaggggaggctcctcaaacatctggagagtccagatacctctgcactctgaagggcccagagcccccagccacaccagggctcccccaacctcaactgagcctggctagggctgcccttctgcttctcaccccatcactggcatcctgatatttgggacccccagaccctatagagagggtatgttggtcaccccgtgggattcttccttgagcatgggggggccatgaatgaggagggatgcatatccaagcgttgcccacagggagtggtctggaggggctgcctggtcctctggggttcctgatgtcctaggagggtcctccatctgcccgaagcaggcctctcagcccgtggaccctaacctgtcccagaagcctatgggcacccaacctcttgtcttgtgggctccttggaaactcgcccccttcctcccattcaagccaggcccctaggatatggaattgagcccatacgatagcagtgaatctggcgaacgatttctcattttcaccaagtctcctgtattgattattcatcacccacaacagatggggaggcctgaggagttccaccttctccacccctgcctggactcctcctctgccctgtcctcagcttctggagccctggtacactgctccttcattctcaggttcccaggccttgagtgggttgggtttttaaatttttttcttgcagctacaaatcatgaaaacaggtcataaaaccaccttgggtaagtaggtgggatggaaccagtggcctcagagctgctgctggggatcaggaagcccccagtccgtttctttctccctctctccctgcctcccctcagcctccctctctccctttctcttaggaaaaaattccagccaccacctcccagctgggctccctcaggagccacagcagctctggcctacactgtgcccatttcgctgactggggcctcaagcctggggtctgaggaggctttaggcctagtgacctctccctgaggctgcccaggggacagtagttgccttggtgacagtgggtggctggtgaccatcactgcccattagtggacccacccgaggtgggtctggctgcttaaagatgaggacagaataaaaaagtgaggaccctggcctgaggctcaggctgtcacaggctgcagctcagccccttgccccacagcagctttggcttgcatcctgctccaagagactgttcctccaaagtgggagcccctcacgggggctcaggacaggggtgtccacccgtggtccagtcactgccgctgctgctgagggcgtcctgcataggagcttccctgcgggtgggctctgctctggggtcctaagcagggcacttgtcctgaacctcacttttttctgtaaagggggaggagagattaatcaaaccgttgttcaagaaagccgcacagagtaggtgttctgcagccgccttgctcccgcctcagcagtcctatagatttctggagggaaagggctgaggtctttgcctaaaagaagggctgtgccccaggtgtgtgccacactgccgaaggcctgtgagagccgctggccttgcaccgtagggtagctggggtttcgttgtgcccccactatgttcatggcttggagtgaggacacccattgctgtgtcaaggggaatcctgatgccctgggtgctatgtgattccagctcatgctccctgctgtgcctggcctgcctcctctgtccagcgctgagaagactaagttccaggatctgattctaagggtgaagtgttcatgtatctggtgcttagaggatgcactagactccgctcctcctgccttctagtttcagcaagaactttggagataaggcctggaccaagtgtctgagaggagaggcaggttggggagaaacggatggatgggaatgagtggggaccgtccgggcagtgtggttgagctggaccatgaggagtgagcccagtgggtggggggtgccctcccttgtcccctctcaccaccccttctccctccagcccaagccacaggccaaacccacaatctgcctgctaggccacttcttccctgcccccaggttcaaaggtcaccatcgttctgccggggccagggaggggggtgctctttctgccccctcctctcctgaggcctgcccagcccaacccaacccagcccagccctgctgcctgcctcgccttctgtgtcctgtcctagtgctcttgaaaagtaatcataatcataataattaataacaacagagcccatagcaggcctgaggcagcccttaaagaggcagtgcccccttttctcccagcagagctggcagtgggacctggctggcactgagaggcggcctgtgcctttgttcccatccctccctttgccttgggttccagggtggtgttggggcgagcatttttgcctgcattctccatcagcactgggcttctcgtgttttaattgaactgtcttttcttagcaatagatgctttcaccgcatccagctgctcgtgtgtattgggaaacctgcctgtaatacagctcggctaaattaaaagacacagcagctggaccaattaaacagggagggaggaatgcagacggacaggcagggagggggtactggtaatagcaccccctcactgtctctgtctctctttaaataatgtttctggtaatgcattttggagaatgtgaaaaaaaataaaaaataaagccgtagaaatgttaatgatatccacaggacactcagcaggaaatgagagtgatctgggactaataaaagccgaaatgtaatttgtgcagatatacgaggcgcagccttcagagtggtcctgggtttgcacattctgggctcataaacatgcgcctggggagggcagggagcgggcgctgtgccctcggcctgggcacaggcccgcctgggctgccctgtggcagtctggccagggcaggagcgtgaggctgcccacctggcagggagctgccagaccagaaccaagtgccgtccccagctcctctgggttggcgcgtcgcagcaggaacctcctgtaatgttttatccaagctgccaggggtaggattgaagtgggtcagaagggtgggcacgctgcttgttagggatgcctgcgacaaatccagggagaggagctggagcagagggaaagcggctttgataagccggtgggcaggggctcgcctcgtgggaaagtggccggcccccacactgggctgactctcctgcatttgtgggccagggcaagctgactccagagagcaggagaggtggtcccaggactgggctgacgggcttctgggggccatctggctgccctgggcttgccctgctctcaggcagatggaggccctctgtcgccttccctgcatccatccccagacactaaatgaggaaggcacttgtggtggggtccgggccaaggaagaagggtaaatggagcagcacccccagctctcccccactccccacctttctgcctcttccctgtgcccctccccgactctgcgtgcctctccctctctgtgcccctctccccctctctttgtcccttcctgaccccttcaacaacctggaatctttgtagcctgaggcaagccaccccttccttttggagcatttgggaaccagcactggaaagtcccctatcccctcctgggggcctgggccacacaggccgagctgagcccctttcttcctgcctccgggccagcatggttctgggtaaatcccaaaccctctgggactcggccaatggccagcccctccatgcacttcctccaaaacctggggcattcctctttcttccatccctctttgaggggtcttctggttggccaggccagcgagtcagctggaggaacctttaccctggatgctgggctgtcagatgctctgctctgagaggctcccgcaacccaccctgggtcctttcctgacccaggattctgctctgcaggcaggggcaggttagacccctgcctgagccccatcccctaaaatcataaccagatgggctcttgagtgttgcctgccccagccctcacctgctgaggtggggaggaactggccaggaggggacagggctgtgtcgccccatgtgggtggggctgggctgtgcccttccgtggccgtggccctgggactgcatctctactcccattagtatgcactccctcactctgggccacgtaatctgtttatgcacgtatgatatcaaaaacaggaggcaggtgctgccgtcttgcgttcctgggagtcagaggaggggacattttatgtctacagtggcttggcagcccctaatcgatgtctgctagaaggaacagacagattccagatggcgtggcagtgatagaggaggtgtgtgtgtgcatgcgtgtgtgtgtgtgtgcgcgcgtgtgtgtgtgagcatacatatgcttgtgtgcacgcatgtgcgtggggacaggggcagaccctcctcagtccccagcatggctgggtcatgcttgaacacggtcgcgaagggactaaattacaggatccagcaggccccaggggatgagggagcgggaattgctctgctaaatgcttttgagctgtcaggaagggctgggagtgatgggtgggggacattggggaggagctggcaatgggcggggggggggcgggtagctccccagtgacctggcgctgggcagccggttttgcctcccgcatcagtggccgtccttggcaagactcagctgcaggcgatgtgggagcgggaattacagagcacacctccctgacacagaagttgtcaatatgcgcacagctggtggggaggctcaggcgaaggggggactattaagagctgcgcgggggagcaggcagggtggggaggtgggtgggagggtgctttctgaggcaaaaggaagtggcccgtctgaatcgctcatcctctgccccctccctgcccatcctcccctccctccttccctccctccctcccttcctttttcttttcacagataaccagcccgagtcatgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccagggtacccactttcctcagcattcccagtccttccccacctcctccacctactcctcctctgtccagggtggtgggcagggggcccactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctgtggacacccaggctggcaactgcaagccccttcagaaggacaagctccctgagaacctgctgtcggatctcagcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccggaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgagtcctctctgtcacacatgaagccaggtgaagaggggcctgatggggagcgagctccaggggattccaccacctcggacgcctctctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggggcagcccagtgggggtggaagaaggcctggtaaatgtgggcaccgggcagaagctcccaacttctggggctgatccgttatgcagaaatccaaccaacagatccttaaaaggcaaactcatgaacagtaagaaactgtcttctactgactgtttcaaaaccgaggccttcacatccccggaggccctgcagcctggggggactgccctggcgcctaagaagaggagccggaaaggccgggcaggggcccatggactctccaaaggcccgctggagaagcggccctatcttggcccggctctgctcctgactccccgagacagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcacccttcgtgcgggtggagaagcgagacgcgttcaccaccatatgcactgttgtcaactcccctggagatgcgcccaagccccacaggaagccttcctcctctgcctcctcttcctcatcctcgtcctcgttctccttggatgcagccggggcctccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggtcgcaaacatgagtgcagcaaggaggctccggcagagcccggcggggaggcccaggagcactgggtgcatgaggcctgtgccgtgtggaccggcggcgtctacctggtggccgggaagctctttgggctgcaggaggccatgaaggtggccgtggacatggtaagaggccagcccagccagggtggggagtgtggggttccaaaggacaggcaggcaggcagtcggggagccccttgtttctagtgctacagtgtgggccaaatgtgtctgcagtctcgggacaatctgcagagtcctgagcctctctggggtgtgtgggggaagtggaggcacccatctggctaaggcaggtcacactcacctaccctgtcccaggagacttcccgccggggcccgtatgcccagccaccgccactctcccactcacctggcatcttcaggctccagccccacccagaatccactgggcccctccccatgctgtcaccggagatgccaaggcccagagaacacgaggactcccaagattgaacatcagggctgccccgggcggtgcaagagcaagttgcccaccctctgttcctgtctccattgcctctgggatgaagctaagggctcaggaagaccctctctggcgacacaggcttggtgcatggacccagtcacagggttcctccctctgcaggacagtccatggggtcacacagtcacaacaggcagggcggggcagatccagaccctctcaccattggctctgagaccagctttggaagccatagtcactgagcaccaacatgagagagggaactctggggctgtgccgccatgcacctttggggctgtgacctgccctctctgtgcctccgtcccctcgcccctaacgtgggtatgagggtgcccatggaggaggggtcgggagggttaaaaggtgggcacctctgagcccaccgagcacagcagccctgtgatagtcagtgcagaggggcctggtggctctggtgacagcagggtgacgttcttcgtggtgtcaccacttccccagtaccatagagtacctctgtgcccttctgagggaggggtcagtgggggcggtggggtgcacctctcccccggggccatgcttctgcccccacattcaaccccgactccactgcctcatccagacttccgtggagtgacgctcccggctctcagcgctgtgtggtggctctcagtggggacgcctgcagccttctctggcccctgccctgagtcccatcccctccactccttccttcaacccactatgtgcggctgaggtcacaggggagccagaggggcttggcaggggtctccagaggccctggacaaacactgcctgcatctgagtgattcagtgacccagcacagtggccccagccggtggcttcgcccctccccctgcccagcctcctcccccgtcgctgcactgcccacctgctcctcgcagtacacccctgcagcccctctgagcagcccctgctcctgacagttgccgtggcattgcctggccaaaccaaggtcccggtgggggcccactgtgtttgccacccacgcctcctagtgtgtgtcttgggcacctgcttcccactgcccatggggatggctggagaccttctccacgcccagacgccctgcccacctcactccaccctccacctcagaggaaggctggccccgacaggactcctgcaggttcctggtgccgcgggccttgcttacccagcagatggtggccttgggcctcttccctctccccttcccagttagtgattttttgcctctctcctgctttctgtctctctctgtctctctctctctctctctctctctctctctctctctctctctctctcattactggctccttcccagcgccttgaaacaggttcaagtctctcccgtcatcaaaaaataataaccctcagatcaccagccccagctggctgccacctcccctgcttcacagccccattcctgaaagccttgtccccacggcatcctcggtcccgcagcctcaccaggggctccccgacactcacgtcccaccaggctgagatcaggtcgtctccacatcccctgcagccagcactggccggccgaagggaggaggggtcagccccgagcaccgaccaccccatcctgtccctggcccatgggtgtcttaaccgcccatgcacacacaaggtcctgctggactgaggagacagtgtgtgttggagaggcgctagcttccctacaccacgcgggggctggaacttgccagcccagcccatgcctgtctgctgtgccatgctccagaaatggcctgacagcctgcgcaactagggctgccccgggaaggtcggaaccaggaacaccctgccagacagatgggacatcctgggagaatgggcagagtctggggcttcccagggtcacttttggctcaccaccccttcctgcctcagtggcttgggggcgccatgctccttggagtgagaccctggttcaaatcccagctctgccgagggctggttccatagctccaggcgagtcacgcatgctctgagaactccacaatgtcaaaccccgttagcaggattgtggggttctgtggatcatgtgggacctgcctggcatgtggaaggggcttggggtgcagctgtgtccctggccccagcactgccacacccctcggtaccttgacctcacttttgcgctctggagggcagaacctctgagccagctctcagggataccttttttcctcgatggccttttctgggaactgccctcgcctgctatctctgagccctgcctgcccttcccccaaagccatcatagacccctacctcctatccagatggagcctggccatggaatgcttggggtgagagggacccatagcgggctccgggcattgttagggggctaggtggtgtctgcagaggccccacctgtggcagggtttacatgccgccacccctgccctcctcttgggtagctggggtcagaagggcctgaggcctcactctctctgcatcttagtttcttcacatctaaaatgctattcatatgcctgcctgagggtggttggggcctccgtgcagtaagtggagagaagccttcagccagaggacccccatatgcttaaacatccagacaccaagggccactcacagacagcagccggcttgtgtttcgtcatcccttttgggtcaggaactggggacgctggactccagatctccaggaggccatcccagactaggcgggaaggaggcctcagccctgagctgaaaacctgaaattctagaataaaccccaggccccactcccagcatgggcagcggggaggggagtgttctgacatttctcagctgctgtggttgggatggtgcgcccaccctgagcatgtggggtcctgtgggcccctactccagcctggaggcagctgcaggggtcagagaccagcctggagccctcgggcaggttactcagcctcagctctcattggtaacccaggtaaaataacagtaatcccatcataaggttgctgtgggcatgaggcttccagccatgcctggcacataggaagctattgtcgtttgtttcactggcttcgcacttgggcagaggccgccgccctctctgctgccttctctacctcaccccccgcccccagcacggtggcactgtggctctggcgcctggtgacttctccctccccggcctcaggtttgcttcactcttccaagggccttcttggtgtgactgtcctgtcctggccacgtccactccaagcagctggtccaggtgtggggcagcccccaagctcagcagaggacagttttgagacttagaggaggacggcatcagatttacatgaagtcagccatctcaagggattaccacgtcaccgcctcctctcacaggtctgagagctggtcccctggagggtgcaggtctcatcctaggtagaacagtcccagcctagcttcaaagtgctcctgctgccagaaagggtagaaaaccatgctgaatgccttcactgttgcctggaatgggagcctcagtttcaccatctgtaaagtgagattaatgaaagggacccacagagggctgttagagccagtaggcggccaggcgcggtggctcacgcctgtaatcccagcactttgggaggctgaggtgggcggatcacgaggtcaggagatcgagaccatcctggctaacacggagaaaccccgtctctactaaaaatacaaaaaattagcctggcgtggtggcgggcacctgtagtcccagctactggggaggctgaggcaggagaatggcgtgaacccgggaggcggagcttgcagtgagccaagattgtgccactgctctctagcctgggcaacagagcaagactccatctcaaaagcaaaagaaaaaagagccagtaggccaggcgctatgtcttacacctgtaatcccagcactttgggaggcctaggcaggcagatcacctgaggtcgggagttcgagaccagcctggccgacacagtgaaactccgtctctactaaaaatacaaaaattagctgggcatggcagcacatgcctgtaatcccagctactcgggaggctaaggcaggagaatcacttgaacacaggaggcagcggttgccgtgagcggagatcacaccattgcactccagccccggggggacagagtgaaattctgtctcaaaaaaaaaaaaaaaaaaaaaaagcaagccagtgggcaaggacacacaccacgcccagcacaccagaagcatgcagcagatgctggctggtagccacagccatggtagtaactggcatcactggcccaagggggtctccctacccaatgtaccagcccagagggtgctaaatgacccatgtttgtgggcatgtgtaccccagtgctgaacctccttctggtagattttcaagcaccattttggagaagggaggcagggaccacagggggccagccagcctgtacaggttttttgtgttttttttgtttgtttgtttgtttgttttttgaggcagggtctcactcttgcccaggctggagtacaggcagtggcgtcatctcggctcactgcagcctcaacctcccaggctgcagcaatcctcccacctcaccttcctgagtagctgggactacaggcacacaccaccaaccctcactattttttgtagagacagtttcaccatgttgcccaggctggtatcaaactcctggactcaggcgatcctcccaccttggcctcccagagtgctgggattacaggcatgagccactgcacctggcctaccagcctgtaaagcttgagggctgggctccaactggagactcacctgcctttcctttctcttcatcagatgtgttccagctgccaagaagccggggccaccattgggtgctgccacaaaggatgcctccacacctaccactacccgtgtgccagcgatgcaggtacgagcccgcccaggaacaggagggcattggagcccatccaagcagtccagggggaccctccctgggcacagctccccaaacccaggccccatctcactcttcagtttccctcctctcttgccccagcaattcttttatccttctgtctgcctagacctctgctgggcaatgccagggacatggaaatgaggcattccccaggcacctgcttgaggagtgcccagagcagtgagggaagatagaagcataaattacaatgtggaatgctgtctgcggagccatcattgccaaggggcagggaggatctcaggcctcagagagaaaggggtattggaggttgggcctttgaaggataaataggagttcactcagcagagacaaggggaaaggcactactacaacagcaaaaaccaactgagttgggggtgatgaggttcaaaacagactgagacccatggagcaattgtggaagttttgaagcagggtaatggggtatggaggtaggcccaggctccccgcatcctctccccggtccttcctctcactcatgtattcatttgttccgcaagcatttgttgagcccctaccatcactgggcacacagaatgaccgtgcatgggctggagccacccaagagcccttacctttatcgaccaggtggggaaactgaggctcagagacattccttatttcatccagagaaagcaattgcttatggtacaatattagtcattggggacaacaatattttgggagatatggggccaactttggcctggattcaaaccctagtggtggggggtggggtggttttcgttcttgtttgagacagagttttgctctgtcacccaagctagagtgcaggggtgcagtcgtggctcactgcagccttaacctcctgggctcaatcatcctcccacctcagcctcctgagcagctgagaccacagatgtgcgcagccatgctggctcctagtagtgtttttatttttatttatttatttatttatttatttatttatttatttttgagacggagtctcactctgtcaccaggctggagtgcagtggtgcgatcttggctcactgcaacctccgcctcccgagttcaagcgattctcctgcctcagcctctcaagtagctgggactacaggcgtgcaccaccacgctcagctaatttttgtattttttgtagagatggggtttcactgctttggacaggatggtctccatctcttgacctcgtgatccgcccgcctcagctgcctaaagtgctgggattacaggcgtgagccactgtgcccggcccctagtagcgtttttaatgtgtggtcttgagcaagttggttgatacctctgcacacagtttccctacctgtatgatggagatgataatagccccttctctgcagagctgctgggaggagagtgaaataatgaacactacccacacggtgctgcctcagtcctattttgggtccagcctctgtgacctctccccacacggtgctgcctcagtcctattttgggtccagcctctgtgacctctccccgtcaccctcaatccctcccaactctggcctggaaagaggcgaagtcataacccacctcccagtggacagagtccaggcccccccaggctcccgtcgctctcctagcagccccagctactgcctcccgtcctcacctgatgccctgctggctttgcctggacaggggaccacagcctgtaccccacctgcctggtgggtccccagccagtgtcagcccagccaagctgccccagggaggacacagaggactctgagtgctgacagttgcttggcaggggctgagctgccgggacccagcggggaaggggcttgctggagcagggacgtggaggattctcactggcttcacgctcccactctgagcagtgtgagccagagtttaacatggaccctgccacttgcccaggcatgtggccgcactccccataatagctgccacgagtcacattcctccttccacagtgattaacttagcgcccgctccactcccagccctgctacagaaccatgttgtttccagccatcttcacagattggctgcctcacccacagcacacagcatggcgtggacagtcccaggacttaatgccttggctttcttgctccatgtcctatgttctttctcctaccccagcactgcccagccccccaaggggctcacccttgagtgggacggacagcaaaactgtggttcttggccacagttagggagaccagacgggaaggagagagtatgcactgtggaagaggttcatcctgtctgaacaagggagaaatctaggaagacttccaggaggaggtgacatttaagccaggcctcaaaagatcgggggagctttgtagcaactgtttagtggtgggacttgtatactaggctttgagcaagagaacttttatttcagataaaatcctagaaggattcctcatataacagggatccctgtagcaccgtgaagattgaggcaggaaagggactgggaatgctgcaaatggagacatacacctcagagactgagttggcacagaatccatgggacttgatgatgagggagagggaggtgacaagcctgatgcccagcttccccatgaaggggagaagtagggtgtggacgtgcaaatggagtattagctgctgctgcagagctactggcccttccaggcccagcttcatgtctccagcaccagcccttcattagttctcaaaagggcgtgagttggctgcaggctctgctgggagcaggatgatctagggtggccccagctgtgccagcttgtctttgctccatcaatctctcatcctccagcaggctggcctgggtgcgtcctcatggcagccccagggctttgagagagtggaggtcacagggccactcacagcctaggtcctggactttaccacgttctgttagccaaagcaggtcccaagtccagcacagagaagtgcaggccacctggggtgagctgcagagccacaccacaaaggacctgggtgcggggaggggactgggctgctctgccaggccatctacacacacggcagttccctttggccacacggcagtagaggcagctgtggacatacaaagtgtagatagctgggctcaggatcgagtctcgcccaccatcagcaggcgagggctcatcagagccctggaagggacaaaatagcagggttgtgttcaccatggaacagctggctgaggaggagggtggacccctgggaaactgaggaacagctgccagagaaggcgagggagaacaagtgagctcgagagtgaaggcggggaggacgggcgcttggggtgcagggagggcccccagcgtgactctgccagccaggcggtggggggggcgggggggtgggagtgagagggcactgagggagtgggctggtcaggctgatctgatgtctggccagggaggagccccaggcctctgtgtcaggcactgggactgcagggcaccagggctgcccactggctgccagcctctgccctgcactgcgctgtcctggcctactcatcctgcccccttccaattcttgttaaggaacccactttggagacaagcagtgactgaagagcaggcagaggctgctacaccacagtgtcctgtctcaacctttccccactcaggccctggggccaacctgtcagtgagtgcccaggttccccaggtgcaggcaccaggtcaggagccagatcactgaggactggccttgcccagtgactcccgccccgtgccccatgtggggtggtgctggggcagtgctgagggagccagtttggaagtggcgacctcctaccctcaacttcccttggtgggagtgcccgcagctacccaggcgtgccaggggcaggcctgggattttagcctagtgtctttggaatatctagttcagccccagaaccacatctggcttgcctgagccaagggaaggggaacagccgtggcacatctctagctgctggccctgaatggcagtttccaggtccgtggcactccagcttctggagacaagggcagatcgcctcagagaggcctgctaccacccagccctgccctcagggctgcagagctgtccctgccctgccttctggccaccaccctgtcatgatgccattgcacagagccacctccagtgtgaacaggaagattgtgttggagagagcaccagcctccagctacttttgggtctggggtttgttcagaacagtggctggtgaggctttgggggaggggagccgagaaggggactagagactggggggtccctgggggaaaagccagcttctccctaggtggcagtaggcaggggagtggagactccctgagatagcaacacctcctgggcctaggtgggcataagcactggccatgcttggttgtcctctctgcccctgcctcctgcgcccactgcatgccacacatgtgcagggtggtttatttttaaattttattttattttatattttattttattattttattttattttattttattttattattttattttattttattttattttattttattttattttatttcatctcagacagggcctggctgtgttgcccaggcaggggtgcagtggtacaatcacagctcactgcaacctccgcctcccaggctcaagtgatcctcccgccccagcctctcgagtagctgggactacaggcatgcgccaccatgctggctaatttttgtatttttgatagagatgaggttttgccatgttgcccaggctggtcttgaactcctgggctcaagcgattcattcacctcatcctcccaaagtgctgggattacagacatgagccactgctgctgccaagatggtttctatacactcccatcctcaatctccatgataggcatacagtaggtggcataatgcccattttacagatgtggagactgaggctcagagaagtagcagatgctcaaatccaggcttgcaacaccactaccagtccgtccacaggggttcatgacatgctcactggaagttagtgagctcttccaggggctgggcatacatccagggaagaagacagagctggtgccctctgggagcttgcctgccagtggggaagaaacaaggagcaagacaagatcacacaggccagtctcttaggaggcagtgacaagtgtggctggcagagtaaggcgggagggagggagggactgagggactgcctcaagtgaggaggggcggcacgtggaactcagggggaaaagctctccgcggaggaggtgaggtgagtcaagactgccaggccaggggccgcacccgcgccgtggagtggagtggagtgtggagggttttgtgcagaatctgattaactctttgaaaagagcccctgcagtctggagcctcgcgggcagtgcggctcccctcctggctgcagacaaaaccccacagctgtggggcccccaccctgtcctaaccaccgaaacttctctttggtcacaggttgcatattcatcgaagagaacttttctttgaaatgtcccaaacataaggtaggggaccacagtgttttgtagggcgaggggtgtcaagcgggagaggagccccacctcgcacctccttcacagtcccctgggcccccttggctgcgcagccccgcagggcccagccctaggggagggagctctccccgcccacccccaggagcccccgccgccgtccagctcaggtccctgtccacttgcgcgccgccgccgccgaaaacccgcaggcgtcggggcatgggcagccaggggctggagggcgtccctgggacggcctccctgcagctccccaagataggtgacagagtggggcaggcgggggcgcgggacggtggcacggagctgaaggcgaaggtgaaggtgaagctggacggggtggggccagaaggggtggtgccgacggcctcgggcggagaccccagccgcgctctggggtcgcctgggtctggggcttaggcggggggcccacactgggggcggggcctatggactgtgaagtccgaggtcgtcggtaactggcgggcgggcgtcttttgcagaggctgccgtagtaatccaccccaacggccggaggagccgccggagcccgcctgcccgcccgccgccgaaggagaggagccgcctgcgcagcccccgggcctttgagctgctcccagcgctggtccagagccgatccttgatccgggtcccggatcgtggatccggccgcctagggctcagacttgcggccccgggttgggaggaaaacccgttccggagccgcctgctcccggaaccggacggcacagggcgttcttgcccaccccaggggccaggcttgcggagggggagcccgcggagcggccagactccccggggcgctcagcctccggcgagggtgggagacggctttgtcctggggacactttccctctggaatctcaagacgacgtggcacacattccacgtgggtgctgccgccaccccagtcggtcgtggcgtgcagctgggagccctgggcttgggggtgggggtcgaaacagtactggaagaggcggagggcggctcctagctccgtggactaggcgggggagaaaggaagcctttctgagagcgggctaggccggcactggagaggccggagcctttggaacaaaccgtgcggaacgcgtccaggggccttcccgcccagcctttgccagatctctcgtgcggttcgggcaaagccggggtagacctgggctatgctcagttaggggttgcgggatccccgagtgtgggcgggactgggacaccctttggcctctgtttgtcccctttccagtcctccaccccacccctggagcccagcctgggagcgcaaaacccaagaagcggccagaacgcacctccggctccggcggacgcgcgaccgttgtgcaccaccagggaccgccgcgcctactctgcacgggagcagggacagcgctagatttcgtgtacaaaacctgtgtacccctctatatatatgttacatagaatgtatatatgttgggaacatgctcgcttctcccgtgtgtcgccgccgtgcgtcgtgcgcccgcaacagagccccaaccgggcctttgccgggtaaggggctaccgcgacgccacttgtccacgcagccaccaccggcccgggccagtccctgccagtccgtccgcctgtccgtccgtgtcctcagctctgtccacgcttcgataggcctgacgcagcccccagcccagggccgccctagcaacttcctgtacatatgactgtaaaatggtaaacgtgtgtattatatctggcctcgttatatagtgtatatatatgtatacatatacatatatataatatatatgaagactgtaaatgttaagacgactagtgttcttattagtatattgcttcacactgaagattgtgtgtatcgagctgtttctaaaagatgtttattttccttaagagtaaaaaacagtcattgcattcagaaaaaaaaaaaaaaaaaagtcaataaagatacaacgattgttttggaa

SEQ ID NO: 6286 - DNA, 413663 bp, Homo sapiens
gtgcagcattccttttcgaacagtgcccattctcttgatgtctacagtatcacctttcttgtagattggcacttatgcggccaaaggaacaacaccatgttttctaaaaggctggagaaaatagcacaggtgcctctcctctttcccttcatcttcatcattttgacaaattactcaaagatggagggtgcagttgaaagccagccatcattttttaaaacttctcaggacattgtaacatgcacttgggttgagaactgctactcgagcttctccaggaggcccttggaggtaggaaccagcatttgggctactttagcatcttagtagaaactgaaaccaaaaatgatctcccatggccaccatggccaaacataacggtagtttctagctctctaacctctctccctgacatctccacagcacttggcctgccctcttgagagtcttttctttttttctttttcttttctttttttttttttgagacagggcctcactctgtctcacaggctggagtgcaatggcacattcttggctcactgcagcctctgcctcccgggttctagcaattctcatgcctcagcctcccaagtagctgagattacaggcatgcaccacaatgcccggctaacttctgtatttttagtagagacagggttttgccatgttggttgggctggcctcgaattcctgacttcaagtgatctgtccatctcggcctcccaaagtgctgggattacaggcatgagccaccacgcatggccctgccttcttgagattcttgctgagactgtacaaggcgttgactcttgtctaatcttttgcactgctcctctgtctcctttcccatcaacattctaaagttggctgcttctcagtattcataatccatggttcctctttctctccaagaactctgccagcatgtacatttataaaaccacatctccagccctaaccactctcatgtgttttttctctaatacacctccatttggatgtcatgctggcatctcaaattcaatatatctaaaaaggaactcataatttctgcataaaacagcacccccttacgacttcctttatcaatctagctgccattttcaggatcatttttggttcttccttcaacagtctatttccagtgttcagttggacttttctgtgcaatatcacttctacgtaattaacatctttcaagttcagatcctaacaatttcctgtctagattattgaatcagcctcttgctcaatatccctcactttgttactccctaccacaaggtcataaatacaccattgtcagtttaatataggataaaattgcaatcatgtgactcacaacttattgctcaaaacccatcaccaaagtacaaagcccgtggcatccaatgcccttcagtatggcccaaactatctttctgaccatgcttgcacctattcctccacactagatgggatgttttttctttttgaaatggaaagaacataaactttgaatcagacagatttggttttaaattccctgctacttctaacttggataagtttctaaaacaacatgagcctcagttttcacaactaaaaaaacagaaacaaatatgtaaaatattataaattagtaaaagaaaaaaggtgaataaaacagagacattaatagctaatagaactgtttcatataaattctagtttttttttttgtttttgtttttgttttttttgagacggagtctcactctgttgccccaggctggagtgcagtggcacaatcttggctcactgcaacctccacctcctgggctcaagccattctcctgtctcagcctcccatgtagctgggattacaggcccctgccaccacgcgtggctaatttttgtatttttagtagagacggggtttcatcatgttggccaggctggtcttgaactcctgacctcaggtgacccgcccgccttggcctccccaagttctgggattacaggtgtgagccactgcgcccagcctaaattatagtattatgttttttgttagatcctaaacttccctgctgcacctggacttcgttgttgttgttgttgttgttgttgttgttgttttgtgccttttttgttttggtttggtttttagcctttgtatacagctgtttctcctggctatgctctatatcaagggttgacaaactatagcccacagacctactttgggcttaaccgagacatacctattcatttaagtattgtcattaagtatgctacaacagcaaaggtgaattattgtgacagagaccatatggcctgcaatgcttaaaaaatttgctatctggccctttacagaaaaagtttgcccacccctgctctagcctctctttctttactcatgctatagtatctccccaggtattctgggtttaaaatatgtccacaaatcctccaacaaaactaacttcaaaaggtggagcccccatccccttgaatataggctggaattcgtgacttgcttgcaacaaataggacatggcagaggtgtcagtgtgtgacttcttaaactaggtcataaagggcactgtggcttccactttgctctttttagatcactaattctggaagaagccaacccccatatcataaagacactcaagcagactgtggcgagtcccacatggagagaagctgaggcctcctgccaacagccagcaccaacttgccaggcatgtgggagccaccttagaagctgatactgcaggcttggtcaatcctttagaggaacttgctgacttgcaggcccagtccacatcttggctcaaacctcagaacagaccgtaagccagaactatctggctaagccacattccaaatacccaacccatagaaactgtgaggataataaatacttaatgttgttttaagccactaagcttcaggttaatttcttatacagcaattgataactaatacataagaaaaccttcatttaccatccactgaccaaagactcaaatatacaaccacagcctggacctctcctatgacctcataccttcatatataactacctattccacatctgttcctagagatctcaaaggcatctaaaacccaacatgtgtgagactttggtctctttccctcagacaggatcttcctccaatattccctatcccagttaatggcataatgagcttaatccataaactacaactctggccttctgtgatacttctttgtccttcacaccctatattcaatccattatcaatttcagccaaattaactaatatgtagtttttaaatcaggatgttaccctccagcagtactatagagatgctctttcattgtctctggcatctgctgatcatgagaagtcttctgtaagagcatcattctttgaaggtaatctatctttccttctgatagcctttgatgttttctgaataaccttgagcctaaacctgggtttgcttttattcatcctacctaagacttggtgtgatctttacaatctgaagacatatagctcttcaactctcaaaaaactccatcgtctccctgaatattgccttttgattcttgtctctattccctgtataacagttagggtccagtcagacacaccagttatgttagtagacaaaaattaacctaaagaactgttggccgggcgcggtggttcatgcctgtaatcccagcactttgggaggccgaggcgagtgaatcacgaggtcaggagatggagaccgtcctggctaacatggtgaaaccccgtctctactaaaaatacaaaaaattagcaggatgtggttgcaggcgcctgtagtcccagctagtcgggaggctgaggcaggagaatggcctgaacccgggaggcggagcttgcagcaagccgagatcgtgccactgcactccagcctgggccacagagcgagactacgtttcaaaacaaaacaaaacaaaaacaacaacaacaacaaaaagaactgttaatcagggcaaaaagagggcattgaggcatggaaggaactgcagaaggatgctaccccactagggttaagggactaaaaggatgagattagaattactaacatttagaaacttggaggaagggccctgcagaattggaattaatacctttgagcagagtctgctggcctgttggtactagcgtttctgagggatgcaacgaggttggttatgcaagttttggaacaactgcaaatcgaaataactgctgctaccaggatgaattccactaccaagacaggcattaaacatcattcctaaggcactcacctactctcagaactcaatagactgaatcttcaacttgcaacaatggctttgtttttgacatgcgtcaatttcccttttgctttccagctcagctatatattttaagtgtgtctatgtatttgcagcagatagaagtgattcctttcaccagcttagtcatttgtcaagagtttctgtgcacttgtcttcatccctgtagggcattaccctaacccaaaacattatcatttcttccccagactaccagtaccatcttctaacttgtctacctgccttcattctaacatgtccaccatcttttctccaccctgcagcaaatgttttgtaaacaccaatctaagaacattatctcttggacgggcatggtggctcacacctgtaatcccagcactttgggaggccaaggtaggtggatcacctgaggtcaggtgttcaagacagcctggccaacatgatgaaatcctgtctctactaaaaacacagaaattagctgggtatggtggcatgtgcctgtagtcccaactactcaagaggctgaggcaggagaattgcttgaacccaggaggcagaggttgcagtgagtcgagatcatgccactgcactgcaacctgggtgacagagtgagattctatttcaaaaaaaaaaaaaaaacccattgctcttacaataaagataaacatgttgcatatgtccaacaaggccttgtatgtactgacccagtgccatcttgcattgtgctccttcttttctgtgtttcctggccactctggcctcctttgctattttcaaataggacaaagcctttgcatatgctgatgctcctatctgcatcagtcctcttcccaattctgtccatttaatcaccactcatcctacagaaaacaagtcaaattcctccaagaagccttccttgccatcaaactaggtcagcactctatttatatggtctcatagtcttagatttcttttacacactgtgttatggattatttggtaaagcctcctctttggggttataaactccaaaagaaaagaggcatagcatgctatgctcctagcaagagtttctgccacacaataaacatttaatagctctttatagaatgaataaatgagccatattgaatgttgattaaatttcaacaagctttccagaaatcagcctataatgattatccctttcagtggacttctgacacttgtaattcatctgacatatttcctttcttttctgccatgggcttggtagtctcagttagcatatcattgattaaggtcaggggcctttatgttatttttgaattcccagtgtctagcacagtgccattgaaatagtatgcaatcaacacatttttatttttcatgataatgattaagaacttagtgccattatagttaatgtagtaaaattttgtgaattcaataatgcccctaagtagtatacaactttgaaagcacgctcttctcaagtaattaaatgttataattatctaacacattattattctatataaaatttcagagatgttagttcattattttcagccctttatattttaaattaatgatatagtaatttttaaaaaacaaacctttgctttactttagctgaagacacaaatgtcttcagatggtgctcaaaatggtttaaattacacagatgaggtaaacatacagtgaaatcttagaaaggccccaaagaattccctacgaatgatacatgagccaagggcatgacattcaccttggaggatctttctccctttgaataagtttgataaaatgcctttttttttccactttgaccttaagcacttagaaatcatttgttttacaaaagccccgtggtccaagattatagcaaccagaatagtgatgtctgtcttacatttcaattgtgcatggttcaagactttagtttaagagagtgattttacataaaagtttttagatagatttcactcctgtgcctttgttggtctcttctgtacttctacgaagaacagctttgtagtttctacgctggcttcaagcacaatactatagctccacaaccttgtccaactgttagaatcatccagttttatagcagctgcacacaggcgttcactcacccgggttctgagtttcagcaatcttcttatctttgccatttttatgaaataagtttgttgtattttagcacccaagccccatagtatcttataccttactttcaggaagaggctgtcaaacatctcctggtattatgtttatgatctttgccaccaggtttttaggcttgttggagcatgatttacactgcagacctccctaaatttagttaactttcattcgtcatcaccatccagatattttaatttggtatatccaggaggcataatagccaatgctttgccagagagctataaatattggtatgaattttacatttccacttgacagtaggagtgtctcaattgatagtgatcttaggacttcttgtcagcataccaaatatatcaacaggccttgtcatgaattttccagacatttgtagaatcatgaaagtttttttcacattgaaataagaaagtatcacacacacaaaatattattttttataagattgttatgtaaaatataagattgtgaattttgcattgcatacaatatttattacatgggaactttgtgcatttatgaaattatttactacttatttataaatgtataaagaaatatttagcaacaattgtgttctcaattcttttgaagtctgtcgacttatgtctatttttctagaggattattccttgtttctgtctagtctggcattttactacatatgcactcttttcatagaactagtgatgtccgtttgtcagcctcaaatgcatacaaattgctatcttaaaccagatgagtgtttttgcaaaacaaagacatacaaaataatggttcttttgtagaaattgatcgaaatattttaaagcttccttcaagggtgtgaagttttggttaattctggcctagaaaaatattttgcacatcaacctagggcatgatcatacttattttatataacatcatgcctacagaatgtgttttccaatgaccatcactaatggacattatctggtattttaatttttttccaaggcttttctgtgtataatgaaagacaggaggcccactaaacacaacatttaaaaataagttaactctatattagtgaaaaaaagattattaaaaagattaagtggtacatcaattaaaaaactttttaaaaagtttttttaaaaagaattaaattctgtcaaattcagcctgaaatttgaacacagaaataagaacagcaggattttcattggaagatgcatcattgtgatgttagtggccaaaccagatgccaggaaagcagtgcctctctcaaattcccatatgtacacatgagagttcagccttccttcttaatgtcatccagttcctagagaagttttgctagtgttccttctgaatatacggggcaagagaggaagtcaaggtcactatcaccaccaagtcctgaagccaggtagttgtcagccttgaaatgatcctcattaaaaactagtggcttgaatgtcctctatgaagctgttctttgtttgtttgtttgttttttagacagtctcgctctgtcgcacaggctggagtgcagtggcgcgatcatggctcactgcaagctccgcctcccgggttcacgccattcttctccctcagtctcccgagtagctgggactacaggcgcctgccaccacgccctgctaattttttgtatttttagtagagacagggtttcaccgtgttggccaggatggtatcgatctcctaacctcgtgatccgcccgcctcggcctcccaaagtgctgggattacaggcgtgagccactgcacccggccttgttttgttttttgagatggagtctcactctgtcacccaggctggaatgcagtggcatgatctcggctcactgcaactgccacctcctgggttcaagcaattgtcctgcctcagccttccgagtagctgggattacaggcacctgccaccactcccagcaaatttttgtattttcagtaaagacgggggtttcaccatgttgggcaggctggtctcgaactcctgacctcaagtgatccacccgccttggcctcccaaagtgctgagattacaggtgtgagccactgcgcccagcctatgaagcctttcttgactcttctgaatacacgtggccactgtcttcctgcattgccattgtaccctgtggaagccattattgggacatctatgagactttttttcatgtatgtatatattggtctgtttcctctactgcaccataatgcctgcattcccaggaattctatggcttttctctctatcactccacacaatatctagcactcagtcaatgctcaatatgtttgttgacaaaaacattcttctggacatgttcatagaatgaacacacagccttcagcagcagtacactcagcaagtaactgtgaaaagggagccattggagttaccaaattagaaccactcattttgagcaaaaaatctctgactcaatttgaggcagggctgcaaaagttgaacagcaacattaaccattcacccagcacctcaagccttcacactgtaatcacatcgattagctgaacattggcaccaaagaaagggtcagtatattttttgttcaagcttttgtccatatacagaagctggtgcccgattatttcagtgtttagtgattttaattttctgtgaaatttgcctacacaatttgtgcttctcccagtttatgtgctctgtactgtcaaatatgatacagtcagaaagcacattcctttatcattttcctcttacaaaaaagaaaactggaaaaattatattatttgcctttaagtggaaagacatttcattttccagatggatgctggtacttcaggaaatattagagatatcttgttgaaatttttagaagtgatcctgttatcgtaccttttacactcctggtcaagctgtcatcactaccaaagcatttccataactacctacatatgcccatttctttgagaaagaagaaacagagtgatgctaactttcctgaagtttcatacacgtttgaatttttatatgtcaagtctcagattgtcaaaaattgaagcatggaagtttgctcctggaacaccaaacatatataaaattccacctgtgatgtcctcaactttttaacagctctaactacttcaccaacctctaggaactttttttcaacaggatatagtattcacagacaagaaatgaaggcgagattgtttctagataaatttagctggggaatatggaaaatatgatctaataaaggaaacctccaggtaagttcaagatagtgaatatatgggaattggaaaaccgattgcccagattcttcctttaagtagtggttgtgataaaatacattttgatttctatttctaatgaaaatgtgaaacagacatctatttttccatcccaactgggcttcctccaaatatgctgccttctccctaatgagttggaatagtgtgcaccataaaatagtacaacacatcctgaaatgctgacatttcatttttaattgaaatcaaatagaaatagttccactgggaaacaagaaagtaaagcaggcttttgatagaaattaataggaaagggacggaaatactattctctgtcataaagtagtccactatggaaggctgccagtccacttgcctgaatctgagtttatctccaggattacattcagtgaaaagaacacatcttatgaaggtggaacgagaaatcgtatttggatggatatatcaaaggaaagaaataaaaaatacttcctttcttctattttttaaaaatcataggaatgtagaggtcaaggaaaactgttgaattttactgcaaaaacaatgatagcaaaacaaaagacttcatatcatcaacaaaaatatttacaaaaatatatcagaaaatacattctttgggaggtaaaataaacttacattgctgggactaaaattctctcatcggtgggacaactttcttttaaaaacagttttatggcaatacttttaacagtggtacttttaagagttgtagcttggctgggcacagtggctcacgcttgcaatcccagcactttgggaggccaaggcgggtggaccacaaggtcaggaaatcgagaccatcctggccaatatggtgaaaccccgtctctactaaacatacaaaaattagctgggcatggtggtgtgcgcctgtagtcccagctactcaggaggctgaggcaggaggatcacttgaacccaggaggcagaggttgcagtgagccgagatcaggccactgcactccagcctgggcgacaaagcaagttcccatctcaaaaaaaaaaaaaaaagttgtagcttgagcagcaacaataacattaataaagattaacatttgtataactgtatatggattatgaaatatttgtataagatttttaataattgatactccaaactattatgaaaattcctcaactttcaaaaaacaattctttattctctaaaataccagactttgaatatagaaagccatgatttttatgaaaatatttatctctatggtcataatttctagaaacaatctgtagtactttgtaccaaaaaaaagtcggctatttttataggagtcattccaagacattattgagtgaggactggtactaggatgaggaagggtcaggcatttgacactgaagagtttgtggcatgttgcagagaggtacttaaaaagataaatgccaaaatggtacgattaatacctactatacctgacatagggacaaagtgctttttagatggctatctcaaggagttgggtagtaaatgaaacgaaggatgtaagaacatagctagagggagagctgcctggagaaagggttggtttgttttcagaatgtagaaacttgcacaggttgacaagtggagtcaaagaagagaaggaaagtttgagcttcaggagaaaaaagggataagcgatggatacatatggctattctttttttttttttttttaatctgggtctttccacaacttctccctggtgactttgactgatttcttgggctagctcagacataagaattcatgtttattaaaactgatcaaaataatatgtgatatgttttaaggactgaagcccagatgttcctactcttccagaacacttgaacatgcactgacttcctgagggccaccaggcatttagggagatgcccagtgagaggaaggcagccttgtgtcccttataatgagacccttctctgaaattattaaataatctaccttgcagtaaaaactgctgattcttcgtggaggtctcttcaaatacaatgatctgtgaaaattctgcctacagaattttaagaaaaaccaagagtaccaattaactaaaaaatttatataaaattaatgatgaaaacaatgaccattaacaaacacaaaaataaaaacccctttattgctcactctatctaatactaaaacttcacaaaattaatgtctaagttacctgatgaaagcaatttaataaatcctttggataattctaataaaaataagaaatgtattatctcattctcaaatttgccacaattaaagagaaactctcttttgaattgggaggtttctctctaaagaattttcctcttctaataaaggatattgcaatatcctctgaatagatgtttaaaatctctctcataagttctggaaatctctctcattgaaatagtcccagcttgacagccctgcaataaccattaaatattaaaataacattaaaaagcaactgctcagctcatggatctagctgcaaaactccaattcacactaatgggactcacatagctaaatccccatgtgctgtaccgaaaatttatgcccaaggatccaaggatcaggcgtgttaaagaaaatgatggattcactttcaaaaaaaaatatcgatccactaccaaacaaattatcattattcatgcaatttcagtcacataattattctaaaaaccagactgtctaagattaaacagcatccaattttgcattcacatagtattcatttgtgatgtaataaaattcatacttccattgcaagatgatttgaatgttgtaaaaacatatatacagtttaaaaaatgtgtcttatttacaaacatatcctaaagccaaaatctaattctagatacattttctgtttattatttctgtagacactacgatcataatgctaaagctttaagaactatttttgttgttcttgaggtatgttaaatataaaagggaaaaagaaagtataaataactaatagtgttaatatttaaagttgtgtggtgatctaaacttctcaaagaatttctttaaagaaattatagaaattttgacatagtgaccacacattattataatcatccatggtaactatccaagaagttacacactattaaaaaacaaaagacagtgtgtttaatggaaagtatttcagaccaaaatttaacttactcaaattccaaactaagacaagtcacttaaatttccaaattcacaattttattagctataaaatgagtgagatggacttgggaatctcttgtctgccactctatggttttctgttgtaataactaatttggtttacattgtgtctggttagattttcccatttcccccactcccaccatctccacaacacacacacacacacacacacagagtggagaaagaagtttttaaatctgatagagaactctcgtgcaaatgcatgtataatattctgtgaaattcctatttgtcaatcaaagtatttgccggaactgaaagaggcctagagaatgagaaagagaggtaacattgttgtgtggaaagagcatctggatggaaaatctggagacccagtttcatcagcaaccaactttatgactttgggcggatcacttgctttctctaaattgcaatttcattcaaagcaggaattagataagatagtcactaagtgcatgtccaactctgaaaatggatgcctacaattagaatatcactattatgataaactaaacaaagcagttacttttttttttttttttttttttaagattgagtctcgctctgttgccaggctgaagtgcagtgatgtgatctcggctcactgcaacctctgcctcgggttcaagcgactctcctgcgtcagcctcccgagtagctgggaccacgggcatacaccaccacgcccagctaattttttgtattttagtagagacggggtttcaccctgttgggcaggatggtctcgatctcctgacctcgtgatctgcccaccttggcctcccaaagtgctgggattacaggcatggtccaccactcccggccacagttactcttaagtctacataaaagaaaagaagagggtgtgtgtgtgagtgcgtgtgtgtgtgtgtgtgtgtgtaatcttgaaggatgagggctaaggataaagtgaatgtagaccattttggacattaaataatagtgtgtatatatatattatatatacagtgtatatatattatatatagtgtatatataatatatagtgtatataatatatatagtgtatatataatatatagtgtatatataatatataatatatagtgtatatataatatatatagtgtatatatagtatatagtgtatatataatatatagtgtatatataatatataatgtatatattatatatagtgtatatataatataatacatacattgtatatagtgtatatatattatataatataatatataatataacatataatatataatatatattatattatatattatatgttataattataattataaatacaattgtataattataaatataattatatattatataatatatattatataatataatatataatgtatattatataatgtatattatataatgtatattatataatatatatattatatataatattatataatgtacataatatataatataatatatatattatataatattatataatgtacataatatataatataatatatatattatataatattatataatatatatataatgtacattatataatatatattatatttttatatatattatatattatatatattatatatatatttttatatattatatataatatatatatcaggcagtaccccatataccaggcagtaccccataagtttaaagaaagtatcttttttattacttaaaaagaaaaagatatgttaaatattttctaatctttttgagcatttactgtgcattaggcctgaatctaatagcactgcagatactatttcatttattcctcactatgaaccctatgaggagttgctataattatccccattttctagatgaaaaaatgaaggcctagagacctgtgtcccacagctagtgtaactatatgaagaaatgtaagatagagtctgggttatgttccataaagagtcgtaaccttttagaatcaacattatagataactaagctctgatttctttatttttataaggatttctggtattactaccagatcacaatagctgattgtgcatactattggcccactctatcaacaataatatttttctttcagccactacaaaagtggtattataattttctaaggaaaatcacattgtctggtacataaatgtttgttgcaagaaggaaagaaaccctgttcccaaccaagatgaagagtatggactggatttatccagccacctgcaagaaccaaaaaaaaaaaaaagaactggacaaaatatatgagataataatttcactttgctgggcaatggacgacaaagaatactgatcattaaaagataagaaacaagcaaggggagtcctatgattgcccagcctaatagcttaaggcagtttcagatctgcagtgcaggaagataaaacctaagcagaactcagtaggctctctgagttgagacagagttgaaagtggggaagaccaaagccacctgagttcgtagaacagagaatcagaccaaaaggtatttagcaaagtactgaggaacacatgtaatgaaacaacctatggtccaggaatgaaccatttgaaaggattagaaggaacattactcagtactctcacaagaccaggaatagtgtctataaccaccagccagtctaaagaaacctcataatttagaggacgatgggcagagtattcataagggtcttgcattgttagtcggaaatattagctctcaattaagcacagatttggtcccacttaacaaattttaaaagttaggtccttgtattagaacatttcacactgctataaagaactgcccaagactgggtgacttataaaggaaagaagtttaattgactcatagttcagcatggctggggaggcctcaggaaccctacaatcatggtggaaggtgaaggggaagcaaagcaccttcttcacaaggtggcaggaagaagaatgaatgcaggaagaactaccaaacatttataaaatgattagatctcatgagaactcactcactgtcacgagaacagcatggaggaaaccacccccacagttcaattgctttcacctggtctctcccttggcacgtggggattatggggattacaattcaaggtgagatttgggtggggacacaaagcctaaccatatgaatcctccaggatcaaacagtttccaaatgatgtaaccacactccagggaaggaaaaaagcttaagaaggtctataggtatacaaaaacatccagcacccagctaagtaaaattcaagatgcctgaaatggaaacaaacatgactgggtatgtcaaaaaggaagaaaatataacaagtaattaggaatgaaaaaaattaagtaattgaaactgattcagaagtgacatagatgatagaattataatacaaggacattaaggcactttttaaaactatatcccatttcttctaaaagttaggcaaagacatagaagggatatgtatatattttcaaagaaccaaatcaaacttttagagctgaaaacaacaatgtctgaaattaatggtagattagacattgtaaaagaaaagatttatgaacttgaatatactgaaatagaaactatccaaaatagagcatacaaagacagaataaaagccacaaattaccagtatcaggaataagagaatgacagcactacgtattccataaatattaaaaggaaaataagctaatatgattagcaattttgtgccaataattttggcaagttagaggaaatgggttaggatttctcaaaagttacaaatgaccaatgcttcctaagaagaaatagataagatgatctgaacacccctgtatatattaaagaaagagcatttgtactttaaaacctccttaatctcaccaccaaaacaaacaaacaaacaaacaaacataaaacaacccaaaacaaaacccaaaaccacaggaccacaaatccagatagctttgctagtgaattctactaaacatttaaatgatataggaaggaataaccttaatctcattctatgaatccagcactgctctgataccaaaaccagacaaagacattacaagaaaaaaaaagaacaaactaagcccaaaattagcagaaggaagaaaaccttaaagattagaccagaaataaacaaaataaagaatagaggtcaggcaaggcaactcacacctgtaaacccagcactttaggaagttgaggcaggaggatagcctgagcccaggagtctgagaccagcttgggcaacatggcaagactctgtctctacaaaaaaaaaaaaaaattaattagccagccatggtgtcatgtgcctgtggtcccagttagttatgacgctgaggtgggaagatcacttcagcctaggaggtcaaggctgcaatgagctgtgctcatgccactgcactttatcctgggtcatagagggagaacctgtctcaaaaaaacaaacaaaaaaaaaagagaaaagaaaaattgtagaaaaataccaatgaaattgagttgatgttttaaaaagataaaattgacaaacccttagatagactaacaaaaaagagagaaaactcaaataaagtcagaaattaaagaggaaacattacaactgatacaaagagataagaaaaatcataaaagacaattatgaacaagtatatatcaacaaattggataatctttaagaaatggatagattcttagaaatgtaaagatcacacactaagaccaaatgagatttatccctgggatgcaaggatggctcaacatatgtaaatcaattaatgtgatagatcacactaagaatgatgaattttaaaatcacatcatcatttcaatagatgaagaagaagtatttgatgaaattcaaaacttttgtaatataatgaacgctataattatactctcaaaaagctaagtatagaaggaatttgccacaacataataaaggccacatatgacaagcccatagctaacattgtactcaatggcgaataactgaaaacttttcctctaagattaggactaagaaaggatgcccactcttaccagttctattcaacacggtactggaagttctagacaaagcaattatacaagagcaggaaataaaaggcatccaagctggaaaggaagaagtaaaattttttctggtttcagatgatatgatcttacatgtagaaaactctaaagactacacacacacacacacacacacacacacacacacacacagttagaattaatgaattcactaaagtttcaggatacaaaagcagcattaaagagccggttgtgtttctatacagtaacaaactaccaaaaaaagaaaactaagaaaacaatccaatttataatagcatcaaaaagaataaaatagaaataaacataaccaaggaagtgacagacttgtatactgaaaactacacaatgttgatgagagaaattgaagatgacacaaataaatgaaaagctatcccatattcatggattggaagacaatattgcttaaatgttcatagtactcaaagtgacctacagattcaaaggaacccctataaaaattccaatggcattttctttacagaaatggaaaaaaaaatcctagaattcttatgtaaccacaaaagatctcaaatagccaaagaaatcttgagaaagaacaaagttggaggcatcacactttctgatttcaaaatatattacaaagcaacagtaattaaaacagtatggtactggtataaaaaagatctatagaccaatagaacagagaacctggaaataaaggtatgcatatacagtcaactgatctttaacaagggtgccaacaaaacacagtggggaaaggtcaatctcttcaacaaatgatgtcgagaaaactgcatatacccacacaaaagaatgacattggaccattaccttacacaggaaaatttgagatttaaatgtaatttttcagcccctaaaattttacaaattcataaactgtaaaatgcctagaagaaaacattggggaaaaacttcacaatattggtcttggcaatgatttattagatatgacagcaaaacacaagcagcaaaagcaaaaatggacaagtagaactacataaaactaaaaagtttctgcacagctaagaaaacaacaaaatgaaaaagcaacctaccaaatggtataaaatgtctgcaaaccatatatctgatagaaggttaatataaaaagtatatagggaactcctgcaacacaatagcaagaaaaagtacttttaatgggcaaaagactggatggacatttctcaaaaagagacatataaatggacaacaggtatatgaaagatgctcaacatgactagtcatcaagagaatgcaaatgagatatcacctcacacctgttaggatggcaattattaaaaaaagaaaagataaatgttggtgaggatgtgaagaaattggaacccttgtgcactgttggtgggatggtaaaatggtgcagctgctatggaaaacagtatacagactccttaaagaattaaaaatagaaacaccatatgatccagtaatcccacttctggtatatatccaaaagaactgaaatcaggatctcaaattgatattcaatctcctgtttattgcagcattattcacatagccaacacatccaaacaatcttaatctctatcaatggatgaacagataaagagaatgtggcatatacaccatggaatattactcaaccttaaaaaaatcctgtcatgtgtgaccacatggatgaacctggaggacattatgctagtgaaataagccagtcacagaaggacaaatacttcataactcaacttatataaagtatgtaaaatggttacattcatagaagcagagagtagaatgatggttgccagcggctgggaaggaaagtaatggggaactgatgctcaatgggtgcaaagattcagttatgcaagatgaacaagttctagagatctgttgtacagcattgagtttatagttcacaatactctatgtgcactgaaaaacttctttaattagagggtaggttttatgtgaagttttcttaacacaataaaaaaacaaaactaaagaccaatatgcttcatgaacacagatataaaagttctaaacaaaattttagcatatcaaattcaacattacataaaatggacaatatatcatgatccagtggaattaattccaggaattcaaggctggttttaacaattgaaaatcagtcagtataattcaccatattaaaaccaaaattttaaagaaaattcatttgatgttgacaattccaacatctattcctaactaaactccccagcaaactaaaaatagaagaagacttccacaatctgataaaggttattgatggaagtctacaactaacatcacacttaatagtgaaagactgagtgctttccctctaaaatcaggaaggaggtaaagatggtcttgctatttttattcaacattgcatttaaggttatagccaatgtaataaggcaaggaaaggaataaaaggcatcaagattggaaatgaaggagtagaattgttttgttctaaagacatgatcacctatgtagcaaatctggtggaatcttaaaaaaaaaagcaagtttgagtttagccaggttcaggatacaagataacttatgcaaaaattggttacatttctatatactaagaacaattagaaatttaaatttaataaagtgtacatgtatagatacatctaacaaaaatgtgcaagtgttgtacactgaaaactagaaatcattgctgagaaaaattagagatctaattaaatgaagagatatagcctgttcattcatcaaagacctgttaacatgtcaattctccccaaattaatctatagattcaacatggtcccaatgaaaatcttagaaggctatgtagaaattgacaaaatatttctaatttattatcaagtcactgaggtatttaccacaatgcagacaaagaacagagttgggggtccaaaaatagatgcacacataaagaaaactcacttttttccaccaatgatggatatccttaagcaaaatcataataataaaaataataactttgattcatactttggaacatatataaaaattaactcagaatgggtcacagacttaagtggaaaagctaaattgacagaatatctaggagaaaatctgtgtgacctttgattaggcaaagatttattggataccataccaaaagcatgatccaaaacagaataaattagtacaatggacttcatcaaaattaaaatctgctgttcaaagaacatggttaagagaataaaaagataagtcacagactgctagaaaatacttccagattatatgtattataaaagaactgtgtccagaatatatacagtacttttaaaactcaaaaaaaattttaagaacccaattttaaaagagaaaatgatttgaacagacctttatactgatgccaaataatcatatgaaaagatccaacaatattagtcaatgaggaaatgcaaattaaaaccacagtgaaacactactacacacctattacaattgttaaaattaaaatgatcatccatatcttatgctttagggatgtggaggaattagaactcttacacactacacactacttatactgccagtgggaatttaaaatggtacaaccactttggaaaacagtgagacaatttcctaagacacacacctaaccatatatagcactcattctactcctagatatgtaactaagtgaaaagaaggcacatgttcatacaaagactcgtgtacaaatgttcacagcagctttattcgtaatagtcccacactgggtctagtggcttatgcttgtagtccccgcacattggaaggctaaggcgggaggctcacttgagaataggagttcaagaccagtctgagcaatacagtgagaccctcgtctctacaaaaaaattaaaaattagctggatgcagtggtatgtgattgggaggctaagaccagaggattacttgagcccaggccgcagtgagctatgatcatgacactgctgtccagcctgagtgacagcctgaataagtaaataaataatagcctaaaactggaaacaacccaaatgaccattaacaggtaaatggataaacaaattgtggcatacatgcagtgaaatatgctatggtttgacgctgtatcccgacccaaatctcatgtcaaattttaattcccaatgttgtaggagagatttggtgggaggcgtttggatcatggggcagatttctcaccttgctgttcgtgtgatagttcttgtgagatctagctgttcagaagtgtgtaacacttccccctttgctcttgctctcctgctgaccatgtgaagaaggtacttgcttcccctttgctttctgccataactgtaagtttcttgacgcctcccagccatgtggaactgagtcaattaaacctcttttctttataaattacccagtctcatttagctctttatagcagtgtgagaacagactaatacagaaaatactacccagcaataaaaaggaatggactatggacacctgaaacaacatggatgaatcataaaataattattctgagtttaaaaagccagaccaaaagaataaaacaaaaaatatacactgtatgattccatatgtataaaattccaaaaaaaatcccaactattcatggtggcagaaagcagactattggttgcctggggattgagatgggaggcaaggaaagtggaaggcaggattgggaaggagggataacataggggcatgaggaagcttttggggtgacatgtgcattttcttattcatgggcatatatatatatatcaaagcatattaaattgtacacttaaatatgtgcagtttattgaatgtcaaatatatttgacacttatacacctcaacagagctactttttaagaatatgaaataaggtaggaggggcatgagcaatgagatattacttaattggtacaaagtacactattggggtgatggtgacattgaaacctagacttcagtactaaacaatatatatatattttttgagacagagtcttgctctgttgcccaggctggagtgcagtggcatgatctcggctcactgcaacctctgcctcctgaattcaagcgattctcgtgcctcggcctccctagtagctgggattacaggcacgcaccaccacgcccaagtaatttttgtattttcagtagagatgggatttcaccatgttggccagtctggtcttgaactcctcacctcaggtgatccgccggcctcagcctcccatagcgctgggattaccgggcctggctaactatatattcttgtatcgaaactgcacctgtacctcctaaatgtatacaatttaaaaaaataaaacagccaaattgtcacaaaataaattattaatagtgtggagtgtttcactttcccatgtttttttttcattacaacaatacagtgagctacatatcatgattatttttatcatattattgttttacattattattgttcccatgtaatctatgataaaactgaggctcaacatattactttgctcaatgtcagataagctttggcaacaaacacgatatggaattccttaaaagcaaataaaataaaagatagacctcacttcattacgttggtcctcaagcatttccattcctgctttctcactctcccccctcatatcccgaagcaactctcactcaattcaagagtgcccatcattcccaattcccaatccccctagaaatgtgaggtaacacctcagtctgccctgtccaatgcagtaggctctagccatctgtgctactgagcagtagaaatgtggctcatccaaattgagaagtggtattataagatacagcccagtttctgaagatgtaaatagctcattaataatttgtacattggccgggtgcagtggcttgcacctgtaatcccagcactttgggaggccaaggcgggtggattacctgaggtcaggagtttgagaccagcctggccaacatgctgaaatcccatctctactaaaaatacaaaaaaatgagctgggcatggtgacgagtgcctgtattcccagctacttgggaggctgaggcaagagaatcgcttgaattcgagaggcagaggttgcagtgacccaagattgtgccactgcactccagcctgggtaacagagcaacactccgtctcaaaaaataaataaataaataaaaatatttttacattgattttatgttgaaattataatatttcgcatatactatgttcaataaaatatattatcaaattaattttacttgcttatttttactttttcaatgtaattcctagaagatttcaaattatacacgtgtcttgtattatctttctgtcagaaagcactgatttaaatcctactggggaaagcaatgttatgctttttgttatgacaacttcggaaaatcattaacttgtgttataatcatggtgctatatagctttggttttgtaaaagggtggaaggctctaggtagggtgtcatggatagaatcttgtggtgatagttgaagaaaaattggccttggcagggtagcagatggtgattaggaagaaaaaggagccgatcatgaactcatagtagagtggtagaaaaactttgatcccaactctgagatcagttttgtaagtcaaaccagttcttgtgccttagggtacaagcatattttgaggtacaatgctagtgttgtgatctgtcacactcctgcagctgtttgtggcagtcatgtaagatggagccagcccagagtagtctgggcccaatcagctgcttatcttgcaactattaccaaagcaagatttggagcagcagccgcagcttttgactctgtggattaaaatctcaatctccccaaagccttgcctcatgccaaactcctgtgcaccataatgctctctcttctgctcttatttctcagtcagctagtgttgtgccacactgtttgaaattggtaagtgtcaatgaatcttggaagcttttcttgggcccactgtctaactcttcaccataagaaaagaaggggcatcagtacctactgtactggcaaaattgctgcgtttcagtacatggtaggtagtgttccattttcatcaattatattaaatccagctcatgtaaaatgctgttgaaattgcaaagcaaaacaaatgtcacaaaaggcagagccaagttttgcggttaaattgtactctcccagactcttccctctgcaatgtcttgggctgccatgtgaaccacttccctgggtgtaatctttccatcttgatggatatcttcctgttgtagctgttaagtagttaatatataacatccctttttatcatcttctgaatttggaatcaatggaaaaacagatccaggagtcagacagatggtgagagaatgtggcttttgattagtggcccagaaatctccctaatacttcactcatcaatgaaacactcaccaagtcaccaacagagctggacagcaaaggtctactccaaactgagtgcaggaacaaaaggatcagagcctccatgtcctgtggcatcctccaaagacaaaggagtccaacaaggcactgaaaatgctcagaaatgccaaccaaactcaaaccaaattaacccgcaggagtaaggcatagggaaaaggtcggttaccctggcagaagtccctctgcatgaaaacattaggccagggaaatggatattcctcctgacctctgcacctatataaatgcattcatctgcatgtttatgatgggtttttacaaacacgtttgtcagggtttggcatgtagacctataaaatctacttttctggatccaagttctattcattcactcattccaaaaatatttggccagtgcctgttacaggctaggcacaggtctaggtgctactaggtgaagaaacagacaaaaaccctgccttcatggagattatatttttggcagagaagactaaaaaaaaaaataagcaaataagtaaaacatatggtactacagatggtgaaaagtgctattgagaaaaagaaaacaaacagggggtgagtgtggaagttgtgatatcaaacaaagtaactagggaagcctctctgggaaggtaacattagaagaaaggcccaacagaggtaggaaaaggagccctgcagatatttagggaaaaagtgcaccaagcagagcgaacagcaagtgcaaaggccctgaggaaggatgcttgttatgctagggaaaatgcagagtctaaagtggctggaacagaatgagtgagccaagttcacatatcatctgtgtcttcagggttatgacatgttcatgtcatgatactcctgccttttttgtttgtgttttaaaattcagactcagcaattttactgcaactctggtgctcacagctatcacgttcctctgtacacacaagccataagcacacccgtttcagtagttctgaggctgcctcacctttgctcagagcctgaaaactgctggtgggaacagcatctctcttcattacatttctctgaattcatcaggcacccagcaaatgccattcagaaagcaaattctgaatatgtgtgtggtgaaggacactcctagactattgcctcaaggattttcatgaaaaacctgccccccgtatgagtcttcccagcagcagtggcttcattgagaatatatggctgaccactggcatatttagttcatacttagcacagccttctccgaccatcttaccttgggctgctgtaacaaatgtctacagaacagttggcttaaacgacaaacatctttttctcacagttctgtgggctgggaagtccaagagtaaggtatggacagatctgatgtctggtaagagcccagcccacttcctggtttgcaggtggctgtcttctcattgtatcttcatatagcagagaacagagagaaagagcctgtgtctcttcctctttatataagggcattaattccattcctgagtgctctaccttcctgacctcgttacctcctcacctccaaatgccatcacattggggattagccttcaacacatgaattttgaggtgatacaagcatttagtccaaagtacccacctttttccaatttagctactggcatttgtatacattaatgtccatacctcctaccgcccactccaccccaccatttattcattggtttcacaactatttattgagggtgtattataggctctcaatgaataaaatagactcctgcccttgggagcttatattcaaaaggataataccttctttgaaggcgggacgctgtcttagtcaccattattcccacggcccatagcacagtgctttctttgcctaacatgctctataaaaatatgcaaatcttgagacaagtcacaaagcagaattttgtggaaccaaaaataaatgtgctcatctcttttattctttaaatggctcatacagactaattggaatggagatgcgtatttaactcaatgccttcctctaaaacatactcaaggtccatttatttccaagatggcattttgacctgtgacaactaaagccccatattgcaaaaaaaaaaaaaaaaaaaaatactgtggcaagatgctagatcggtctaattttctccctgcattataaatctttaaagctattgggagtgggagtttaagatggttgaccatttaacgtgactgtttaataaattgcattgctagtaagccatagtacttaacccctcaaaatatcagtatattaaaatcttctataatgttatcaaggagaagaaaataaattttgagaattttcctaaagtgcttgaattaatattatctttttgtggtctaggaaattctgctaacagccctgctgcttttccattaaggttacagtgagacgaagcatgtggcacgcagcttccatttgtagatcaacagtgaaggagacagatttgtagtttttatcagcattagcagggcaaagcacatttgttcacaggtgttaggagtcaccacttgaatgaaaagctgggcagggaaattgtatttgtctagtgaaaatgtaactgaagcataaacacagcccacacctttgagtgtggcattctacagtctgcactgctgttaactcacattgaaaaaatcttggcattttctttccttgaattcattccttaaatggaattagcacattttaaatccttatgattatcattattgacggaatgatagcatttggatccgcaacaaccttttcattgttaattgagtgctgagaatgggagatgatatagttattctgatttttaaaaactagaaaatggaacgtgtgaacagtggcatatgaagctctttgacagacctagggctaggactcaaggcatgtaattccaaaatctttgtttagtcccttaggaaatagcttctcctgagttttgtcctgttgattgtttggcagttcccttaggagactaaatttgctgaagaaaggcagcctggagcagggttaacagtagaaattatcattttttggatccactggccttgtaacatgggagaaatctccactccaccttatacacacctttttctcataatttgttggaaaatttatcttaaaattcagcatcaaattcaattgatcgtttgacctactgacttttaagaacaacacatttttatcagatgctttgttagacactgtcagataatcaaaagtacttccactggtttacaggttcctcgagaagatgggagtatattctgatgtgccatgaatttatttttttagaaaagcgtaagagaaaatacaatacttggaaaataaataaaatctgaacgtaacttttatcacatcccccaacaatgaagagatgaggcatgaacatgctcacctctacccattgtgcctactgtgctgtaggtattgccgaacatatggtgcctggtgtcacccactgttctcattcccccttccctctgagatgtgcagaccagaccccatcagcatttctagggaggataatataatgatatcaagttaccagattttgatgtgtgaaaaatgaactaggtagcactttcctagccatgggagtatatgcaaacaatgttattgagcaaatattatgaattaatttaatataatcattacaatagagaaatattctccatcatttcaattgtcattcagttgtcaccaggagaacaagtattactgaataaatacgattttcatcaggatcaagtctgattattggtttattttaatctagtttttgttttgttttgttttgcctggaaaaatatttaccctgcttaagttatagatattacctgttgtttgaaatgaaatttctacctttatctgccccaaactttgggttgacaaaataattccacagatgaaaacattgctgagttataaatccatattattactttcacaaaaatctagcctgtgtccaggataaaatgacaatggcactttgaaagaaagtagatagcttcaaattatgtctttgagttatggttctgggctgtgaattaggctcagaacagagaagaagagaaacatttccgttaatattcccacagtggaagaacagaaaggggtaaaagagcaatcatcacattttcacactctcaaaagtaatgggataaagatgttccccgtaactttagaccaaatgtgtagacaaaggaagaaagtgtgtgttattttactctcatcttctctcatctccttggttagaaatgtgtcgctcaagcaactacttattcaaatagtaagtgcttgagggtagttaccgttattgaatctcatactgtattagggactggaatggggaagcaccctaactgcagaagcataatctcacttttcagagcagtgattttcaaacttgagcattcatcagaagcaccacgaggacttgttaaatagattgctgggcccaccccggagtttctgatcaggaggtatgggtgggacccaaggatttgcatttctaataagttcacagctgatactgacacaattggtctgagaaccactttttgggaaccactgctcttgaaagcagcacagcaaaagtgaaacatattttggaatgcaaaacctgtttcagctgtggctccaccgcttcttaggttatttgcctctgttgcccctatttgctcatgtacaaaatgcggagtactaatatctgcctcatcaggttttggagtatgtgtgaaactatatgtgattgtagccgcatctttatgtaagtgtatgaaaaatgcatatgcaactggtatgatttccttcatcaacttggagtactaatgcaagtccgtcttttttatgtttccagttaatcattcctacctccacttgtccaatgtagatagatgttcaatgtctgcctcttgagaccacctccttcccccaaaacatatatctcaggagtttactcagtttgaagaacagtccaccttccaactctagaagagagaacctcagagtctaatcagcccactgacctttatttctgctccaccacacaatgtcaccatttgaaactcagctcacaccatcggatggaatttttcatctgtacaatgctcttgctagaccaagtttcgttacaggccacagtggtgccccaaacttaggatccaagattgcggctctttcagctcacacacatacgctgttatttccctaaaatgtgccactgtacagggcaattgggtatgatgggttttcagtctaggccacatgctgtgctaatgccagcacccactgctacctggcccaacctccagaccatgttatggtgccagggttaccagtcttgactcccccttttcttgagatgaatgctcttgtgtgacttagggtgcccattctgcaatctcagttctcctcaacaggaccccagtgaggtgttccagctgtcctccctgggtctgtgcttgtacatctgaaatcttctaataacctaaaaagggaaaagggctggaatttcaattgttttatttcaagattggtcctcaatgcttatgtcagcttacctccctcaatggcctgccttcagtgattttgccgaccatccccacttcttcccattcccctggctctactggaaaagtcgtagcaagtaggaggctgtccctaactagtagccattaccaatgaccaccaaccttcttataactccactctgctctcccaggtgatgacatggggctcttgcaactgaggatactgctgatcctttacagaagttggtttttcatctatccattacttgagatgtggaggttttccttgtcccctttcctagtgagatccggtcttgccacacactctgccatttgctcaccatgcagaatccctgcaacatttcactctttgcaactgggtgggcaatgcgctaaaagcaaagatcctctttgtcctctctgttaaaagctgaaccagagccagttccaagcaggcctcttgcactccctcctttcttaacccttccgtaactttccaacagaaggcacagcaaggcccatctcacccccaccagaggaagaaaaaagaggaagacaaggaaaggaaggaaacttgccccaacccaaaccaaaaacttcctagtgtgtgtccttgacacacaatggagcagtttctccaaggattctggggtgggggtgggagaatggcagaaaaagggaagaatcggctttttttaaaaaaaaacaaaaaactgatgaagtggcagagttaaaactttccctcaatatttgtgtgcagaatctatatctagtgcttttaaaaaatcattgttgttaagatatagcaaaataataattacccagtcattcaataaaaatgtgtccaacgcttgttctgagtaaggactgttctatgtgccagtgacagttatgggaagaatggcgcaaggaatccaccccatggatgctttgggtcaagtagggagctccaaagacacgacattgatgacgtgaggatctgtcacagcagttcaaggttctgaatgatgagccccataggaggaccatagagctattcaacccagagctcggagaaattgttttctcctcaggaggaattgttcccatgctgtgccatgatctcctggcctcctaacaaatgagacatgctctctgtggtgtttttctctgctcacagggacagtaagcatctattctatatattctgtgtacatgttttcccttggggttgatagcagctctcttctaaatgggttaaccagcagcagagatgcagcctgtggttatgaaatggagtcatttttactattagtttatggacaatagtgaggagtttgtgtcgcctgttccacctgttattaactattttaacaatctctcttagaagtatgcacagaaatacattctgggtttgacaattctatatttcagatcatatctggcattcttcaaaatagaatgagctcaataaataataataataatacctaacttaattcttaagtaacaattcataatttataaaactggtacgaatacatgagctctttataataactctatgaagcaaataaaataatcttcatcgttatggataaactgtacctctgagaagttcagagctttgcctagatctcagccagggtgactaattactgagggacgtttggcaatatctgggagcatttttggttgcctcaacttgaggggcacagagggtgactacgggcatttggtgggtagaagccaggtatgctgttaaacatactgtatgtaatggccaggatatacttccacgtcaaagaattttccagcctgaaatatcaatagtgccaaggttaagaaaagctgctctagggtcacaaagctggtaaaatctgaacccaggtatattactctaaatctagtatctttctatgtcccccaactgtaaagctttcatcttgaattgaatggggaagcatcacctattacattttacattatgttcattttggtttccctttttcctgagctctggggaaggggcggaaattttgcctttagtagacaatgaaatgttgctataatataaaatcatacctagtgattctggaaaatctttcagcataatttccacctctttgcaactttatcaaactctgttgtgtctgcaattacaattttttggactacaaagggtgataaattttcctgtgtttctcaattctaagactaagatagacaacatctaaaaccatgtaagagagatgggaagcaggagtaaatgattgattagcatgtgtgtgtgttctcaattattgatggtaatggcccgtggatgtaatgtgaacttgccaatgctgctgataatcgaaaagtcatttttattgagatttggaatatgaaacactttttaaaaggagagtcatctatctaataatcactttaattttgaggtaagctactatagcagttatttttaattccctaaatacacatcactgtgaggcaggagaggcatccaagaatgtgctagtcagtggcggatgccaacaaagattaaaaattggaacaagattagtaaaggaatggctaaaaaagctgtggtataggcatctcctagccaagggcaggagagttgagggcgtggataccagagccagacagccggggttctgaccctgaccctgaaagcttactaatgttatgatcttgagcaagttacttaattgagcaagttacttaatttctctctgcctcagtttcctcaactataaaatgggagtgtatataatacctaccatatagggtggtgctgagaactaaatgtatcttaaaatgtgcctgccacatagtaagtgtgatagtgctatatattttctatattttgtaggcattaacgtgaatccggcaaacctatgtatagtgatgtgaaaacatggcatgacatcccgttaagtgagaaaaagaaaaagaaacgaaagaaaatcacagagccataattatcacactggcgcatttatattttaaaaatccctaatgactagacaggtgacttataagttgcacagtgaggaagaacttgaagcctttttattccatgagagaagtttacaatcactttccggtttgggagtaggtgaatacttgtcaccttgaagccgaccttctttttttcttttttaagacagagtctcactctgatggcccagactggagtgcagtggcatgatctcggctcactgcaacctctgcctgccgggtttaagtgattctcctgcctcagcctcccaagtagttgggattacaggtgcccaccaccgcacccagctaatttttgtattttcagtagagacagggtttcaccatgttggtcaggctggtcttaaactcctgacctcaagtgatctgcccgccttggcctcccaaagtgctgggattacaggcgtgagccaccgcacccagcttgaatcagactttcctttcctttttttttttttttctcagttatggaatgtaaaatcagaagtccagttgggcctcagggaaagggcacagaaagaccttttaagttccttcaaaggccacctctcccaagatcctttggaatgtgaatctggtcacttgggaagaggtgggcagatggtgcaggggttcaaggagccctctggaaggacaggcatcttgttggttactatacaatactccactgtagattatatgatttatctactcaattgtccctcaaatttaggttttcccagttttggctattatgagcacagctgctttgaacattctatatatgtatttttgtggatacagcacttatttcttttgagtgtgtaacgtggttagaacctgtctactgtattaacatggtcatgtctgaggtctattggaaagaatatacaggcatttctctgtatctgagggtgattgttctgggccttcctgcggatatcagactccacaggtgctcaagtccctgatataaaatggcacagtatctgcatataaccagtgccatccccccatatactttaaatcatctccagattactagtaatacctaatgcaatgtaaattctttgtaaatacttgttacactctattgcgtaggaaataatggccaaaaaatagtcttatatgttcaatacagaatttttttgaatacagtatttttgatctgtggctggttgaatccacagatgttggaacccccaaataaggacagtcaactgcactccaatggtcccaaagaggaatgccaccagagggtagaagaacctatctgggtggcaaagcctgtatactgtggcctaggagtacatgagggtgaccacttctggtccaggtgtagctgaggtggaaagcacatttgaacaaccttcctttgcccagagttcacacccgtgagaatggacaaagtggataatattggagtccatgtgtacggttccactgtccctgtgtagaacacaatattagacattggaacaatgaagcactctaggacagtactggccctttagaggtttagagtctaattgaggaggcagcagcaatatataaatctatacatcataataatttatattagaagcaatatgttcatctcatacattgctggtatgattgcaaattggtaaagccactttggaaaacagtttgctggtgtctactaaaactaaaatgtgcctatctgtgacctagcaattctaggcatgtaataggtgtatcctaggtacatattcaaaagaaacaagtgctgtatccacaaaaatatgtatatagaatgttcaaggcagctctactcatagtaaccaaaacctggaaaacctaaattttggggaaaattgagtagacaaattgttgtatatctacaatggagtattacacagcaataaaaaaaaacagccttctcctacaggcaaccacatggacaaatctcacagatacaatgagtgacagaagccacatggagttgaatatacactggatgatatattccactggatgatgttccaagttcaagaacaggcaaaactaatcagtggcaacagaagttcaatgggatgggtattcactatgaagcagaaggaggaagccttctgggttgttggaaatgtttcatatcttgatctgggtagtggttacactgatgtatatataagtaaaaatttatcgagctgtacagtttttcactttttatcatacatatattgtaccacagttttttgttttgcgataagactctcactctgtcacccaggctggagtgcagtggcacgatctcggctcaccgcaatccctgcctcctgggttcaagtgattctcctgccttagactcccttgtagctggggctacaggtgcccaccaccacacccagctaatttttgtatttttagtagagacggggtttcaccatgttggccaggctggtcttgaactcctggcctcaagtgatctgcccgcctcggcctcccaaagtgctgggattacaggcatgagccattgcacccagtctgcagctttctttttttctcaagtttttgtgttaagtataataagtaaatgagttcagagcactgagtgatgggtgaaggtcaagaagtcagagcagacttcagaggggagggaagaattgaggtggatttgatggaaggctggaacctgcacagggaaactgcaagagggaagttggatcatggaaggaaatatctgagaacaaatgcattgtagcacagatgccaagaaagcttggaaaatcttgagctttctcttcaacactcatcttccctccccaccagttgagaagccttgggtattatgtaggataatcttcactcagctccaagggtaggctttgatagatttgagtctcagcaacataattacttagggatgaatgtaaaccagtcatgacataatttgagtcaaaggcaagtatattcctaaaatggtccagtctcacctcagctgaggctttagtttcaaggttcagggggcaccaacagctatctccgtctagaggcaaacaaaagagtgattgcttccatttttactggtagccatcttggtatcatgagggagttagcctgacataaaattgggctgagttgagagaaaagtagagaaatgaagctggagctgtatttgatggctctaaacctttttggatttgcaagccctttatcatttaagccagtttgaattgatttttctattgcttcgcaaccctgatggcttttctgctaatctatacacagcatttcttgaatgctcgttttcatggccatagccacagccctatttcagaatctcataagcagtagttaagtgaactgcagtagctttctaactggtctctgccttcagtttctttttaccttaattcatcctccatgttgcctccagaatgttcttctcaggcacatcttatcactgccaccatgtgatcatcctaatggttccatgcattgtgaaaaaaggccaatggcacatgtatacctatgtaacaaacctgcgcgttctgtgcatgtatcccagaacttaaagtataataaaaaaataaaaaatacaaaatagaaaaaaggccaatggatccaaatttgctgggttttaacagtttagtcttttggttcttctcacaaaccctaacaagatccttactctctagccttctcatctttgccagagttaatgcttcagcccaggacattcttttctctctatctgcttcatgggaataccacttttctttccagattcaactctagtctcatctcttctaagaagccttctaagatctctccagctgatagcaatgactccttgcattatagttttacggcatgattttaccacttgataactctctatatagtttgtcaggggtttgggtgatttattcttgtctagcctacccattagcatgtaaaggctgggaagttaagggccccagtttttcatcttgaatgaattcttcattgccccttgcatagtgcttttcatagacaaactgctcaatgtcttgtgtcctcaatgtcatgtgtcctatgcttaactgactagagcaaagacttcctttaggagaggatatggaaataaagttggaaaagttaggtggggagggggttggagggcagcttttggaggattttaaaatccagattagatatattaagtgcaattattttactgcactttggaataggcaaaagattatctgttttccaaaatttctttcattccttctatattatttactctttttaaacttttacctttttttttttgagacagagtcttgctttgtcacccaggctggagtgcagtgctgcaatcttggctcactgcaacctccgcttcccaggttcaagtgattctcgtgccttggcctcctgagtagctggggatacaggcacacaccaccacacccagctaatttgtgtatttttttagtaaagacaggctttcaccatgttggccaggctggtcttgaacttctgacctcaggtgatccgcccacctcagcctttttaaccatctccttttctttgggggagagggaagggggaaagcagctctcgggtttgaaatatcatgcagtttgagaagaaatagaatgcaaagatgattagctttcttttctcctctccattataatcccataatagacttcatgaatacccttgctagcaaagcaatgagggccattgcattagactgttctcacattgctataagaaactacctaagactgggtaatttatgaagaaaagaagtttaattgactcacagttccacaggctgtacaggatgcatggctggggaggcctcaggaaacctatagtcacagcagacaaaggggaagcaggcacatcttcacatggcacagcaggagagagagagcgaaggggaagggttacatacgtttaaacagccagatctcatgagaagtcactcactattatgagaacagcaaggggagtccgcccccatgattcaatcacctcccatcaggcccctcctccaacactgaggattacaatttgacatgagatttgggtggggacacagagacaaaccatatcacccatctacttgagcagtggctataaacttttttttttatgataacctagtatgcatgtactatactgtatattatacagctgaaacaagacttttgtaaatcagcaatactcttgttatgatgcaagttagtattttccgttatgccatttcacttcaaacaaacaaaaacaaaaagttgatctaaatcaatttcatgaccattaaagaaacgtgttcttctcaggcacatctgatcactgttgtcacatgcacgattctaaaggttccacacattgtgaaaaaaagctaatggatccaaacttcctgagttttaacactttagtcgacatatgaaaaatgtggcattaaagcatatgtatcctaattactaggttacaactgttgaatgagctaagtgcttttgccagtattttatatttaatttgatataataattttatgacagagcattatacccttttaatagatgagaaaagagaggcttagaggtacagatccaaggttacacagctgcatatggcagagctgagatttaaacaaaagtagaccaagcttctgcttacagctcagtgacatgtgccatagctttaagtgacagccaatgcaatgaagatttccatgtgctgatttttttccagatggagtctcattctgtcatccagaccggagtgcagtggcaccatctcagctcactgcaacctccacctcccaggttcaagctatcctcctgcctcagcctcctgagtacccgggataggcgtgagtcatcactcgaggctaatttttgtatttttagtagagacggggtttcaccacgttggccaggctggtcacgaactcctgacctcaagtgatccacccacctcggtctctcaaagtgctgggattacagaggcgagccactgtacctggcctgcatatgctgatttttaaactttcagcacatgcaagggaaaacgagaccaccgacgtacagacaaaatgctctccagcctacaacttcatttcttctctggatctctattctggccctagaaatctgcaagtcctccaaaaaaaatgacaaaacccttaaaatagaatagtcaggctgcaatagaaaaaacagttttatgattaggaggaaacttctagaaggctagtactaaatctttttcagtcttctttaaattaccaaaattccatggacactcagaatgaaagattgttgaaattttatttttttccttttccttttcctaaactcccaaaccatctaaaagcaggcaaaatctaaattctactctgtatatgtctaggtctagtaaggaaggtttattatcttaaacatcaatctgttatgtatgacttgatttctaaaattgcttaattttctgggtcattcctggaggaatacttatgcactacgcagtgtgttgggtcttaaggatacaaagacctgctcctcacctttaaagggggaacatgcactgaaaacagagaacataataaaccaataattgtgcacagtgggacccatgcagaaataatggtacaaggtgttgaggaaagacagtgaattgaatcgtaatcctgccaaggcagaattttgatttttcctacttttaggtgttttgagggtttgggaaaggaaaagggaaaaacgcatctttgacaatctttcattcttagtgtccatgaagttacattaatttaaataagactcaaaagatttagtggcagcctcagagaaggctccttctaatcataaaactgttttctctgttgcagtctgagtgttctattttaagggttttgtcattttttggaggacttgcagagtgggagactagggcaggaatggagatccagagaagaaatgaggttgtcagctagagagtattttgtctgtacctgggtggtcctgccttcccttgtgtatgctgcaagtttaaagttcagcgcatgcagatcttccctgcagttgtccatgacctaaagccatggcacatgtcactgagctgtaaggagaagcatggtctacctatgtttaaatctcagctctgccatatgcggctgcgtcagtctcctcctctgtaaaatgttaaaatgttataatagtgaagcagtacgatgacagcaccttgtattgtattaaaaataatgaagacactgtccccatggcttggtaaagtaaggcaattattgtacttacatctttagggtctagagcttaagcgacaggagtcagtagcctgctggaaatcaaactcaccagcaacatttactaacaatgaaatcaagctaaaatgaaaccccaagaaaaactggaaaaaatatgaaagctgcactttttagggtaaagtgtgcatcttgagggtacagacagattcttcattcatttatttaacatatagttattgaatactttatatgtgccaggcactgcatgggtgtagagacatggagtggacaagattcatgtactctggcatcatggagtctacagtctgatgagggagctggtcaatgtaaaaggaaatgcatcaacatgaggatcccatttgggcacagtggccctaagctaatgttatggcagagaataatacgattgagtacttactttagacagaatagttaggaaggtctgtaggaggaggtgatgtttaagctgagaccagaaggatggatgacagggagttagccttgtgaacagtgacggaaagaattaagagaccagcatatgcaaaggccctggggtgtgtagaggactgtgtgtgtcataaatctctggacttctttcacacaaactggctgaagctctccccatccctgttgccagctgcctttctgactcagacttacagtgtgagtagggctccagattgaggtcctagctggttagttatacccatttgacttatcaacctaaaaatatgctgggatagtcttccctttctacacatttgccacaggctatatcttgcttactgtgagttagccattcaatcaagactgcccttgacatttatttcattctgattttttttttcctacatttttgcctcaggtcctgagagaatggctgctgacacaaggtagatgctcaaaaattacttgctgcatctttggatgaatttcattagagcatcagagaggaaatttttgttgttgtttgtggcgctatttgcttgtttattttaacacaggtgggactcggggagaacaaactggatggaatttgaaggagaatggtagggcattctggattaccagagggctgcctggctatgccgctccttaacgacatgaccttggcccagtcatcccacttgagccctgacattctcaactacaaatgagggctttagaccaagtacccttcaacatataatgttttttgtctatgaatccagtggcaaatatggggtatcaatatttgccactccttccatactactgtgaaagaagcattatctttaggcattaattcagctcatgcaataatgatgccttatatttgatagaaatttgtcatttacaaagcaccttcatttacattatctcatttgattttaaccagtcatgtaaggtatttaagatagttataattttttttttttacatctgacataatgtgaaacttgcccaaggtcacaaagagacagaaaagggaatgaatgacacttgtctgtgctgttctgagtataggtggcacaatgaatcagataggatctctatcatgtgtgagtgaagcaaatttttttagtttaccccctagaatagcggtcactactttagaaaaaaatgttaatgacagtgttgacaatgttgaaatgtaaataatcttttttgtattaagttctttagtagtaaggatcagaaaagtacttaggttagctcacctggggaaggggaacattgcaggaattagcaatctcatggacagggaatactggactcctcatagtaattgggaaagaatctctaggacttaattgtttgtctgcttttcttggaactcccaagaccgttctctcttatctgaagagcagtttcctctgcttactcatggttcttgtttccctataaccatggctctcacatggcttagcttgctgggaccaggtctggcccactgactacaagatgggcgtgatccatcactcaccataggctacggtcaatctcttcctcttcgctcctggggtccaatctgctggggctggtggggctggggcaagaaggagtcatgtggcacccccatcaagttctaccttgctatgaactgaatgtttgtgtctcctccaaaattcagttgaaaccctaattcccaatgtgctagtattaggaggtggggtctttgggagataactagggttagctgagatcatgaagggggagcctccatgatggcattagtgttctcataagaagaggaagaaagaccaaagctctctctttctccactatgtgagaattcagtgagaaggtaatcatttgcaagccaggaagagagccctctccagaacttgaccatgacggcaccctgatgtcagactttgtagcctccaggggtgtgaaaaacaaatgtctgctgttgaagtcacccagtctgtggtattttggccagcctgaattgactaagacatacttctatatgaggatttatgaacaggttcctaggcaagggagtctgcaaattgaagaggcatcccaaaacatgcctactacccctccttttttatttaagtttcacaggaccctcttggttctccttttcttaggtgcctccaatcttctaagtataacattctgtgacaattctgtgacagaataagtatttattctctgataattaaggaaaaacaaaaacaaaaagaagacaaaacacccacatttgtccctgaaatttaaaatacgaagggttgttccctggttttctgattgtagggtcaaaaaacgaagaagcaacgagactagcaattggatacctttagatcccaaacttcatcctatcattggtttctggatagattatttattgcccttgaaattcagcagaagggggctgggtgcagtggctcacacctgtaattccagtactttgggaggccgaggtgggcagaccacctgaggtcaggggtttgagaccaccctgatgaacatggagaaatcccatctctactaaaaatacaaaattagccgagtggggtgacgcatgcctgtaatcccagctacttgggaggctgaggcaggagaatcgcttgaacctgggaggtggaggttgcagtgagccaagatcgtgccattgcactccagcctgggcaacaagagtgaaactccatctcaaaacaaaacaaaacaaacaaacaaaaaaagaaattcagcggaatgaggagtcttaaaaacctaaaagctagaaggggttttattggattatctaatctaacctctggattttacagcaaaagacattgacattgggccttagttcaaagaatgactagaggtagagccagtggaatttctcctaacccaacgtttgtgatcttttcattacatcatctaagcagaacctgtaggggttaactctgagaattggggatgatgcttgtgataatgcagcaaaaagtaatgtctaaatgtaagatattattttgagatgagaacaccgaatggggatggaagacaggaatcttcaccatgtgtgaatgtacaggaaacaaccaataaatgccttaattcttgttctgtaaaaacttacatgtaagtaaaagatcgccgaaattgatctgaactctgttactgccacaaacttttatcagcaaatggagattaggatgttcccactgccagatggtatataggaatatggttgaatgtggactgttatcacagactgtctggtttcaaaggtgggctctgtcactcaatatagttgtgtgacttagttaagtttgtaccacttacaaaacttcttccttgggtcaagctactcaattttacttgcttctgttgcccaatatacaaattacagtagtaatacatactccatagggttattcttaggcttaaagtagccagtatttgtgaagttataggaacactgtttagcatatagtaaacacatgtgttatctgtcattattattacttgcttttctgttgcaaagactaaaagctattgttttggagtagggaaatttccatttaaaattccattggctaggttagcggtatcagttgatttagcaaggaattaagagatgaaaaggaattatttctttcgtggtggcttcatctttatctgtatccactataaaattcgtaaagtgggcgttatttgctttacacagaccagaaaacaggctacagaaggtaactgcttggccagaaatgggttgagtcagtcgtggcttatggcacaaactacatttgagtctacaaagcaatagatgaaggtcttcgccaagtgaagactttttggacttggaaagttcacacacttccagcgctctataagaagatagggtgggggagttggaggagaggacccacatccctcttccagcctaggaccaacttggcccagaggccttttcccatgccgcccaaggctcgctgagaaatctggctccacacagtgggagaacccagggtcaggcttactgtgagtgaggccggcccagtctttcccgagccttcctcagggagacctgggggtatctcacttccctgcggaagtctgtggagtttaatttgtaaatttgtgccgaaactacacttttgtgtcaaagagcaaggacggccaagaagcggcaacacgaataagagcgcagggaaatggggcctgcgaacgacctcggcctcgggaactcccacagtgccgccccacgcgcgacgcctacccgagaacagccacccgcctccgctcccggaggaggcgtggtcgaccagcaccgccatcttggccgcctctctaggcgctctgtttaccactctatggtcgcctgctcccgccccgccccttcccagtcattgtctggaggagcagccgcggccgcagctccttctctttataagcccgcagttcccggatgtgaatggattacaatgtatctttcagggaaacctattattatcaatgtgactccacgggggagtccatggtgatgatgatgaggaggaggatgatgatgatgagacacctctaaacttggaacaagtttaagactttatgagagaagaaaaaaaatcaccaacaagaattgtttgaggaaaaattataactatcctgtgttcatttttttttttataaacaataagaaaaagttgttggatttttttttaatgatttcttttttgggggagggaattttgttgcagttttatggtggaaaatgcaaaaaccagagccaggtgcataatcttgtaatctgtggatatccctggagcaggactgagtaccagttaaaatactttttggggatacacatgtgagatactaagtacttgcagaagatttttgtctctctttttaaagtctctttccttggaatattgtgagaatatttgtggccatttaaggtaacgtttcaatttgccgtcagagtaaactgtttgtaattgaatttaatttttaaaatgtcgatcccgatgttttattaaaacaaaagggacaacctattaaataattgccaatgggaaaaagtgtgtgcatgcattttgtgtatgtactcgcacatctagcaataccaggatttgtagaatgtgtgttttttttttcaaacacacgttaaaatagcttatgttgcatataccggataaagcacgcttgttattacgaaacgatagaattatgaagcttaaattttatcctaaaaagtgatgtgaaaaagtatgttttaagagcatgcagggcctataatggtaaatgttgaattaaaaacttacagtgctggcgaacagggacttagcgtgcctaggaactcaagtgcaaaaacaaaacaacatccacccccaaaaattgccctttttttttttcgaagtttgcagttatactattctgtgacttaaaagggaggggaaagaaagtatgcaattcagatttcgcccccaacgcaaaactaccgaaacgaaaatctccccaggaaaatgtggcttgatttatagacgaaaaagaaaaatattgttcctcttggcaaagtctttttgcatcacgtgtatttgcagcctagtataaacttgctttgccgtgtgtggatgtgtgagtgagagggaacgagagtaagagaaagaaagaagtgaggggatgtaaactcgaataaatttcaaagtgcctccgagggatgcaacgggcaaaaactgaactgttcaggcttcagattgtaactgacgatctgaggaaaaatgaggtgctcgatgaattttcgtttgtattttttggcgaggcgggggaggtgttgagattttttttttttcccctcggggtgggtgcgagggggatgcatcctagcctgcccgacccggagcaagtcgcgtctccccgccggagcccccccacccatttctttgctgaacttgcaattccgtgcgcctcggcgtgtttccccctccccccttccctccgtcccctcccctccccggagaagagagttggtgttaagagtcagggatcttggctgtgtgtctgcggatctgtagtggcggcggcggcggcggcggcggggaggcagcaggcgcgggagcgggcgcaggagcaggcggcggcggtggcggcggcggttagacatgaacgccgcctcggcgccggcggtgcacggagagccccttctcgcgcgcgggcggtaggtaccggcgcctgcggggctcggcggggcggaggcgcccggcggcgcggggttcgggctcggcggccccgcacgcggctccgcgcctcccgcgccgcgggctcccggcgcccggcgctcccagaagagacaccccttcccctcccgccgcttccctccccctcgccgccagcccccccgcccctccccttgatgccccctcggagggaccgaggactttgccaggggcctgactttaatttttataacccctttctttcacaaattagggtgctggacaattagaggacccgaccctccactccgctccccccaaccctgtcaccccacccctccccctttggacgtgttttcactccagagacgctcatctttaatttcttgatagctactttgaaaagcggaggggagtggtgtgtgcgagtgtgtgtgcgtgtgcgagtgtgagtgtgcgaggggggtggggtgcagggtggggggaaagttgagatcggatcgttctcagtagtttctcttttctctgtgatccattcatttctcgctctacctcctgttgcataaaatgatgcgctgaagagcggctttttttttttctttccctgatttggttttatagtggatgttaccagtttgatcgtctctttggaaatacaatatcgctttttttttttttttttttttttttttttttttttttgctattgctgcctattccatcttaaaaaaacaaaaccaaacccaacccaacaacaagtctcccatcccttcctcctttccaccttaatcccacccgcccccacgtccccacccccaaccccccagtctccaaaaatccgattgtgttttctccaaggattgggactggattttctgattgcggttatttccatgtttctaggtttgtgtgattttgctaaaatgcatcaccaacagcgaatggctgccttagggacggacaaagagctgagtgatttactggatttcagtgcggtaagaaagaacggtggaaactaacaacagctgtgaaaaaaacaaaacaaaaacccaaacacttcagctagaaaccagtaggaatctaaaggacagtaataatttttaattggctgaatccttggtaaatatgaaggtctttttgacaagtttttaactataattttgtggtgtgatggaagattcaggcttttttttttttttgagttttattactggccttcaattccctacccactgattaccccaaataatggaatctcaccccagtggaaagcaaaaatagacacccctaaaactaaaccacccctaaaacttggccatgtctgaacactgagactactaatactttgcacactactcttcgttttatttattgtttttggaaatggaaaatagaaaataggagacccagttgtctctttaaagttttaagctaatgatgctttggattggtaggacctgttccttacatcttacctcctagttacatcttttcctaggattcttaaaactagtatggatatgctgagcatacattctttagaaccttttggactgttttggtaaatttcgtagtcgtaggatcagcacaaagcggaacttgacacacttgtggagttttacggctgtacttggtccttctccatccctttgcttccttttcctaaaccaagtcccagacatgtcaggagaatgaattcatttttaatgccagatgagtttggtgtaagatgcatttgtaaagcaaaataaaaagaatccacaaaacacacaaataaaatccaaaccgccttccaagtggggctctttcatgctgctgctgctgctgctgctgctgctgctgctgctgctgctgctgctgctgctgctgctgctgctgctgctgctcctcctcctcctcctccttctcctcctcctcctcctcttctagaccttcttttggagaaatggctttcggaagttttgccaggaaacgtagccctaggcaggcagctttgcagccccctttctgcttgttgcactttctccattcgttcctttgctttttgcaggctctgactcagggaaggtgtgcattatccactagatacgtcgaagaagagggaaaccaattagggtcgaaataaatgctggagagagagggagtgaaagagagagtgagagtgagagagagagagagtcttgcttcaaattgctctcctgttagagacgaaatgagaatttagtgcaggtggcacttttatttttatttgggttcacatatgacaggcaaatcctatacgagatggaaatggacattgccacgtttatggccaaggttttcaatataaaacaaaacaacttttttcttctccttggtgaaactagtgtttttctagagaggctgctggcctccaacctgaatcttgataacattatggggactgtgtttgttccaaatgtagcagtagtactgcttggccatctaatgaacctgaggaaaaagaaagaacagagtgataatgggggctggggtgggatctgtaatgttgtttctcttttagttttaagttggatggtgatgtattttactaaataaacccttagcataaactctaagctgtttggtaacagtatgaaagatctttgaggagctctgaaggcacaagtgtcttcttttcaactgtaatatttctttgtttcttttagatgttttcacctcctgtgagcagtgggaaaaatggaccaacttctttggcaagtggacattttactggctcaagtatgtaaattcttttcttagtgttaagttaaatgttctgggctgtttatttactcaattgtatgtttttggctctgttgaagagttctgaaaaagtcattgaattttagcctgtaatcatacggttattgcattacccatcagtggtataacttacacaaaatgttatcttgtgcgattaaaattaggtctttttttttaagtcaaggaaactctctcaaaattccatcacttaatttaagagcaattttctaatacagttgtaatcaaacacatgaagataagaccagtgttaacatggggaataaattaatgttttctatttgaaaataaggggaaaaaatctctaacattcataaaatgggaaaatcccttgtaaataatatcatttattaggtactgtatacaattaacccttttaaagaaatgaacacttaattctgcaaatgaatgctatgtagtaaaccatagctgtaaatagcctcttgctaatcttagaggctaaatatgaattcatttatatttaaaataccctttttgatgctttagctgtttttttttccctaacgatttacttgtgcaatgaatttttactgtatttaaagttgcaaatctggaaggacttttacgttttataaatgaaagatctttgggtgatgcttaaaaaagatgctagcactattcacaaaggaatctgtgtgcacagtgattatctggaatctaaggaggggtttattacagggctattcgaatatctcttattaaaagtgcagagtgaaaatattcatttaaaatgtattttttttaatccaatgaatttcaaataagaaaaagttatacattgttgcctgctatcctttaagtccgtggcttaagtccatttatgcttgttaaacagctgcagtattttaggagttctggcaatggtatataacagtacattaggccaagtactattcttaagtcagactggtaaatgttgacatcttttaactgtgagatgccagtggaattgtctgtcaactatgaatataatttaacatcttttaatattcatttggtgctatagcaatgaaagaagtttgttcacttatgtgatttgtataattggtatatttttataaaactaatggctttaaaagttgctcatttccaaataagttccttctccttctattgcctgcctaagtttagggaatttgtgtctcgataacttgttttaaaaaatgtgagatgcttcttgtatttttattttagttttctggtgcacattgattaaaaggaccattgacagacaatatgtttgtgttttactatcctggacctggttatgttttccacttagggatttgggatagtttttatattagtattatatctttaaatttctgtatggtatcctctatgcaacttttaagatggaaaatattaatatgcatgtttgatgtaaaggtaaggacaagtatcttttgtgggcaaattaatttttcatgttagacaagatcaaaactaactgtttttgacagtaatttttttatgacttaacttaaaaatgtgtattcagtttcaatctaaaagtagcttatgtcagacagacacagagatagactacttttaaagtcaatgctaaaaaactagtttgcaatgttgtgaaaatatgcatttagaataacttaagtatattacattagatatttaataaagtaaggtgtttagaaatatgagattgtgttacatttaaaaagacaactgtatgtctgatccattttctatgttcacatttaaataaagttcttgctgtgatgtttaaatgtttatagagagtacaggcttaataagttgaatatgtattaatgcattttggtaagtgatgatatatcaacacttacacagttctgaagacaataacacacacacatacacacatacacacatacacatacacacatatgttcatgcatgcaaacctggagagagacttcactcttaataagtcatgttacactgcttctaatgcatacacagtgattattttgaaggtgtggaactttaagttacgttgtaccagaaatggtgttttcaggaccaaatgtttacttgtaagggtaaaaagtgtaatggtccttttattctggcagcctgaatgagaatgcagggtattcatttcatgtagtatgatggtgattataatatgtagggtacagattggagtgttcagttttcctctatcaagatagtatttgaacacagggctgttagttaagaaaacgggttgtatttccacttaaaagagttaaatcttttaaaaagcgtaatacattttaaaaatcatgaatactgcattttgccctttaattggaaggatcaactaggaaactttggagagagaaataattttctaaatttacctcaagttaatatccattgtcttgagtggactcagatgtccctttcatggattgctttgaaacttggatttaggaaagatctaaactataagtagactgttcctatttgaaaaatcagctatggtttttcaaagtgaggcatggtaataattcatgcttaaagttcccaatagcttttgattccattaatataggatgctccatagtgatttgcaatgtgagaataaaaataaagtgtggccatattccctttaatctttcatttcacaaacatggtttttcctaccaccttaagaaatggtgaggctgctagggagaatggaatgtaacctgagctacagcctgacattcccagggagcatttttcacatgaaaggcttttgtcaacccaggaaaggactagcagtttttgtttgatgtttgcaggtgttcagcagaaagcactaaaacaattcagccatgatggttcagagcttcgatgaccttaacagggaaaattggtgggctctggaattatttttaagaaatagttataacctatatggtaacttaaacaaagggatttaatatccgttatatcattgatcttaaaacaaactaaaagcatccacatgcctggatgattggaaaattattctcattgaaaagtaggatacctaagttaccaaaaaaagaaaatcatctaaagagtctataatttattgatgagtatggacttaattttctgatatagcagaaggacagtttatttggttacttttgactcttgtgaggaaaagataaacatcctagctttgacatctttttaaaaagtcgttttaaagttgggccactaaaatgatacattctaaagaacttgttagatcaggtctggtcacatctgttacatgtatttactgctggtctatgacagatactacatctttctcccttagtttaaaagttgagctttttcccctgtgactgtttagttttactgaggtgttcaggtattgttaaaagattgtcaaatgaacgagtgtttgaacaattaagagcagcgttaaaacacaccacatctctgttgtgggtcatttttggaagaggaaagtattgcctgaaatttacctaagttagctaacctatatccacatgacaccaacataatatgccaatttagtgaattcattgaggcggaaaaaaatcagtccggtgggtagttttgtatgatacagaaaattaacgtggtcacatcctgaattagttttgagttcatagtgatggcatgaaaaaaaaattggtttccccttaaagatatttgttgaggagagctgcttaatattgtgtgtgtgtgtataagtgagtgaaaacacccttaaaatcgtaaatggtataattcataagggttctgtggctttttgtaaagggcagagtaatttaacaggttaaaagaagtacagtggcgttaaacccattatgttagaatcacagaattttgggtatagaaacccattagaaatgttgcccagtgccttcattatacaggcaaagaaaactgaggcccaagataaggagttccaaactgtgctttcttatttgttattttaaaaaacaagtttttatttgctaattctctatggccctgcaaatcctttattggaaataaccttggtctcactgctgtctttctgtcctttgtactgcgtaatggggcttgaggattagtgtgctgatatttgtgcatgtaaatgcttctgtatatgcatgtgccttctgaaaacttttttaggtttggagctgaattttggattattgatcattctcttttgcctggtcttccctgtgactgttttgcatgatgttgggtaaaataatagtgtgggtgagcatgtcacagtgcttctcagtgtgttagagaggtgtgctgtgtaccttatacctgttgtattttttaaatcctaacaagaacctaatgagatgcaaggattactactatcctgtattcatagctgaggaaacagagacagatgttaaacaactggatcttaaggcagccaataatgaaattaggttttaacctcaggtttgtctagctcaaagtcctgagttctatacacacacacacacacacacacacacacacacacacatcagacagctcatttttgcaagattatataggcaaacagtgtgatattgaggcttcgcacgaaatgctatctgtgatctttagggtagatagcatttttaaaaatgtgtctaatgttgtaatgatgtcaaccatatccattatttttcccgcctttgtatccaaataaactacccttccaatttatgacagatatcaatgtgactaaatatgtctttctcatatctttattagttttactaagaaaatacagtagatattttaaaagttgtgctttcattctgttgtaagttgatagtctacatggatgccaatgaaaacatgtttttatgtagctaatcaattcagaatttgaggtaaccaagcctgatgtattaatatgtaaaaaaataaggatctcctgtctttaaatataaaaaagttttgcagttcgttgttagatctttgaaacttaatattcaagaacaataccctcaattctatctgcatcactaaaataagcagttttgaaggtttgatatgtctgttaccagacatgtgcttaaaatgttacattttctaaattcagaaggcagaagcagtactctatttgacactgacttaagtaaataaaatgcattaaacaagcgtggggatccaagaactgttgaaactgaaatgcttaacatttttgacagcatcagcaaattatccttaccctactattgtaatgaggaaatcacttaaataacagatgaacagccaagtcacataaacatatataatagaactatgtaatgaaagtttatgctgttaattgctcgaatctgtcttaaatgcttagaatcatggagcagtaaagactgtcatataaacagttttgttttgagcttaaaattattcctttttgctttcatctgctatgataaacaaagtaattttgtaagctttaaagatcaaacatttactcctaatggtaaactacattttatattggaagtttgcaacctcgtccaagtcatagagttgagtcctggtggccccaggcctgtgattttcaacgtttagtattatgatgctatttagatctgttcccataagccaagataacagatcttaagttgcctaataaggaacatggtgtgttttgaaatgttcttcagtttacaagtcttaaaccaaaatgttcttggccaaacctttagaatctatatgtaagttgaataagtcagattttatacagacatagcatgaaaatgaagctaagtaggaacagaaaaatctgccctttctttattatttttttttttgtattttatgagctattttttatggccaggtgtttgttcttccaagttaattagatagtgctaagtattagaaaatgtaaaatacattacagattttttaaaaggttatttttgttactggtttcttattactctgggtaaaattttcacaactgaccaccaggtttattagcttatatgtgagctacccattttgtacattcgtgagccaattgactaggaataaggtatgcacatgggttttatgtggatacttttgacccatatctctcttaatacttaggagagagatataagagaaataataatttaatctttggagaagattaacactttgttataagttatatataggtaaatatatatatatatatttatattagacttgcaggaatagtgaaaatgttgaaaaggttgtcatgtttactttcatttcaaagataaaggcccagttaatcagcatatcaaatacccaggtgtgtttaaaatcagtttatgtgggtgaatttcagggctgtaagaaagtattttatttaaaggtgcagccacacgattgattgttcaaatgggtgcttttgtacttttgtgtgacaattaacatttaatgaatgactttctggactggcattggtggtaattactatatgtagtttattaactgcaatccattgttggatgtgcctttattgatttgttttgcaaacaccccttcacatgtgcggcagtatttgtgcagccgtatttgtacgttactttttaaagaacctgtttcacttgctgatgctgacattgcctctaaaaatgttagtttataaattctcatgtgccagaatgtctctttgatccaagtaattttagctgaaatacaaaatccgtcaacttttctgctataaaaagtttgcattcaaatcctcagggaatcccaaagtaatgacacaatattgtttttcaagtaaataatttatggaaatttacatttataagagactttagagatgctctattttttaggtaaggagccaaggttcgggagggttaaaagtcttttgcccaaatcatgcagttggttattggctgtaataggacacaaatacacatgtcctgaccctctggtcaaagacctcatgctgcttttaattaaggcttggactcaattcgatggtaccaactgtatatttcttaagaagggaaaaatgtgtataatctaccatttctgaaaaaattattaaaaattgagattgtgaaagatggacgttgtaatccagcccacttgtcatcacgtgttctaatttggccaaggcagttgacaaataactgttaaaatgtattgtgttattaaaaataacaaagtaagacccatgattaaatatcagggctgtaatttaatcttgggggatctggtgctgttcataaaccatttggcttttttctgtaacggatgacgtcaaaatccagcttgattgaattatgaccctgggttacagcagcacctgctggtgcctttttacttcatggcctgtcagcatttccattacaaacttttttctctgacattttaaacttcaaatagttaaactggactgatggttggcatataaactttctgctccttgggaaaagaccacttgctcaataaaaacagagaaggtggtgacaaagccccattacaggataccccttagaatgttctgctttgctttaatcttccattcatttaaacattcttttggggggtacttagctgaattgcaaggcatccaaatggaaggtttttaatctcaaatttcccatgtgaagacttaagtatggggtgtttacaggactggtaaagtgcaaaaagacctagcatctatgcaggttattgaaactctggacaatccagttttcatacagtgtgtaaaatgctgaggagcaagccatgaaaaacatgcaaattggcataccttgtcagtaattgcttttatattcacttaagatgagtaaaaattgataatgattatggttagaaaagtatctttatttatatttatatctggagactggtagcatagcttcagtttgtccccttgggttttaatatgttgggaatggagatgggatgttgtttgcatctagctagtcagcttttcatctatctagtctaattctgattgatggatcatcatatatatatatgtatatatacacatatatgtataaatatgtatatacatatataaatatataaacgtatatatacatttatataaatatataaatgtatatatacatttataaatatataaatgtatatatacatatataaatatataaatgtatatataaatatataaatgtatatatacatatataaatatataaatgtatatataatatatatatatatttagtacctgctattctcatatctccatgttagcaattagaggacatagagggctttatggaagagagaaccttctctcagagggcatatattctaacacaggggtgtccaatattttggcttccctgggctacactggaagaagaagaatcatcttgggccacacataaaatacactaacgatagttgatgagctgaaaaacttttgcaaaaaaacctcatgttttaagaaagttcacgagtttgtgttaggctgtaggttggacaagcttcttctaacaggagaaaatagaaaagtaaaaatgtgattaacatctagcattgggaagacacaataatgtgggagtttagagaaatgaaaacttatttctttcatggggaaattaataatgaagggttcatggaaaactcaattctaatccttgaaggaatggtagaattttgacaagtaggtagtgagactgagcgtgcatatcaggatcactgtgaaccaagcacagatgaaagaaactggaaagggtagattaaagagagctcccagaaagagaagtttcttggctctaaagtggagtcaactctggtctagacacatgggatgatttccaggcaaaaacccctgtcttggttgccgtttattttcttgactgagtttgcgtttcactcgggggtgttaccgattataatccagttccatccaaaagtatatgtttttaatggtagtgtcgggatggaaattgaagattttgtgtccctacttcccaaaattcttcctataatatcactcagcagtggaaactttcttgagccaaatgaagctgctttggagaaaattgttcatgtagccaaattctggaaatctaggttcttttgcaatgtttgctggtaagtagctgtttcatattgaggaagtggtagaatcttaaaggctgcacctcaaaactaaacaaaatcgaaactcaccagtacaattcaagaggggttttcacattttttaaaaaggaatactgctgtatttaaaacattttaagattgcaaaaattcatcattataatttttattatcatcactggcatcaccatgaccagtgtcacattgtttggtcaaaagctggaatggaaatgtgatagttatctttgccatattatatattgagaaatgcgtttaaaacttttccggagataccgtgatcttagcaaaaactaatgtaatatttgtaaaaacattgtgaagtggccagatataccttttaatgaaactgaccagaagtacatcacaaatagaaaaatacacgtgtgtgtgtatgtgtataccatcccttcccccaaatattgttcagattaaagtgtctttctctctgtgacctgcaagtatcttaacttagcatgtgtgtccaatttccatagtgaagccaaaaattcaaatgatggttgatattggcttaggaagaatttattaatgaatgactgtgcttggtatagagtaaaaaaaaaaatttatgacaaagaggatattctagactcatgtaaaagatttcagttaagaacctatgaattcctcaacctttttcttcacttttcaaaaagtaaaggatttatattggaaatattttgcaaccctacaacctgaaactcaaagctttggtcagcaggtggtaataatatttccaggttgaatatccaatttcatacataacccaatttgtaagtttgaaaagaaatattaaacgatgtcagttttaatgcttgtttgaataattgttctttgttatgtgccctcttggacattattgtccactagtgccccaaaccattgaatgcttttctgttctcttatggccactgtgattcttcaatctagttacttctaactgcaagattaattttcttctgacatctaattttcccctgattttattaacatcttattattctttttctggctcattttgaacaatttctcttttatatggggtgtatatttgtagtgtcccacttgtaagggaattctacactttaatccttagtaattttggtagaattgggataagatgagagatagtccataattgtttaaggcttgattgtttaaagaaggttgaaagcttcagaaaagtggaagtggatgaatgcatgccatgttcttattattttttcagtgtgagtgtgtttcactggagtaacgatagagttattaggaattattacctttaatttacttatgtgcacattcattcgtccactcattcattcattcattcattcagtgaaagtttttttttttttgagagccaagatacaagttatagtgctagaaattatggtgctacaaagaacaacaaatttcaacttcagcactgggacattatgttgcagttgttaaataaaagttctacagtaattcaaagaaggtacttttgaaataaatgatgttggccaggctgggtggctcatgcctataatcccggcactttgggaggccaaggcaggcggatcatttgaagtcaggagtttgagaccagcctggccaacatgatttaattattttgtagaaatcccgtttctactaaaaatacaaaaattagctgggcgtggtggcaggtgcctgtaatctcagctactcgggaggctgaggcaggagaatggcttgaatccaggaggtggagtttgtggtgagctgaaattgcgccactgccctccagtattggcgacagagcaagactctgtctcaaaaataaaataaaataaaatatgttgaaatatgcaagtatactttttcaaaggacacttttcaaatataaccaagtacagacttcacatttctaactgaaacggaaatcctaaaatctctgtatatgtgtacatgttctatgtgaatataaaggaaggcgaatggatttgaatgcttatggaaattggcccttgaagtgtagtgttaggaatgtactctgaaatttagtgtcagaggttgtctgggaggcaatgagaattaagttccattcgtcctttttgagcagaaattaaaattttggatgtgtagatggtactcatttacttctaggacactagatatacatgcttatcttttttatccccacacttgaattatgttaatatttgtgtttaaattgatacacagtaaaatattcttttaaaattaagtagatgattattgagcatctaccatgtgtcaggtaatactttggcagctctatataaaatgatgagcaagacaggcatgtttctgatgttgcctacatggaggacacagacattaatggataatcagccaaagaaggtcaagtactacatttgagaggtgtgtggcctgagaagagtttgcaatagggatatctgatcaaggggagcagtcaggaagggctcagagatcagcccaggtgaactgtggtcttacagatgaggaggagttaagtggatggaggttgcttggctgacaggtagggcatgattccagccgctgtggctggtgggggttggtaggtgtcagatcccgcaagactgagccacagggagccttgacagtgtgctgctaatcagatttgtgtctgggacatggacccaaaggggagtcactgtgggtggcccacaccagttgtgaagtttttgcagaagtttaggtgagagacagggttgctggttctacagtgtgggtggtaaagttggagaattaactttgtagactttatttgaaatctgtacctttaggtcattggggagcattcatagtggctacttgtttttttttttttttttggtgaaacttcctataactttctaatacttgaaaatctaccatactttatacattccgacagtaattatgagacctaattcagctgtgtgatagccactgcctttttagcaaccaagcactaactagagaagtgctcttttattttctgagaaaagttagattgagtttgcaattctgcgagggtacaggggtggaagtgggtcttattgaatggtcttcagtaccattttggctttttttttttgagacggagttaagctctcattgcccaggctggagtgcaatggcgcggtctcagctcactgcaacctctgcctcccgagttcaagtgattctcctgcctcagcttccccagtagttgaaattacaagcatgtgccaccacacctggctaattttgtatttttagtagagacagggtttctccgtgttggtcagactggtctcgaactcccgacctcaggtgatctgcccacctcggcctcccaaagtgctgggattacaggcgtgagccaccgagcctagccctgtttaggctttttatagcctatgttcttatgagcagtaaacattatgatggtttagttagacctgttgaattgaattcacttctcctgcctgtggtcaggtatcaggtagcacagccacagaagttactgaatgtctttgttggtggactttaggagagtggtttaatttatgtggtattctatctgggattgcagcagtattgttagattgcattttgtcacagggaggaaattacctggtaactcctgattaggaacaaaatgaagcttcccctttttacaaatcctggctaacattccatttggctctcttctgttgaccacctctctctctcccctccctcctcactccattttctcagttattttattgtttactattggaagtcacctcccaactcaggatacttgttagtccattttaggaaaaatatcaccattctttcactattattctctgttgaagttgaagaacagaatattactttttttctttccattattggttacaccagctagttagagacttggggtaatactgtgggcatgggttggatcctgatatctgtgtcagttagtgagagttggttctatgaccctagagctctttgtgtccttcaaacgagggtgctgaaacaagacgaacatagaactgtctataccaagcaaaaaactcctgaaagcacatgcccactgcaggtgaattggtagcatagtgtggagataagtgggcagtgcttggtcctgtttctgcctcctagagagtacctctcagcatccagggatgctttagtaactcttagttaaaacgaaatgaactataattaattacctttcttttgggagggacacagagagtttcaacagcatctacaatgctttttttttttttttgaaaagaaaatatgatagaatattaagattgacagagctggggatgggttggaggctgaattatgatgtgtgttttctttatgcttgaattatttcataattaaaaacaaaacatataataacaaaaaaaaaaacaccctctacctctcattcacattcccctctggccatagcctctttcttgacttccttcctagcaagacttttgttaagtgttttctacacaggctgctactgcatgcttcaaaatttaaccccaagcaaatattagaaaacatattttatcttataatacttgatacctacagaataatctgtgtaacaaatgtaagttgtgaagcttaataatggagtgaacatctatgaacccaccaccaacataagtactggagcaatgtcagatccattggccggcctgtgggtttgttccctgtccaccttcccctatctttcctgccagagagaaacattctcatgccctttttaaagtagtattgtgactggcatatgtatccctaaacaatactgtatgttgtttggttttgcttgttttggaggattataaaactgatagattgttttgtgctacttgctttttcacttggtatgttattgtccatgttgttgcatgtggtgtatgttaattttctctgctgatgaataggttgtagtttatttatgcatgttccagttgatgaacctttgtgttcctcttttttggaactacaaactttcttgtatgtttctcttgatgcacatgtgtaagactttctctgtggggtatatgagtggatatctatgagtagaattgttggtttgtagagttacatgaaagtccagcatggcaggatagtgtccagttgttttttaaagattcttactgatctgcactcccacctgtagcataaaggattactattggtgcagtctactggtataaaatagaaaatgtatcccattatagtctttttttttttttttttttgaggcagggtctcacatctcactctgttgctcaggcttggagggcagttttgcaacctcggctcactgtctggtctcgactttctgggctcaagttatcctcttgcctcagcctcccgggtagcaggaccacaggcacacacatctcacccagctaatttttgtattttttgtagagaaggggtttcaccatgttgcccgggctggtctcgaacttctgagctcaagcaatttgccttccttggcttcccaaagtgctgagattataggcatgagccaccacacagggccgcattgtggtcttaatttgcatttccttgataattcggttaaacaactttgtatatatttatttcagatcattcatgtccactctgtggaatctaccccgcccccattttctattgggttatttgttttttcttattgatttctaggtgttcttgatatatttttggatgataattattagtcatacatgctgcaaataccttctcttattttgtgacttttactctctctatggtagctcttgataaagtccttaaatttaagatagtcacgtaattattttgaagggttggaaaagccttcttaccccaaggttgtacatatattctcttgtatgtttcctctgaaaaggatttgataattttgcctatcacatttaagttttccatgcagttgggattgattttgtgtggaaatccattcacacgtactgaaaagtccatcctttctccagtcattcacaatactatttctgtgatatttttagttcctgtatttgtggggtctttccttctgggccttttattctacttggttagtttggctaccttgcctcggtatcacattataataaatgttataactgtattttgttgtttgttaggtaaagcccttcctccccacttttcgtgtcccatatgtacacatttgactttgggctattgtggagcctgagttcttctacgtgaatttaaaattcagcttgtcaaggtctttgagaaccctttgaggcatttttattgaagttgcatggaaactaaagatcaattttgggagaattattatgcatttaatgattatctctactcatttatatctccattgttttaggtgtctgatatctcaaaacaattctttataattttttagctgtaatttcgtaattatagttttataattttctccatgaagttttacattttctgatgatttattcttcagtaccttatttttctgtttctattattaccagtatatttttttaattattcaaattatttgttacttgtatatagaaagtcttttttaaaatttttatttattttttatttttagagatggaatctcactctgttgcccgggctggagtgcagtggcgtgatcttagctcactgcaacctctgcctcctgggttcaagtgattctcttgcctcagcctcccaagtagctgggactacagttgcccggcaccacacctggcattcaattgatttttgtatatcaattttcatattcagccatgttgctgagctctcttattagttctaaaaatgtctttgtgttttccttagagttttttctgtagatctgtcacatcatgtgtgactcaagacaattttattgttttttcctttcaaaccccaatacttggcctttttttttttttgtctttactgtgctatatatgaccttaagtacactgttaaataggaatggcaatactgattatcttgtcttattcctgattttcaccatgaatagtgatgttgatgttgatagatacttgattaagaaagtttcattctattcatatttcatgaagagtttttatcatgaacaggtattgaattttatcaaatactttttctacataaaattaaatgatgacttctttatttcctttaatctgttaatgtcgtgagtgacatccgtatattttcctgtggtaagccacctttgcattttgtggatgaaattaatgatgtagcttcattactcttttaaaaatattgtcctggactcaatttcaaatattttcttcagtatttttacatctatgcttacaagtaagattggcatataatatttttttcctcctactttctaagtctagttttgtctacaaagttagaataaggaagtgttctcactctgtattctctggaatagtcttaaataaggatgaaacaatctgttctttgaaattaggtcaaacttatctgtaaaattggtcctagtataagaagattttaagccactgatataatttttaaatataataatattgagagtgagagctttactttttctgcagatactttaacaattaaatatatatataaacttatatggatgtgtgtgtgtatagatgtgtgtgttgtatacatatatatgtaatatatgtcagttttctctctatttcatttacattttaaaatttattaccataaagttatacaaaggtattctcttagctttttaatctctgctgactccataattttcatttttcattcataactttatttatgtattccttctttttttcatgatcaagctaatttgaagtttttcttatttattactcttttcaaaccaacttttggctttgtggattatttttcttgtgtgttttctacttcattaatttttaatctttgttatttcctgctttctatgtacttaggcttattattctgtttttttttttttctaaatagagttgactacttagtgcactaatttatcataatttctttttataatataagaatttaaggcaatataataccctctgatgactgtggtgactgtattacataggttttaatttattacattttcatcatcttataagtattttaatatttacagtatgatttcttctttgatacttgcaatattttttggtgccttcaaaattttacaaatgaatgtattacttatctttttattattgacctctattacaatttaattgttgtcagagaactattctgtatggcaacagttctttgatatttgttgaggcttgctttgttgccaattttgtgaatcagttttaaaagttccattgtgtgcttcagaagaatgtgtactctatgaattcagggatctatatgtgtccagaaattaaagcttgttgattgtgtccttttttttttttgagatggagtctcgctctgtctcccaggctggagtgcagtggcgcgatctcggctcactgcaacctcagcctcctgggttcatgcaattctccttcctcagcctcccaagtagctgggattacaggcgtgtgccaacacacccagctaatttttgtattttcagtagagactgggtttcaccatgttggccaggctggtcttgaactcctgacctcaagtgatccacccacctctgttgattgtgtcttaaagtcatctctacatttgctaatattcgaaatctgcctgacatatttgttattgagaaaagtagattgaaataatttgctatgatgatgaatttataaatttttccctgtatttctattttgactttatacatattgaaattatattattacatgcattcattttaagaattactatattttcctggttaattaaaccctttattcagtttgtatgtggctattctctttctgcccttttatcttaaactctgttttgtctgatattggtataattattgcacttcccttttgtgtagtatttgtctatatatctgttttttaattttttgttttcagttattccatgttgctatgttttaaatatgcagagtggcattttatttttcttagtattctgatggttttattctactgttttctgaatttccctgtggctcataagaagttcagtatctttctgattgccattcttttctagtagatctacccttttccctgactgttttttggcatttagcagttttactgtaatgtatctatttgtgaattttaaaattctatttggtctacattgttcttcatgcatctgtggcttcatgtctccctccaattcagaaaaattatcagcttttatttccttaaatattctgactcctttattcattctgttctcttctttggggattccgattacatgtgtgcttgaccttcttttctgtccttcattctcttaacttttctctcatattttcagtccccttgtatctgctgcattctgggtaatttctttagacccatcttccagtttacaaattctcccttcaggtttctctaacgtgttatctaatgcaatgattaattttttttatttcattgcttactttttcatttctaaaagttccatttggttctctctaaattatgcctactaatttttaaatactttcttatttcttgttcatttttgtgattctgtctttaagttcttcttgtatttatgacagtttttgtattatatgtatttatttatgtgtataaatttatagggtacaagtacaaaacgtgacatgcatagattgtgcagtggtcaagtcaggactacattgtacccattaagtaatttcttagccacccgcctcctgcccctctacctttccggatctccgttgtctctctgcccactgatagactacatccatgtctatacatttttatttttattttatttttatttattttttagtttttgaggcagaatctcgctctgtcgcccaggctggagtgcagtggcatgatcttggctcactgcatgctccgcctccctggttcacaccattctcctgcctcagcctcccgagtagctgggactacaggcacccgtcaccacgccgggctaatttttttttttttttttttgtatttttagtagagatggggtttcactgtgttagccaggatggtctcgatctcctgacctcgtgatcgcctgcctcagcctcccaaactgctgtgattacaggcgtgagccaccgtatctggccatccatgtctatacattttttagcacccacttatgagtgagaacatgtaatatttgcctttctatgtctggtttgtttcacctaagatagtgacctccagtttcatccatgttactacaaaagacatcattttattctggttttttttttggcttcatagtattccattgtgtatatatgctacattttctttaataattgtaaaatagactatgcaattttatagatattttctaacaaatccaatgcttaaattccatgggcttgaggtagtcttgttatttctactaaccctcacttaagcttctttgttttgcttttgtgagatgcttatgaattcacatctggtgggtattgaatctatgaaaatctgggagtctaaagtgagaatactttctccagagaggaattgcttttgcttcatagtctctttcctactctgggagtcctagtcttcttatcacagtgctgatactggcatttgctctcagagcatccctgcttcttgtgcctacctttcagtattgaaaactcaagttttgttttattttttggtgctttcaagatttccttatttcttgcatttatacttttggagaattttttttttttttaatgttgaacattggttgttttgtagtgtgagaggccttgggtgtattgtcatacttttggaagcagaattctgatttactctttaacccttttcagtctgacttctgtcaccatttattccaatgaaactagttgtgctaagattacctataactcccattcttcccagcaactttagagaaaatgttctttttaaaaaaatggaaactctgtgcttctagattctgcacaacacagtttcctctcctagtgttctttctgcctctcttttgttggaagaggaaatgttggggatcttacctgggctttctttttctcttctattgagaggcagtttggtgcagtgcctcaatctggaatcagactgagttgttatcatctggttattagcaatatgaccttgttttctcactgtaaaatggatagaaatagggttgttgggagaattcattaacataacacttgccatgcactcagcccatttctaacacatagtaggcatccagtacatgtctacttttattctctggtacattatcttcttaagtcatctcttgtttccaagatgacagctcacgtatatattgctccagtatgatctgtgcatctcagagtcagtttgtagagccatctgtatgttatatttgattttcttctgtctccttaatgtataccttccctaggcttctgcatataggaaatgacactgccatgcacctagatgattaaaccagttccggacactttgaccttatcatttgtgttaccatctcacatgataattgtgagttgtgctctccacatctgctttcaccagttgagttcaagacaccatcatttcttgcctggtctactctagtagcctcctaagtactttctgcactttgacttcttccctgttgaatccatatttcacagcaaccagagtgattttttaaataagaaagtcaaacagagcatgctttctcccagcttcaatgtttttctcatagtgcctagaataacttctgttctccttaatatggacttgaggtacctctacaacctcatttggtttccttctgctgctgtatactgtttggctacattgggattcttctaggctttggactttgtcaagctttttcttgattcagggcctttgcacatgcagtagaacacatcttctctcactctgcgtggctgattccattcagagctcatctgaaatgccactttctcacggcgactttcttttatttcctagtttaatcaagactctttggttcagtgcgtgctgaatttgcttaataaatgattccataaacatacatattttgaatagaatctgctgattaataggaatgatagttctgtgagatcatgctcattttaaatttagtcatagtgtcattggaaaccactacatgtcttttctattcatttaatgaattttcaaggtcataaaaatttctgatgatattataatttttgcatttgcaaatacactttgcatagtatttattgctggataaaatattggcccaaatcaggggttggagaactgacattcactgagcaccatatgtcacgttctcttaccttaatatcgtatgttaggccctgaaatctagttatccccgagtcactgaagaggagctgagattcagagattcccctaggctggccaaggccataccttgtggagggcacagcctaagtttagtccaggagtttgaactctaaggagagaactctttccatatctgctgccttatttcttctctaagcaaactccttaagttcacaaagttctttcatgtgtattactcataatatgtatgtcaagttctagagagtgcagggcatttttgacattttattttggatcaagctttcattcactaattttttatttttctgagcatccctttgaggtccttgaattcacggatgagaaaaattaaacaatcagtgattaagtggactctctgtgaagttacacaatggaatattaaattgttgatggatattttttattagccagagaaagaaaaaacgcagactttttttttttttttttttttgagacagggtctcactctgttgcctgggatggagtgcagtggtgtgatcacggctcactgaggcctcaatctcctggtctcaggtgatcctcccacctcaacctcccaactagctggaaccacaggagtgcaccaccacagctggctgatttttgtattattgtaaagacagggtttcagcatgttgcccaggctggtccgtaactcgtaggctcaagtgatctgcctgcctcggcctcccaaagtgttggaattacaggtgtgagctactgtgtctggcccaaagcattttttattccagtagttgtgtcagtctgttttctttctatgtatgtatgtataatttatgtatctatgtatctgcctgtctatctacctatctctggttaaatatgttttagaaaaaatgtaactagcacaactaggcctggacttatagatattatttatggtagaaggctaagttgtttatttttttaagttaattatttataaagaaaaatattaaccatatacaagtacatttagtacttagttatggcaaaaatcaagaaggtgaaatagatatggaaaatgtgattgggtgagttggttttattggactggtagggtgtgcccttggccaaaccaaaggccagagggtacaaggaagtcagggggacacactgctggggagatagagagggggctgcccagttgtgaggggaactaacttcttgtccagaacttccctagggccttccctggctcttgccttctttgctgtatattttggttactggcaggacactggttcaaatatacatttccgtggtttgattttataaagctaaaaaagcctcatgctaatattcagtctcttatgttatgaatgttaccattttacctcttagctatataggtatctataaaggacattttttaaaaatgaaaatcatccttcctcagtaaagaactagagaataaacatgtttctgaaagtagaatgatgtggactagagcaggggtcggcaaactttctctgagaggggccaaatggtaaatctttctggctttgtaaccacagactctctgttgcaaatactaaattctgctgttgtagcatgaagccagttatagacagcaaagaaaccaatgagcattactgtattttaataaaactttatttgcaaaacagacagtagttgtattttgcccaggggactgtagtttgtagacccctagatgaaagaaatgtatcttagggcctcccctcttagccctttccatcatcagcaatgtgatcttggacaatatactttaagtcttaatgaatttattcatttgaaaaactgacattttattttagatcaggcttttcattcactaattttttattgctctggacatcactttgaggtcctggaatttacagatgagaaaaattaaacaatgaatgaggacagttttcttgtatgagggatttttgttttcttcatatttttaatgtgtttaatatactggagtgagcatgtcttattcttgttaacagacaagctatctaaaaattaaaacacaaactaaaagtagaggaagattgttatgagaaacatgtcatgtatgtgaaatacattttataaggaatagattagattctttatggaaccaggatgggtataaatacatcactagataaatattaagtaggaagatcattatggacaaagattgtttcttaggaattttgcatcgtatagcactgtgttagacagagtccttaactgattatttttgtagcatttgtttacacattcacttattaattaattttgccaatgtattgagccatctatggagatgtgtggaggtctgtgttgaaagcttgagatagaaaaaatgagaaataaaatagttttggatctcgaggcactcacattgaaggagataaacatgtatataaaatattatcctattgtatgataagttctcaattagaagcatgtatgtatagggcaccactaggaaatctgtatcattggagtagagggaagctaggcaagagacctgcacagagtttgagcagttgggtcttgaaggatgagtagggattcttagacaaaagaagattgaaaggcagcttgagctgagggaaatgtctgtgcaattgtgaactttacaaatcataggtagttctgtaagattataactggagtcatgaagacaggtgaaggatgggatactcaaagtttggctagggccatgcaatgaaagccagggaatttgaacatattcagaaccatggaatgctttgggaatctaatgaaagatatgatacatttctataggaaaatcatcttacataaaaatttcaatattttgctacagttttaggaataaggatgtagtgatcactttatgaacagtacagactttttatatggttcccttctgaaaaaaaaaaggagttcacagatagacacatacttcatcatcctgcttgatggtggcagcaaatgctctggatgcacttatgtgaagtttatcatgactttattacttaagagcctgggagtatatgagattgtgccatactgttatttataatttcctcaaagagatggctaggcatgatcagagaagccttcttactggtagatgtccacatatgtcagttgcctaggcatgatcagagaagccttcttactggtagatgtccacatatgtcagttgcctaaatgctggagaagtcacgtggcttcggatagaatttcctcatttgtaagatggtgctcctcaaaggacctacctgccattagagtggtaaggattgaattaactcttctgatgacagcactgagccctaaatttagcacatactaagagctcaataaatgttagcagttaatacccttattagaattatgaaaagtcggtaatttcattcatgtatgttcatatatggagtgctcacaaatacttgaattcttttattgaacatgtgagttagtcttgcattacgcactgcatatatgtccatgtatttctggatcatcatgggtcatttgtttggaataaaacttcatttacggaaatcgtctgtacagccctggttaattttttctctgtgatgggttgcattacatattttctatataaaacagcaatggtgaagataagttaactaatgaatatatattattatgtgcttttattttacagcttctaatattcagtggggaaatttttcttgttaagagacaatggcaaggccagttggcctaaaattagatccagcagctgtgttttgaatcaaggccccacatgtgcactttatactccccaccccctgcgctgggcttgtctgcttctttttcttgcttcaggaggcagcatttttgggtgaatgttaacattcatgtttttcctagtacaaccagaaaggtgcttctgtttaattgtaaggcaggtttatttacatttacggaatggaaaaaaagatttatttaattattaattttacaaaaccaccctttagcaccaagcataaaactttggagcccaaatcaaggcactaggtcacttataatttgatttctaccaaaataagtttttttttttttaaagaaaaaaccctatgataatttttaacatttttgacagctacaagtaatttaagttgtgttttatcagtttatattcagaagccaatgttaactggtgttaattttataggtcctagtttctttgtatttcttgccctactgtttggttaataaaccttttttaaagaatatattcatgtacacacaacattatcatgattcggtttaagtatccgtgtttataagtgcacttcatttcacctaattatgttatttattcatttacacattagcaacgtactacatattccacttttacaggaacttattttaattatacctacagttctgttctgctccattatatcatagatcaagctgaataatagcagtcttaaaaggcatatgctaaaagtgattatgggtcattaaggccaaattaaggtaacatttctgatagccacaagcagaagtctaacttacaattacttttttttttttttttttgctttggggaacgtgttctagttggctttgatgttgacggtctcatggttgaatgcctagtgggtgtatggattgatccttgatcagactgatttttttttttttttttaggggggagatatatacaaaccatactttttatttatccagaaatctgtatttatccagaaatagtctattcaatgactttactgccatatttctcaaaatgtatgctttttctttagccctctctcttcctgcctgccattaagagtcacacaggcaaccaatctccccatctaggaaagtgagtactagaatgcattaaagtcacttttttattgatcattagcataaagcctcattgtgccattggagagtgacctaaataagtatatcacatcctttcaaagagaaatgccccatggaaaccatacctaaaaacgataacaataactaacagaatctgcgttttaatgagttgatttttaattcttgtttcgattggcccaatgtaatctattaagaaattaaagggcatctttcaagcttatccatatacttttataatcaggatgtgtgactctagtgttgttaattttatttttgagaaatacttagattttgtatgggcataagtaattcaaaattattttgttgattttatagacattttactagggagatccattgttgttacttattttctagtttcataattgctgattaaaattaataagattcaaatgggaaaatgacagtagaaatattccaatttagagttcttagtaggttggcttactttttgctggatttatgatgattttcctacatactcagatttggaagatacagcatcataaaataaactgtagtttatatggaacctctacattttggttggagatacaagtttctactggctcagaaattttttcttttagtttttgattttttttagagacagtctcaccctgttgccagactggagtacagtagtaggatcctagctcactgcagcctcgaactcctgggctcaagtgatcctcctaccgccgcctgctgagtatctgggaatacaggtgtatgccaccatgcccagctagtttttcatttttaaactttttgtagaaattgaatcaaactatgttgcccaggctggtctggaactcctggcctcaagtgatcctcccaccttggtctccccaagttctggcatttaaagaactcagcccagctcatgtaatttttaaatattcccactccatgtgattacttcagtctggacatgtcagactgaactgtcatttcagtttacatgtcaatttgtctttcatgtaaaaagggggaaaataggaatatatgcttatattttgttgtatctgcatttaaaaaaacacaagaaaccaaagtggttacctgagtaggggtggggaaggcagtaaagaatagtgtgatggggatgagacttccaaatagataactttttgtattattttgacccttgaaccatgtgaatgtattttctctaaatatatttagatttgtttttgaacaagaaaaaaattgatagcagctatgaacatttttttctttttttcattttcctccttgatataagttacattttaattgtcttttggattgttttcttcagaattttaatcataaaataaatgaaataaataaatgcaatcatcattccattcctatcagtaatttctattagtgtggctttttctgtgtttgtttttgtcatttagagatggcatctccctatattacccaggctggactccagctccagggctccagtgatcctcttgtgtcagcttcctgagtagctgagactacaggtgtacactactgctccctactttgtgtgtgtgtgtctgtgtctgtgtctgtgtgtctgtgtgtctgtgtgtttgcattagtttatgggcaactagaacacgttagatgcttttaagcatcgatttggataaagaagcagtattaaaaatccaactgatgccatacttcatggaagaaaatcattgcattaaacaggaattacacataccgatatgaattagttgatccaatggtcctttgaaatggaagttacatttttaggagatgggtatagcaaaagcagaggtgtttttggatgatgagcaataaatagggggttgttcctagattcccagagacttacataaagttgggaatgggagaagtaagtgatggggacaagctaaattttaaattactcttaaagtactttgtttagattatattaacctgtcaatgtgactaaaatgtcaacagaattctcttaagttttacagatttgtagatgctaaatgctcatgaactgaactgaataacagtaatgaggtatgatgatttggtaattttattttaattagcaacatgagtaactttaacctttatttaagaaaataaaggtaatatacacatgtgtatttattatacaatgggaaaagttccctttgaaattctccatgtggtttggtgtattggcttatgcctgtaattccagtactttgggaggccaaggcaggtggatagcttgagcccaggagtttgagaccagcctgggtgacatggtgaaaccccatctctattttaaaaagaaagaaagaaagaaattctcagtgcaacagtctttaaatcatgaaactgttcagttggagaatttgcatttgcttattgatagctgcatatctactattgtgaatttaatatcttatttatttacatttatgaatataatactattgagaaattaggctctattctttttacagtggcatttttactgattgatctagtctcatcaaatataactgagatgtggaagccattatcatagttcttaaacactattgctcttgagcaggggatgtgagatacagagcattgtggaaaaaaatgctattctggaaaaccactcactcctttgaaagtcaaagagaataaacaatgtggaatttgaaaaaaaaatcacactgaaagataaaggtatataagctcacttaactattaatgatacaaattaatctgcaaagaattaaaagcagctttgttaatggcagaagacacatgcagttaataaggacattacttctcatttggggttagattggcttctcctttattaatatctgtttaaactacaaatagaaagaactccattcttaccagacttcttgtcacaagacccagtctctaaagagaaatatcattgataggaaaccagaaagactaaatagatgtatttggtctcacaggcagtccattaatttgctcaaattaaatattatctttaaatattgaaaggttaaatgtacaccgataatggatttagacagctattaagctgtaattgctttctaatgcagttactaaaagacatttgatataacatattgagaaggaaggattagagacttctctacctcagttttaactgagagttttatggctttaattctggcagttgtaggaattggataacaacagtttttatgagaacgcacacaatatgcataaaatattcagtgggcagattgttgagggaatgcattatgtacagtgtatttatgttcatagtttttgcaaatctgtaccagcagtactatcagatcaactattcaccctaaatatttttctattagatctaaaagtcgtatttctgaaaatgttaccattttatggtttcgacccctctaagctgaattaatgtgttttgtgccctggatatatggttacagtagtgaccaaattaatttgaaaacttctcagtctgttggagagtcacatctagttcaggtagtcaaactgatggctttccctgcctgggtaggcagctttctttttagtattcgcattgtttgaatttgtagtatgagattttcacatttttacaggttgcattttgtgagttgagtgtctagctgtgacaaattattgttaacctaagaacatatgctgattgatacagtcagccacttgcctccagagttcaatggaaggacaaaaaatttttggaaaagaaatatgaatgagagctaggctcttcaaaacatattttcctggtgaattatttaaacataatctaagtatgagtatgggtcaggaaaaaaaattacctgcagttaagatatcaagccaaagtattttttgaattgaataaagaaagggaaggaaaaagcctgctgttgatccctgtcactcatgtttttgtattaataggcagcatctgctatttgttctattaatgttttatattaacattttcatttagtttcctttttaaaatggtgaagttacagaattcactttggtttcacaaacctttatggagaaataaatgcatatgaagatctgttctggggcctggggaagatgtttaaattccaggtgatgccagggccactgcatggcaccccctggggttgtacatgcacattgtatatggcagccgcttgcttccttcaaagaagagtgtgataatatctgtgctttctgttgaactttcagagtacttccacagatatgtttttaatacttttaaatcctcagaaataatttgattatttcagttttatacatgagaagtcatgttcagaggagtacacacgaatataaggcagaaaataaaaaatataagaatttcatggattacaaagaaataaaccactacttccattcactgtaaaccagagaagaatatatagggaagttagaattcagtgtgtacccttattaataaaactagtgttttattaataaactataataaactagtgtttattaataaattaaattttttcaaattttttctgctttctcaatagatgctctattttctcccctcctcctattccaccctaaaattaaaagagaaaatacatttctaaattttactgagatagttaagcacagaatggaatggcattacccataagagtctaatatataatgtttataatcctttaaaagtagaattagggttctgtcatctcaatatactatgctgactttgagatttcttttagtcattaaatctgttctgcaaatcttttttaaaaaaattatgagtgactttatgttttgttttagataattttatcactaccatctaactaatttttctttatgtattttcaaaaatttaataatgaatatgattgcaatatgctttgagaccaggatagatgcttgcttgtttttttcttttcctttagactatcatcttttacatacctttctctttctcttaaagtaagtggaaaaattggattcattgaattggtcttgatactatctagggttataacatcctaatattctgtgagtcttattttaggacttgcatatttaatacagtttttaagtctttgatctcctaaatatgcttatagcagccgctaccttcaccacacccaaatccttgaatgttatgatacatcatactactcatgctggatatttactgatctgctgtgttcaagacagactgctgagcttcgtaaactttaccacccaaactaaagacagagagtaaatacataaacacagggagttggggacttggctgaaaattgccacccaaagcttgaaatttatttgcatgctggaacaaagaatatccatgaacttgaaactcaggatgacgtatgtttgatgtttatcctgtatcattatgtattctagggcaccacttctgtatacccagatggaaatcccaattttaaagcaatgctcttgggtattgaggggtatatttgcgaagtcacagtcatcatttattccatgttcccttgccttcttttctgtcaagtactctgagagtcttgatgttgaggatttattggaagcaaacgttgttacctaaatgaagtctagtgaacaaaaccaccaaaagaggacatgaagtgactgctatgtatgtatatatgatatatttttcctcagaattatctaagtgctttggttggttgcaaatgtggaattttgctgtttgtctctaagtcactcttatagaaatgatctgtgtgtgtgataccataggatgtgcttccactgggctcctgagcagtgggaatatatacctgaaacagtatgtgacacttctgtgctttttctccctctgtggtttctgttcttcctataatgtacgcaagtgcaaatatgagcagtgagcgagtagagagaaaaccctgtaagttttgtgctctactttaggtgtatgtgattgcttctcttgctgtgccattcatttctgatttaaatgtctaatgactctcatcaaacaacatttaaactttctatgagatcctgtaaatgttcctttagatcatattatgagtaacaatggatgaaacgagctttaatggggaggctgcggttcagtccgggggttctgcagctgttggtgatggcagaacacgtcaattgaactgcagccatgcgttcagtggcattttgcccattaagcgatgtataaaaacagtattcctggtacagttacatttcatttctgcagcgttttcacagtcagcactggtgtgtcccgtggcctggccttttctcctcttggcgactgaaaaaataaaagcccagtgctttaaggtggtgttgcttaagcatgaatgaaatcactcaaaaaatgtcttcttagcattgaaaaaattggtcacaagtcagtaattaattcattttagagtaagttcatcttggggctgacaaagaggtgtagtagctaattttaaaagatgagtgtaacatctttcccatgtcatacatgtcaagattaaacttaaattatgtattatatattaatgaccttaattttattcataaactactgtaagtacaacagaaatcaatttagttctatttcagccatcatttctgggtgtgaacttctagtttctataaggaataaagagataggcatgaactagtacctgacctcatgaagcatacactgtagttggagacgtatagaccaaaagcaatcctagatggaatgggatatttgaatgagctaaatagaggattgctttgcacttagagaaccttcagtaaatgagtgttgaaagaaagtgtgttcaagagttacctttgaattttagatatttatatgtcactgtggacttcctgggagctgactgaaaatggtgattgtcattgtcatttgacattttttagtctaccagtctggggcctaattcagcattgaaaatagtttttcctgttttaccagaaaaagtagaagccaggagtttgtttttctctcttttccttgtgctcttttaaatcttatttccctcacagttgagcaggaggaggaaaaaaaaagtcctatttccttcatcttattttccactaggcttttgaggaggacgagatattctgaagcatatttgaaataaattgaggaccgtaacttggcaagtatgaggtgcaggaataatccatgtgcaggagagacggtgaaagattactcagaggtacagagccatggagagtcggaaggaacactggaagtttctcgtggagatggaaacctgagaacttgactgtggttaggacaggttggaggagtcctgggtggtgctgaagaggctcggttccggagtcaggccgttgaggttgaagcctggctctgccattcgctaacattgtgaccttggaaaagcttacctacctctctgagtctcagtttgctcatctgtaaaatggcaagagtgtccacttcatggatttgcgaggagtaaataagctagtccgtgtaaagtgatgcatacagaaagcaccagaagtattagctgtgattgattgcaggagccacagcatgcagcaggagaatgatttttgaggtgtttgaagaataatatgtaaagagggctgggtgatatgactcacgcctgtaatcccagcactttgggaggctgaggtgggcagatcacttgaggccaggagttggagaccagtctggataacatggcgaaaatgccatctctactaaaagtacaaaaattagccaggcttggtgctgggtgcctgtaatcccagctactcgggaggctgaggcaggagaattgcttgaacctgggagacggaggttgcagtgagccaagatcgcgccactgcactccagcctgggctacagagtgagacttcgtgtcatagaaaaaaaaaaagaataacatgaggatgtgtttggtgttggcattttggtcacattgaagcagggagggaatggacatttctttcagaaccatgcagccctaaacgttaaacagagaggtttttggggataagtgttaagattttgatgtggatattttagaaggttgggcgtaacagctgattcaacccttttttatcaccatcaatgaaaagggctacataaagatttaagaagaggaggacattcttttctccacagctggtcatgcgcccagtgtagttggcaggaaaacggattgtttggaatgtgtccctaaaatcctgtaatttaattttcattatttatataacgcagtccgtatatgtggcgctgtactacatgcacacaagaccaaatttctggccagtgtaattttaccaaagaagagactgtaactgaaatatttgtacctactaaattatctgcagcttggtaactcaccgttagggagtccatgtgatcccaatcagcaacagggattggaggaacgcattgttggcagtgaaataaggggtcaggaactagaataaatagtgctgggatggtaaacgggcccatgttatactaaatgtaatataaagtcactgactttgaggagtccagaaaaataagtttgtaaatattgacattaaagtagcaaccagtttgcatgctactatgtaaaaggaaactattaaaataattattatacgtagttttttgcttgcagcacttgtttcattctgttcacttttagaaacacaaattagaaaggagtgagtctcttgatgtgtgtctaagagaagttagagtaagatttctagaaatcacgagatatataacttggatagtttatagttttctacaagtgtttcatgttaaaagttcctacattaatggtccttcaatgaatagtatttacctctggaatccaggagatatatccacagttaccgtattggtcatgctaggcaagggcatgatttattggacttgatattatctgtatatagttcttgcttttcaaaacagtcatctggaccgggagtaagctaataaggccatgcactgcataatggcgtttcggtcagtggtggactgcatgtaccactttggtcccataagactataatggagctgaaaaattcctatctatatttcttatcattatttagagtgtactcattctacttccaggaaaaaaaaaaagttaactgtaaacagcctcaggcaggtccttcaggagggattccagaagaaggctttgttatcataggagatgacagcaccatgctgttgttgcccctgacagcgccatgctgttgttgtccagtgagacaaggtgtggaagactgatattgatgacccagaccctatgtaggcctagactaatgtatgcatttgcatctttgtttgtgacaagaagtttaaaaaatagtaaaaaaagcttataaaataaggatgtaaagaaaaatgttttgtgcagctatatagtatgttttgttttcagctaagtgttattacaaaagagtcaaaaagttttacaagagttaagaagcttataaggtaaaaaagttagagtaagctaaggtcaatttttttttttttattaaagcaagaaaaatcttttttctgtttttgagacagggtcactctgtcacccaggctggagtgcagtggtgcgatcttggcttactgcagcctccgcctcctgggctcaggtgatcttcctccctcagccttctgagtagctggaaccacaggtgcgtgccatcacgtgcagctaatttttgcattttttgtggtgacggggttttgccgtgttactcaagctggtcttagactcctgagctcaagtgatccacctgccttgacctcctaaagtgctgagattacaggtgtgaaccaccatgcctgtccaaagaaagaaaaataagaaaaaaaaaattcaatgtatccttaatgtacaatgttgataaagtctacggtagtgtacaagaatgtcctaggcctttgcattcactcaccattcactcatgactcacctaaagcaacttcttgtcctgcaagctccattcatggcaagtgccctatataggtgtacaatcttttatcttttatactatattttaaatgtacctttttgtatgtttggatatgctcagatacacaaataccattgtgatacccttgcctgtggctatttagtacaataacatgctgtgcaggtttgtagccttggagcaataggctatgccatatagcctaggtgtatagcaggctacaccatctaggtttgtgtaggtacactctataatgttctcacaatgacgaaatcacctaatgtatttctcagaatgtatccacatcagtaagtaacacataactaatttattgcaaggggcagaatgtaaaccattggtttagtagttttagattgagttaaaaaaaaaagatatccttgaggttagtgagaggaatcaaaatcaggggacagtgtaggcatttggggtcaaaatttattcagcatatgctagcatgccaccaggaaccagaaggaataaattattctgactccattcttggcaagatctgtgtggctacagaacgtaattattttgcaaatcatttaagttgctgaccacagctaggagattaccacctaagtgaagattaccacctagatggagtgtgattcctccctgggattccctttcagaattgtcagaaaacaaagcagtaaatccacatgttaatcattaaaataaacgaagtgcaatatgcccagcaaatcatttcacacattttctatttcaaggaattgggattcaaatcttaacctaaattttacatattcacattttaaagcatcactcagacttgttcagattactgagcggagtaagggtttcatctgaacacatagaagctggctgcgttcttgaaatggggaggatggggttggtgaggtcacaaaacttcttttcagctccctggttgcaaagaatatgagtgctatgacattagatgggaattcaagttctggtctaaattgataaaatagagttgttattttatggcctcatctttgtttttatatatcacagaatcactgcgaaaatggcagtttgttttctaaagaggcctgagaccagagcagcaggtcacaaagcgagcattttacagcgttgtcagtcagcctatttggctgaactgaatttcccagggcaaaagttttcttacaacgtttcaaacaattcatcaaaaagatggcctaggaagtattaaatgtcttacaatgtaaatatagacaaggctttattaggaaagtgtgcacctgtttatttattgacttatttattataatagcctttcaagtagttttcttgatccttacactcttcacacaatgagtgtaaatagacaccagtcatagttgtaggtggtgagctacagagctctgtattgattagatcttcaggctgtcaaaacaactagaaattttaataaatgttttcaaacaagtgaccagttccatctaacccatcagaatgttttattgtaaatataacatggctgtcagtttgacagaaattgtcttcccagaataatttatagtgtgatttcaaaatgcatccagtcacaggcttttaggaatcctgtcatagaatattattttatgccatcatgttttaaaaagacacagtgataacattgaataggaatagtgcaatgacactgaagtgcagttttagatgggaggggaagtcttccttgcttcagcaaatcaggtgtttgaagtttaaaaactgcttaagtggatttgtagtaaagctctgtctgttttaaagtactggtgactcaacagctgtggggaatctgtctggaatcggcgcggaactttggagaatgttttctcctcaggagctggaactcaactcttcctcagcccacacaatgcaggatctgtggttttctgtccctgtttctttttctccatttttctccccttcacttactctgattgatggaaacacgtgctgggagctttccctgacattctttccaaagactgaaagtaagaaatgttatggtggtgctatgtctatttttgaaagtaagtctgttaacgtaaagcctgtgttgatatattgggatgaattataatggtgatattattacagccttcaaagctgaaaatttattatttttctcacctacttttggttgctgatacttgatcataggaacatgctgtgcatctggttaattttggggaacccatttgtagattttcaaaagttaaactttatccttctttatatcttctccaggccctcttttgttattgaaaaacaaatagaaatacaatccactacaacttcggtgcttctgcttttctggtcactctcattattaatgcttataatgaagatatttttggaaacactgacttatcattggttttgcaaatacagtaaaaataatattgtttgttggaactcttcattatgattcttttacttttaaatatttaattcataattattcttgtttctacatctgtattttaatttttatttgtttttatttagttttaaagacagggtctctctctgttgcccaggctggagtgcagaggcatcatcatagctcactgcagcctgaaatttccaggttcaagccatcctcccacctcagcctcctgagtcgctgggactacaggcccgtgccaccaagactggctgatttaaaaaattttttttgtggagacgaggtctcactttgttacggaggctggtctcttactcctgggctcaaatcattctcctgcctcggcctcccaaagtgctgagatttacaggcatgagccactggaccctgcacttacgtctctattttcaaatgttaaatgtctttatgtataggaggtcatgttggattttaaaagtcaacagaaattgataggaagcagtgtgcagccctgaatgaaactcttaagttatgggggaaaaaaataccagaacctatgagtgaaattattttttaaaatctcgtcttgctggtagacaggttttttagagacagggaccgcatcttctttaatctttgctgtatcccttgttcccagcatattgtctggcacagagtatttaatacattaagtgggtgaataaaaaagtgaatggcgccgggcgtggtgtctcacgcctgtaatcccagcactttgggaggccgaggcaggcagattacctgaggtcaggagttcaagaccagcctggccaacatggcaaaaccctgtctctactgaaaaatacaaaaattagccaggtgtggtggtgggcacctgtaatcccagctacttgggaggctgaggtaggagaattgcttgaacccgggaggcagaggttgcagtgagctgagatcccgccactgcactccagcctgagtaacatggtgagacagtgtctcaaaaaaacaaaaacaaaacaaaacaaaaaaaaccccagaccaaacaataacaaccaaaacaagtgaatgggataacttggtgctgagtttaagagccaaggttcatttccttggtacctgttgcttgactagaagacaaatctgtcgtaaatgatcaaaaaaatgtttacatagacggatgtggaggagaattttatgtatgcatacacacagaatactaagtggcattttttatgtgacagattcatttccatgcatattccatattgtaagtcagtcttcacaactgttttgtgaagtagcagatccctgttttgcagatgaggcaactgatgcatacataggttaggttcacttttccaaagtcctagagtttttatttggctgagccaggatttgaatgtcagcactttagtctctttctagagtttctgtgtgcaatcactactgtctattacctctagcagtttatcacatgcacaattgttcgtaacacctggctgtgcatgatgtacatctacaggtagacacttcatgtacttgctgtggtagtactctagaaacactggtaagttcacatgttatcaaagaaactcctgtatccgctctccgagtgctgatctggtcattttctgcttgatgacgccagtcttttgagttaactcgtaggtgtgcatgttggtttctttaaagtgttagattatgaaccatagggcagcaggtgattaatttctgcatcataagaattcagctactgtttttaggaatttgcttacaaaccatcaagtttgcttattcttacagagttttgtctttatttgtggtattgtaatatataatagttagtatctgaccccaagagccttacaatgaggccacgaagacaaacagaatttcgagaagtcagaatgaagaatggtcctcaaaagagaaaggatagaatcttggggttttattcttgtgagggatgttagaaatgatcttatctctaagtaatggggagagaacttagcaaaatccttaaagagcaggggagtccactttagtgtgagttatttaacttctctgtgatttgtttacctttcttcaaaaatggaatgataatgatactcagccccctagtatgttgtgaggattgaatgagggaataaacatacatggagtacttaaaacagctcttgcacacaggaagtgcataacaaatattatcattgaaattatcattttacaattgaggaaattgaatcccagagaaattaaattacttactcaaggctaatccagctagctaatgactgagccagggctggaatcttgacatacatgtcgtcagcactcttgtaatattcaacagaattactgtaaagcaatcctctatttgacaagtaataatacataatctctgcatttacttgggatgctgaatatatactgaacttcttgctgttctttattttttcttctgggaactatatattgggtgattcttttaaaaaatgtggttatatgccaacattatgggaaaggaaaaaaaaacttaccagacttttcttccatacataatccaaatttcaaatgtattaattttgccgaatgccatggcaacatacatatctgtttttcagttcatgaaaggtattttgggaattattggctcatgcatgcttgagcgttttcgtctttcagctatagaaatacactatgtatcctcttcattttgtgtttgtgcttctattcaagatgagaataaaagcagttagtttctgggttgtaatattcttcagtgaacggtggctttctaaaacagttacaccttgactgaaatgaaaactctgctgtatcataaaagatattctaattactgcatctagttaaaaggagaataaatcactgggagattattttaagtgccttaaatataataaaaaagaataatggacgttgaacagcttgacaggtttgatgaatgcagactatggctgatttctgctgctttctaatggaaaaggagagcattttactttctaggtgtattgtcaaagcaaatttttgttagggaagataaggagaagccttatctttgttgagcacttgccttgtaccaggcattagccaaggcagtgtattatctcatttaatttcatttaatcctccccaaccttgtagataatgttatccccattttgcatctaagaaaaatgaggctcagagaatttgaataacttgcctcagggtatatagctgcaaagtaggatccagactaggttctttctctttatttcattaccccagtagggttgtgatgatgatgtaaatataaatgtaaatataattgtctccactgttacaaagatactaatttcatcccatttaatttagaatggttgtgtccaaacaattttaacttctttgagcctctgtaaaatgggaacagtcaggtcactgtgatctaaaaggagaatatatgtgcaaacctctttgcttagtgcttgacagtaaatggggagtgcctgggagatttgttttccatatcatcaacagacaaatgggtgttcccaactgattctaagttaagagttttagatgtttaattaatagactcataaattgtgcctgtaaatttaaaacggtatctgttgagtttttctaaatgtattttacagattagatggtgatagactttcttaaaatgttgtgttttccattggattttgccttcataaatgtatgaaaatatatttagttagtgtggacatgattgcagtgctaatacatggcagattgtgtgtacatatatgtgtgtgtgtgttggctattgttctatctgtaggagggtaaaaatctaaatggtgggcaaataaaatcagaagaaaatgttggttaatttttggattatgttgtctctataagagaatgttattactggtaagtattttgcaaagtttttcatccatgtagtgaatatgaaacatgtcttcttggttgactcatttgtatcttttacagtacattttgggtgccagtttatagattcttttcctaaaatctgcaaagtaatagaagagttagaattcagtacctaagatacagagattctattactccaacccccttgccatatgaagatctgtgtttaaatgagtcaagaaaattaacttttaagattctatgtggatgtatgaatttattcatattccaacattcagttgatggcatttatgggaactatactcatggaaactcagaaacaaagaaacttttatttgccactatattcacacactttagtagttctttcctaaatctcttttgaagtaaagaatactataacatcatatagttttgtgttcacagttttacacctaattttacacattcacatttatagatatgcacaattactggacttactctttgcttgtgttcaaatataaaagcttatagaatcttgtaccagctatcaacacattcatccaaatgtattccgggtttctccattgctgctgtggtagtaaatataaatctacattctcagtggtattagttgttcttagtcaagcatgagaggaactgtatatgagtgtcattatctaataatttttctaactgtgttaaataacgtcgtattctcccttcctttgccatgctgaatcagctgaagagacaaataagtacagaagggatgagtgtggcttcataatcagggatgaatgtgttatgatccatcttgatccaataagcagatgaatatttcacaactgcattattttgtaagtgaggatactgtcagttttgtagcaaaggttctggtagataagattgtctttcttgatcttttataagtaaatttttattgtaaattatttaactgcattctctgaaaaatgtacttttgtatcagagaaatatgcttaggatatatatgtgtaagaatttaaaggacaggtttagttatgggccaaaatctaatgttgtagcatcaacatgatttttattaagaaaagagaatttgatgttgagagttttcagttcacatacagaataagtaaaccttatcctataaactacacttattattggtatccgtgtttttaaatgttttatgtgtacctcatcaaaatgagatcatgatctcctaatttatagtgattgtgattatttaaaactagctgaactaggataacataaatagtgtaaaaagggaatcctacaattgtgattactacattaaaaatgcaatttgcagtataaaatgccatgtgaaggttaaatgatgttaaagataataatgtgtataatgaaatcaagaatagagcatttaacaggaatgtatcactttatgggcatagaaggcaagagagatctttacactgtcattattacgtacatggtagtattttctaattcagtggtcttcaaattgtatactatggaactcactatatgaaagagataatttttttacatgggcacaaacacacaattaccttagcaatggctgaagtcttattcttaaaatatattctttgttttgttgtatatttttctctaaaataaaataatttgaacaaaataaatataggactatccttttcaaagtaatagtcagcgattgaatttttgaagtggaaagactgaatgaaggcctgtggataaagacgaaatcctgaaatatcaaaaaacaatagtttattcacaaaatagatgtttgtgaaataaaagttatgccctttgctttctcaattgtgtgatatttatatgtcttagtgttaatgcttgtggagtagggacttaatatttgttaactgaataaaactgcctaattctatgaagaatactaagtttatatgccaggaatttctcttattttttgcaaatatgtaataataatgttttttataactcctcagatattatgatttactcttgattaggcaaactgtgggaggagtatcagattatacaacatgccaaaaaacattaattatatttctctgtaatgaagacctgcaaataagtaaagatgtttgtaagcagtcaaagtagatgtcatcaagttcatgtgttaaatttgttttgggcagatagtgaacagtcatttactctattagacaaaatatcataattagtgaaaacaatattctgttttttttgttttgagatattccctttgttttgggggttctgcagatttcctgtgatatgtctgcatctgattttgtttatttagtctgcttcttcaatgtgctgacttcataccttgcaaaaattctgaaatcttctcaactagtatttgtgtattgcctcttccttactcctcctctgtttttttaatgaaactcctctaagaaggttttggacaattctcattctatattatgtctatttatgtctatttaatatagtctacttttttttttgcatctctgtttcattcactagaatataagctctctgaggaccatagtctgttttgttcaataacgtatattgagcatttgaaagagtgactcagaatggatgtccggtgcgcaagtggaagcattttttgaataaatgaacgatttctgtgtaatttattctgatctgtttttcactttacctagctttcattggtctcgtgtattgtataattcaagctctgtttcaatggctgtatttttaatttattggtgttctatttgattcccattcaaacttatcttttcattatgatgtacattatttttgtctgtattaacactttaaatatgatcatttaaaaaatctctttcaaattactctatttgtcaagatcttgggggcactaatcctcctttgtgtgtctactgacttgtccacagtggataagtttgtgtgtgtttctaatttttgattgtgagctcatcttcatctgggatgtttgtctcctttggaagtttgtgctctgggttatgggacagttcttacaaagtggttttctgttagtttctgccaatttctcaggaatttcattggtttggcattagtttttacattaattttatggcttgtggttcccaaactaagcaaatagtataaatttagattctgcaactgcatatggaaaagttttcagggttggattactcataggcaactctttctttgcccaccaaagcccttgccagacatgttttctggccatttccctgaatcagtgacataagaatcagtagcctttccaaatctctggctttgtgcaggggtcttaggacctgtgcctctgtgggtttaaaaactccagcccctatcccttagggcccatagatctgctaatgtttccagttctgtgttttttgttctggctgtaaattccctctcagaattccatttcttttgagtttgggtatgtatttaacttttttctcatcatgttttatccaggctttttttttttaaatggagtgtgtgtgcgcgcacgtgtgtgagagtgtgtttggaggagtgtattatttgaaccatcatattgctgagactagaaatcccctctcatttctaagatcaattattatgtggatatttgctttctttttctgagtgtaatattaaatacgaaatggactcgtgaacctggagaatgtctgtcagaaataccgaaccttccttctttcattttcgcctgtaaaatcttacaatttttttaaagatagatatacagccatctagagaatacacagaagagtgatttggtgttcatctttgtgtttgctgtttgctgaaggatcactcgctaagatacgtctaacattgctataattgttctgtttccctttgaattgaatatttagggtaaggcactgatatgtcagtaggatgaccaacactaaaagtccagtatcctgggaaacctctgtctttggtagacctggattgtcaccttagtcttggattccttccggagactgaagaaatcctttaaaaactttcctgctgtggagtcttctggctcaggccccaactacagtgttacattcagacttctttgttagaacaaagttttacatatattcaaatagtaaggataaatattaatctgtttagaaagagagccttgaaaggatcctagtctttttgcataggaaaaatgtccccaatcaatgagaaagtctaggagcatgatcaagacttattttatatagtttgtcttttagggggtactggtggattatacttttagagttacattcagtattattgtggctggactaaaaacccctcaagaatacatttcacattgattttattatagacatctgtcaagcaaagcagaggcaaatgatagcatactcatttaccagtaatgcaaatcaaatgagctagtggcaacaaaatcactcctgacacctttgccctttttctcttgatttgaactaatgacgtgtgtgtgtgtgtgtgtgtgtgtgtgtgtgtgtgtgtgtgcgcgcgcgcagactagcaaaatccagactagcaaacaaaggccaatgacaggataactttcataccttcatgcctgggtcactcaccatgtacgataggagcagtgcattctcttgtgaattaaaaatctatttatccttcctgggtgcataagtcccatagaaggctgggaggggaagtggaactctttatataggaggggcttagacctcaatagcctgtccctttgaatgacaaaatgcccaccagccttgccacaaatagcttctgaaatatgagaaccttttttaattcttaagatccttgaccactgcaactaatgtaaagacacactccgcaacaaacttatacacacacacgtacacacacattttattctgttttataggaatggcagtctttagcagtgcataatttttttattattattttgtttgagactgggtctcactctcactcaggctggagtgcagtggcatgatcatggctcactgcagccttgaccccctcctgggctcaagtgatcctcccacttcagcgttttgagtagttgggatcacaggcacgtgccaccacgccttggtagtttttgtgttttttgtagagatggtgtttcgccatgttgcccaggctgttcttgaactcctgagctcaagcaatctgcccaccttggtctgggattacaggcgtgagccactgtgcccggccaacattccatcattttaaaagctgggcaaaaagggaaggaactagttgagaaaggaaggttctatggccagaacatcagaatgcttgtttttagtttttgcaaacattggtgaaataatagttggcttttttgtaaagcctttccagttggaaactgcaagtactttttttttttttttttttccgagacggagtctcgctctgttgcccaggctggagtgcagtggtgtgatctttgctcactgccagctctgcctcccaggttcatgccattctcctgcctcagcctctccagtagctgggactacaggcgcccgccaccacacccggctaattttctgtatttttagtagagatggggtttcaccatgttagccaggatgttctcgatctcctgacctcgtgatctgccctcctcggcctcccaaagtgctgggattacaggcgtgagccaccacacccggccagaaactggaagtacttttaaaagtatgatggaagatacatactttgtaatatacatacatacaaaatttgttctttgagcaaatttattcagttttactggcaatgaaactcataatgtttactcctcagaaattttaaaacatttgtttgttgaatgtatttattgtttctatcggcagtctttggaaatctgtcttgtgatagttctaataatatggtttgaatacagcattgtcatatgtcttatatgttggggcaacattctaataactatacattttttatcttccgatacgtttttctgaataactctttgtgttgactgcaagtatgtttttgcagagtcaccaagttctgaaagtatgcttttaggatggcactaggttactgtgtttgtattaagtataattgtgttcttttgtagatttgttcctatagagctatggtttcatggtctgaagctgaaagaggtttaaagaggtcatcacagttcctcctcccacccttactgttgttaaatatgaatgtacgtttgactattggaggaattttgtttctagaactttcaagagtaattgttttctgtaatttatagtaggaaaatattgatttattaatagttaaaatgttctttgggatgcttgaagaccatgatgtgaaaaacttaaaaaaattagcattgatgttgtttctatatatttgccaatgggagtactataactttgaaatgtaggggattgtttgaaacatgaattgtgaaaaataacgcaactttagttattttatattgggtccaggctagtccgctgaagagtatgaagtacagttttatgtaaaatatatctcagattgagaatgtggaaacactgttctttaaaaaaataaaatcttcagtaagatccttttatgaatttactggtttgttctcatttgtcatcggactgtttccagatgtaaaatattactttcttgaaattgctgttgagtctactatcaagaccaggtgcatgttgttttacagctattttacttctgatttttaatgctgaaactcatagaatgccttgaactgataatttgtttaactctctacctactaattggaccaagaaataactttgtatctttatctcttttccatttcatgttttatttctgtttcaattagtgtgtgcctttggcaaaaaggagatgattttgctttctgttttaggatttgcctccaagaaaaaatatattttattgccacattttctcaattgatccagtagagttcacagacaatgaaaagagtaagaaaactaatttttaaagcttggtagtgttataattttcttccttataataatcagaaaaagaatttgtataacttttgtttctaatatagcagttctgaaaatctaggcttacacattttccttcccattactgctgtttatacttaagtaaaacaaaaatggtcgctgcaggtttttttctcattttagtgcagagtttgaattcttcaaagactgctaaggttttcccaccttaacaatttatgacagacccttatatcttcataggctgagtccgctgctaagagtttgctaactcatgactttaatacaccagtagagatcacactggagttaaaacaaagagagcacgaaccctgaaatgatttaagactgttcttagctgactactggaacacagtgtctcacgtggtgttattggtaaccttaatgcagattataattctgtagtttaaccaggatgtgttggctatggtaaagtgcctttataaggaattgtgaaagggcacaaggaatggaaacagaacctcagttttctcagtgtaaatgatgatgacaagaattccctgtgcacatttgttgttgtgagaaagggtgagatagaatagattggacacatagtaggtgctcactgttagtttttctcattcattcattactgtgtcattctattggcatgctcacagtcatgtagtggaatatgaagttacatcgtgatatttttcattcattcaccactgtgtcattctgttgacatgttcacaggcatgtagtggaatataaagttacatcatgatattttaaaagctaccgatgtggtagatttcacagtcttgaaaaggggttttttttaagctgaattttcagtttcacttgagaagagtcctgatttgcttgtacaaagagcagtagggttgcagagaaggaaagaaggcaactcttttaagtcccagccgctactctgctgtgtcttattctctaaaacagtgaagaagtctgggtggacattctagtggtcagaagcctaagctttgtcttttgatgagtgcagacaggggagggagcaactgacgagggagtagaggggcttggagccccttcccaagtctaccatccctcacttatgtgtctcttcctcagtaaagcacccccagtgcccttatttgctgtatttttcttcatggaacttactgtctatgggacctatttgtgcattcatttatggtgtgtctctgcattgctttccctttcactacccatgtaagttccatgaaggcccagtcttaagcattacaggttgagcgtccctaatctgaaatgctccaaattccaaaacctttgaacactgacatgagatagtgacacctttgctttttctgttgttccaaagtacgcaaactgttttatgcacaaaattatcaaaaatattttgtaaaattacctttagcccatgtgtgtaaggtatacatgaagctgcatatgaaacataaaatacatttcatgttgaaacttggttctcaccccaaagttgcctcatgtatatgcaaatattcaaaaatcccaaaaaattagacatccaaaacacttctgatcctaagcctttgagataagggatacttaacctgtactgggtcctcagtgcctggcacagggtggatgctcagtaagtattttcttaaaagaaagaacaagggaaaggtagatgagacgataagaggtggaggtacagggaagaagaacacagaaacatggtgatgaaaagaacagtctgataccttatttgggccccagaaaatgattggtactgaagggattttattagtggtcatttaagaaacttgtgttgtactgtttttgtgtattggaaggaggctagacattgttacatggaaattcacagttacattttcactaaatgtttcattgtgaaaaacgtcaagaaaggttggagaaggtctaggaaaacttatctttgaagatactgtcttatgaatttccagctcagacttgcagcttttgggagctgaggctatgaggtgatcttgagagcagctgaggaggctctaatgggttccagctgtgtgcccagagaacccaccctctcaggataacattaaccaggtagaccctgccctgactgacttcctctgggctttatgggtccccgtggtctgttgcattgatcttgcattttcaggttttatagcaattctaaacatgtgagggtacatatttgctctttgatgtgccctttgatagaagccagagtgctttacctgagcctgcctgtaataatgggggaaggtgggttgcatgccctgcagccatacgctccctgggaggctggttttattgcggttgttgattggcagactttaatcaggggtgtttcttgttgtatttttgaacatgaagtatattaaggatagttaaacatgtagtcctgctggtgttttgttttgttttgaaccacattttgttccattgtgccacttgatagaaaggagggcagaatggaaacatatggggagcagaaatagtaacacttatgtcatataactacactgtgttggtgattttttgtttttttccatgttttataatacctttatgtacatccctattaagaaggcagctattgtgtctccatttcacagagaggtaagttaaggaatgtggaatttggaaacatgcttgccggttagtgtggatggaacctaaattagaattcagagctcttattactagataggagaccaatcccaggcagtcatggcatttctgtgaactctttcgaagagtaaagggacaggaattgccttttcagagtagaactcagtgcatatcagtggaattatagaactttagggttagaagggcctttgatgggaccatcctttaagctagaactgcctcttgaagtttgcagtgtgcatgacctgcagctccattgtttatattccaaatctatgaaactagtgagagaataggacacatctttgtatgtttaggtttgacagtacttatcagaagtggtcatattacggttttctatcttcctttggtggcttttcagctttccttggtaccagccttccaaaagaaattagctcccttgtgccctcactttaatttggaagagattggtttggaagagccaccaagggcccactagacagctccttagaagttgctgtgacttggcagatggcacctgaggtttaaggattggggatctagccatggcgtgttgatgatgatgatgatgaggatggcaatgactattaactccttaatccatatttaatcatatcaccagaactgatggttgttcattgaagattcacttcatgaagtacaagctaggtgattcctttttgaaaataacactgtgggcctaagatatatggaccttatgtggcttaaaatgacccacttctctgtgcttactcctaattaccttcttatttctttgaatttagtaatgggagtaaatccgactttaaagccatttgtggtggcaaaccctaactattcaatgaaatacaaatttggtacatttgcatcctatgcaagttttatatttttgacagctatttttgtatttaagcaagaagccgaaataaaaatttctaaacagatatgccagattatattcaccatgtttgagtatagtattgattggtcatggctgatgtttatcagactaagcaaagtgtgtctgtattagttgtctcaagagggtctttattcttaaatgcttatgaattccataataagtcttggaaagtggaacatacccaagcacaatttataacttttctaggctttattggtattctgagccatccagtgaggactggagtcattcacatgatagaataacacagataccatttattaatctgctgaatattgatcacatttagcaaattgctgaatattagtagtgaaatactattcctctacaaaatagtagtagccatagtagtagcaaaattatcctcatgtgtccatgcatgatttatatgtatgtgtgtgtttatatatatacagtgtatacatccatatctctatatttctattttgctatctttgttgggatttataaggtaacttttaattattttccttcccccattctctacttagcgatcctttctttataccaatcatcatggtaaacactgggaatataaagattaataagtcacagtacctatccttagagctggaagcaaatactttttatccagcataatgagtgttacgagagatggtatagaaaatgctctggtaggcctggtgtggtggctcatgactgtaatcccagcagtttgggaggctgaggcaggtggatcacttgaggtcaggagttggagaccagcctcgccaacatggtgaaaccccatctctactaaaaatacaaaaaaattagctgggtgtggtggtgggcacctgtactcccagctactcgagaggctgaggcaggagaatcgcttgaacccgggaggcggaagttgcactgagccgagattacaccactgcactcccgcctggatgacagaacaagactccgtctcaattaaaaaaaaaaaatgcaaaaagaaaatgctctggtatcccagaaaatgcctactctgtttcaggaatgcaattcagaaaggtgtaccagagtgtcatttgcagtctagtggtagtttcatagaatgtctgtttcaagaggacccttctctatagatctgtagtttttattagttataatttcttcacacttctgtcagaaatgtttgctgttaattttgaacactgtttttcatgtgaatatattttttaagtggatatctttttcattttgtttttttcctcctggcttttaaatatatatttaaaatatttttatccatatctaatttttgcaactttcaaaaaaactttctaagcagtcacctcctgaccctctttttcccccttagctgtttcccccccccttttcagggccacctcccctccttcagagcccccgcataatgctattcctttaccgtccagccatctgcctgttttagcctcttcttcactctctctgtttcttctatatagatttccccatatgtctgcttcttcctttatccacaagtccagacactcctccatagctttcttaccaccccatcctggtgtcccgtctgttcataaataactctttcatccgccttgaatcccaaccccctactctttctaaaaagagtgtgcaaataaacctaaagtgcacggagccaagatgcatagcatagttttgattcagaatagactttctccttccaatcacctgttttagtccccattttttgttgcttggcttctttgtacagatccacaattgccgttcaatttttgtatgaaagtggatgcaaagttatttaatgtcttcatgacaaagtttttgcctcttactggcaggttattttgccctaatcagttacacagtcttgtgcagcctagtggttgctattttggagtagtcaggtttgaaccttttgttcttcagaaattaacgtattatctcagaaacagcagtctctgcttgcgtgcttggcaacacaaaactgcgttaggtccttttctaagtctgagttctaggacatgtgccatgaaaggagtgttaactgaatcacctgcagaaatggccacaaggagggctttgtaatgttctagatatttaaaatgttggtgtcctcctcctagcatggtgtgctagtgacaggctcctttctccctggtcaagagtaaacattggcaatttacttccctttagaaatgtgttactgtagccatcgcggagttgccagtgtttttccttcctaatgtcagtgataattttactcacagattccctgcagagattttagctcagcaggaagtaaatctaggtaagattgccttgaaaactgatctaaaacaataaatgctaactgtatcattcctttttatttaaaaaaaattggaggcataactaacttgattatttgtaactggtgagatctaataatcgtggttaagaccccattcgttcatacattctctcgttctctctctcactgcttctttgcctatagaaaaataaaagtcagagattgaaatgattcacactatattttttaaggatgaaatatcatagtagaaatgaaaggtagaactgtttactcatgagatgctgagaaaatctaaactgtagctttcctagagtttaggaagctaaatattttattggtatcaaaatcagaaatatctaaagaataagatatttagttttaaatgtttcatactttctaaaaagagtttttgctttgttttgttttgtttttgttttttgagacgagtctggctgttaccacccgggctgaagtgcaatggcacgatcttggctcactgcaacctccacctcctgggttctagtaattctcctgcttcgacctcctgagtagctgagattacaggcacctgccaccatgcccggctaatttttgtatatttagtggagatggggtttcaccatattggccaggctggtcttgaagtactgacctcaggtgacccacgcaccttggcctcccgaagtactgggattataggcatgagccactgtgtccagccaaggtcttttgttgttgttgttgttgatagtcaagaatgagattttactgaaacaaggacatcagaataaaaagaaatgtaaaaaatgggaaagacactgaaaattacaacaacccatattactcattcagattctttttggaatttcaaatagtcaataatgaagagacataaattccttggagaaacgtagcttagggtcagctttcctttaatgacactagtgctatagtcacttatatgtagtatttttggtgttgtccaatttctgtggattctgaacattagctgtacacagatccaagtctgtggctttagcatatttttgcttttacatcttgtcaaaaatatactgttagaatatcttagactcgagaagattttagaaatcactaataatgtaacaactgttattggttatgaatgaacaaaggttcagttaaagagtatttccaggtaaggctgtacatatccacagtatattatagagacttctgggttatgcactggatattaatggtttggattatggtgatgtttctgaatgtgtgaagggtgaagttctagacttcatttttattaaatgaaattgattttcttacccccaccaaattacttaccaaacattagatacctaagatcttaaacatagccatcctctaaattatttgttctttaagtgtccagagaatatcgtgcagcttccagatcatggagaaaccagttctgtgctcttgaagttgcagtggtaggagaaatagcagtcttctatgacagatttttcaactttaaccctctcactctctgctaattagaatcatacggtcatacacttttggttttttttgtgtgtaacaaattttttctaaagattcaacaaaagagtttcaaggttaccttcaagtaggtacaaatatcttagctctggcttctttttctcccaaattggctgtggactgtaggagcttaattagttcaggctcagtgcaattggtttgctcctagggtgtgtctatacttaaaacatttttttataacagaaaatacgtttttgaccacttttcataacttcctcttgttgtttaccagttttaattttatcttggcaattgaaaatcttgggggaggccaatctaaaaaaaattcttggattttcaagttggatatacatcggtttcctaaaaagaactctctttttcaataactttgatatctcattcattcagcctgtatttattgagagcttatcatgcacgtggtgttatgctttttaattgctggtaccttgaatatttagagaaaaaatacctcgtgcattttgtctctgtgtgtttgacatgtcaccttgttgaatctgcaccaagaaaatgatgaattccaatgatctatggtagttacaaggccttagaagaaccagggatgtgaatttttggtctgcttcctccgtatttcctattcattgagaaacgtgcttgtatgcatataaacaattccttactatttttctttctggagaggaaacagtaatgggtggattttatcacaggacaaagactcttccagatagctgttacagtccctccctctgctcacctgatttagatgaacctctctttgacccaccacgatggtggtaagtctgccgttgcagttttgtagacatgtatgtgaaggcgatgtttgttatggggtcagtgttgccttaaggatgcgggctagagtgaggggacctttgtggtgggctttgcagacttcttggcagagggaagcacagatgcgtgaggttactattttcacctatctcctcctttctttattgtttacaggaacacttgtctaagtggtgcacaattttgccttgcttacgcttctagagtgaaaaatatctgtccagactccctgggataggttggttctaacatcttggtggattgagcctggaccaggagttttgacttagaattcatggagagaggtgtctgtaaatgtatatatacccctttatgtttgggagaaagcatctgtggagcttatctgggtagcaagaggattttgtgacccagcaaaggttaaggcacactgcctggaaaaatcaattaggatccagttgagggttagatctggccatagactttgcctggtgttggtaaataatctgaaagccttaaagcatctcagagtaatgaaaggggcccaagggttcacagtgccttttctcaggattgctgcaaggattctggattaaaaatccttctgctgtctgtggaacagaacatttcctgggatcaatccttgagccttccatagacaaagaatttcccaaaactaatcttgccccatgtggtgtcagaggtaaaataagtgccaagcatgagaagccagagtaacctttactggagtaacctctgctagatctcttgttatctatgtactcttagaatatcttagactcgagaagatgttagaaatcaccaataatgtaagaactgttattggttatgaatgaacaaaggttcaattaaagagtatttccagataaggctatacatatccatagtatattatagagacctctgggttatgcactggatattaatggtttggattatggtgatgtttctgaatgtgtgaagggtgaagttctaaaccctttttagataggcaagtgtgatgtgagcagtagagtacattttttgtttttgtttcctgaagtggggcacatttctctcccctttgtggttctgtaaatacattgttgagtccagtggaacttcaaagatggcacatagctactgatgacacacacaaatattgtaagttgataaggatgtctgaaatgttataagtggctacctgatgcctgatgtcaatgctggtatctgtaaagcacacacactaagaatagagactggcagctcaagggtgttgatggtaattttattgtatcttcaagaaagtgtgtttccagagaattattatcagtaataatgactaccaccttgttttcttttgcctcatttctctttcttcttccatgaaactggggtaagccttattgtagagagaagcccacatggatatccagcacctaggttccgccgagggcaaggcggaaatgaactgagttattccatttctgtgtaaatcggcgtcatttgctacatgtgcaagttttgggccagaggtgtggaaattgggttcactgttaatctaactagtgatagcctttttaatcatgtattttaataggaaggtagcacagttgagggacctcttttgcctcttgtgcctaagacagctgggtttgaaactcagtttttaatgaattatttaactttactgtgtctcattttcaaatctataaaatggggttaattgtattttgcaggattatactggagaagatgatagtacatttcagatttctaccacaaatatggccctcgaatttacttttctctactactaagcaacaaaataaaattgaggaaatgggagtctctctacctggtctttgatttagagtgtggtatttcttcattatgggtagaagagtatttttctttatagagagtcattaaccttcaggaaaaaaaaatcaatcaaaggttacgtggaatgaagaagcgatgtcatgtaattgagatttttttttttttgattcaaaatgtaaactcacttgatttagaattgattggaacatggcatgtgaaaaaaacacaggagacatttaaaactgtacctaaatctgatatagtagttaagaaagctagctttataggaaattaaagggggctgattagagtaagataggagagagagggggaaaggggatatggtgggtagctagaagaaaggcatacacatgcttagaagtaggaagccagagatggaggaagacctaggatgggcttggaaaacttctgaagccttaatgaactgatcttgtcacacacagctgttcatttgagttgtgggcctcagagtattattcctttttatcactgtcttttgaaatgctaattagataattgaccattgttcccagttctttggttactttttattcttaaacttctagagactaggccttgaatgggatactcagagcagcacaccagatgggaaattattctctggccttcagttgccaaatgaccaccacagtagtgcttgggatgtataaaatccagctgagaggcagaactagcctaaggggtggttagcatacttcttgggatagtccttcatcaatagatttttattttgtaatgatgaaggggactgcctttgtatttttatacagatttatcagatttacttaatcaataacttaatcaatattgattacttaatcaataatcatggtcttcttgaccatgaaaggctcatttaaagaaaagaacacttgaagaatatctgaaaatgattagcaagatacctttggtttttcatgaaacaccattataagtctaatgtttgaagaatgtttttattctacttctgacctagttaactcatagttttttttttaaattgaattagataatgtgtatgaaagcatcttgaagaatatacactcagcacaaatgtaagatttgattaataaggtggttattaatgaataccatatagtaacaatatatctgagtcttgcagaaaaacattcttgaccaacaggacgtgatctagtagaagagctgcctgttctacatattttataaagagaactaatcatttttcttctgtatactcaatccgatatcaggaaacctcatttaggtctattcacactgtagaggcagcaaaataacatgcctgaccttttctatgtaaatattaaaaattattaaatctgcatgttggaaagattgatttcggcaataccttctaaattttcagtgaatatttaagtgtaagtttgcagatagtttcatgaaaataattgacttttagttttggtactagaacaattggaatattggtggtatttttcattttaaatctgtgtgaactaaaattttcttatttgtctggcatgaacatcacagaaaaatcctttcccttcaagctatttttttaaaaaaattgtaaaggagatactatgtattgcagaacatttagcaaatagtgaaaaaataaaaagggaaagtcaaaaattccctcttattagttcagtactgtaacagtcgattgtattgcctgggctatttttttaaaaaaattgtaaaagagatactatgtattgcagaacatttagcaaatagtgaaaaaataaaaagggaaagtcaaaaattccctcttattagttaagtactgtaacagttgattgtattgcctggtggtagtctttatatctgtacacatatacatacaatttaaaatatgtatgcaattttagattatttaaataaattcatacttattgttatatatttttctttttctttttttgtatttgcatttttaaaaaactgataagacctgccagggttatgtgtgctgtagtgtttcctgaatttatttaactactatggtttttctgttttctaatttattaattcattaaacatttgttattcctttgttttcttgggtcagttttatagaagtcattttccttaaattgactgttgagttaaattatttcactcttatgttccagatcatgaatttgtattgtgtaaaaatttggctgcattccataagttttgttgataatgtaatattctctgtgttactagtttctgaagttattttggcagttttttccttttaatacaatagctaacttgaactctcatttaaatttcaaagagattatcaagtttagcttttaaaattttcataactgttttctagttttattaaagtgtggccagtaaagaaacagtgtattttctgtgtcttaaaatttcttatactcttagtgtcccaacaaatgatattttaggaatttctcagtatttcagatgagatttatttttatatttgtaatagttggaaatgtggcttattttctgtagtgtacattttaatttgcttttcagtttttaaagttttttcttaactagatctcttttgaacctagaaagatgtgttaaacactcccacaaaataatacatgtttctcatgcataagcgattcatgatgactgtgtgtttatggtagatattttcatctttgatcttcagtactccctcttttattattatctctttttttccatgtattattgtaagagaacttttcaagtttgtcgtctacatcagtgacaatttttctacaattttatgcaaattttaattttgttaatgcatttttagttttcttacaatatttcctattacatccatctgcttttacatctcttcacaaatcttttgtgttgacacctattttatagaaatattctattttatataactgtcaaatgtgatgttttctagactccacttgtattttttatagggtgaaaatgtttttcaaagtataatttccctctgaattatgagtacatatttccctatattttattgtgcagatttttttctcactacacagtttttaacatgttaaactttaggacgctgcaaatctgcctttcttaatatattctgtgatgttgaggctaactacatatattttgtaaagaggtatgctggtctccatgtcagcctctaccaataggaggcgctggagggagagtagaaggctagaggaggaagaacttggcctttcctgttcttgttatcatcactctggtaacatcagtcttttccagtttttagttttgtctacattcctaaaattaacctccttggagataacagccccagtctgctggtgtctcttcctcatcacgtctctctgagcttacaggctctggaaacccaaccgcttccctgtttccccagccgtggggatggtagctgtttccatccgactgttcatgggtgcttcttctcaagtctaaagccagaggactgtaaatgtatgttgtttaagccacacatccaaccatactggttcaggaaggcagcggtcttccagtagttagttagctttctaaaaactccctttaaaaatgagactttagaaagaggatgacaaatcctgaggactcgtgtcttaagcaaattttctgtctagatatttattataaacctaattgcatctgataagtgctgtgtatgtcatactctatcaaaggtaaaagggttattaaagtaacctgcactttttagagcaatggtggatggccttgcagaaggcacatggcctttatcagtcaactcactgtggggaagctggagaaataaagttcaggtgagagtaagccgacagttctggtgtgattttcttgggaggataacgtataatgtaggtagcaaacacatgggagaaagaaggttttgcattatgagatttgacttaatgtgtacagtttgcttttggtgttgtaaagcagtaaagaggcttattgacatctctattgaaggtcattgcagtgcatgaaatgtaaatcaaagtgttattctttattagaagctagaagataacatttacataacatgcttttaaggtaatgagttaagttcattattttttattactataactgtttgaagaaagttattttcatgctaaaaatactcctacttgaatccgatttgtcataatttttgcatgatgtataatctattgttaggaaacgataattccatttatttttgtttctgggggaaaattgttagacagctgtttcagtctttccaaataaactcgcttccagaattcctagtaagtagcaatgctggttgataggaatgtcaccatttttctgacccccctcagccttatcacaaagacatagtgcagaagccatataagaaatttgagaaaaggaaaagataccaaggcctaggtatttcacaaactggataattagactctgaattgcgacgaataggctgaaagaaaaaaatgtcacaagcctatagtggcttaaggaacactgatttcacagtgaaatctttctacataaattttatggttaactggtaataggaataaaactgtggagcaatgtcagacaattctgttatgattcctgcctaatgaatggcaggctttcccttggtattttctccttaacctgcccattgccctttctgtatgatcacattttctttaaccagttctttgctcataaataaagccgtgtgttccggttcaaaagttgcatcttcatttataaattcacagaatatgtttttcagggaaaaatgtaactcaatcagctttgcatggtttacataatgtgatagtctcatatttactatgtggttaacaagaaataactgttaccaacaaaaatcagagaatttaaaaacaacgaacattttgcttgggagcctatgtatatctctatataaatacatatagacatctataaacatcatcgatccttcccatgtgcacatgccatatatatgtggatgtgggatgatacttgtttttatatatacatatctatatttatatagctgaagaagtgaaacatattgctttttatttaagtgactcaatgcgtttatagacaagctttattttacagtactttatcaatgccgagatgataagatactgctttgatttggtcttctaaaggtcaaaatttgaaagaataaattgattcctagagacattcttatgctatcattggccttatattgaacagagaatttctaggaaaattattattcctcaatggaaataaaaattcattttaggtagcttaatcaatttgaattattcatttatggcattgctttcaattgttgatgagtgtatttgtgtactgggtgtggggaggtcttcaggggatgggaaggtggagggatgagaagattcttatagcactaaactgaattttcaattccctgctaaagtgtgaagaaagaagtgaagtgcttcattttcttctttttagaatcatttagcaaccacagttcgtactttatattttttatggagtactttcaacaacttgcttttgcagttgggaaatgacacttacctggattttcttgggttctttattcatgacatcaatgaagactactgctaatgaaccatagatgaagttacacatatgctaagcagggaaatgcaggaagaatgtgaaggtcctagagtatctcaattcagcatgtaagtgagttgtgtgcacagtagcacagttctgtcttatggctggtcaatgctccatattatgaatttacataggctttattttaggctctgaaataattatttttattatatttctcaaatttgccaaagtatctctgagagagattcagatcccatctgtttgacagctgaggaaatggggacagttggtacaatggtttctcaacattagaacacatctttttttttttttttctttttttgagacggggtctcactctgttgcccatgctgaagtgcagtggtaccatcagggcacactgcagccttgacctgcctggcttaagcaatcctcctacctcagcctcctgagtagctgggaatacaggtgtgggccaccatgcatggctaatttttgtatttttttgtagagacatggtttcacaatgttgcccaggctggtctcgaactcccaggctcaagtgatctgcatgccttgggcctcccaaagttttgggattaaggcatgagccagcacgcctggccagaacatgtcttaactttttaagattcatgatcctgttgggagtcttatgttgttgctaatgttgcttatgtaatttactttcataatgtcctgtttccacctatttttccctctttgtgctgaagactattgaagagcattgactagtgacattcagataatagtctggtgagtttgggttgaatgttcttttttgtgtggcatgcttggatatgtgtaaatatgtaagaatatagggaactaaatcttacttttcaagatgctatcgtgacacctctgcttgttaaaatgttggataattgtgagaaaacacacaaaaaaatacaaggaccccgtcacacttctttattctctttcagattttatacacttaaacagatttacagcaaaaaatcctccaatgactttttaaaaacactgttatgttactgataaactgatttttgtctgtgtcccttcgtatatattcacacaattttcatatttctgggttattcatccttgcttcacatgtgttatctcacggttaaaaaaatttttgttggatgatcaaaagcaattaaaacattcttattcagtgcttacatacttttgtgttctttttctgtgtcattttttcatatacagaatatgttttccaatagtttacattctgaattttttaatgaccagtgttaaactgttagacttaccatcatttacttaagtctctcctacatatttggtgattttggttatttctgtatctttgcacacgttttttcatttttgtttctattttctaatatgcagtttttatagcttcttgatagagtctttgaaattttgtttctgtgaaattgtgtagtttcatagaactaaatttgctctacttaactgtacctgatgaattcatattagctataaatatttaaacattttatataacagacagcaaatcatcatattgctgggaatgtaaggaagataaactccatgcattctagaagtcattagagattttgcatataaagaccacagctagtttcaagatctaaatcttgaagcaggcattcaaggtgtttcaataagtacttaacggtaggccattaattcatgtaatcatttaggataaatgatgggcagaaaagttactgtgcaaaaagtattatttggagaataatggatatatgaaaacttacataaatgattatttattgtaatttttgttactttcaatttcttggtcatggcaaaaattgaaatgcaaggtcaaacagaagagagatggagaaagctctaaccagcaagggcctggactctcacacttccctgattggagctgctgtgtgtgtctgaggagtcaccattgctttactgcttatacctaaacagaagtatatgtagctttgcttgcactgaggatgtttataaatcctctgggttttacatttgatttactttcttcctcagccttcccatctcatttgaagacacctttagttttttcatttctcagacttaacctctagggaattattcatatctccattttctcttatattgtacatttaaagtcttcctaaatgttgttagcttatatttattatctatcgctgcatagcaaacattccccaaacttagtgatttaaaacaataaccattttattggcacacaaatctgtatgtagtttacctgcttggactgagctcagccagttggttctcttgttgatgtcaatggtggtcactcatgaggatacagtctgatggcgggtggacaggagggcctggttggtttagggagccatcaactgaattggctcacttctgttccatgtggtttaggcctccagaggatagctcagggttcttcacatcatggtagaaaatcacccagccgcacaaaagagcaagatcaaatgagtaagcactttttaagtctctgcttacatcatgcttgcagatactccattggtcaaagcgtgtcatgtggcatagtccagtatcagggtgctaagaaactccacaaaatcatgggtgaaggatggtgttattcattaggagctcttattataaccgtttcccacaaggttctgacttttaagaattcaaccacttttcctaacctctgttgctaggactttgtagcactctggtaatagtctgctaactggactgcctgctttagcccttgaccttagtctgttttttaatggagcagtgatctttaaaacataattcagatgttattcctcctcttctcagaacacttcattgaccttacaccttatttagttaaagccaaagaccttaaaatggtatgtggcttccctggtacctctgtgatatcatttgctttctctcccactctacaccagccacactctttcttagtgttctgcaaatgcaccatgcaagctcccacctcagggtcttcacatttgttatcctttctgttaggaacacttgactcaggttctccatagttgggtccttcatctctctcttcactcaaatgtcatatcagaaagccttccctgaccacactcttgaagattacagtcatttcctcttctaatgctcaccatcgtgtttcctacttagtttttctccatccaggcctccggatcactctccatcctgctctgtgtctcaagaggctaaccttctacagttgcataatcagactgcctttctctcgttctctcagtcttctggttgggttcacctaatgggaagctgtagctttcccttcattttgcttataaacctttaaaaaaaaacccaaaaaaccagacagtatattattttagatttagataagaccaaactaagatttagtgagcattttccatgaaccaatttctgtgctttcagatatgtcatagaaaaagttaagtgaactgtcatccctgtttaagagtcagggatactgaggttgaggttaaatgacttgttcaaggtaacagttagaaaataaacaaacaagacttccaaactcacgtccagtcatcttttccatctacagccctgtctccgtaagtcatcactgaatgatcgctgttacacacacctttggaatttgtcttttatcacatacacaccaccaccaccattttctggaaacttcttttaaacccaatctgactttttaatcaagtctatatttgctagtctcaatagctgttaccttcatcctcttacatctaagggcatgttcaccaggagtctttctccggaatcaccaacctcctcttctctcctgactcttcagcattttaatatgctcatttctcctatcttaaaattaaagatggatttttaaatttaaagatgaatttaaatacgcccacccccctccaaattttgagactaacttttctcttcattttgttctgtccttttcaagccaagttttctcacacgacattctgtatataatgtgccatgatctggcttctttccacaacactctctgaagattccacctcaaaacgtcatcagtagcatgtgtgattggctttgacctttctactgctttacctctttgaagcgttggactttggaacacagccttcttctatacctcctactctctttcaaaactcagctcatgtctacctcttcatgggagtttttcttaacacagaagactgatctgattgtccctccagcttgtcctcttgtatgctggggcatatgccagcaatcacagctgctgagatgcttagtcttcctgacggaactgtagtttttggagtggtcaggatcatgtcttcagaacttgcaccccagccatgtgtctgcacgtagttcagtgaccagaacatagtcaacactcagtacatgcctgatgaatgaacaaatgagtgtgaccatacttaacttggtgaggccatttttttccgtgagttttatactctgggttgttttcctaccttggattctctgacttttttctctctcatctacttgcctgactttcttaggtcttttaactttgtttctccatctttacattaagtgttgggatacagggctgaacaagaacaggtaactgtcttatggctttacgtttatgtgttttcctctgaaattaggcaaatttcctaatcttgctgaagttattttcatccttaagaaagtaatattataggtctttatagagtggggcaggatcaaatgagcatgtttattaattgcttagcattatgcctggcacaaattcaattaccattatatggtaataattttaatagtaataaaccatatattacacatgtattattcataatcagatgatgtatgcattatataaaaattgtactattctataaatattgtaaaaaaagagtaaataatatacatcaattgctttgtgcatccatatatttttacgtgtgctccttttattaaatcatatgtttttcctcagtttattggttgctttttacttaccaaaagcttctgtccaaaaaaaatcaaatgctgcggctgccctgagcagagttcaccttggaagaggctttaattgtgatgaacctgtaagaacaaagtttaagaattgagataatcagcagctgtgtatttctttaaatttttatatttaatgatttatttgaattaactgttaccacgtttacatcttctagattagtttttaggcctttacttttccttggctgtgggtactgaccagcatggtggtaggtatgattggggtgtgtgtgtgtgtgtgtgtgtgtgtgtgtgtgtgtgtgtgcatggatagatgtgtgtgtatgctcatggatgtgcatgtgcatgcatgaatgcataatatttcaaacacatgctcagtgattgagtcactgtcaggaagtaaacttggagaccatgttgctcgatgccacaatagtcctgttattgcattgtcaccacaggatgccattaaaataggtatgaagaatgtcagtgttcattaatttggttctcttcagagaacattagccatggggaaaagatacagtagaaatctgagaagagatggaagataggagagaaacctggcttttgaagaatgatctttgatctttcagaagaggaatacatgtcaagagcttatctatgtgaaagaatttacatgcaaagcaaatcaagaacatagattttgcttatctttatagattatagtttcatcttagatggcaaagaaaagccaggcttctctatacaaagggatttgcatgtttatgataactcaattagccttaacagagactaccagtatatgctggctgtctggcctcaaactttaatgcatatgtattttcaaagagaactaaaagattttgggattgtaacacagagaaagaagagatagagaattatcaaacattggggatcagctttaaaattataaaacaaattatatatgttctgaaaaattacttcaggaataagcagcttttttttaaatatgagaaagcaaaatcatatcctgtatgccattaaaggttattgcgttttccaaatttatagttgcaagtgatggaaattttctttaacaaactgaaggatgcatttgtagtctaaatggtagctttgagagtagttagatatttatggaaaaattataagaagcaatgtgcttttaaaatttttttttcaaaaatagatattggttaggaaaactacactctttcactatttggtaatgcatattctgactcattcacacagtcattgtggcacctaaagtgttgcaaaattagacatttatatggagatgggctattgatgtaaaaaaaaaaaaaaaagctgagggctaggaatgataagacatgagtagagggttttaaaaatgagctctttgttttccactcttcatcatgcctagatctcagagaggttttgtccagtgagaataaagaacccatgggaattatgcagaaatcactgtccagtaaaaggaatagttttccttcagtgaccaagggtgggacctgaagtcagcactagtcagtgacgctgttttatcgtcttcatgccaggtgaagatttgcataggtgaaatgcccacttattaggagaattacaccctgacagaaatccaaaagatggtgcccctttatcttctatcaggggatttcatctaatactagaaggagcagtaagataccatgagtttgttaccagttattcactggcctgatcctgaaggtcattgcctttcttcagtgttatttgctcagtatcctgcctgctacccttaagcacttactttgcctattgaaatcttactagctattcattcagaagtaccagtatttctttcaaggttgatcttatgatgctactgtattttttcttgccttttaattatttttttaactttttattttgaaaaatttttaaacacatgcaatgtatacacagtagtagaataatcttctgtgtcaccatcatacagtttcaatatttaccagcattctgccttcttggctcatctatatataccactcccactcgattttgataaattcttaataatagactatgagatccttgaaatttgaaactataattaaatatctgtctatagacaccatacacatatatatacagctatatatgcacatacacacatatatgcatagacacacacacctacccctttattttattttttattaaaatgtaacgtatcctcattgtggagatagccaatgttaatattttgattactgtgtagattctatcttccattggtttttaaaaacataacatgaaatttgtttattgcttttaaacttcatattttaccatgaatattttccaatgtccttgaatgttttgaaagtgtgatttttaaaggcagcgtaatattccatcacatggatcttccataatttattttaagagtttgcaactgttgaccacatcttaaactccttgcacataaacacttgtctgcatttgcaaggatgttattaggatagtttcctagggaattattaggtgaaaggctctttatgtatcttgccaagttgctatctaggaaggctgtgccaatttgtattatttttatcttattaacgtggtagtcgacatagtatctggttgtgttcttttagaaattggcattttctggattaatgacactgaacgtttttcatgttcatgattcttattacatgtgtaaaataaggtgttatctggaattgtagtgaatggtacatgccatttagtttagctccaaatctagtgctttgcagcaatgattaattatttttagtatttcacaaatcagtttttgctgtctttggaccagaatgtctgcctaagtgcaagttacattagttgagagttggtcttattttactttttgagtattattttaaaaaattgtcactgtgtataattttctccctttatgtcatgtaactttattgagaaatgcaattcaatcaggaataatttagtttaggtaaaacttctttgtccaagaaatatactgtcaggtccaaatacattttaagttttgaaaaaaatatttatttagataaaaatttgtaatcactcagggtatttgactggatttgaagcataatttacttccagaatgaatttagaactctgttgttaaagtacttggtacaatttgtatatccagtaaaataaaagttgccatttttgcaagtcagtgttttaatgctgatttggtacttttgctatgtgaaattccccatactccagtataggaactgaatgaaaacatataccttattaaaatagtagaggtaagtattttcagcttcctaaacagcagagaatgctttttttttttttttttttaaacttttggaattactctattacctacatctaagttgcaaatccaaaaataaaactaggattttattaacatattctgcccttcattgcttccggttatactttgctgaactgtgttcgagtatgttgaaaaataattccgtgtattgtgtgttgaaaatgatattaaaagtatatgtgttatgtggaagaaacaatcaaaacagacctactcagacatcaacaggatattattaccccaaagaaatgacgacagtttgccagcttgatgcgtaaaggaaggaaatttacaaacatctccaagagaggcatgttgaacggttgaaggaaatgaggcacgtcctgcttttattgtgcttattgcagtgggattcccagaagactgaacaaggctgtcctgagacctctgtttggcagagatcttgttgattcatattttatttttgtttcagaaaaggtctgctattgttcaaatttctaatgtagctcataaacacacagccagtatcatttccccttctactgactgatatatacaaataaattaaaatctacggtcatcattaactcatgttctgtttccatggagcacaggagagtaacaaggaaggccccttaaaagaaaggccttttaaagtggaggtctcagttcacaaactttaaaagtttacgaagtagtattttagaattttaatcaccagatatattgggggaatttattacttcctattcatatggaagaggacagcagaggtaaatatttatgtaacttgtattttaaaagcttactcttgattaaaatgtttgatctatcgacttctgtatccttagaagtttgaattgctggacatatttgactggggtttttacaaaggcttctaggttgaaatgcatggttcaggattttggtttcaaatttctgtcaggttggacacatataaatgagaaagtaatgtggaatattataaacatttctgcttttttaagctctaacttttttttgctatctctaccaaaatgcctgaaaatgtcatgactctttagacggagaaatagaggaatggaaaccattctggatcctctgctgtgactcagtcagtctaaggggcagactgagcgctatatctggagttttactttatgaatgtgcacctttaaccttgagtcagaaaatgtggttactgtcagtcttactcagtaagtggtgctgcatagaacatcagggggagacttggccttggtttagtagaaacttgaaggagacaaacatgaaaagcagtgtcagaaaatggaagaccagtgttaaaaatctttggttttgctttcatttctcttggttatttcttaggattattgctttagatcattttcccaggcattttcatggatgaagaattccaaagaaagttattatttcaactcttgaaagctacgcttcagggtgaaggtagggcttgattatcaaaggaatttccctggctgcagtcctaacagtttaacttcctgtgatttccccccgcccctttccctttatttttggctcagaacttcagtaatgtctggattgatggaattcctctgggaggcagatttgagggtctaaaggtgcttctcaataaagattttgaggaatgatattaacttattagaggcaaccctctattgttttagtataaaggggatgagatttgggggaatcattttggatgtcacattaagccactagccattttactcttgatgaccttagttgcctttaaactgtatttttagtggggatcattctttcaacagtccattcttttttaaacgcaatttggtttataattctgggggctgcctctacatgctgtactgtcaagagagacatcaaatattttctgagtagttttcaacacagtgaattaaagctgaaaaaacaagtagcgatactaccagcatcttaactgagtatgtggtggtggtgtttgagtgtttgtgtgtgtgtgtgtgtgtgtctgtctgtgtgagtgttttatgttgctgtacctacttgcttttaggtagctacagttttaccagagaagagaataacttagattatatcaaagtttttttttatataatggtttaaaaacctgccctgtgtctagtactcctttacgaagtccgcaagacttggggataacagtggacaataatgttccttaaggacttacagaaataagacacacacagatatatttaaattccaattaatctgatttttagtgtggattattgaagggctaggaacttagactcagaaatggagtatttttcctgtttaaaatgtaaagagatttaataacatacaggagtcttgctatgatttttgagaggagatttactctaatgtttcagataatctgtttaacagttaataaaaatacgatttacattttgtttggattttttaaagtcagcacataatttctaaaagtaagcaaatttcttgcagggatggtgaaatgaaaccttgtagcatttagcgtgtattgcggttttgttatttgcagtttgttattaagtgttcctaggaataaaaggaggtgcacagcaacaatgtttactgtgccgatttctggtattttataattaaagagcaagtgtgagctgggaagggtgggctggaaagcatggattctggctctaaatctcagctcgaccacttactacctgtaacctggggcaacacagttatttaatttctctgtaaaatgaggataatacaagtccctgcttcattgggctatgggaattaaatgagtgaatgcatctaacattgagaacagtgttcagcccatagtaactgctcagtgagtatttttaagctattagcatgatcaaatttagagaggagaaatataatggagcagtttctcagttcttgttagaaataatcattacatttgaaaatccaacaaaatattaacattcaaaacccattttcagaagtggtggtggtagaattgctataacggaggaaaatttaggaatggcagcctggttaaaagaaagggcgggtagacctggagtaggttatagatcaatttaaagcagcaaagttttctaaaggtgcttctagttttactttaaatgagtttgcagttgcacatatcaaataataaggtgttatttgccagaggcattttgttggtggggggtgggagaaagttttggggtatattgtgtgtgttgggggtacatttccccggctgcctttttccactgctgctggtcctctggtcaggaagcctccctgtcccgcactggttctgttatttgttcttggatagcatcaacttgaggatgagactttataggcaacacattagcctcagtgtctcctcctggttgtagtcatttcccggttacatgggtcagtttctccaccttacttgagtgaatgcctagaaaggctatttcagcctagagaatttttaggggaatggagaagctgagggtaactcctcagcaccaacacttgaacccaatcaatacttgatagattactcccagcacacacaatacacccagaaatcttctccccaatccacacccaattaagtttcagccaaggttagaattcagtggttccctctgtgtgtgtccccttagctgttgctgttcaggtgcaaaggtgttcatttctttgtctacccatgtgtagttgcctgatatccaactaaactgcatcaaaatatggaacccctaggtaggcaaaaaagataattagaatacagtagtccccccgccccccttatctgtagtttcattttctctagttttagttactgtccatcagctgtggtccaaaaatattaaatggaaaattccagaaataactcctaagttctaaattgctcgccatttgatgaaatctgcactgtcctttgccatctcatccgggacatgaatccttactttgtccagcagattcacactccagacactccctgcctataagtcacctctaggttttcagattgactgttactatggcagtgctcaggttctagtcacccttttttgacttaactatggccccaaagcacaaaagtagtgaatctggcaattcagatatgccaaaagaaagccatgaagtgcatcctataagttacaagggcaaagttccccacttaagaaaaggccaggcctggtggctcatgcctgtaatcccagcactttgggaggccaaggcgggcggatcacctgaggtcaagagatcgagaccagcctggccaacatggtgaaaccccatctctactaaaaatacaaaaattagccagacgtggtggtggacgcctgtaatcccagctacttgggaggctgaggcaggagaattgcttgagtctgagaggcggaggttgcagtgagccaagattgtgccactgcactccagcctcagtgacagagcaagcctccatctcaaaaaaaaaaaaagaaaaaaaaaagaaagatcatatgctgaggttgcagtatattataattgttctatgttactcttagttattgttgtcagtctctcactgtgcctgatttatgaactaactttatcataggtatatatgcataggaaaaatcatagcgtatatagaattttgtgctatctgaggtttcaggcatctgctggagatcttaaaacctatccctctcttagagtgagtactgtgattatgtttaaataaatgaatgcatgcttgcttgtggaaatatttttgtgtgtggggtatgtatatgtgtgtgtgtgtgtgttgcatgtggacattttaatgtgtgtgtattatcctagctgatggttttcctttggacatttgggttcattttgtagaaagaaaatgcagttttagaatcaggaagctgattggatgattccatctgaatatatgtgtgtgtataaataaaatatattatcaaaagcctgacttgacttgggaactgggaagtagcagcctcaggtcctcctaggtttattggagttacacttattagtaagtagcctaatcctctctgcaaagagaggaagtacagttttatgatagaatcacgtgggatgaggatcattgaaccagagagaaactgctgctgtttgatttccactgcaggtcatcagtatttcttgatctagaacaatgataaaaagtgttctggtctttaagcaaaactcagatttaggctttatccttagaatctgatctttaaaactggaagcacaagctttccagctttgaattcactccatttcagagatgaagaaaccatttctcaaagaggtgtctctgttgaggtttcacagtgaacaagtcaggtcagctgaatccaggtctagtgttatttcctgcaaatacattttatttttcatttttgcagtaatctttagattaaacccactcctatactgttggattagttaggcacatggactgggtgtatgtttcccagatttgaaggttggttctccatgtcatagttatttgttctggttgcttttttttttttttttttttgagacggagtctcgctctgtggcccaggctggagtgcagtggcgggatctcggctcactgcaagctccgcctcccgggttcacgccattctcctgcctcagccccccaagtagctgggactacaggcgcccgccactacgcccggctaattttttgtatttttagtagagacggggtttcaccgttttagccgggatggtctcgatctcctgacctcgtgatccgcccgcctcggccttccaaagtgctgggattacaggcgtgagccaccgcgcccggcccggttgctattttttctcagttttcttatctgtacagtggcggtagttatttcatagaatcatactgaggactaaataagttatttcttgtaaattacttacatgagtacccagcataagtgttagctataataattattatgttattaatgattatgtcattattatgtattgttgatagtaatataataatatattgctttttagacactttagttagctatccagcatatgacaataaaaaggtggctctattgaagagaaggattccataattttcttgtgaaattagcgccataaatcattgaacatcttgcttcagttttgtgtgaattatttggattgactaagtactcttggtactgggctgagttaccatctgctgtgttttgcttccataggtcaggcttattctcctagggaatggtgaggtggaaaaaaatgccaataacctaaccccaaaatgtatcctaactgtcttgttcacatttataggacagttttattgctgtaggtaagacggataactgggcactattccagcatcttggcagttttccttttttcaaggtactaatattaggattagcatgttgttttaaagccattgcctttctgcaccttataattgcttgttcttgggggaggcttggaacatttgaattacggtttttctgccaaatatgggagaggttgtctgttttgttttaatacttcgattggtttttaaagttggtactacagtccattttgccaacagacaacacaaattagaggcagtgtgggcacactgtgtatggggcagatgcagagaggggcagcgaatatgcatgagcgagaatgttatagctctgtcagtttttgtatgtgtgcctcagtttatttttggtattgataccaatgttcggcaatacagtgatttgcctcctctattttgtttctaaatcaaagccttggcagattaaaatgactaggaaaagattaaattgttaatggtataatcatatttttctctaaagcattgaagaattacagtgtctatacttattagcatgtgataactttagtgattgaaatgtttagctagttttactcaaatattagtaggatttctaattttcataggagagcctagtgccacaaaagttactggtaactagcactcttcagttttcatcttcatgtaactgttgtgagcattcaaggaaggagctgggaaatggtttagtcttcatagatgctcaacagatgtgagttctcttttctcccatgtatacgtttcttatctttttgtagagttcatgggagcagcatttatggattcagacttatattgttgacaatgtccttgctacctgatagatgatcagtaagtgttgcagaacgaatacatatgagagcagcagagataggagtacattagggcaattagaatagattcctttttttgtttgttttttgagacagagtctgttgcccaggctggagtgaggtggatcggtctcactgcaacttctgcctcctgggttcaagcgattcttgtgcctcagcctcctcagtagcgggactacaggcatgtgccaccacacctggctaatttttatatttttagtagagatggagtttcatcacgttggccaggctggtctcgaattcctggcctcaagtgatccgtccacctcggcctcccaaagtgctgggattacaggtatgagccacagtgcccggccattagaatagatttcaaagaaaagttgactgtgccaatctctgctccctcctgtatgttgttaagtctacagggccatattgcctaaagaaacggagttccccaagaatgtgttaggaataacaaaaattctgtactttgacctgaaaattgcggttcttgagctggttatttttctaggtattgttggaagttatgagtcagagttaggtacttattcgtggataacacaaggacttctgtcagagatctggatgctgtcagtagaatctctgtttaccctcttgggctcagtttattcatctattctatgaggaggagtatgcctgtttggccttcctcttaggttgcttttgagaatgaatgaaataatatgtgaaaattctgttcataagtgtagaagatggctagtgatgatgatgatgatgatgatgaaattgatgatgcccaaaatatggagaatctagactgaatttatggctttctaacttcgaattttcggctttctaacttcgaattttcaggaatgcatgatgatagaatgtttttatttctgatatccactgcattgtttctatagaccttcaaagtttgacacaaataactaaattattttgttttgttggtgaggatcacttttattttagcggtgtatcctgttaaaataaccttgcatgaggattctcaaagttatactaatgttgcactagtaactaaggcagttccaaaaagagacatttagaatgaataaggataaatcaaaagtaattcatatccattggtaaggaggtggcacataccaagtgtcaactgtagatattttagaaattgaagtgttaccatggaatcaaagtattccactgtaaggttgaatatctcaggatacctactttaagtcgtcgattaagatgaagttaatattcattttacatatcctgcttgaaacctcttatgctgtgaaattttcctgtctattaagaatagttttagaaaaatgaattagctaattccttaacttgtatgtaacttgaatataagttcctttccttaacttgtgtgaaaatcagttctcctttgtgaagagcatgagagatacctcaataaaatagtaattttatattgacatcggttgcagtttcaaagtcagagttttacacttatgtgcccctatattgtctagctttgtaatccccactttaaaaggcatcccaaaatagcaacagaagaataaattgtgacttgggtgtattagatttgtatgatcttgtttattgagctgctttgttatgtagttaccaaggatgatgtaagcttctcatccaagttttcctttactatgctgcattgtcctttaaatgtcatgagaatacaaatattttcaaggtagcagtgaggaacaatctagatgagatgaccaaaaggacctctcatatgaaactgcagtgagcaaaggtttattggtctttggatctctaaatagagtgactttagatatctaaatttagtgaaaaccagaattcagtgactttagatttcagaccataaggggttgtaacacctactccttttctctgtaatgaagaaaaatgaccacaacaatgtggtggatatcagaaatagaaacttttcatcgtcatgcattcctggaaattccaggttagaaaggcataaaagagagagaaaacctgtcatagttagtatatctaccttggttagtgtttttcacttaggggattgcaaattcatatgagaattgctgagagaaacaattaatttagaacaaatattctccttccattgttacagcctgtaaaatgttacttctgagttgctacttatctatcaccatttctctttctccacttcattgttagtgtttgtatgattagggtgggcgggggtcttctggatggggttgctcacactccacaaagccttttccctcttctgttgaaagaagacacagctgaaatcagtctctttgccttttcatgatatggggatgcggtggaatcaaagcaggcaggatgaaagcccaaaagcttcctgtttccagctgttttcttcagcgaaggttttttttttttctcccaaagatgatgcttcctttcaaggggtttttaatctgctaactgtttcctcagtttatttcactacagtaaaatgtgttccctttaggtcatatctgtctcttttaaaacccaacctgtccttttcagccgtgttagttgctactcaaaagaacaaacgtgatttataaaagtccttttaatgaggtacaaagaccaataaacctttgccactagagtttcatcttttcagttgctttattttcatttatgaaaaatttgagatgtcaaaaagccattgagaacactattgatttgaccatttaatatttgtaaacaaagccgttaaaaataaaatatattgttatggccttaaggttggttgtggtttttttttcccttccgaatgcagtataatcatatgtaatttgtttaatgtaaattctttaaaattaaggcactggaaactgcataaatgctaaaatgaatactaagagtggcttgatttattaagtgataatgtgcatgaaaatatggcttttttgcactgatgtttattgcttcactttttgcattgatgttgttttggaatttacatttctaaattctgcatcctctagggataaatgaaatataaaaatgaattcttttaatcactcattaaacattaactagacctttcacccatttcctagatcttccagggttctcagtaataatcatcatcattatacattgatttataaaggaatatcagagtgagtcagaatttttctgtttctttatcacttgtctttccccaaatatccatactgacctaaacgtaggagaatttatcagcaagaaggttcacattgctgccctgttatttgagctcattctttgtgatataatgaagccagtggcatatgggggagaaccacctcatttcattttcactttaatgctaactctaacatatgcttttgaattgaagtggggtcccaaatgccaatatatgttaaaagaattaaacactttgaaaaaagagaaagttttcccttatttactcctgttgcccactctcttgagggtgagaggctgatagcgcttaaaaacatgagcatgcctattttatctgtactgtttaatagagagctatgaaaaaaatggcaattaacatattcagacagaaaatcatcctggctgaatgactcattaaatagtcgtataaacaggatgtgccgaaatgaactggttcagaatttagttccattggtcttttcagcacacactgctcattatcagcactttaagaagcagacttgtgggtgcttagaggacacttaaatttcttttctctttatttttttcttaaatacttctcccctcctccactcctttcccctgctattcctaattctttgcaggctaagattactcgtctaaacatgaaacattctgttggcaatcgagttaggggtaagagcttctgactttcatccaggtcggtggtcctaaccccagatgacaatcaaaatgtatttgaagatttttttttttggagacaaagtctccctctgtcgcccaggctggagtgcaatggcacaatcttggctcactgtagcctcagcctcccaggttcaagcaattctcctgcctcagcctccgagtagctgggattacaggcgtataccaccatgcctggctaatttttgtatttttagtagagatggggtttcaccatgttggccaggctggtctcaaactcctgaccttgtgtgatccgcctgcctcagcctcccaaagtgctgggattacaggcgtgagccactgtgcctggccatgtttttaaaatatgcagacattgctgaacctcatttttttgggcttcccattcagtaggtctagaggcaaggcctggtagtccgtattttaataaaagctcccagtaggattcagatagccagccgggcttggaaactattcactgatttgtgtcccctcacagtaaaaatgctctttccccaggtacaggatatatggccatctggcctggatatcagtggtttgcagacctggctgcaaattagaatcacttggggagcttggagaataaatactgatgtttgaccccacccccaattaaattgttggtggggggagtagttaaaacctccccagttgattctaatgtacagtcaagttagagtacttctgtcctacataaacagatggagctaggtttagctgaaaaagtctagttttcttttagaatatgctttaccctgtgctaaaactcctctgttactgtgcctccctagccacacacacagagcttaaacgtattgcctctactaaggctttcacatttattggtaccctgttctcaggtgggagtagaatgctaggctctcacgttgtatcagattcctgtttcttcctacctgagtatcacatctgtgatgtgcagatgtgttggtatagcatgagcaccccacaaaggctaagtaataaggatgaagaacaaaattgcagtttagcaaaggaaggagcatccatcttttgagtccctgtatactccaagaaaaattctgagtaaacaagtttcttctttagcaagttgtgatattaaatgggtgcctttcattacattggctaacatttgcatttcttggacctgttctggaaaagggtctgagatgaacccatcgttgaagatctaaaaaacaaaaactttcaccatgtcaagggaaagaggaaagatttccataagtgtaatcttgtattctggatggtacatgaaaactctacttcctaactgcccacagggatttaaggggtattttaaggggtacttacaaataaaaggaagaagatacattacatcacattctcattaccaaggagaaactcatcctctctaggaaaggtttctctcctgtcttacgtgtgactttccacctgctaagtccccttgaagttactgagcaaagacactcttacaacactaagccattggtgctagaagtggaagtagacggagcccctgaggttcaggtgccaggtccttgtatctctgatggcgtgggaaacaaaagtcagcagccatttctcttcactagagactcagaggaggtaaaaaggggggattcacgaagtcatcttgatttttccgtatcttatggcgaagtcttgtggtagaccccagaaccctgatggttggtctcacgctcgtaagtttacataaggctttctcaagaaactgacatccagagcgcttgccttagagaagacagctgaccatggtcatgacactggcaggtgttaggactggctggtctactctggtatggcagaaaccctgggcccctgaataagggaggtgattatgctttaaagtctaggcttaccatgtgtagggctgtgggactcactgtcagggttgtgtaaggcgagggccatcgcttgcagaagtctgagtgtgtgagcacccccttaaatattgcccccaggtgctgtacttgcttaaccccggacccagccctggcagggagcaacagcaggagggaaaaccattggtaatttaggtcttcacatcttatgcttcatttaatgtggttgataaagagcctccttgtaaaaatatcttggtgtagactcccagggaaggaaacacttgtgtgactgacaagctggcagtgcccatggccacgtgtgtcaccctggtggaggataatcgtcctattattttttgtcagtaggtataacaagtgggtagtgctttgtgtattccactgtgatgaattaattttgtgttcattgtagtagcactgatcataatgaattaatttggtattcatgtggatgtcagaggtttttttttccccttccaatttcatgtagctttagttaatggatactttaaagtacagtacatctgatctgatttctgttctctcattcacttctcataattttccccccgctggatattgtgaggtcttctgtttttaaaacatttaacttgatctttaaataattaatgttttaatagctttacatgaactcaaacattcctcctgcttttaatttataaaataaggaaaataaggtaaatagttataacaaatataactgctaggttgaatgatatacttaataacttgtatattttagtttggtttaaaaagatctgaactaatcatttgtaatttgtagccttattgaagacaaatattgtatccccttatgcaaatatgaaataatgaaaactgcatgccgtatataatagtttgctcttcttttaatttcttctctctttccctcatagacaagattgataaatgtatgtgcatatattatttatctgttcatataaggacatgtaattgactattagatatggtaattgcataaatatatcttattcaagctcatttccttttctgtttataaaataaatgtttttgttaaattggaatatgtactgaaatagaagtgcctaatttaggattcagaaactaggtacacaaacaaaaatcaaacaaaattctgggaacctttgacaaacttgttctttaacctatatgtgtttaaaaaatttgttcatcatgtttgctgattattgaagatatttataatagaataagggtttccttcatcactaacacacctgctcggctgatttgctcccagtggaaatatggttgaacctttagaaagaacgatgtttttttgccttacgagtatcaggatgccatttttggtctttctttaaatttaaacttggaaatggtatcctccatatattctcttgtggctttaaactttttttttttttttttttgtaattttacagctcttgttcagtttgattctcagcagcagctgtattccattgtagactgctgtgtttcagcaattgatggatcctgtatatattctactatttagagtatataaagaagttgggactcttgcaagtggcaaggactatataactgggttactatggctttcattatttttgttattattgtgacagattgtacagtaatatgctaacaaagatttatggcatcatgcagcagtaggaaatgttgggatggaggagaaaactcatgttaaaacaaatgtctataataataagaggaaaacaaaacttcaaaaaagctgagaattgtttctagtataaatatttttattaacatttgttatggttgaagatcttgagaggaactgttcatgcatttctgcagtttagattatgctgtatgcctatttgtgcatcatcgttcttaggagattgttctttcttctggttttttttttttttagtttttttgttttactggaacacataggtattgaatatgcaatgaacagaaaatttatggagggcagagttatgagtatctgaggaaagtttaattacttttataatttagataagcttcataatttattgtaacacgctgtactttggcacaatttgtaacaattataaagcacttgaatttaggttctttacttggcagctatcaacagagttagctgtatgaaaactttaagcatttactttccttcctccgccttgcattacaggcttacgctgtagtagttttgttgctcccactttcatttgccacatctctgggttttatgtatcacagtatagtaggcttgtggctatacactaggaagcagacgaagagagaacctgaagatacctcctgatgcccaaacctaggaaagggaaaaatgcagaagaactcagacgactcttggaaatgattcttgcctcaattaaaaagacctcaccactcacctccatgtaaaggacaggtcgtgaattattcaaatgattcagaaatcaacatttaaaaaaatgaacataaattccttttcataattaaagagcggtggaaaatggctcttttcttaggtctagattatattgctgttaaaggaattgctgcctagtatacaattttttgacattgttttctacaacatcaatcttatttgttgtccttttttgtcacgcctgttaaatgtgtatttttctgtgttgatattgaaactaatgtacaaagtgtgacatctccaaaaactgatttggttgttcctaaaaacattggtccttaaaagtatatttatttgcagcccaggaatttttagcttcacatttttcttttaataactaaactgtagaacagaattagctctcataaaaccttgtacttgctgaacaactctcataattaaatgaatataatgattttatgtgacactttgaacttctaaagttctttcacatctatgtatgtttaggacaagatttaaaagttaaattattctacagttggagtagaaataagtggccaagtatccaacttttgtatctcaaataccttctttttttttttttttcccaaataccttcttatattctccaccgactttttgggctggctaagtgtgacagaaatgggaactttagttctggcttttgattctctcatgttaatgtaggtttttgataagtcacttggtgcaaaacactgaaacaacttatctattggcttaaatgagtcaacagtctgaatcaaacaggttgtgaattggttaaaataataaaccagtaaccctgtggttgagctcttgatgattaaagaaccagacctaagaatgcatttatagtcttttaaaagagagtaaagactcccacttctttgagctgtgtttctttgtgtagatttctttttttttttttttaaagaaaggcttcattatctgtttcagatctttatagatgttgcaataaggtactcctttctattagtataggattgaaaggatcaaagttaataacttgaactgagatgctttaaaataacaaaatagtttattatctctttccttttcaagatttatgttcttacaagggtacaatgttcatgattgaatgtggtcctactggtaaggcttccatgtaatagaagagtaattcccttgtctagcattctctgggttgttttaatgttgcaggtgaatgtgttctgctgtgcaaataaatgtagttctcttattcacattcctgatgacttgcatccttaaacccttttggtcagggtattattgtcctttatcctgaaaaatgtctgtgattgtagtgccctaatactataaatcaatggggactgaattcagcgcctgctaagtagagtgaggcaaccctttaaatgcaaatgcatcagggctagttttaatgtaattttaataaggctgaaaccattttgaagtagacttaaatcataatactaatcttaaaagactctctatttagctgagaagtccctttattctcactggccatttttcctctgtgtgcatccaaaccacctttcatgtgattccacagtttttcatttctttttttttttttctcaaatagaatatatgtacagtttgtggttactttattagttggagaagagcttgtattgactaaaattgcttcacttctttttcttcctggttgtacatgcctgactaatctgtgtgtgtgtgtgtgtgtgtgtgtccataatatttcaatcacattgctgtgttttggtcagagaagtaaaaatctagctgtcaatgccaactggagtagttatttaagaatataatatttaagtaggggagtatatgcaaagtaatataaaaatgaggaaaacatttacaaaatcaaatgtgacctcaagtccaatatttttcaatcttctaagtctgttggtttcaccacctcacattatttcaatgtatgtgaaatatatcttgctgtttatatttgggttgatgggacaggtgcaggatctttgacctggggaaataaattggattaaggactagcttaactagtctacagaaactgtagactacaaaaactgaaggcaagaacctactgtcacatcttttgcagagagacaaaggcattttggtatttggatattttacttgggatatgtattttgtgtatttgtgtaattttgtattaatttacacaaacttaagtaaacaatatattaataagattcatcaagtaatttataaattaactttcccacatttttctgtgttcaagaattatcaaggagatgtgtaaatattgaagcctatactatattccattatttgcttttaatgtatttcatataattcagaaaacagtaatttatcatttacattacttcccttttcctattgagccttctgaaagaataatgtagaccagcattttaaaaaaaagcttgtttcaagacatgttaatagaaattttattttcagtccattctgcattaaatattgtaaaacacccctagagagtgatattatttgtaatgattcccaaattgctttgaccagagaactccttttttcatgaaatacctcccatgtggaacattctgcagaagagttttgtgaaatgctaactcagcccaaaaggttttttaaattaaggcctttcaagttggtaatggtatttagtttcttgttttttaaaatagactttgtttaggacagttttctagggtcactgtgccactcatgctgactgtcctgtcgtcttgaaaaatactactggtaacatgtgaacagatatggaggtcctctacccgagtattttaataccaaataatagctatatcttctcagatattggtagctatgtcaatggagatgtgaaattggctctatcgatggcttttgtccattctccaagagaggcctgtctttgtgggtggaggtgttggtggatatgtgtatgtgtctccttctcttaccctcttaacagtttggtcacagtggtgaccagtgagtatagagcagagccttgacaatgcacctgactttgggctttagccagatagtatgaatgagtgaagcagatgttaaggagaggtgagtttagggcaactggggcattcgtgccccctcattcattcagttaacatttccaagaatcctgtgcagggcaaataagatctatctcaggaccagcaatatctcatccttggtatgaagataagaagtcaggagacttgagctgtaggtttggttgtctccttgcctggcaggcttgcctaatttacagcaagtagaaaataatctgtgtcttgttcaaatctaaataacaatgctttaaaggtagtgtagaatatttgttaaaaagaacatattaattatgtttttagaagcttctgtaaggaagaaagaagtttgaccccccaacttttctcttttctagaactgcaaattactgctattttaaatagactttgttgtttaactgtacatccaggaaaatctaggaaattaaagaagcatgcatataaatgattgtgtagcagaacatgaacattaaattcatacagtgaagaaattaaagttagaaatactctcaaacataagaaggttctagaatcaatcctttaagcacagtctgagacatggtatatctttgcacttacttggaccttggtttctattcctgtgatgattattggatttgatgccatctgatgtcctgttcctcagattctatgaagctgagtctgagattaacttaggtctgagattgacataaaggggaaccggtccctagatttcctcagggctgagaagttattgatttctcaagtataataggactgcacagacgcacaatttgcaccaatcggaacaaaatgtttaacaagttctgagtatagaaaacactttgcaatttgaatttctatgattccaaaattcaaaaaagctcctttttgattaaatgcactgccctcaaccacacatgctcattttctctgtctactgctttgtcattctgtttatttaactttacttggcataccagagttttaacgctgagattttaaagtacatatgcaaaattggaatgtgtcagagaacctaggaacagattcatcaaaggagtcatgaggcacattgcacatgctttaacatcaaggtgtaaacggagcccattaaactattagttaagtggtgatcaggagcaagagcctgattagattacaaaatcttctgtgtgtgagcgcggtatgtgaaaacataacacttgatcctcaccatagtgccaggaagattcaattagagaactggtatgtgcccagatttggggacataaagggcaactggattttgaaggaaagatggtaaggaaacacctgcaaaaatctgcttctctgtgcaacagactgggtaattgcatatgcagatggatagttagggatataattgcttgatttgtgaacataaatgccctttcgattgtgtcagtgttgaattttgcagtgacaggtgcctgcggattgctgtgtgtgtatcctttgcacccctgtttaaatatttggcctggagtatgtcttccattcattgtgaatggaaccaccgccgtcccgcccccatgatggtctgggggtattgttatagctcttaatgtctctccaactttttctcataaataataaccttaatttgaaaccttaactaaaagaaggactgcatagaggcatgtggtgaagggcttacgaattatgcacagaattcattttttaaagctgctggatgtaactcattagttttcattgttttctcaaaataaggaaaactattaaccaacactgcagactaatagcctggattttttttcccccataatcaactgaagtttaatggaaaatcatcttttgaaagacttccttttttctccttgctttttcttaacctttccattaatactgttccaatatcttctctaatctctctcaactaaatagcattctcagtcattccttttctatgtcaacatttctataccgcactgaagatgtttgtaaaaatactggtgcagtccaaatgggatttatttttaaattgaagaatttgttaagcacttacttatgtggaatggtcaggtcatctccgtattcctttctctggccttatggagaaagtggaggaaatggtgtctgcctttaatgaggttgctaacgtgcctgaactacacaataagttattaagtcatattttatgtgattattcagtttctttttttttttgctccattctaaatcaaactatctaaattatttttgtcaaataaaggttaatttcagcagttgttgataataaacacttgcatgtactattcatatcaacgtgtatgatactctgctaagtatagtacatcagtaatctcatttaatctgtcaaacagtatatattattcccatttcacagatgagcaaactgagctataagattaagtatattactcctgccatatagttaataaatagaaagggattggagttcagaaatatgtgcctctctagcccacgtttgttgctgttttggcatctaatttgcaaatataaataaatatatctaaataaataaaaaatatcttgaatctgcctttttaaaggagcctgccaaagagaggcaaaataaccgcagaaatcccattttgactggctttgatatgaagacttcacacaactcttattttaatttcttggtatttccttatgctttgctgctcttctgaggcacattttctcagtaagatattctttatgctttttaactaaaaatgtggggattaaattttacccacaaaaaggtttgaaaccgttctttctaattcttcatgtgtcattaaaaaagtatccgcatgtattttggtgcgtgtggagaaggagctggcactgtgtgctcaaataatgctcagaaccacctgctttgaatgtggtctgattgaatcaaatgacgactgcttttcatcaccgagccgggattgggatgtgggggaagtgttttgttttgatatttcacatgtgcttaggtgttcgtggtttcaggttgtttaagaacagactctcattgagtgttggtgagtcctgtgggggagatttgaaagcaacgttgaggatttctaggtctgtttcaaaattacatcctcttgtgtggtgcatttatttgtgttcaggatgcagattgccttgtggaaaatggcaaatcattttccctcataaaaggtttcttttgtttttttgtttgtttggtcttcagctattttttttggtagtttcccctcctgagttcagattatcagtactttcatcatttataccactcggttctctggagttcttggtgcactgtgggtccacttttcttgtttggggtgatgactaacatctgccctgatactcgcctggtacttgaggctctgaactttattatcttctcttcaactgcagctcgtggcacttgtaggcaacgtgcctcccaaagagcctgaaagagattacagctcacttcctgccatcagacagtatgtggggaggtcaaggggtgggcagaggagaggcttggtgaaattcagacttttgggccccatctagaagaatctgcttcagtatctcttggagctacccaggaatatgtattttcaacagtgctccagatctgagggacagttggaattaggaaaactgtggctctaactgatgccccagtacttctcaaagtgggtgcccccacatcctgatatgctggatgtgttttgtaactgcagattcctgggctccactgggagtggtggccctggaccagcctctgtcatgtgtccccaaccacactcttgggattcgtatttgtatgaactttagagaatgaactgccacagagattctaggtgacaggaaattgtggggtaaattggaggattacagatcatgcttctaatatcagcacaggtacacacaatcgtcaaaataggggacaggtgtgtttggaaagcttgttttgtaaagaaagtcttttctccctttgacttctcttctttacgtggaagctacacttctgaattacaaagagacagagaaaaaagagaacaataacaacaaaaggttcctgaggcatacctaagctgcaggagccaagggagtgtcccttgttttacttggtgatggctgtttgaacagccgtttgctttctccttcctgtcctctgatgtgaggatgcaggattggaatcattagaaaccctaggttagtagcatcaggctccctgccctgtgtagtctctgggaggacagagctgcagcttaagttgtgcttttgtcttggcaagcacctttcaatttttatcctagctcagttgctttgtttggcattttactggccaatactcctttttttttccctctcttctccatctcctaattctcaacctcttctggggccaaaaacttggaggaaagactttaaaaaaaccaatttcactcctgtttatgtaatcgtttctatattacagaaggctatggtatgttttaaaatgtatacatctctttgcttttctcccttgtgactgaatttttgaaaaatgcttgaaatacggacaccaaaacggaatgtatgtgtgtcacatttaaacggaaaaccctgtttgttttgtatattagactatagccaatgaaaacccagggagtaaggattttcatgaccacaactgaatatagaacctcataggtttctgttataagtataaatattgagaatagttttgtttgtttatgccagtgcagttttatagcaaatcctttcaaatggggtgcaaagccatccatggatatttgtaaaggctttgcaaaatcatacataaaataaattgtccatttgatttgaacaagttttgcaattatttgtggctttaacaggggcttttgaagggcactgtatatatctaccagctggttctacttttttttttttaagaaaatggagagctttgtatacaatcccttgggtaaaccagtaataaactatatatcaggtagtcaagtcatgccatttcaaatctgttttacattttaaaggggtaataatttgtgaatttcatctcatagaaatttttatgcttcaaatcaagttgttatcccatccttgtctattttttttttatcgatcccctcactcagtgttttagagaaataaagcatacaatggaatctcttgctgggaaaaaatactttcttacttattatattgtatcttgtaataatatatttctatcaccatttaaaaaacattcttttagttattgatgattattttgtcaaattatatgaatttggttctgttttctttttgtgacaaagattctgaattttcatgtttaataaatgcacttcttcacatgacaaatgttcattgagcccttagccaggcattggtgtcaaccctggttcataggtgcccagagttcctgtccttctgaagcttgcatcctggtggggatcaataaacaaagataccaaccaacaaatataaatatatgtatgtatgtaattgattgattgatatctgtgtgtgagtgtttcctcaatggcattatgcatttatttattcattcttcatgcatttgttgtgtgggaaagaatgttttccaggttgaggaaagacacgagactcgacagccagggatatattaggtaacggtgaggagtctggtgtgattgaggcacagaaggaagtgccagtgtaaagtaacatgagaagaaagtacacacagatcctgagcaccttaaatgctagcctaaggaattttaagtttatacccaaagcaatagggagccactgaagatttttgtatggagaagtgacagttgtcagtggctcatagtagattggagtgggcacctttgctgaagttagggaacctgttttcaggtccttattatgagacgtgctagttaaaagaggaaaggaggggagggggttggcaaaggctgcagttagttacattgagtgaggtcaagtaaaatgttttgaagcatttctatggagaagtcccagatcttcttacctttcatgactttgttagactcactcttcagtgaaataagactggtcttgatttttccatgcgtcttgagttaaagcgttaccctttgctacctgggctctacgatttcacctgttctctggccacaccttggaattcacttctttgtgctctccaatatttgatttccttcttgtcttcttttctttgttgttgttttttgtttttgatacaagagtctcactctgtcacccacgctggagtgcagtggtgtgatgttggctcattgcaaccttcgcctcccgggttcaagcgattttcctgcctcagcctcctgagtggctgggattacaggtgtgcgccaccacgcccggctaatttttgtatttttagtagagatggaatttcaccatgttggccaggcaggtctccaacttctggccccaagccatctgcccacctcagcctcccaaagtgctgggattacaggcagcatggccaccatgcccggctttccttcttgccttttcttaagagtcctgcttcaaggaaacttccgtctccttttcaaaaactatttcagtaacaatcccttggtgtttatttaccatttgtagcttaaacttaaaactttttccctgtattagttatttttcaaatatactttttgtctcttcaactaaattttgagctcaggattcataatttatttgaagaggtacaaacagaaaggttctgtcccatatttctaagtagtaggatttatttttccttctattgaaatgaaaatataaatggcctttgaggctccaggagagcccacaaaattttatttagtccaaaataccgtaaaacttcagtattattaatacttaaagatggtttgcctcaagcaagaaatatgaagctctggggaacacattctgtgtgtgtgacacatccagacagtgtggtttgccaaatggtagctgatccagagtgaggttcttaaccttcatcaagtcagggactgctttgaaaatccaatgcaagctgtagactgtcttcccagaaaaatgcgtatagctaaatacatgaggaaaattctgcagtccttagtctgtgtatgtagcatgtgtgtaggtatgatattggtaaatccaaaagaaaaaatgctttttagttaccttttgtagccattaacgttacctgtgctaagtgctcattaggcatttgctggctgattctattcatgtgagggccacagggaccaggagaggtgagagcaaagatgcatgcacagatcagagaagggttaaatggggaattatgcagcatgtaacttatacatttcctgaaaatgatgcttctgtggacttagacaaaaatgagtggccaggagaggattgccgttggatagatgaagtctagatttatccagagttggtatttcttgttaaagaacctcagtgagcagtaagttcataaacctactggggtgctggtggagggggagatctactgtttattttaggatgttttcagctgcaacaaaagaaaaccctgactcaaatggacttaaacatagggaaatgtcttacattacgttacctattccaaaatctctggtggtttccttcctccgtgtactgccttcatcctaggaatgataaggaaattcctgctttggttctgggcatcacatccaaacagaaaaatcatcaaagaggataagtggtcgtctactgatgtgtctctttccttggagtagggagatatttccaagaacccagtagaggctgcacctttgtgtcttagtgctcattttgaaaccagtatctggcctggggaaggcaaggggtgtgattggctgtaggacttgggggtttccctctggaactggaaatgaggtcacctgttcctgatccactaggaggagtggtggctatgtgaacaaatagcaattataccaaaaactgctgcacgttctactaagaaggaagaagagaaaaatagatattggaccaacagaactaacagtgtcattgtatcttctgataaactcacattctgaataaaaaaggaagtcatgtttgtatttttaaaatttatctaaatctgttgttattttctctaccacaacacatggggtacagtcatatgcttaagtccatgtgagtgagcttttataatagatgttctgtccacacaaggactggtttccaaggcccgcactcagtttacttatgggccccactgccatgcacaattaagaaaaagacgagattttagcaacttggactgaactatagactttgcctaaactcattatttacagcagcacttttcttcataggtgaattgttaataggtttgattacttattcttgccttggagaattttcaggtatggcttacaaagtgatatgaattgtcatctctcaaatgcatctttaatttaaacatattctctatgtttctgggtagaggaagaggaaaaaagtctatgaaaatgaatttaaaatgcttctcagagtcagtattaatttaaaccgttgcggttttctgtggggcatatttaacccaaaagaaaagcccttataattaggaaattgggattctgaataattaatttgaaagaggaaatataactttttctacagagaacatctttcatccaaatttggagttccagtttctgcagatgtcacttctctctcataacataagaaaataggtaagaggcagtttggaaagaggttgaaaggagaaattataggttctcctcccagcttttccaataacttgccttgaggacttggaccaagccctgactttctctgatgtataaagttgtaaaggaagatgaaatactgtgcacgaaagtgctttgaaaaattgaaagcagtaaactgctctaggatatttattgttagtgtggtggttctggttattataaatgaagcagaactttaaatattaatggtactcttgttcatcaatggggaagttataggggaaaggttttccaaaaaatgctgagctataactgccatccaagtaagtgacgcagaatgcctaacccaatttgtatcttgctatcacctgatcacagaaagctgtttcactgtagaggtaacagttgttttctcctctgtcctgaggccaatgattatataatatgtatcaaatcactagggtgcatatcaaagtgagcataaagaggcaaatatttccctttacaatgaccatataagagattatttctgtcaggggataaggcatacatgaagtctgactgtttcactgcatttttactatagaaatcactgagcttgagacttgtacattaactccatctggtcatgtgactggcaagtgaagtgtttcaatgtgttaagaggactgatctgcatatttcttgctgaatcttaatctgtacttgcatatttgtgaaacgaatgagtatttaaattatggagaaaagatgtattgtgccaaactaacctttatagcatacctgtggttgtagtttctctagctaacagtggacaagatgaaaactcattatacattttcatcatgttaggtattcttctcaaagtcacaggagcactgcagaatggttcgtaactttatgaattcagctggcattttggatatatggacggcccctttgaggggctaaagacacagccatccatttcaccaagagtcgccgagggtgccttattgcccctaccccgtgctgggtactgagggtgggatagaaggcaaaccagacacatcccttgtgtttatgcagctttttcttcagtgggcaagacattacttgagaatcctaaaaatataaaattacgtctatgacaagtccaatgaaggagaaggacaagacacttgattgaggaggacatttattgctagtcaggggggacaaggaaagctgacccaaggaaatgatgattcagctgagttgatagaggagtgaaatagtcatagtaggaaagtggagtggtgggagttgggaggaaagtactgtatttgaagaaccacgtgttcaagttctgcagcagaagggccaatgaagtacttgagtgttgtcaaaggcaatcaaggtaactggaagagagaacacgagggcgtgagggtatgttatcaggatgaccttgatgttcacaattaagaaagttgctctaatcctgacatcaataggaagactgaagtatctgaaggagggagtttgcatgtctgttcacaaagacctcttaagcaatacactgtacactattaatatgccagtggttcttggggcgctgtctccaacctgtggttgtctcactactgtatactctactccttccccagtgtgtgctatctgtgtgatttgtgtgggatcactacatccctggtggactactgtgactggactaaaacaatcaaggtaatcctatccctctcatcacggtgattaattcgggtcatccaggcctaagcaaatccatgcatggtattttttggctttagggattgttccatgatggtcccaatcaggacaaagttcagcaggaattttgctcttttatagactgaacttgctgccattgaaagtcaatgaggaagcaagtagatctggaatcctatgaccatgagagaagcctgctttagggtgaagttgacatggaagtgtcagaggtgaggggtacaaagaaccattttgtccttgctaatatagtagatccactgtatctcagattgcacctgatacctgttgaagttttcaggcttttctcacccctaggcccttctccaatcctgatgctagctgttgacaacagtcattattaaataaatatcagaaacctcatctgaattcaaggaatctcccagctctttctaaacccatacttgctcattgtaactgtagctcaggccaagatggaatagactaccttggtgaggacaggtgtatgaagaatcactgatttaaagattgttcataacgtatcgcagtcattaggcataagtctatttcttgagacattgtaagggattattcttggaaggacataggtccaaaatgttgaattggacgtctaggagtcagggtggtaaaaatgaagtatatattgattaagtggagagttacatgagtagagaagcaaaatgaagccgagtagaaaattaaaggttttgggaggagtactgcctgaatttagatgtttttaaagtacagctttctgtcttcatgggaatatcttttcgatatactgagaaaaagaaatccaggtgttcttcacttttgtaagcatcctggtttttcgtgcagggagcacagacaacaggatttcttgccaatcagttaccattgtgaggcctgatttttcatctgtaaaatgaggataatacagtctacctgagtaatggctgtgaaagttaaatgaagcaatttgagtacaaatacctcacaatgaatgattgttttcattgatgtggtggtaaatgtttaataacctctttttcaaagaataaaagccgttattggtcatttttgccaatttccatggtgtaaatacttccaacattgtgccagttccgagttaccagtgtgttacaaaattgaaatggagttagagaaatacacatataatgccggagagctcaccaggatgccactgctttctttccttctttccaaattacatacatcccagattttttttttttttttttttttttttgagatggagtcttgctctgttgcccaggttggagtgcagtggcacagtcttggctcactgcagcctccgccttccatgttcaagtgattctcctgcctcagcctcccaagtagctaggattacaggtgcctgccaccacgcccagcaattttttgtatttttagtagagacagagttttaccatattgcctaggctggtctcaaactcctggcctcaagtgatacaccctcctcagcctcccgaagtgttgggattacaggcgtgagccactgcacccggcccataagccaccacgcctggcctatgccagattttgtacaaagtaaaatcaatccttgtcccccaccactgtgatactagggtttgtttgattttagtgacatctgtattagggttgacacagaattaataactgaatcaataaagagaccgggaacagggccacgccttacacaaggtgacatgaaaaatgttgaggtgtagcagtttattcccttaggttaatcatgaacctttctgttaggcccctttgaaatttagtatcactctgtcctaaatcaccagtaccttgcaagtgttgattctagcccatataactcacctttctcaaaaattctgctatgtttgttttagtaaccaaatactgtattttattttcgtaagattttcttcccaatctagattatatatttcagagagaaagcgtcctattttatgtacattttgtatccttttggtgtcaaatatcatgctatgaccataacagtaagtgtaatacacataatatcctccccccgcccccccgcttttttttttttttttttttggagttcctactgtgttccaggttccatggtaacattttccttgttatctgtaatcatcacaacagtactggagggtaaatacggtcattcccattttacagatgaggatacattcaatgtgagatgttaaagatgttcttcagaatttcccaggtagcaggcagctcatggtattcaaaaggtaatggttaagagaaagaatggataatgaatatcttgtgtctattttcttgagacagacgagactgagcagcctgagaacatttggtgctcagagggaggaaatgctaagaggggaaaacaagtctgaaagggaaagaaggatagttcaaagaccagtttcccctgcttcagaattctgactggtgccagctctaactgcgtatgtttgctttacttggaagatagaatcatagtgccagaattcacggaagtctgttttggaagatgcattagtcagggtatgctaattgctggaacaaacaatccccaaacttcagtagcttaacactgcagagggttattaccctccggtgtcacagagcaacgtgggtgggctctggtcctagcctggcttcttccatggctcaggtctgctatcccctaggaccttggagttcactagatattggcatcaggctgatcaaagaggaaaaggagagtggtgcatagacgattacatgggaaattttaagggccaggtctggacaaggcaagtattacttctgctcacattttattggccaaatcctagtcatatgatcccatgactgcaaaggaagatggggaatttcagattcctaggtggtcacgggcagaaagagatggggattggtgaaaacatagcctggctttagccacagagggttacaccagaggcctgcaagtttggtgaccactagttttcagaggtattgggtatttgataaaatccagtgtcttccagaggttgagcatgagccacatataaataactttcccagtgacgggccatcagcagtccaatgaagacattgggtcttcatgtcttcattggactgctgatggcctgtcattggggaagttatttaccttctctgaggagaaaataataacttgcatttcagagtggtttgggacactaaaggaaatcagaagatggaactgatttgttaactagaaatggacataagtattggttacaggtttaaaatgaaacttgcaatgtttgaggaagaaagggaaaatgttaatgcaaaaacaaaaaaggtaaagaaatggtgggaagtagattattggcactttttctttggaaacccattgccatatttcatgtaattaaacttcattccttttaatgaaacaattcttctaaataatacagagatttcccaccaatataatatttaacatttataattttcaccttaaagtttgaacatttttaattttaaaactgtttgttgcagtttaaatctccttatgccacagaactgtggactttctctggttgcaaaattctttacagtgtcttgaattgaaaagggcttaagtaaaaaaagctgggggaagtgggggccttttacaaacaaattacaactcatttggtacaataaggataattcattttgtcttgttttgcatggctgtatattgttttgaattcattctgcatttcggaagcttgcagtatttcttttctgtaggtttcttacttgtaactgcagatttcgcggtttcttttgtgtaccacttgcctcccagaatttggcccaacagttttgagtagctgaacaatttatcggggacagatcagctgaaatgtggctcaacttgagtaaagcagaaggaatgacataaggttaggtgactgatgtgtgagtttttgaatttgatttggttttacatggaaaggttgaagcaatgatccatgtattctaataaaaatcatcagtacaaatcaaataaaatctggcttagtggctattttcccactgtatcactcatggctagcctgtgctgttacagaccacatttggcaggcacggctttttcctacaacaaatcttaaagtaacattgcaatctttgctgtgttaaaaaggcatcttttctaatcaaactgtctgctaatctcatcagataaatcattattctctactgacagctccggctttcccggaaccccttccctgcttcttgttttctctcaagatgtctggttatcgtcattcttcaggtctttgcctctatctcctttcacactaatgacatatcttccattcctgaggaagagttacagctttttaccattccacttactgaattggtaagaccagtacctcagagcagctcatctctttctgaccggtattccactagttatcagatgggcaaaaggcaggatgcatccaagttgcagacctactagaaccaaaaatgcctattcccaggaatttgatgtgattaaacctaagaaatcatcagttgatgcgttctcatctctttcagctggactagtaaagtaaggcagatgtattttcactacttcagtagtgaacatgttttatagaacctgaaagtgaaagtaagggaagcagcatggtttagaggaaaccttggtccatttttccgtcatagacctgtcctgctagcaaagtcctgggcgtttcttaaactgatggcaactgcgtgtgccctggtggtgaaatggtgttgcagtatgcctgggcactgccctgtgaaaaaggacacacagaggggagactcacagttttgttttcattgctgacatggtttaaaaatgtacgttgctagctgtgaaaactcagtcattataacaccgtacacctttcttctttcagcaagtattccttgtgaacattagcaagtattctattctctgttagaattaaacaggtaatcgtaatagcatgaaagggtgaaagtatgtcttatgcaaaatagcctcttttatatagggcatctaccaattttcttgtgatttttgttttttcctcttttgaaaaatgattttagtctgctcgtgtttaggtaggtaacttctcttgatcccaattttatactttaaatgatcccagatattgcattttaaatgagatgagtatataaaaaataggaagcagaaagcataattaaaaattgtggttacattatcgtgagaccaaatgaccagtcagactcctctgaccaatttcatagaaaataaggaggtatcatttgaacaagttgtaacatatgggaactgttttaaacaccatcattgatatcaagaaactattaggaaatgcaagtttgtgtatcgtgtgtgtgtgtatgctgattttacacacacaggcacatgcacacacatgcacacacacatttataagcccaagtaagagaaacctttgccaatgtctgccaggcatttggctgaagtggaattgtgaggaacattttctcagcctttataaatcacagttgaaatatgtcagcactgttcagtttataaaatgacaagggctgtaggctgggcatggtggctcacgcctataatcccagcattttgggaggctgaggtgggaggattgcctgagcccaggagtcggagatcaacctgagcaacatagtgagaccctgtctctacaaaaaattcactgggtgtggtggtgtgtgcctgtggtcccagctactcaggagggtgaggtgggaggattgcttgagtctgggaggttgaggttgcagcgagccctgatcgcaccactgcactacatataccctagatgaagagcaggaccccatctcaaaaaaaaacaaaaacaaaaaacaaaaaacaaaaaaacaacgagggcttcatctaaaggttaaagggactgtttctaccttatattgattataacaagttaactcactcaatattgtatggtatgcttatgctgtattgaatggcaaagttcctctcacagtcttttttggggtcacccttcactcttcactttgtgaggtggctagttcatttgtatacctgctctctaaatgtgggaatatattcttttaaaagtggcaactcaacttatctcccccttctaaaatattttagatgtttccaatttttttttttgtacgtcagcccatggaaaccacactaaatttttctgtgtcatgagtatgcttgtctctgcatttgaatttaattgggaagtgcctctgaaatggcaggtctcctttttacacagtggtttacagaatgtggtgggaggaggcaccaaatagcctgttaggatagcatggctccaaaactgattctttaacttgcctttatacattgcattaattcacaagtggatcagtccatcttgtcttcatcttggccaaattccttcaaaattaatagtaaaatatgcctaaatatattcttgttcctgccctccccactcccacctaggtcacagggctacaactaatcattgtctccattgaaatgtcactagatgatcaacgattgaagaatatttcttaccaattcaaatagaacagaaacttcagtcaagtttagcatttattgccctacatttctgcggctgtcaaaaccagttgatcagagacgtgaagatatgtaaggaaataggaagctgtgatgggttatcgcttgtctaagagtggtacaagtgagacttgagggcattatcactttttaccttatacatttttgtattttaatttttttcaataagcacatacttaaaaattagtttgaatgttcttaacgaatctttccataggttactgattagttcaacagggacaaattataatcatacattgcagaatttgcatgccactttgaccaggtgatcaaaattggcatagcacatgaggggcagaccaacatgccatcaaggggctctggaagtgatgtcctgggaaggacaccagaccactattgtagtattatatccactggaatataatcatgaggaagcatctgatcctcccaaattgagaaacatttccataaaataactggcctgtattcttccaaaattctaatatcacagaaggaaaaggctgaggaattatgtctgattcaaatggataaaagagatagacaattcagtgcagtgcatgatcctggactttgtcttctaccggagagggaggaagttccctattggaatatggattatggattggatctaagtacccacagtatattttctgattttgataatagtactgtttttgttcttaggaagtgcacacagaagtactaaggtgcaaaaggatataattgatgcaacttacacatggttcagaagcaacatattatataattataactgcactgtaattgaaaacttttaaaattagcctggtgtggcagtcccagctacttgggaggctgaattgggaggatctcctaagcctaggaggttgcggctgtggtgagctgtgtttgtgccactggactccagcctgtgtgacagaacgagaccctgtctcaaaaacaaacaaacaaaacaaacaaaaaccccaaaacttaaaaaaaataaaaatgtaaaatatgggaagaatgaaaaaattatacattttccttgacttcaacccttgatcttttcttgatcagttcccaggtggggttaggatatctgtgttttttatgaggttccttggagtatttgggtggtcagccaccatttggagatcaccatgtagtgcctagattataaattatccttttagaaagagttgctggaatcatttcaagattggtcaggtaccaataaataagtaatagaaacaccctcaaaattggaattgaaagagtggaaatttattttatttagtttggggatatgaacatggtataatattgtcgcattttttctggagtttagatgaataagagcagcctacagttgaccggatgacttaatatttttttcgtaccacaaaaattaaatgctttactaaaactttcattctcttacaattctgatgaacaaggttgtactgtatggttaagtatcacactgtaaatttaggcaatacatgtcctattgagcccatggagtaaaatagattttcccgtgatccaagctattacaatttcagatgtgtaaagtatttcaaattcattttaatagactgcttcccttcaaatacatgtggaggtagatttatacaactgtaaacagtttatgcatttttacagattttcattatatgtgtttgatactaatttacctctttttaattgtaggagagataaagaattagtagtttaaaacagtaggaactgcgtgttctgctgtgatcaaggaattagataatctggcttgtttgcttaaggggtctgtatcttgagacttttatagggcagtattaaagctctgagcctccttattatgccagtacccagaagattgctttaatgagaagtaaagggcctttttccaattacaagggaataactgcattaagttcctgtgttatgtcaacctgctttgatttgattactatgaaagaaatggatttatctgtcagtgttacttaattaagccttctcattgatgttttgcagagtaatatagtgtggtttgcacatttgagcctaagtacagagaaaattggcctaaaactaagacatgacccctgaagataacatgcaagattgatcatttgtcattgccaggtcataggctgcagtgttaaacataggtggaaggattgccatgttgaaagggtaaaatgaaaatcagtttatgggagtgagtattttaagcaaaaggggttgtggtggaaaactggattttagggaggagttttgaatatgtaaaactattgacttcaccaatattagtcaagcatctggaataggaaatgacaataaaacaaacaggagaagtagattttgttaaagtataaaaggaaatagaagaaaaaggagaaagcaagaggaaagaatgccgtttgggagaagtagaccattgtggttaggcagagcaattacagcctacagatatttcaattaagccagcctccccttctcagaacctcacaaatggcaccctcgggagaaaagaggtatcaggaaagaaaagaagaaaagaggaaacagttccatgtttcatgttggctaacctctcccaagaataaattcaataaattatttaccaaataggcattttaaataccagtttgtatatctgaagtcattacaatattatggattttgcactataaatattacatgtatggtttgaaaaatacacacgtaattacatgtagacattatcagaggtatatattcagttttattaggaaatgaagcatattcttaaatgtattccttagttgtttaacactttgttttctaaagtatctaccttttatttcttgcactctgtgatatatctttagaaggtgatatgtctttaggaggtgccaaacacctacttaaaaacttccttgcaatattttcacatttatttaagtactttgaaacttatctgtgtaatgttgaagttagatggtactttgatttttttttcaaagtcttcagatatggtaacttacttccaattgttattctcacgcaattcacaatgtttactctccaagaaaactgtcttagttaagactgatttttaagtgcttttagattggtcacatttcgaaaagtcaaagaaggtatatatagttcacgttatactcttgcttgagttattcatggctcttatttgtaggatattgctttaaaaggtaggatccccaaacgactaacttctcttcaagaggaagaccccagctagccagtcccatacacttgaaaggttgctaaatggcactcatctctcagcatttcacattatatattcaagctagggtataattcaagttagatgatcgttgacacctccaaatatataaattaatataaaggcttcaatgtacgtttggttcagttgcataatgtaactgtttaccaccttgagcttcaaaaagatttctgagtttcaatataaggaacaccactgacatatttgtaacataacagttacccacttcattttgttactttctcattatctgaattttatgttataggaagatgctttccctgtttatgacagcacacaatggaattaactccatatcttaagcagcagaaatgtagtgttcatttttgaaaaacaggttattttgaacttaaggaaaataatactgttttaaaggacttattaatggaagtttaagttggatgttaattaaggctaaaatattgcagtaattgtctgcgaacacttttttcctactatactttctcaccagcatatctaccctttaacttttcttatcatatgaaaaatactctaagatgatctcatgcttgacctttgagtttcagatttatttggttaggaaatccattagctctgagaaagccagggttgacagcagtcatctgaaaatggaaagcccaggtctgtattctttatatttgacttatcttttttttttttttttgagacagagtcttgctcagtcaccgaggctggagtgcagtggcacaatcttggatcactgcagcctccatcttctgggttcatgtgattctagtgcctcagcctcttgagtagctgggactacaagtgtgcaccaccatgcccagctaatttttgtgtttttagtagagatgggttttaccatgttgcccaggctgatctcgaactcttggcctcactttttctagtctgatagttttgattgctgtccacataagcaaagtagagctttgagtaatcaaatcataatccacctgcctcggcttcccaaagtgctgggattataggcgtgagccatcgcacctggcctgacacatcttaacatttgtgtgggaagcattgacacaaccctcatcctttgcttagtcagatttgggaagtgctggaagcttcttgtcgagtttcttgttagtgcccagatcactcattctgaagcaccatttcttatgtctaatagaaaacagaaacaatcatgcttgtgtggacatcatctgtcaatatttgaatctcctcaactcttcctatgtctgtaatagtactcaaatttgacttcaaattactctacttagagctcttattatactgggtgctaatgaaaatgtgcacatccttaacacgctctttgctgatgaaatattttgaactctaaattcatctggcactgacggagagcatatgccatctcagtttgtgtgagggctcagccaagggttcttcctggactaggaaattagtaggagccacagatgtacgcagtctgtgagtctccataatggtgtagaggatatttaatagtgtctgttgttgcaggaagaaggttttgaggcagtgtagacttcattgtgtttcagaatgattatctttcctggaagaacttgacatcctatctctgaacgcattctgaatgtgttgaaatttttattaagaaatcaatatatttccacaagagcaggaatctgtagacttagagcaatgcaaaataccatttcaggcatttttctaatttcataaaactctagggtcctgggtgattggcatgttgtaggctcagagtatagaaaggacaactacacagctctacgtcaaatcaatctaggtaactttcatacttgtttatttcaaatcaagctgaaagttacatggtatttagtctgtgttcttagcttgggactctgatcagcatacataacttctgacaacatgtcatttgtgtattacacatagaagtacactgagatataaagagaatactctaatggtaaactaagccactgaataaatctaatgcttactgaattcttactctgatagtgttatacagggtcacggagaaggtaggattgtttaacctaaacgttttgggtgtttctaagatccaggagagtatttaaaaatcactgacctgtttagcagaacaaggagtcataaaaatgtaaggctcagattttcttagatattggagggtattattaaattaggcactcatgataaatactggtgactatggtagatatttactacggatcaagtactttcctaagtgtttaacaaatgttagttaattcatttactttaacaataactccttaatcttgcaaatactatcatccccttatcttctgttagaatactgactttggggtatgtcttgggttttcacttctgttctccttgactcaagaggccattacattttcaaggctgacagatgtccccagggcaaaaaatgtgttttcttcttccctgggttccagccttcactttgattttggctccctgattccttgttatcttgtctgctcagtattttaaaatttttcaaaaaactgttatccatcatttttagttttctgtgggagagttgtccaaatatactagcctgccctatttccaagaatggaaatcaaacttgcttatttcgtagttcacaaaaatgagtacggagaggccagtgacttgctcagaccagagaactggtcactgcagagtccctgctgaaatccagctctttatcccaactcccagtgctgtgttttctaaagtttgtctagtctgtctgatagttttgatcttgctgaccacaagagcaaagtggagctttgagtaatcggattacaagtgtaatgaatgtggatgggaaatcgcagaaggtaagaattatgtctgaacatctttcccctaaatagagtgtttggtcatagttctgcccaaactgttgtgttttggcactgatctgtcaaatactttatttattatttttttttttgagacagtctcgctctgtcacccaggctggagtacagtggctcgatcttggctcgcggcaacctccacctcctgggttcaagcagttctcctgcctcagcctcctgagtagctgggattacaggcgtccaccaccaggcccagctaatttttgtatgttcagtagagatggggtctcaccattttggccaggctggcttcaaactcctgacctcagctgatctgcccgcctcggcatctcaaagtgctgggattacaggcatgagccattgcacccgaccaatgtgtcagacactgtagaggggactcatgcagaatgaatcaaataagatgaaaatttgtggattttcagattgcctcctaaagcagccagcaatcccatggaagagttactaaatctatcttggtttagggtaaaataagaaattagaaaaatcttgaactgagcccatttcagtcttttggaacaggaatttctatcatctacttgctttcttcctttctttttgcccggggtaatatctttctctttattctcccatcttggaaaaagggtggcaatagaacaaggggggggggggcgagaactaaatagattcagcagcttcatcccaggcagtttttcatttgtcactatgttgccttaatggatttcacacatctatttcctgtatattgtttagtctcacctctagatgtaaacacttctcataccacaatattatcttacttttcactttctgctgttttaactcatttcaataaagaactaatgagcccaccattgtacagtaccacacaagatgttatttgtgtcaagtatgtttctttcctataataaacgtacatcacagttgggtatgatataagtatatagctctatagctgtatatatattcacatggttatttggataataaattctgtgtacttgctgaactatcgtattgagccagccatacaagttttatcattgtgcctactgttgatactatgggctgctatgggatattctgtcctctgtgttgggagctcacagatattttctgtctggcttaataccaggattaggtatgcttctcctggacactttgtgtgtttttatctgatggttattgtcaatcttgtttccctctctgctttgtctacttaatagcttctaaagttttgacccacttctagcaaatagccagtccttcactgtgtgcattttgataaactcatcatacctctggccttactgttctgctacttttattttgcagtcacttgggtccttcaaatattgatttcgtatattttgtgttgtatgtgtttctgtaatcttttgtggacacaagagttgggtataaactcccaaataaatatattcactctgcgtggggagaagtgacaggagggaacgttcagctggttagacagagatgtgacattcttactggggagtctttacagcagtgggcagagcttcagcctccttttgtgtccaagctctgccatttcctgatcccttgggcaagttttctaacccatctgagcctcagttcagatatataaaaccagaatactagtaaggcatttgagagtttagcgcagtgtctgacatacattcaagctcaccacatgtgagctgttactctttctttgagaggtgaggaacagtttaggcagaaggaatagcagttacaaaaacatggtggtataaaagaccgtgcagtgtcctggtaccctagcaggagtaaggaatggccaggtgtaggccctgtgcaaggtttacatgaaaatgagtctggacaagaacttcttggatgctcatgtgatggaggtgtatagtgaatgctgctgaaaccagcaacccagacagcaattttaagatatggagtgagagaggctgctgttggtggtgtggggcatgcatttgtcttgtgttacagtggagtagtcctgtggttctcaaactcctgtgtgcataaaagttacctggggacctgttaaaaacagttttctcagccccacccccagagtttcagactgagtagatatgagacggaccctaataagccaatttaaaaatgggcatacaggtgattcaggtggcggatacactttgaaatgcacttggtggtgcactggaatagttattgaggaaatgctaactaaggggcaggcctgacaaagttcaaggagagggaagatggaagaaaatgacttcaaagtaacatgtttacattcattatgaattaccattgcgcatgctatggaaacactagtttatagtgtcttctatggatatggataaatgagcaccggtcctatagatttttttcaaaggtaaaatataattagaattcatatgattattctatttattaggtttgggagagctagtgatttgtcctcatccttgagatccagcaggagaccaagggaaggggaagcctgttcaacagagagcaatcaaagaaagaaaggtgcagcagcgtgaggtcaggaagtgggaaagatggaaatgggaaagggtggaaaaagagcagtcagatccgattggtcaggaatctatttgtgaaggaacccagccagtatttaacctgctttgaaaaagctagacttccagcatttttaattagtggattgctcgcttttgaaattgcccagttgggaatactcaagtgttgatgtgttttatctgcctgctaattagcaggctgcttggttgaccattacttttccttttttctgtggacagaagatgtatatgaaggtctcttggtacattccagctcaagtctagcttaaagtgcataagaaaaactgtgtatttaataagagttcttactaaattataaatcaaattttaatacatcttttctccaacttgattccttttgctctagcacagggcttctcaatctcaacacaatttttatttggggtcagaacaccaaaaatatatatatatatttttagggacagggtctcactcagttgcctaggttggagtgcagtggcacaatcgtagttcactgtaaccttgaactcctgggctcaagggatcttcctgcctcggcccctccaattagctaggactacaggcaagttccaccacacttggctaattttaaaaatttttgtagcgacagaatcttgccgtgtttcccaggctggtctcaaactcctggcctcaagcaatccttctgcttcagcctcccaacgtgctggtatcacaggtgtgagctgctgtgccctgcacagggtatttcttactgtggagagctgttttgtgcaattatgagatatttaatagcaactcttggcctctgtgtgatcaatgccactagcaacacccaaattgtgacaaccaaaactgtctcctgggtggctttgccaaatgtcctttgggatgcaaaagccccactgacctggcagtagcgtcctctttcctccaagtctctgcctacttttcatgtttaaaatcctcttttaaaattgaaaagataaaatgagtccaaacaatttgaaatcttatggtacttatagggattcaaatctgttcctccattactttttggccaaattcaagaggagaaatctctcaaatgaatccaagctggctgttataggtgaaaagaaagtcaagatgcgccagacttttaaaagcttgcagtggttgagagattttgttatttatacactttttattttggctgaaaatatttggtttttgtttaagaattaagagaaccgtgtaggctacaaaatttatttatgtgcgaatcccagagggttgtaagtagcttctttgtgtgcttcagttcaacatatacaggataggccagcatgttggattgttaaacagcagatctggggaaggttttacaccttttctctaggcttggtgcagtcccgagagctttcttgacatgccttgaagctcacagtgcactgatttaaactgtccataggggacatctgtttgcagtttgtgttatctgctgaagcaccaactaaaaggaagtgaaataatatttgtcattaaaaaaaaaaagagaagttaatttaatggtaataacttagttgttgttgcttttctatctcttaagatattctgaaacaccatgtactctactgtatcccaaaataaataaattaattatactatgattacttctgctgataataaaatagcagtaataataaaaggaatgacagtagagcattaagagaataaacagtatcactgaaatgtgaggaaacacaataaatgggattgtgtctcctgaaccttagtttcacacttcctcctccacttctgtcagagggtgtttgtgatggccgtctgttatcagccgtgatcaaaataatataacagtgaaactttttatacttatgaaggccctttcatcaaaaatctcacagccatttctaaatatagagcaactgatctttaaaacacttttatgttttaagcaattaatatggtaacttagctgttagactttccatcctgcgtatttgccatttggagcgtggatggaacatttcgtaatctactcagcattaaaactttgctggtattgagtttagaattccaacttttcgatggttcatgtaggtcttttcactgtcatctatcaaaacaaaacattgctttataatggaataaccacattcatttccacatatcaaaacccagattaaggattatagaccaaatggtatgtctagtttaaaaaaaaaaggaaagacagagacagtattgtcttaacctaaaaaaaagttttgtttcagtcctaatatccctgtaatgtgctggtggaaatagactactgaatactttctcagtctcattttctgttgcatgtctggtgtcttctgtgataagcctgggctatggaacaaaaaggatccaagagcattatggcgaggatgctaaaggtgttagtgtggatatttaccttaatttaactttttttgcattaaagttatgttagtgcatttttaaacttattttatccaaaagattgtaataaaactttaagtacagtttcacatctataaagactgaggctatcaaacactgtgaaggatggaagtaatttttatgtttatacctctggttcctgagggtccagttcatttctactgtgaatttaaatgagttaatttaagtagatgggtcagaagccactatcatcatggtagcccggtgcctggttcttaattaaaggcaacaggagattaatttgaaacattaatttgaaagtgcatatacaaaaagaaaaaattactgcaagaaagcctaaagaacttttctcttgtccctagatgtagaagacagaagtagctcagggtcctgggggaatggaggacatccaagcccgtccagggtaagtatatctaatcttttctcccacaaccagacatcccacatatgtaaattgacaaacagaaggtgtgtttctctctctctctctctctctctctcacacacacacacacacacacacacacacagaggcatgggcatgcacacgcacacaaacacacacgcatatatgtgcatactaagtttaatgaggatcagcttgactttggaatttttttcccccattctcttattggatgctgttattcaatttgacacctgttccacttctgctaaccagaagaaaattccttcgttacatgtttggtctttcttttgtcagttattgatccatattacataatgctgtttgttgtagatggaaaaacttaaaaaaattcctaatatccctataaggtattggtgtgaatagactactgaataatcccaaagatacactatgaagttctatcctaccagtataatctacgtactgaatctgagttgatttcgctatgtagacatgttatcattccaccagtagggactttgatcactagatggatcattcatttatttgccctcaactttttgctattcttctccacagttttcctacatgcattggttgtttcttggggaagacccaaggaatataatgtaataggaatgtaataggaagaccatggaataagagttgggtgggtggttaagcaatacgtgtttcttgtatgtatatgatcttgggcatgtcatttcacctcttgggtcctcattttcttattttgcaaaatgaggaagtagatccagaggatcatctgtgtttcttccagtttaaatattcatgattttgtatgaaatttctttaactgaatcattgctaggccctctaaaatccatgtcagtttttatgatgtacatacaatgccccagattaaaagtacacttcgtgtacatggtaaaaccagcatgtcttcctttcccaaccagctatatatatatagatgaagcattctgcagggagggtaacattttactgtaagtgttcacacaaatttgggttgggggaaggttccattttggcataagaggcagggaaggtaatcaagctgtcaaaatgagggcatttcagcaagtcagagctagacatttccacctgtccttggcattgtgatccttagtctagtgttcagggtacagcaggatctctaagcttaccagtaactttgtgagcccttacaccagctgtcgagcttgacattctaatgctttatatggatgggttgaggaaatctttcctcctcctcatgttacagtctgcacttgcagaaataaatccattccccttgacagcaagtggagatcatagaactcccctcaattgtttagttcatccagattttcacaatttcttatgatttatccattcagtacacatggtacttttaattgtgtttcagaaaacaaggtctgtttagaatcatcttaatttaggattaaaactaactagcttttggtttttgttagctgtcctgccatttttctcaaggaatatattggtgaataatttcaaaccaattttgtgtaatttatattttctaaatccagaagtttgcatgagacaaatcatttgtggcagatttatacccaggcgtactttcaaggtctctcttttttcatcttaacatggggatagtgtctaccttacagcactgtgctgaggattaaattagataatatatattaagcttttagtacactatctaggatgaggacacttaataagtgataattagcattatgcaatgcctggtatagagtgagtgagtgtactatgatgggtatttaaaatgtagcctctttttatagatggacatgttggcagaattagattacagtatcaggcaagttaattgttatacacgaggaaaggtgattgagaacggggtagttttccttaaggttgaggggatgtgtcttttccttgttcatgcagcagccctctcttttgtgtgggcagattttgccctttggctcacatgcaaccgatacctctgagtaaatttgacttagactttcatgggcagttccaccagctgagcagaatgactttttcccccctttttggtcactttatgcactttagtagactgaaagttgaaccatgtagtatagatgattttaactctttcctattgcgttatcaaatttccccattaaaattaagtaactggacagcttaagaacattgttttaattttaaattccccttaaaacaataagctgattgtaataatgaaatatttctgtcaaaatttgtctgccttacaactggttgttttttgtgacatgctttgtccaactccagaaatgctaatttatgctaatgttttgatgttcatatcctagttaaaccctaatattcttaactttcttatgtgttaattacttatgtgacaatctagttctcttacaaccacaataccacaatagtaactataataaaacattgaaacttcagtatcctaacaccaaatgttattgtttgaatggctctatcttggtctttgaaaagcaattcattgcatgctatgcctaattttcccttgtggcacaattttgctttaatgtggccttattaaaataataatttttaacataagcaatatactttgtatgtgtctggtgtcttacatacactattttatttaatcatgtcaacaactccatgcagttgataccattattattattcctaagatttctcagctattatgaggaaaatttggacttcgtagactctagagctttcttttagccactatacctgtgaaagtgcagattccttctagtgaagttccagggagggaatagtggactccaatttctttggaggggagaagttttggtagtggagctatgtttgtttatgtgctgtttattaatataaaataataacttacactgtcattttatttacagaactatggagatgggactccctatgaccacatgaccagcagggaccttgggtcacatgacaatctctctccaccttttgtcaattccagaatacaaagtaagacccattttaaattaacttacactttttgaatgctcaagttttactatagaaggtaaaaccatgtcctagacagaggttctgcttttagaaacttggatatttagtcagttcacttgtaataatcttaaattgcagagaggattggcagtctgtgtttggtaatagtgcattaaggattaagttttacaagcatatggaatgaaatgcttttagtgatactgaatctatgtggaaattttgttttccttagacctaaagcacggaccacagtttcaatgttgtatcagtagtttcctaagttaaggtagatgaagtcaaagtggtgaatatttagaataaaaatatcactgggcttgttggttggcagtgatatatagtcagtgttaactgtgatttctgctaaaggggttatgaaaataaatggtgttaatgggcttagtgtgcttaaatcagagtagtgcattcaagttgaattgtaaaatctgattgtatatttatcaaggcatgaactttagtgctaatggcctaggcagaccccatcctgctttattaaagcaagttacctgttagtttgaggctgtctgtgaatctccggcatgccattcatcctggcatcctcagcatgtttttctgcttttggctaccctgtagggatgtttgtttaacagcagtaacttgagcaatgaaaagatgattcctaatggcttaaaaggtcccaatagctggctactttagttttgattgaaaaaaaaaaagatctttgttctagtaaacatgagttcttaacaatattagtaaatctctcaacctggccaaattctcttgagaatctgtcaataagtgaagttaaatttcttggtacaatctgttggacaacactccaaggaaacacacacagcgatgattatatttttctgagaccataactgcaaatgcttctaaagaatgtcatgattttaagctttggaagctataccagttacttcaggtccttgaatctcaggcattctttgaaaaatcaccatcaaatccatctaaatggatttcagatatttaacacaaaatagtcaaagcagataaatactagcaacttatttttaatgggtaacatcatatgttcgtgcctttgagtatcttaccaactttgagaaccacaaagttggttttggtcatagaatgttcttatttttgtgctatttttgccttcaaagtagtaaatttcatatttacgttttaacattgtaactcaagcaggaatcccagttctttatcagttgttgatagaaaggtgcattgtttcttgttctcaggatatgtagatacaggtgaccagatatatttatcaacttagattttaaaaggcagcttttgactcttcagtgtcaatagttatgattttatttctaacacccttgcttctctattcatctccacacaaccacttagaataaaagattcacttgaaaatgtagtcttgagaagtagcacctaaataatatactaacttccttggatcctaaaatgatcctccaatgagctacagtaagaaaaatagaataaataaatactcatagggagacgcttatgttatctatgtgaaaaaagttttaactctaaagaacaacttgataaattaatattacagaatacaccaagcagtacaaacagattaaatgattgttctgttcatgtttcctcatgggcaactgctttacaaatcaaattagtttttcaacccaaatagtatttaaaatataagtggcctgacagtctagagcggagagagctgattcttttcacttagttgttgtttaggctgcaaatccatgtcagctttgctcttttatcctgtctgccctccttcccattaaactcttaaatatggagaccaagacagtctcctgcattgtgataggaaatgctactatgtccacgaggcccccacccactgttcccagtgaaaggacttctctgttagataagctgtctggtttgaaacatggctctttattgtttacaaactgctacattttccacctcgagcagatttttgcacagaaaagaattgtgcttgggctaaatggtttatctgacattaacggcgcagtgtcagactggggtcagggaagtcaccctcagagcgagagggtattgcgcggtatgcaaaaaaaatggaaaagggagaaaaagacattgaaacaagtatgaaataccttacatttttagtttagagaagaataatttttttaagagaattgactcttatgctgcattaaaaacttcccatcgctataatttctcacacacccgatgccttcttgattggcttgcgtatctgaaggctagattcggggaacaaagattctcattgattttgcccaagctgctgtttatttaaaatgaaaccacttttcagatgagccatatttggtgttatgttacagctttacaaagaaaagatagatcattttcaagaaattaacgacaattaatttacaaatgataataaaaacaaagtaagatctattggtgtaggggacagtttgaactcatagcatatatgctgtgttctaaaccgcactttgtgtccagacccagagcccatgttgtgacctttgtggatattttccttctaccaaaagaaggtagtagactttagcataagtgtttgacaacactccagtctccactttcagaatgtttaactggtttttgttaaaactacaaagtatttgtttctgtctcaaaggcttaattctgctgtgatgtcgcatcagggtaaaagctatagcatcagaaataaatcagccactttattggagcagattctctattgtcaaatcaatcaagcctgtgactgaattaggcgtctgctacagaaataagtgacactaattttataggaaagagttattaactgcagatgacctgatttttttttttcctttttttggtgaactgttcatttagtaaggttttattttattgcaaagaaagaaaaaagtactggactactctttccttttgagagtggattatcattaattatgtattttgttctttatggcagtatacaattttagggaaatgataacaggcattgctagtatatttgtttataacctctatggtaatgaaacccattattacaactctgaacttcttgatttcacatgaatggttttgcattttacagatttttaaacataatacttctatttggcactgaaattccaaaacttagttcatttgtgtctctatttcacatttatgcaaagtgggatataaattataagagtaataaagtgttttagcctaggcaacatggtgaaacctcatctctaccaaaaatacaaaaacttagccaggcgtggtggcacacttctgtggtcccaactacttgggaggccaaggagggaggatctcttgagctcagggggcggaggttgcagtgggctgacatcatgccattgcaccccaacctgggcaataagtgagatcccatctcaaaaaaaagtaataaaatgtttgttttaatttattcttttagaaataatcttgtgtgtgtggaaaaatgcactatttgatagtttgtgaatccctaaagtaaataaaacacccatgtgtggttatacatgcatgcacacacatgtacacccatacacacaatgtatgtatcatgctagaagacttaatgacgtttcttggtttataagattgttctgtattcctgtctgtggttatagttgtcatacagggttttagtggttgatacttgtaagtgttttaaagaagaacctaactaacagaaacaaaaagcaagctcctaaattttttttaaataggtgtgaatagcctttgtgtttgttttgatgttggcagggttgagagatgtcagtactgactgcctacattgaccaattcatatacttttacctgacatttactaagaactcactcgttgctttcattgtgtagatacatgccaggttgcattttgccttagttgaaattccatgcattgttttatatctggagaaaataaatcatttcttccttgtgactgcctatcattattaatgattataatgtacactggacctattggagacttcttcattgcagtttttaaacaatttgatgaaaccttcctaggtggtccattggatacctttcagagtatgctaatggtagaaagggtcgatgagtctaattcctctgtttttttaagagggttatttatatgctatggaatagtttgagaatcctggcaagaagtgtatggaaagaatatggacattaaaaaaaacttttttttcctttgtcaagcactaaacttttgcaggtaattgtccagatatttttacaatggtagacaatatattttctagctaaaactgtttgctccaaggaaggagctaagcattccattttccttttattattccagagcatcgattgaaagctagattgaggataagtgagcaagttgccccataaaattacatacatgcatttgtgactgaagggtgtgaaaagcgatacttttgtacatttggctacagcttagttcagcatcggggctatgctttcacatggcccattttgaatggttcagtttccttactgtggtatttggttctagtcctactcatggtactctcccagagcattaaataatttaccgccatagggtagctgggttctaacctagctcagcagaacatttttctgctggattagattgaggtttcaggcagaactgaagaaagctgctggcttacaggatgacctttgaatctcatctgggttagcggttgatattttgatttggttactgtggtcatattgtgacagctgctagctcattataattcggttccaccgctccgtttgcctagcaggaatatttaggtttgtattacttcagagtgtttatggctaccctgagtttagcccagcataaaggtgaagtgttgtgagtgttttcaaatcccagtggcagaagcaggtgccacagtcttcttgtaaaacagcaaatgtgagtacatgctaatacagggagttttactcttcattgtaaaacagagaataaccaatgaatcagcttttactaggaaaagtgtttttggaagccttaatgtacaaaggaaaagcatgactacaaagaaacataatttttcaaagcacgaatgagatgttacctgacttcatggttagatattttgttctttgcagaagtgtgagtattagaaaatagtaaaacctgtacaataatggcaatcatttgatgtttgaaagttccaaaggtcaaataatctttagtaacttcataagaacggaactgtgaatatagatgtcagctctagaaattttagttcactttttaaatgcagcgaaattaggtagtgatacaagcaggcccctttgctagttcattagttagggacatcttggtgtgcttcttttttttttttttttttccaataacacctttcagcttgatgttatctcgacatcaactcttaagtgttggacttataatgtggcacaagtaatttctgagaaaggaaattattaattgtggtcttatttgattttactttgggaattttcatttctttaatgttaaatttaaaatgccctcctgaaatattaacaagtatgactcgtttgagcctcatcgctggtgtttttagcaatcttgattgttgagctaaggctggtagtcaggagtcaggagaactcagtttttctttcttctacttcttcctttcttcttctacttctccttcttctttttcttttcttttttttttttttttttttttttgagacagagtctctctctgttgcccagactggagttcagtaggatgatctctgaagcctcaacttcctgggctcaggtgagcctcccaccttagcctgctgagcagctgggacgacaggtgtacaccaccacatctggctaatttttatatttttagtagagatggggttttaccatgttagccaggctggtcttgaactcctgacctgaagtgatctgcctgcttcagtctcccaaagccctgggattacaggcgtgagccaccacgcccagccaagaattgagttttctattctgttttgctacagctgcctgtgggtcctctggtcaggtcgttttcacatctttaggttgagggaggaacagctctttaggtgatctctgagataattttattatctaatggtccattgatctttctgatatgtcattttatccttatactatattttctctttggagatgttttattgttctttctaatccattcatctctattttatgaataccttcaagtgactttgccagtgatgtgttttccaaatgtaattctttaaagcctaactaaaatagatattccttttatatctcagctgattccagatctatagctaaggaattggattggttggggataaataaaataataactcattaagttgagtcaccaggagaaaagttctgtgcatagatcagtatttagcatagaggttgtaggacctcaataaatgactgtcgagtgaatcagggaattagatagatagggtttaaacgttgaatgaaaagcccatacattaaagttaggcctataccttactgtaccaagaagaagaccctaaaccagagccagtcatatagaaattcacattttgttctataggactatatccttgactgggcaaaatattctgccaagataggaaacgggccatattacagtgtggcctgtttcagttttcagtacaccacagattattttatatataagcggaaataagtaaaatcaataatattttgggtcgggcatagtgcctcatgcctgtaatcctagcactttgggaggccaaggtggaaggattgctcgagcccaagtgtttgagaccagcctgggcaacatagcgagatcctgtttctacagataataaaaaaattagctgggtgtggttttatgcactagtggtcccagacattcaggaggctgaggtggaaggactactggaggctgggaggttgaggtcactacagtgagctgtgattgtgccactgcacttgcactccagcctgggtgacagagagagaccccattgctaataataataatacttattactatatttatatttttgtaattatataataataataattactattattattataaataatttgaaaggccattgaaaaaagttgcgtttctggtattgagctaagataactgatttccttttgtccagtcagaggacatttccattcttctctcattggtcttgtttcctttccggcctactctgtgatatagcacagctaatgctgtggtcctcaaacacttttagagtccaactaggtttactaatccaagtcgtataacatttagaagaatttctaaacagaaaaatgttacttgaaaactatggccaacagagatgtatagaccttctaaataccaggggaagatttctcacatagaaagttattgacccaaagagaagataaatcatttaagcttcacataaaagtaaaaagcaatttgtatcaggtaggaatgcttttgcttcgaagtaatggaaaatgtgactaatgatggcttaagaataatttttctcattctagaaatctggtggtaggtccctgctggaagtggtttgcagctcagtgatgtcagggctggtggctctgtgattcttttgtccttcccctcattgtctaaagatgggggtcacagcttcttgtgtcaagttcaggtttgatgcagaaagaaggggaagggtgagttgagtggtgtctccccaccacactgcttccccataacccaggccatctccagctgcagaggttggggcagggctgggaatgcagcctgggaaatagacaggagagaagcaagtttgggactcatactgggcttactaacttgcagtgttcaattcacactttaattttttaaagagaaaaatatataattttctatttaataattttgaaaattaagaacaaggccttaactttcatgtaataaaaatatataaaaagatgtctcagctctaatttctggtcagcaaattagagaggaagatggagtaggaaaaaagatactgtaaagaggaagatggagaaagtacaggcatgagcgtcttgcatgggaaggagcgtgaggtctgctgtttgcatctcaccttcaaggcctgtgtcttcattgtcctaagcccttgagcaaggcagcaaccagccaaagccagctctccttacctttgctttccccaggaccttctcttttaggtctctggcttgactttctgccagcctgtccagggcacccttgtcacgcaacaggcctgtagctccagccaccaaccactcttttctccagtcccctgggtggtctttggcagagccaaaggccaggctttactcccagtgtctcctgctgcacccatccagagcaggcctggcaccctggagcacgtccctgggacatgctgctacaagtgacagacaaagatctttctcctggaccattgcccaaacagtttccagggaacttacctccagcaacctgccatgtcaccatgaaacagtcagacaagaatgcctactgcctaggggagaaaaccctctattttcttttaatatgtacacaattgcagttgttgatttttaatgtggaggattaggtgcagccaaaagacatttagttttagacaacatgccaagactggatgaaatggtgagagctggatccaacttttgtccagaagtttcccaaccctattgaacagtctcatgtcatgaatcagacccattggaacagaggcagggggaaggaccatctatcattaaaggtaaccaggatgtgaaataaacagtgctgcttttatttagtagaaaaagtttttctctaggtttttacatttttatttattttcatgtttttatttacttactttctttttagacacagaatctcactctgtcacccaggctggagtacagtgacatgattatagctcactgcatcttcaaacacctaggctcaagtgatcctcccgctttagcctcccaaagttctgggattacaggtgtgagccactgtgcccagccaattctctaagtctttccttgggaagatggtttctctgaattttgcataagccctatacttaaaatgtgtctgtgacagtattaaccagtaccctacttctggactggatcttgggtggcggggttgcgattaaacactttgtgtttctcaaacctctcattactccatggcttcaggagaataacatcagtatagttagggaatcctgaacctcacatccttgaaacttctgtgtccaccttaagtgctgtattcatcctcaataaaaataagactgctttctttgttcacattatatattcttagaaccaaagaagcaaaggagctgttttgagcagtgcacatcttacagggtgtcatgggacagtggattctaggtcttcaggggtcacttcagcataattcttggcttttcacttcctagtgatgggtgatgggacattgggcaaatttcctcagagcccccgttttctggtttcccaggtgaggacagggatgccagcctggcccacccctcccaggctcactgagaaagatgtggtgatgtgatacactttgtaatcactgtgctctgctgtgtaactgttagggcattgcaaggctaaccactggtcatctgtcattttcgtctgggtaatgaatggaaaaatctatagactttggggttttgggtggtagcaattttaaaatacctataccttctaaagagattggaacagaaggcaggagcaggtggaggtagtatagaatgttcacttctgtaaacatcaagaccaaaatgaaaaggcttcttttttagccagtccacaaaacagtaatcctataaaataagtacctctttggggacagctgtgttggattcagatgctcccttttgtgaaatatttgcctacagccatgtttctctccattttaaatgttctcaagtttcatctttaaacacaaggccaagaacaccctggtgtggtgtttgagtggtgagactagggagaacccactgacaaatgcagatttctttgcctgtgttgtaggtcatctgaataatggagtcactacaaggtaccatggttttcatcaaggagatagttttacaaataccttccatattcttgggaatgttttggagacagtcctattccacttcatttctttcttctccacagatgcttggtatagaatgttgcctctgtatatgggattattctctcattccctttactccacagacgcttggtatagaatgttgcctctgtattggattattctctcattccccttactcttaagagtttttgaatccgaaggaaacatgttttgttttgagtaaaaggaggtgttcagtggatctcattttcttttcttttgcggaatatgaggcctaggaactaacaattgcaaaatatatggagcataggttgagattaaattaaatttatttctaagtggttaatagacacagctcgaacatttttcatcttcttgatgattgcttattaatcactccttaattccttgacacatttattaataggaaaaattgcaaggaagcatcatttgaaagtagtataaaatacagctggttatattgtttatgtttaagataaaacatttaaagctttcacgtaggttgaaaatgccacaagagaactaacatgggggaagtggtggatggtggacctagcagagcactgtggtcagctgggcattgctgtgagcaccagctcaccactctccagttctgtgaccttgggcaagtttctttagcactgtgatgaaatttctcatctaagtagttgccctgtgtttaaaagaaataacgtaaagccacctggccctaaaattcagttaatgcaaattattattacacctactattatgttatctagtctgtttttctgttcattgggtccgatcagcttggcaaaagtgatatgctaacttgagcatcatgtagtgaattctggcagaacgtggaagtgattaattaaatgccaccccctcgtgggccatattaaagctgaatgaaaatagaaagtgtgtaatatctgataacatttggtggagaagggggagacagaaaaattgaaggataagagaaaaggagacacatataaagctaattttagagcgatagatcacaaagtaagattttctagctttgtattatcagcattggcttggctttctgagtctcgaaattactaggttactgactggccgtgccttttcctcaccttggctattcagaccaagctgtactcttaacagctcagtagccaaatctgaatgcttcaaatataagcataaactctttatgtgtaactgattgcacttaattgggcaataccaaatcatggaagaaaatttattagtgaccctgtctccttcagaactttcagagtaattggaaatgagcctaatatccgtgtttttgaaagctttaacaattggtctactgacaggattaaattcatactttatatggtgtgtatgttttttcatgcttaagtttttttccttatttattgatggtcttacaaatattatttggaaattgagatgcagtgagcacagatcttaaatatcttggcagaccgcctcagtagctgtggatgatccctgttagctagagaaaaaccaggaaaaaaaaacccaacctggtacacaatagtttacgaaatgatctttgtgtgattttgaacaagctgtttttcattttaatctcagtttccttgcttctgttactgacctaactcatggagatgtggccaggagagggtgggagagctctctgaatttttttgtttctcctgaaataaaacagttctaaatagacatacttttgtgtgattacattttccatttttcgcaaagtcgtaggtatagtttgaacaccaattgagaataaaagaagctgccttctcccagtcttttcaagacattttaatagttaatgagattttgccccttaccctcatgagtttcatttggttctgaaataaaaatttacggctgttctctcagctgagctgatactagtttaagagtggaattgagttcacacctgctctggcataaaaagcctctatgtgacttctttgaaatattcacagagcagaataagagagagtactcactatctctacaactgtagtaactacacggtaatgttgcttgcaagcactttagagaagctgctctataaactgactctaatctgctgatattgtccacagatagatgcctcccctaagtcacctgtgttcctcaaggtggaatgtggttgtggaaatgcagttggtttgtgtaggcagtgggtctacattaacactgtaaagtgtacatatgggaaaatctttgcatttgctaggccatttagccgttcaagacatggtccgttagtcaggcaacgtacaatggattttctgagtgttctagttaaagagcaggatgtgtaaagtagtatacatttaggcggataattaataattggtgtaggcttgtaaggctgtaatagaatatataaatttcagcacctgttaaagttttatcagagcagatcacctttccttactgtgagggaatattcccgcctgtagaaaaataaagtgctcccactacacgtgaaaaacctttatgatgaaaggaggactggtttttataacaaatattattttccatggtcactgtgattaggtgacattttagcagtcacatttagagagcgttcctagacaatagtattttgtatgggtttgactgtaggtggcaaaacactgcatagaaacaatattttagtgcattctaatattcagatacagtttacttgtcaaagaagccacctccccccccatatcatccccccacaaaacaatagggttgttcattttataagttcatcacaagtaaatattcagagcgaaagccttttctagtggctacgttggaaggggtagagaagatgaaacatagatcccaagttcagtttttggctttggttgtatcataagcagtttttacacttcatatcttagctgtcttcattttcagacatagaggaagtgctcccttacagcagtgagggaaagggcaaatgatatatttgtgaaagcaaagcagactatcttactgctttaaaagtttcattggctgcttgataaataaaattaacatgttatcgatatgtctgcaatcatatggtcctcagtatatgtattttttaaagccatttatataaattccatttattctagaagctgcccaaaatgataaacttcaatactcaaatgagtctttggttcgtacagtcattcacccagcaagtacttttgggaagctggtgatctgcaagccctatgttaggtactagatagtggcatgctacttttcttgctttcaacttggcccacatcctaataaaagaatcaggtagatatcagataattacaattcagagagttggggaaataatccatgtgttcccagggtgttgttgcatacatatcagggatactccaccatcagcttcctcataataatgtctaattttttttttttttttgagacggtctcaccccgtccttcaggctggagtgcaggggtgcttactgcagcttcaaacttctgggcttaagatcttccctccttggcctcctggtggcagggactgtgggcacgtgccaccacacctggctaattttttctatttttattttttgtagagacaaggtctcgctctgttgcacaggctactctggaacctctagcctcaagcagtcatcctgccttagcctcccaaagattacaagtgtgagccactgtgtccagcttggctaagatttttttttctttttttccttttttttttttttttgagacagagtctcgctctgtccccaggctagcatgcagtggcgcgatctccgctcactgctagctccacctcctgggttcacgccattctcctgccttagcctcctgagtatctgggactacaggcatctaccaccacgcccagctaattttttgtgtgtttttagtagagacagggtttcaccgtgttagccaggatggtctccatctcctgacctagtgatccgcctgcctcggcctcccaaagtactgggattacaggcgtgagtcaccgcgcctggcctggctaagatttttgggtactcactgtgtaccaggcacttgctaagtactttacacatattatcctgcttgctccttataataaacttctttgttagacattgtcattaccattttacaaaggaggcaattgagaatcagagagattaggttatttgcccagtgttgtgtagctggtaagtggcagaatccagatttgaagcaagatctgctgaactctaaagccttgtccttacccaccactgcattgcctcctttgtagagaatttagaaagaattcccagaggtggaatagcagctaaacatgggttcagctgcaactaatagaatacctgataacaatggtaggttagtaaaacaaaggggtttttccccttcattttaggaggtgtctggaggcaggaggttgcctgtgtgagttcagcaaatcaatgtttctttcttcccattctgccctccttagcatgctgattttcattcttcagctttttcctctcctcttgcatttctttcttgcaagctggctcttgagcctcacacagcacattagagtcccctaaaggaggcaggggaggcagaggttagggtaacatttatccttacatatatcctattccatccaggaagggggaaaaacattaccagaatctggtggccttgagcaggattctgctaacaacttattggctaaacctctagcagacatctactcatagctgcaagggaagcttggaatgtgaactcttagagccatggttgggtctctgactcaagagacaggcaagggaggagggagttaggaatggctattgtatggatcaacatgaattttcttaataatatacgtggtaatgcctgagcttcatcttaaaggtgagttggttagaactatcctgatggaaagaaaattaccagttggtagagatgcttgagcagagccttgggagctggaagacgtaataggaatactggaactgaagtcattctgtgagatgactatgagatgtagtaccacagaggaagggatgacaggttgatatggcttggctgtgtcccacccaaatctcatcttgaattgtagctctcataatccccacatattgtgggaaggacctggtgggaggcaattgaatcatggggggtgggtttttcccatgctgttcttgtgatagtgaatacatctcacgagatctgatggttttataaaggccagttcgcctgcacatgctatcttgcctcccaccatgtaggacgtgcttttgcttcttcttcgccttccaccatgattgtgaggcttccccagccatgtgaaactatgagttcattaaacccccttttctttataaattataattatttataaattataattaaaatctataaattgtaccatctccggtatttcttcatagcagtataaaaatgctctaatacacaggtgaagctggaatacaatcctggccccagagaaatgaagggtctcttgtgtttaggagtggaagatgtcagattttcaatgaagcgtgtggtaaactactcaaggattgattttaaatagtgagataccatgatatgatttatgatttaggacactcaagcaactgtgaataggaggcaacttgagggcaaggagattactcaggaggtgattaaggcaattccaagaggaaatgatgagattgagctgaactgggaacaatgaagatgaagaggaggatggatttgagtgatattaaaatgatggaaatggttggacttggtaactgatgggcaaggcaggggtcgtccttggcttcttggtgtctggcttgggccacttggtggttggcagtgccatttgttaagatgtagaatatatgaggagaagtaggtcatgggggattaaggtggtcagttcagttttggaaataatgaatttttgacatgtctgtgggtggacagatttgtgattctgggtttgggattgcagatttggcacacaatattaatatttcatagttgaagtcatgggagtagataagttccccagagagagacatgaaccaccaccaacaaggcaatttgttgcattgtgacagctctaacttttagaaagttctcaattctgtagctgtcagcctgaaatactcatttttccctctgaagctaactagtattgtgtattgtctctctttccacatgttttgaaggatgctaatcttggcttccttcaaaagcgcaactggaaaactttcaacacattgtagaacatggtttaatcacaccttgtattcccggtcaccatcctctgctgtgttctagttcatctctttttccctccaagtggtgaatccaagtcttaccctagtattccagatctggtttgatcaatagtggatctgctctcatttttagtgttaatgcagtctaagattccatgtatacattcatattttaacattgactgaaaatggagcttgtggtccactaaaatcattaagtgtttttaacattaattgctttacatccagggcttccacatctttgtgtagaatgggacttaatacgtatcctcgtctgatttcttcatgttggttttggtctgcaaatgtgcaataattctgtcctttcactctgttgatataggaagtgagatggtgtgatgcttaggaatgcaaactcttggatttatatcctggctctgcccaccctttactacctgggtgacatctaagttgctttctctgagtcacagtttcctcatctctgtgttgaagatattataaaatccatctgttgggattgttgggtgaagtaaatgaggtaatgcatgtataatgcatagaggaatccccagaacatcatcaacactcagtaatttttccctgttactattgtagggcatataaggagttaatggcgctatttttgtgattgtggatcctttctctcagtattctttctggaatactttcagtatctctttctggagagaaagtttaaggcaagtggttcatctgtgacgaatggaagaaggaaatgtggttcttgattttgagttgtgtgatgaacccaaatttaccaggcaatagataggatatgatgattactaaatttgccattgactgatagttaactggctaccttgttgggtctcttgagaaaagaactaaaacaagaacaacaacaacaaaagcttaaaattacctgaaaatatgtctctttacctacacctaattttaaggcagaaaattccaaagtgagccagctactcaatacaggtgctgaaggttatgtgaaaattcgggttaacactaatgatagattgagaggtaactgtttgctttacaaaccgcttgccaaggaatgcccatattagactatgaaaattagactcatggcaaattttcaggaacatgattcttgtgataaacaagctatctggagggtgatgtgtgagctcacaggggagttttaagaacaggtttccattgttggacagtaacctgacagctaggcatactcagaggaagggcatagattagtatccaacaacctgttttaaaaccaagcaatgggaccccatacaaggtccaggttgacccgaaccaaggttagatgaacctgacttgtttttatagtaaacgtcacaatggtgacaagccagcagggtcatcagcacactttgcagctacagacttcccactggacaaaccattttcagcttcctctgtttggtcacacccacaagaagtacgaatggtatatttaaaaagctagtccatcttggttcatttataccagtgtgtaggatttctgtagactctgggctggttacaacctagagctgcagaagggtgcagagcttcatgtgttcattctgtactgtgataaagttctttgcacgtttgtggaaatgcaaaagttcttctatgcacctggcttctgttccggtcatttccttgtatatgggttttgatccggtgtgacggaagagggaagctatgcattctgagatctcagatttcattgtatccaattatttataagacctgagaggtgctttattagttaggaagcactgcagattttctctgtagcttttaaaaatcatcctgacttcctatgtgttattttttgcattggcacccattgccaatgctatgtctcagaagagccgagacttgtggccaataatccttagaaactgatggggctgtagaatttatttctctgtcaccctttttgaaaataaaataaagttatatttttcatttacatggatggacaaattggggtctttaaaataaaacctacttccccttttcattctttttctgatcatttgtagcaaaagcttagtggttttctgtagaactgctttgttttaaaaatcaaattgaagaccaacttgattctgcctgcagagcaaagctatctgcctttttagaaaatctggatggttaaattggaagcacattctgcacatggtttagcagttagtagcctggaaaatgacccaatagccaagatagtttttttgtttgtttgttttttgtttttttaatcttcattgtaagtgcttgtttaaagtgtaagcttgtaatggactattttgcacattgttcattgttaattcttttcaggctattatagttctgtaaatacattgcctgctaagttgtgtcagtggagaaacattagtgctataagaaaatccagtgaaatgtgcttaaaagcattaccaattagcgcatgggactggatcaccgcgatttcttagtgatcctagagaagtcagtttcagttgacttcccatttatttaaaatgggtatgacaacgttctttttggagaatagggcagcacacaaatgcacactatgctgtggcctgctgaagagtttccactgatttgtgactatattactcaatattgctttgtagcacccttagtctaatccacattgaaggagcaaaatccttctgtatcttacttattatacgattatgtaatacatatgttactttatatataatatgtagtagtacttattttactatttttattcattataatgaaaataacaaatttactgggtggtatctaccatctagctcaagctgttctattttgtattgtttaaatttgagaaaagctaatattggttaataattaaaggttacaaaaattgtagtgggaaaggagttaaattctgtctctcagatagtaaagactgccagaacatggacataatcatgggaaataatagggtggatagaatgtgatttatctgcgtatgttaaagaaagaaaaatagtgatcgtgaatgtactgaatatagcttaaactatttatcattatgtacaaatggaaacttacataaaacccctgttgattaagttttatctgaaacaaaggatatgattggaagtggagaatgggagagtattttaagagcatgtgataatccagctagaagcttcagcaagtctgtggtcaaacaagagaagagaaagaaagagcaaggaagcttgatttggttatgcaaatttggagcacacatatgagttgggacctaatggattgttgcactggatttggtcatcaaatgatgcttttcatagcaaatattatctgagccattaattcaaacactgagaaatgcaggccatgtgtaggcagaaccacagcctttttatccctcaaaacaaaatgtaaaagttggccttgatggttagaccttataaagaagaataaggggggaagggggaaaggagcaagtagtgaaggaaaaagcacccagaatggaaacaggcatgcgtattcagacataaatccaataaacagacaccccaaagttatgctgtgtaagaatagacacacagtaagaaatttccagctatcaggctaacaggatggaaaactggagagcacagagcaattacttacgaagaaagaggcacagttgacatcaagtgttatagaggagactggcatgattacaggaagatgttgagaatatcagaaaacatccccaaattaagagtgccaaaaagaagaaagattaccgatgagatcatgataaataataatgagctgtttctcaaagtacctgaagaaggggcctgaaaagtggtttgtcaagcctggaagacagagaaagggtaatgtattgacggacgatggagacactgctaaaaaataaatgaaattttcaccccagtgttcacaaaggaggaggtggttggggacagatgtcagacacagacacaaatttcccaggggagaatgaagaaatacaaaagaaatcaggatcctgctaaaacaggtgatcaaggggtgagaagaagaaaatgaataaaaccccaaaaaccccaaagcttagcggtagtcacctaaaaatcttcaagaagtgagaacaaagaagctaacaagaagaggaaaaacatacccgcatcacttagaaaggctggaaatattttcatgtgtgtgtgtttttatctagttaatttgttagactagcccttttgaaacttgtccttaaaggaagtaagatagaatacttaaagaaaaatgattgtggctgggcgtggtggctcaccacccagagtggaaacaggcatgcgtattcagacataaatccaataaacagacaccccaaagttatgctgtgtaagaatagacacacagtaagaaatttccagctatcaggctaacaggcctgtaatctcagctctttgggaggccgaggagggcagatcatttgaagccaggagttcgagaccaacctggccaacatggtgaaaccccgtgtctactaaaaatacaaaaaattagccaggcgtggtggcacgtgcctgtagtcccagctagtcgggaggctgaggcaggagaactgattgaacccaggaggcggcggttgcagtgagctgagatcatgccgttatactcttgcctcggtgacagagtgagactccgtctcaaaaaagaaaaaagaaaaatgatcgtttaagtggccttgaataaccaagacatctttcctgctaagttcttttcgagttacccattatgcccagcgttgaatgtttactgtgcttattaaggatgatttttgtgtcctaggtgatcactgagtccttgattgggccagtatttactggatggatgcttcttagtgccagggagtgcgctagatcctggactactgggatggaaaagctagatactttctgagggtttttgaagtcacttcttcctcactcatataagcaaccccacctctttccaggcattgatttcagtgtgttcatcatccctggtcttgcttttaaccagctacttgatgggcaaaggtctggagaggggcagcctcctttgttgctggctcagtgtgctgtgctgtcctcagcgtggtgcctgctttttgcccttatcctcagatgtggatccctctcttcccaagctctcctccatcccctgtgctgcaaacaaaactccttgtttgttgctccccaccagtggccacgaaggaatttgcaaacccctcaacctcctactgttttggaattcatgaagtttttgccctgagcaagaggctatactttcaaaagtactttttcctttcttcattttcccaccccctgcctttcaaccactgccccgccctggtgcacacacctccatcccaggctgataactcccatctctatttgaaccacccactcccttctcttggcctctgtcaattttagggctcagcaaaactgggcttactaaaaacacctttcaatttctgttctcagcattaatctgtctttgcttagtgttcaaagaatactttaagatactcattaatgcaaacactgttatgaggagggagcttcacttcggtcccttcttctcaccttcagatactactgtaacagctgtgtgggactggagtatggaatgtttcagagaagctgcttctgagtgtgtaggagagggctgaagaaactttcatccagtacacagttttgtcctgtagtccttgttcccatggccaaaagtcttctggtaaaattaatctccagtgctacctttcctaccaggactgcaggtggtgtcttttagttgaaacagactcccgtggtcccttgattctcatatgtaatgttccatgttcaggtgtctctgaaagctgttagacttcatccaatggagaagggtccattgagctacatcactttcttttttcacatttgcgtttctttatgtagagtgagttgcagtttggttggctttttttctgggaatagatcactcttctggggactgtcagacttggtccctgccctgggtgagtttgccatcttattgagggggtactaacatgtgcgagacaactataatcatagcaataccaaccccacctcaatggctgagtgactaatgagaggagagagtgaggggctgagcagaggcctctaggaagcagctgtggtcaatcttagcctacatttactttttttttttttttttttgagacgaagtctcactccgtcactcaggctggagtgcagtggtatgatctctgctcactgcaacctccacctcccaggttcaagcaattctcctgtctcagcctcctgagtagctgggattacaggcatgcaccaccacacccagttaatttttgtatttttagtagagatggggtttcaccatgttggccaggctggtctcaaactcctgacctcaagtgatccgcccaccttggcctccgaaagtgctgggattagaggcgtgagccgctgtgcctggcctaaacctatatttactttgaatttcactatagtctaccatttcctgatgccttatatatctgacatatatctgatgagtgacattcttgagatgtctgcccaggactcctgaaccccatgagaaataagattgcactttgcagttcttcaaccttgctgtgcatctgagtaacatgtggcccattcatacactgcagatgcctgggctccgtctgtgagattctgtgtttagaggcctgggctgggatctaggcttctgttatttaaacaggaatttctgacctacacattgcttcaaaaaattgtcaattttgttttcaaaattgttattttttcttgaactcaatacttatttttaaatcctttttcactcaggaaaagtgaatcatcacctacttagcacctaattatttaccactaagatatttgtgtgcaaaaaattaataatttttagatcaaagaaaatggataacttctaatatgttaaaatcgtgcatatttccattgagagagagaatgggctgaaattatccctcttttatattttaattgttcatcaaattgatagatttaatctactggccctaaagatttgcttctataataatgttgtgaatgaaaccttcattgctgtagattcacaattcaacatcatacgtatgtggtaggtgtgatttttcttgtattaaaggaaaaagggttagcagatttttaccaatttagaaaaaaggcaagccaaattagagggaagtcagcattataaatatttcgaaaagaacccccattcattattttttgtaatgtgtagctaagaccaagcaacagtgaagtgggaatctttgccttatgcaaaatggttagggaaatagctaaggatgctaagaaattagcttcaatattggttgtaggcatgaatgtttttctcagggacttgggtgattttgttacactttctaatattatctctgctatcttctaggacttattttgtgcagtcaaagactttttaaggctgtctgttctgtaaaagaaatacaaactccaagttgtttgattttatgagttttgttgttgttgttgttgctgttcagtctgtaaaatagtgacgtggataataaagatatttagttgtatgtccagtgacctttggaataataaaactgtttttgtctgtgtgggtttttcacatacaggtaatgttttgttcacattctggatacagacctgacctcaggctgctcagcactgcaatttcataggctcctatgaggtccccggctaacattttgactgtggtggtagaccttcacctcttagatttcatatatctttcattttgcttcttttgtgcttctgttgaattctgtatatttaagaaaattaagatgcagagagaaaattggttaatgtctcctctgtgtcttgtaatatgtggcccaaacagaaagaaaatgtatggaatttagaaattttatttacttgttttcttacatcatagaataccattttaccattgaaattattaaaacctgcttttattgagaattttggggaagttgaaaatgtaacctttacggggaattaaagctgttttattttaatgaataaagtagttaaattattaatcatataaaattatttctctggatgttaataaccatttctttacccaggaacttttttctaatcacagaatcttgattggtggtttatttgaaggcatatctcactattaatggttcaagaatacccataacttttggaaagactcaaaacatattgcataattggattttaagttatgttgtttgtaagcttatttgacttgtatcatgtagtgattactatcagtttttctggatgtaggtaggtgcttcttatgattctttcatagatagtattgagtcattcattaagtctattcctcagatgcttattgagcatcagacttgtgtcacatacttgcacagcttggtgttggagatacaccctttatcaccacatacttggagttgctttttgtctgctgtaagacacaggatgtagtgaacaggccaagagaaatatagggtcctgtgggagctccttacagggagggacatagcacagagaaactcagggtagttgacatttaagttcagatctgagtgatcaggaaaacagccagccagagggagctggcatgggaatggatggaggcgtgtttgagtcatggcagccagatctaaagaaggctacaagtagagagaggactgtgcatttctccttcccatcactggaagaggaagggtatgaggagtaggctctacatgaacatgagagccagctcatgaagggctgtacaagccatgtttcagtgtttatcattcattctgcaaatacatactcagcactatgtgtcaggtacttggcttcaggaaacaaggcagaaaataatgcctgcccttgtggagattttattcaaatggggaagagacaaacagtaaacatggcactagtggttttgaaaatgggtcagaagtatgtgtagtccaaatggttacagactcagcatttgccaatatcatggagccaaatctaagactatttaataaaaataagtttgcaatcatttccagtcctcagctgataactacagatagacttattcttaactcaacatatttacaggtaaagttgaaggttacctatcatttatatttattgctcactcacattgcatcaggcattgggctaagcaagcaagcaaaccacatttgagagaaggtgctacagtttagtgcaatcagtatttcaagttcaccagagtagaacttaagagtagaaggtttatttgttaaataagaatacttgaccttaatggctaccaaaaaagagttggaagaatgaataagatctagtatttgatggcacaacagggtgattataatcaataataatttaatagtacatttaaaaataactggaagagtataattgtattgtttgtaacataaaggataaatgcttgagttgatgggtactccatttacccatatatgattattacacattataagcctatatgaaaatatctcatatacctcatatatacccactatgtacctacaaaaattaaaatacacacacacacacacacacacacacacacacacgaatacttgagaggtgatcagaatgtcctgtattcctggccgggcacggtggctcacgcctgtaatcccagcactttgggaggccaaggcgggcagatcatgaggtcaggagactgagaccatcctggctaacagggtgaaaccccgtctctactaaaaatacaaaaaaaaaaaaaattagccgggcgtggtggcgggtgcctgtagtcccagctacttgggaggctgaggcaggagaatggcgtgaacctgggaggcggagcttgcagtgagccgagatcgcgccactgcactctagcctcggcaacacagcgagactccatctcaaaaaaaaaaaaaaaaaagaatgtcctgtattgctgtttgaaaacacattaccagaaccagaattcttccttgaagttttgaacaatatcacaataacagaaacatctcaagattttatcatgcagccagcaaacaaaaaaattctacatagtgattgaagtagacatttgcttgtcactcaagatgaattattgtaaataaggagtttttattacaatgaacactttttttggcagaattaataaagagcagaggatactagaagtcagtgcatagaagcaaaaggagaaatgtagttgagcatagtgaatagagaagatttgctttcgtttatttgccctatacattaagaccattgaatgagactattttgtgtatgacaagcatttgaaaaaattgttttactctggcaatcttaggctgatttgttttatttcctttagaataaaagttgcaagtgggtaggaattatgccttaaagtgttagcctacaaaggactggaaaactactcaagggtaacagctgaagaggaaatggctctgtcagtgtcgtgcgcatggatgattgggcacataagggacacaagcagggagaaaggtgcagagagaagagctcataaaaccaaggaggcttgcttggaactaaaatagaatagcaaaagtgaaaagcctggggagccactaatgtgatatagtttccctcgtaacataatgcaaatatgtaaagttgaaaacgtgtgccgcctcttgcatagacattgctgtcatcagcagcacacacagttgggtatatttggcgaggcatttaatctcctggctctctggtctctcagtccatatcaccagaggcatgtattttcaaaacagtccagatcaatgtctggtctttgtatctgtggtacaaatataaagcttacttgtccacataacagcaaagtaaatccgtggtccattaacgctaaattgtaaatagtgatagtcacttttgtccaacagtgtctgtaatgtttattgctaaagcccatacatgtttattgatattatcctaatctgggaacagtagctgctagttatctatgtgccaaacactgtgctgctgtttgcaaattttatctaatagcaactgtttgtgaggagcatttgttatctgcattttacccataaggaaggtaggagggacagaaaggttaaaataatccagatggaggacccactcttggtcactggtatgttttgggcttagcacacagttctgccagactctgcaacatgtgttcttaaccatcagactttatttctctggtgggcaacacaggtagatgtgacaggttagaagtattagatataaatataagttatcgagatgatatgactaccgaattcactactgcactttttttacttttttaaaaacatgtatttcagcacactgctaaaccacagcaagaatctttttaaaaagaccttacaagaagcatgattacaggtcacaaaatcaagggaaaatattgtcatcattattttttaataagtgataagtgaggctgatgagtgtagacctgttgctttattaatagaaatatgtgcatctggtgaggacttgtatttgccaagcacactgctggcctggaattagactcctctgtggaattcaggtcagtgtttacacccatagtagtttacaatctttcataaatttgagcaaaatattaggaaagcacttagaagcaatttagagaatcagaattaaagtagaatcggtgtagcatgtatgttcagtggagaggggcgagtagaggagtgagtttctctgacagatgatgaatctagtttgtttactttttgggagaccctgtttccacactcactgacatgtgagtttgcatcctggctcaagcacttaaactccccagtctccctttctgtgtgtgtgggatggagataacaaggccaaccttacaaggttgtatagggtaaagtgcccagtgtaagatttgaagcacagtaagtcttcagtggggctaggttttctccttcctccctgctacttacttcatgaagaggatgaataagtacaaatctctgttcagcgctgcaaaggaagattatcatatttatttatttatttatttttgagacagagtctcactctgtcgcccaggctggaatgcagtggcatgatcttggcccactgcagcctccgcctcctgggttcaagtgattctgctgcctcagccacccaagtggctgggactacaggcgtgtgccaccaggcccagctaatttttgtatattttagtagagacagggtttcgccatgtttaccaggctggtctcgaactcctgacttcaagtgatccatccaccttggcctcccaaagtgctgggattacaggcatgagccaccttgcccagcccagattatcatttttaaatgctgaaaacctaaatttcccattgcactgtgctattactttcacagtgttgactttcagagatatccgtgcaccgccttttggtagctccctatgtcctcttgcttctctagttgccatttctttggaagacccccccgacattagttatctcattttccatgagtgattttgaaacccagtttgtgccacagtaaaatttattgaaatagaagaaacactggatcttgagagataccaccagcacctgcagtcttaacgcttcatctcctctcctgacctgggtccaactcatctttttttctcatcaccgcctgctgccatcttgtttactccaagtcttcaccgttcagtcagaaatacaaagccctgcatgggtcaggtagtcctcagagaaggagagaagtaagaaagaaagtggaggccggccacggtggttcacaactgtaatcccagcacttttggaggctgaggtgggcggatcacctgaggtcaggagtccaagaccagcttggccaacgtggtgaaaccccgtctctactaaaaatacaaaaattagctgggcttggtggcaggtgcctgtaatcccagctactcgggaggctgaggcgagagaattgcttgaacccggaaggcggaggttgcagtgagccgagatcgccccattgcactctagcctggacaacaagagcaaaactccgtctgaaaaaacaaaaaacaagaaagaaggtggaatcaaagggatgtaggggttccacaaatttagatgagatgtcaggtttctcagatgtgttccttgatttgaggtaggtgatcttagaagagctgcaactaaactccaactggctcctttttcccccatgtcttagaagaaaatgtgcttcgtttttattctcttgacaaccctctgcatttgcatctttcagcttcttctaacttgtgtctcctgggacctttcttttcataactctattttctttcatcatctgtctttcccctgactccttttccctttgcttcaaaatgtgcaaatggatcctctcttctctggcagtgattatcaaagtgtggtttctcggcgaaatgtgatcacttacttcaaatctcctgggatgatgtgaaagttgggacccacttcaggcctatgtgtcaatacctcagtatgatatattccagcaactttcccaaaaaactacttagtttccaaggcagtttggcatctcctagagtggcacagcaaattccatgatttttttctagccctgttcgttttgtcttttaaaacctgtctccctcaacatccacaatgttaaaaacgtctaacttgccttctgtttcgctcactactctttttttttttcctgctttctgcttctgtcttcataagtgcaggcatgggaagagctgggaatttggagtcccagtagggtttgattccttaatgtcattgctcagtagctgcgtgatcttgggtcacccatgtatcttcagtagggcatctgctttggaggtttgtgtggcttgcaagtgtcatttttaaattgggagcccaaatgcaattgtttgtgctctaaaaatctgcctcttccagtttgctgttggaaaacttggaaattattggctttgccagggttgtggcctctggatgagagctaaaaggtgaacagccttttatccattctgcttccccccacttactcagggtcctttcctgttacaaatcatagtttgtatggcatggcaagtactggaagggagaaattctctccagtgagccagaaaatgcaacgggatctgtttgtgattgatagagataagagtgcctgatctacttttccctctgccagaaaagtatttttccctgacagctggagacatcaaaggtctgaagctgtgaatacagagagatgaatgttctaatattaatattatatttaaaaatataccacgtaacatttaacatcaacatgtctagtttcctctgtctggtaacccccagtcgtccatatgcaaaaagaggaattccaatcacagaggtcctcactccaaggagacaggcaaccattacgtgtctgtgaatagctgagtaagccaaactgtgatagtttctgatagatcatgtcaagacctaaatagtggaatcttcaggatttggaggtggggagcaagtcacctggattgatgaggactcactgatgaactgaccaaattgtttttttttttttttttttttttttgagatggagtcttgctctgtcccccaagctggagtgagtgcagtggtgccatcttggctcatcgcaagctccgcctcccgggttcacgccattctcctgcctcagcctcccgagtagctgggaccacaggcgcccaccaccatgcccggctaattttttgtatttttagtagagatggggtttcaccgtgttagccagatggtcttgatctcctgaccttgtgatccgctggtcttggcctcccaaagtgctgggattacaggcgtgagccatcgtgctcggccccaaatgggctttttaggagttctcatggaagagatggaagtttcttcttgagtgagagcaatcccagagtctgatatttcacctagtacatgggaagggaacatgttttgtcctaagccaggtgtgaagtatagtcattcatgttgggcaaaaacgtggcaggacttggaacttctgtggggacccacaaaggagaatagaggagaagactccatgaaatttctggtcctggtgttgtgtggatggcccagggccctggccagagagattcaactactaggtgaggtttttttcactttagacaaccctgctaaggcttcatttcacttatatgccgtctgtgggcctttgatggttcttttttcctatatttgctatggatatatttatgcatttaaaaaatttgcatcattgtaacttttcattgacaaaatatatttaatatgctcggtttttacagttttgcttaattagtttttttcccacttatatttattttctgtaacttttctcttttttgttgtctgttttgctctattaagatgttatatatcttctcctccttctccagagtagacctctcatcagttcaccaaaatctctctccagtaagagtcaggaagcttaccgtgtgacaaccccttcaaggcaataaggctccaactaagggattaagattgttttttgacaccaaacattgtttatcctcttaattttgagctatgtagcctgaaatccatgctctgtgatgaaatggaggtggtttatctgagctttaatactcttaaaaatgaagataatgatagagcatagtaatgaaaattaaataagatgcatgcatctagcagagaagctaagaaataggagattcttaacaaatgtaacctcatttcttctttagtttctgtaaaaccccaggaatgttagaaaatatctaggtcgaaaggagaagatcatgagtttggtgttaattttgaggtacctttaaccagtcaagtgaagacatgaagtagacagttgaatttaagggtgtgcagatcagagatgtctgagtggagagtctgcagttgaagagctgtttgtagagatgccagttgatggtatgagattgcttatggagtcttgagtaacaggtgggccttgagcctagcagtagaaggattttcaagatttaaagacattcaattgagaacaaaagagcatgccagggactgggagagaagggaaatgtgatgttatagaagctatgctaagcatagttttttaagaaggaggggatgggtgtgtcttttttggtcatcaaggaagatgagtactcaacagtgtctcttggctttaaccactttagtggtcactgttgacattttcagagagttttcttggtggaatcatggaataggaactgactttccatccctcagagttgagttgtctttcatctgacttggcaaagtatttcttttatgtacttctaatgtgatttttctctattgtttatagttgtttgcacttttcattcacgtaataaattatcagtttcctgaagacagaggtcatgcaaaatcccatgtaaattacacctagttaagtatttagtcttagaatcattggttctcatgatgaacaaaacacatttcttggtctgttcatttattcattcattcgctgaacagtttttcatttaccaattccatacaaatagcaggtactattttaggttatgtgaatatagtggtgaacataagatactcccttttctgtaaactttcattgtaggtggagacagatgagaaggaatgaatacaaatgttgagggcgttcagtgtcttcacttatttgttcctcacaacaatagcatgatgtagatgttattcctagtcctatttcattgatgagaagatggaggcatcaagatatttagtaacttgccagggttctcagttcattggaaacagggatgatgtttggagctaggattcaaacccaggcggtttgactctcagatccactttgctaatcatctcactacactgcaaagtgtttggcacggggaaaatcattattcttattattaatgtagttaatagtaactatttctcaagggagctgaggaatcatttactctaattcagatgagaaaatggacactcatacagctagctattggcagaactgaaatttagaagccatatttccaggctccccttccaatgttttcccctcatccagtacctcttctttaaggaatggagtatggaaaagggaaaagaagctggaagaatgaaggaatgggcaaggagaaggaagggtgtgtagaagagatataggaaataattaaacctgttggatttggggtttttgatgctattgaactgtctggtttttaaagtttttttcccccttatattctcaagaggtagatatccttgaaatgatatcttcatgcaaaatagtgttttatttcatctatgaccaaaaaataattcaggagctaggaaaccttagctccttaaaagtaaaagactgtattttgggaaagaacattgttactggaatttatactgtgatgacactggttggtagacacactagaagctttgaggagtgtgtgtgtgtgtctttgtgtgtctgtgtttgtgtctttgtgtgtctgtgtttgtatatgtttgtatattagtatgatatatatagaagtacatatttattttataaaatactggtagtgtttaatttgtgcatactctttaggggagagggtattgaaatatttttctgggttggaaaagtttttgtacttacatgcaaggctgctctaaaatcaagcaccatattgaaacatcacaaatatacactaagcaagggacagatgcacaaggaatttaagcagagtttttctaaatggcaaataattagaggggaacagatgcctatgggcagcaaaggatgaaatgaggtaccaggaattttaaaagggagatggaaatacaaatgtagaatgcagttgctctcaaggatgtttaagcctagagggtgtgcttgcccaaagttcactctttttgtgggtattgacttaaatttggttctctcttcacctgtcttccccaaagaagtagatgatgctaatcattctgaagtggaacagattttctgtggaacctcagttttggatgatctgtggctgcatctctttcttctgcctccctagggtcttgtccttttataggactgccaggatatgacatttcacaaccatgtcagttctcacttatttattatttataccccatatccttccaaaagggtttttaggtagcctaccaataaaagacacgtatgaaaatatatgtgtgtgtgtgtgtgtatatatatatatatatataaaattttttgtcttggtttgtgttttaggatggacatgtcccttctttagaaacaagtctgctgtaaaatgggttgtatccatctcagagctattctgcgtagtcttgatgtggaaaaggaaacaaatctccaagaataaagtagagcactaggcatttcccatcttcctgtagagtggtagtttaaacagcaggggcactgagcagagcgattgagccacccagcaaagctgagctgtagcacctgatcattatccctcaggtttaagatttacctgttgtgctcattgtaacaaaagaaatgaaatctctgtaattatattggaagggggaggagatcgtgttttagttcctttgatcttgagctagaataggctctgcttttggaaatttaatttgaaagagcccaacgtacacatctgctttttgtactgcaatttctattgagcttgaaaatagaaatttattaatgcaaatgtgtagagtctgttccttgaggaaaagatatactcattcaaaacacaaggtgatcccttcctacatagctatggaagatgttaatatgttttctgtttttttttttccttgacttcagatatgaggttccttgctaacaaggactaagcataaaaattataggatccattggggaatggaaagattcattcaatacttaaaagtttccaaaggacaaattcattggtgaagagctgggggaagcatactgaatcctcaaaagaaaaaaaaaaagccaaaaacaagtgcatcatcaaaccattctgaaaatatgtttgaattgatgatagggcccatgctaagagacaaagctttcatttcaacgaatccaatctgcctagtgttgtgtaaaattgcctttgcctgtaaatggaatggcatgcagattttaggtaggacactttctcacccaacttagcctgtactctatttcattttttccaccattacatgaagcttcacataaatgacaacttgacttaatccttaaagtggctggattgtgtggtctattttgattaaactttttcttgttcttagtgtaaattttcagtaatgcctaaaatgtcatgagcattttgggacataaatcctttaagctattttgcagtcatatagttgttctttggagggtttgagtgctttcctaaactccttctcatctctaaataggcaaaataaattataaattgtcgagaacattcaatcactcttcggatgagcaggcatctcctaaagctggggaaagtatccattttcaatattttgagtaaatatagttgattctttataatatttgtactgtatcaaaagatctcaaaaactgttataaattacctagacttaaggaagaagacatgattaaataattcattggatcaataaaaccaatctgcttttttctgatgtggtgtgatgaagttttttttcaaatggggtaggtgggcctcagtgctgtgtattatccttttgattctattggttactgtctttctctgctccccccttagttgttgtttgatatttttgtgctttttgtttgttttgttttaaagaaaggaaagctgcaagccatagaaagttaggctgtgagttaggaattctgagtttaaagcagggagcctgtccctaactttgtgtttaagttggtgtttcagttatgttgccagtgtaagcttgtgacccttacaaatgtacaatttcatttgggttcagtgattcctggatgagtttgtgatataggatgccaaaggctgtggaatttctttaagacacaaaatcttgagacagagctgattccttggaagcttgtgggtaactagagtctcatgttaactaatctggagggggctaagaaaagtcttcctacccacttccaattaattaatttctaacatttccatctaatcatgactttgtcgagtgacacacatcttttttcctcacaggcaagaaactcacacacaaaatttctatttctaatggcagacagttggggtgccgcagccaagcagtcacccttaaaaattaatgagcgtaatgatggttagaaaagcgattctgatggtggttggagagggaggggccatggggatggcagaaggaggaagaccggactcctcataagtgacaatgatgtgagcccctgtcctcatctcccctcccatccccccttccgcccagtcaccaccccttccatcctcctctctttacaggagccaaagcagatagaaagacagggcgattatgaagacgtcagttggagtgtaggcaggcgagaggggcgcagcgccccagatgaggtccggggggagctgaggagggtcactcatggacgaccgtgtgtgtgtgtctgacagactgtgaaatggtgcgttgttgcacggctgcgctgcacctgggcccttcatctgtgattgattggtttggtcatgtgtaatggtcccatctgctctgtgttgtttttctttttttacttataaacaccgttcccagaggctgagagaggatgagctatgttttgtcatcttcacttacactttagctcaaaaaagtggtcaagtaggtaagctctaaagtctgtccaagtaatgtagtaggaaagtacggtttttcccctttgcttgattgtgtgtgtgtgtgtgtgtgtgtgtgtgcgcgcgcgcgtgtgcctctcctgcgcacgcgtgtgtgcgtggagttttaatgctgcctgttaatatctgaatagttcgtgaaccacggaagaccaaaatatcgcagaaatgatttgcacaactctgtgtattgtgactcttactgcagtgaggatttttttttgtaacggagccaatacttaattaaaaccgctgacatcatggtgttataattaagcgtggcattaattaagctggaataacgatttttttttattaagaactgcttctattgtataagaccattatcgcctaaaaacaaaataattttaaggcaaaaataaatttgctttaacctagcccttttcaacttcccccaaagtccggcctcaggactgtcatcatcagggctccgagtctgtgtgtgcgtgtgtgtgtgagcatgtgcgtgtgtgtgtgtgtgtttggtggtgttgggttgggggagagtggaagtgaaatttgttttttttcacccaaaaatgctgatcggctcctggcattctgatggctaattatgcatcggagagcttcgacagctgcattcatcatcataaaatgtaataattaatgacattccaacaaagaaaaatatgcaaatgaggactcattagcattttcatattcagctttgataatgcttttgctgacaaggttgtaattaatgaaaattcatgtcgcagtcaggagattggatcggtttcattccgctcacaattcccaaatgcttgcattatggaaaatcggcggctctgccaacttttcagggaagaaaaaaacacacacacacactaaaagcaccagatgcaaattaatggtagggagtctttaactctttaaaccacccccctaaatttccatcataggaaacatgtgatgagtgttagcctaagaactagattctcttttttttaataataggaaagtacttttatttgtgacccaagtatgagaatttctggcaaactttttttttaatattaaaaaaaaccccccaaaccctccaccttttcccttctttccttttccctttcaagactatttaaatgtacatagtaaaacatgttaggacagccaagccccagcatgttgtgttctgtcctctggctggcagattcacgccacaacagtttattcatccacatgctttttggcgactcttcatcacgtatttgggcttagatcttctggtgcctccctcggcgtgctacccataaggtcgaaagaaaagcaagtattcgatttctctattcagggtgggtttttttttttttttttttttttggatgatagtggtttttttttttttgtgctttttctttttaatctattccctttgtggtttagtgtaagagtttgagaatgtgcccataattctctcactcaacacttctggtttagtgttgttcttcaaatgtaattttaggagacactctgcaatcaaaatggaaacccagaaaccccagagcagagatatcgacaaatatttaacacagagagctgttaatttatgaaagcctctgtgtgttgctttcaaaatgtggaactttaggttggcaaatgtacacttgatgccaacctggtaccatgtttgacagacaagcctgaagttaaactgaaagttctatctggccctcaaggttagaaagaaaaacttaaacagagtctgacttcattttctatttgatctttaggttaaaaaatgatgattattaaaactggtctttttgctgaggcagatgttttaataaaaggtttgtataatgattaagaaaaagggaaaatagaagtgtacttctttataaattataacgtttataagcattttcactctcagatgaataaaatgacttctgggagttcctaagatgcagtttcctgtttatttaaagttaaattgtaattcccaaagttgctagcccagcataaataaagattataatacgccttgttaagggaagagagaaactttgatatgcggggccttattttttagagtatttcagtaaaacagaaagaatcatcagttatttcacgaaaattttaaaataaatcttttttcccttgtatgtgattaagaatgactgggtttcattccttgttaaactcttggggttccaagaaacagaattttatttcaatctcttgcttcttccaacttttattttgtcacagtttgtacatgaacctgtgtgtgtgtacacaggcatgtgtgtaaatgtgtgtgtgtccatgtctaaagattatggtggctctgtcctctctcctgtaaaatctattgtggtaaaatagcaggcaaaagaaggttttactttttttttttccttttagtttatttctttttttgtgtgggcaaactgcccatccagatggtagaatttcacctgtaagcaatctgaaacgataggttaattctgacattttatagagctttttttattttcttttcacacagtacaactaagtgcagaataactgctcaagataatgtttcttttttttttttttttcttttaaagcgctttctgctgtgattggttcttttttcccccaaatctgaatttggggctcatttaaaaatctgtggctttaggcactttgctgttattgtcaaaaccacatctaatgaaatctttgaccagcttctaatatgtgtaaatgaggaagtgatggcagaagtgaaaaagcaggttagtcgccgagaagcagatccttgtaattttataacgctgaacgttccactggctttgataaatttactgttagttttctcctcccaccaaattcacagatgtataccaactcataacttcccaagtaatgcctagcatggtattagcccccggaatcctgggacttgcttttgttgtcagtgtggttagcctctggtggcttatgtgactgagtaaactggagaaaaacttcagggtgattcgttgtcccgtgatcaaggaatcccattatttccaaaagcgggttagaagatgtttttggagtagagtgtggaagggaaagggagtattggagattgtttttacacataatcatggtaatcatgctgtgttgacaagttagttttgaatgtgccaccttcttgtttttatttctagaaaaccttcattttcatgaattatttcttgagctgatgataaagatgactttagagacatcttctcccctggtgtattcctttagggaaacgtttttgaaagtgtttccctttattatacctgtaaggcttgggacctttgtcatggcattgtttgttgttttttccgtttcctgttttgcacgtgttaattcctgtgggcattttctttttaaagtgatgggatttccactgtccagcagcaagccacatttactggagttattgaactctgtaataggaaacctgtgggtgatcagttttaccctccctagaagatactgcttcagtcaatgagaattacagccccatgactgagaattttaaagaaggggttccactaagacacccagatgttttgtttcaggtgttgcaacaaaatcaacatttgtttgtgggcagcgaagccagtgttcctgccagtattcccgttcagtcgcttctcatatttcccttgcaaactttcccattggttggggtctgtggagagatttcagtggctggctggtggaaatgtttgggagaacatttgcgtatcaaagcaacctaaatatttgcaaaaatgtttgcttgagaaaaaagaatccacttaggattaggaagtaactgcttaaacattttaaaagcatttgtgatttccctaagtatattactcatgagccactgcctaacctgaatttcaggggtcactctggaatctgtatatttaaaaaccctataagataataaaggttttgctttatgattaagatctgaatccatacattaaaatgaaaaaacacttgacaagacaaaatatattttaagaattgtttatcatttagtgaacctgcaaaacaaaaggtgtaaagaaagggcctcatgaaatggttggatgttgaatacctctaacgtcattctttccctctactgtagattttttgttggtaaaacccaattgtattgctatgatatgacattccttctgttggagtccataagctttcttccagtggtaatgatttgaatgtcagatctttttcttgagtttaatgtaggcattttctgtccacattattaaagtttcagctacattttactgatggtttggaaacagtatgtgtaaaactcagtgtaggccaatttttccaatttgttaacaaggtaggagttgagcattgacaattactgtacttaaaagcccctcggatcaggtgttattttaccatctggacattttaattagtaataaaagtgtggatctggatacacagaaataggatctacagtacacaatggcccaatgcactctgttggtgctgaggtgtatgtggctacattttataaatatgtatgtatgtgtgtgtgtgggcaagtgtaattatgtgccaggtgtgtcctttttcaaactgggcactaacacaacaccaaagaatttggctacttttcttagataaaaagtaaaaatgtataatctataaacttgcacataagtaaaactgtatctttttaatgctcctacttcctcaagtatggcatgacaaaatataatgctgacatttaggtaggcctgggcaaaagatgtgactcttctctttcatagctgtgtgctctaaggcaaataaattaaccaccaagtatcccttttttctcatattcagaatgaaagtataaatgataattgttatggtatctacctaacaggattatgaggaagctcatttgagcatgtatgttgaaaagcacttaatgaaatataaggagtcataacagttcttaacaattgattgttaatacaggatgcagatgaccaattcataccccacataccatcttttataattcagtaaatcatctcatatttaaaaataagggagatgcaaatataatgttacattagattattaacaaatgataagtttaagaccaccagaaaaaaatgtgttcataagtttcaacataaagcaaaatgactcattcttataaagtatatacaggctcattgacgcaatgttatccttaattaaggcaaaagcgatgcatttgagggaaatagtgaccctctggagaaatagagaatgaaaatagtttagggaaatgaatcttaacatcttctcttttggaaaaattcatgcatgtttctcttaatcattatgaatttcatgtttgcaaaccagtgtgaatacttaaacgataatcattattgtttagaatctacctattactacacacacagatacacacacacacacacacacacacacacacacacacacacatttgctcaagaaaatcatcctcaggaagtaaaggagttgataaaattaccattggagcagatgagtttggatacttctactgaaagctgtttcagtttttattataggtacagttctcccccgagaattctttgggagaaataaaaacatttgtttttaatttaaatgagtggtaacatgctgtagcataatattaactatttcagtgattttatcaattttatcttcctctgccttaatgtaataaatgcatatcttgattaagtacaaatctttacattacgttgtccctaatgacaaatattattttaggcaacttagttttaatcatcagagtgtcttagggagcttataaaacttgtctctgggacatggtattagcaggatgtacagagttcctttttggtgccatgctaggaggagagactgacagagtcagtccagtccattcattcatttgatagataataagtaaaccacagaagaaacgagaatatgtcagttctgactgtacaggttttaagattttttagacttaatattgaaaactagttttacttaatgttctatcagtttcatttaaatgccctaatccaatgatcactttcatttaaatatcctaatctagtgagcagatagggcttacatagcatttgtcttgaagacgttttaaaaatgcagctgcaggtcctcatctttgaaactccatttggtaaaaatggccatgtctacctttacctgtagatttaagtgtccacagtcgcgggatgagaaaagaaattgtgacacttcttgaaaaatggtctcatcaaagggattcagttgaaaatgtgagggactgcatttaaactttgataaaaaaaataagtaattctaagtaaagtctgtagccaaactccttaattgtgatgcatttgctgagttcccctcttccgtcgtcgggcctgctctgatgccatatggcctaccatggaacatttaacttgtcagatataatggattgtcctggaagcagatttttgctttgagcactcggctcctttcttgcatttcactctcagctccaggctgcaggatgaaggattgtggtagaagtgcaaagaagagacacacagttgattccccttaagagagtgacctatatgccacaaaattttacccacgtaaagaggcattatccccgtcactggccttagcaggctgcatgtcaaagtcatttaaatttccctggacttaacagattgtgtaaacatttcagaactgagagcttaggaataatgaaacatcgtcattttaacttaggcaaaaatggtgcagccatattggccaaaggaggcatattatttattgtgacctacatgtaacgtagaccacctggtttttagattctataaattaagttctctcaagtttatgaaggatgctaaaaaatatatatattatgatggaaatgttacttggctttattgtttttgtttcgtgaatagagaggtgaggttgaaatgatcatttaggaatcgcttcttagccttttggctaagatcaagtgaaatgatcatttaggtggagggacagtggcagctaattatcctaccaggctttctagcttgaaacttaggggcagaccttccattcattctaacctatttgaaattagagattggatgtgttatggactatttaatttttatctgtaaaagtaaataatgtagtctttgttcattttaatttggtgcttttatgagttaatttttttttcaatttgtgctattgtttcaacaagcttggaaaacagtaggaacaatttgtgacttttgcatctgtaggaaaacttctttaaaagaataaacagtgccctacctatatgtgtgtgtacatacatagctgtgaggtactcttctggtataacctactgtaaaccccaaagcaaatattgtgatatagagacacagaatagacaatttacaagtaatcaatcaagcacaaaccagtgggaaaataaggaacttatgtatctcaatttattctttaaatgctacatatttgattgctttagggttgcaaaagttaattaatagatttgtataagacacacagaaatatacatacactaaaagagactttgctaagtgtaattcaatatactcacaaaaatatgtgttaattatgttagaaatttaatatttaatttaattccataaatccttgcattacaaataagtcctcatacaggtcagatagggcaataaaaactactgtggccttgaaaactgacagaagctcacttctgtacaaatctttttaatgaacaactttccatcgagcagctaagaaatatctgttaaagtcagtatttaatactaaagtgtacttatgtatgtttcttactgatcctaaattgagcacgttagttttatcaatgccactcatcggctgactgtacccctcctcccccatacagatttggtgagacttagtactaaataagtttggggagtgcctggccatagccggctcttgttggggcatgtgcgccctctgctggctgctcacataggaactgactggtgtgtgaggttctttctttcttttacttttcaaggttgggttttttttgttttttgttttgtttcaatttatttttatacaactgatcagatatttaccatgattataaagttgtagcttaatactgagtatggccgttaatttgtttttatttggaaataaaggtgaggttttgttttgggtgtgtttttggtaaatagatagtcctgatagttcaaataacatgcaatgtgtgtaatactcttgagttttttaagtggttgattgtatatcacgattaaccatattttcattgctttcatattccccttgccttgattgtatttgagaagtattcttgttggactaagttgggaatagaacttaaaaggggatagataagtcattgaaattttgaaatatgattatttgtctgtaatggatgtggtaggtaatccctagtagaaaaattcctgttatggttggttgatagttttcacttgctttgccaaggaaaatgagtatatttacatcataatactttataaaagcatttttggtttccttgcaaaccaaattaagctgtgctcactggcagacattgagaatggtagtttgagtaaaatattttttgttttgttttgcttttgcagttgctgtttatagagtatgagatgttaaaggaacaaatcactgatggtctctttactcccaggacacaggactaaactatacaagggcagttacagaggaagagtgtcagcctctctaccattgcctgggtggagagcatccttgggtcctggtagtgaaggccagggctctgtgtaatgagtgtgtcttttaaaaatagcaacaatttttgttgacaaggctccatcaaagtctttataataatttagtttgtataagtgatttctgtgtatctctgaaattaaatgacttgatggagtcagtttggtatttgttgtacagagaaggcagtttagatttttatagttcttttgtcttacattgcaaatttttctaatttgtaagcaaaagccataaaaacttccaaaccaaccgtggagtgatcaaagaacttagagctgtggaagggcagaaatgtcatctacgttttttttttcttttcttttctttcagtttttcccctttgcaattttaggttccagttaccttaaaatttgttttggataaatgatataaatttttacttaatagtctttacttactttgatttaacattgtcaaataactaagaattgcattctaacaaatattaagtccttattacctctgttagaatgtcatcttgcatgaaatctcacatacatgtctctcctgttaccaccttgtcttcaatgaggttgtattgggtgctctttcttggtgcttctctgggttcccattatatcccttactggtggatagcattgtgttactcctggtatttagtcatctaaactcttacctccttgagaataatgtgcattgttgactctcttgcatccagcacatgttacacagaaagcacccaacaaatattaaattccctatattgtgttttttaggcctcattcaccactattcagatgataatttttgcaagtttcaggattaaaaattgtggtctgtaaacatagtatatgtaatgcattttattttcttgcatactttttataggatgaggtcattcttctggctactccttgtctgctttcttttttctctttttcctccctctcatccttccctctgcctctcctcttccttcctgtgctccccaccttcctctcttgattgagtcatgctcctagattcagtcattgagaggcttctcttaaacactgcagcatgggaccattcatctaccaaccttccccttccttgaacaataactagtgctgcaggctggttggactctggggagtgtggccctgcgtatctggcagtttggttattattatgggcccattctcttgaagttgatcttgaagagcaggcttggctggaaaacatcattcttctataaatataatggttagcaatcttcctactctttgtcttccttggaatgtgttttcaattctgggctgttcctcccactcccctccagtttctctcagtagtgcatgtttaggggatataggtcaattgtattcagtgctaaggctagagaaatgatcatttaatatattacagatacgtatacaaatggcagttggattatcttctgtctggggttaaaaatgtcacttatatatgtgtgtttatgtatgtattatacatatctatataccgtatataacattgtcatgtccccccccattcttttgatgtagttttgagtatcatatccaatgtgtatagtttaagagatgaacattgttatattcttgttcactgtaaacttagcttgaaagttaaggccatcacctgtgtaccatggtgctaaaatacataatttttctatatagacaactaagtgcctatgtagactactctataacaaacaaaccttttcctctcttttccatctcactgtggcttatttagagttgtatcatttttatcttttacattgactgttgctaagactctggtggaacattcagttaagtgagcagcatataatttatgattaaaagtgatttgtgtggtgaaatgcggctgctgatttccttcatattttccaataaattccaaaatatttagccaggcaccaaagtcttgcccagatgatgttgtctctattacattcagccagaaatgtcacccatctcctccaatgaaagggaaaggaccggattttctccctcactgtggacttgtcatgcctccacagaacgtggacagagaaggggtagaaggacccttttaaatgaacgaaccaggtcaggttcactagagttggatcctggattctaaaggtgacatccactcttgagatagaagagagatgctttcagagcagcgggccagtgggtctgatcaatgaggagcaaccttaacaaaactccgggattctcatattttgggatactgttgtttattaggggaatcgatttggcaatgtaaaatcgatttcttaaaaaaaaaaaaaacagccttcattattggagatgagcacatttaaaggcctagcacgctgccagagaaaggtttctctaacccatgaaatgtaactgtctgaaatgaccttggggatcaacaagtccttgtcttttaaaaaactctgcgtaaataggtgagtgctagtagtaatctactttttgttatctaccatgttaccaggtctattggagttttagctaatgtaacctatagagctgtgcctatcacttaaattggttgcttgtctccctagctggtcagaataaccagtggaattttatttgcaagaaaaaaaaatctgttgggcatggtggctcatgcctgtaatcctagcactttgggaggctgaggcaggtagatcacttgaggtcgggagttcaagaccagcctgaccaacatggtgaaaccccatctctactaaaaatacaaaaattagtcggatgtggtggcacatgcgtgtaatcccagctactcgggaggctgaggcaggagaattgcttgaatccaagagatggaggttgcagtgagctgagactgcatgccactgtactccagcctgggcaacagagtgagactctgtcttaaaaagaaaaaaataaaaataaaaagagagaatgccagactctaccgaattcacgtaccatggagaagagaacccaggaatctgtttttaggaaaagtcttgctgataattctcctgatcagcaaggtttcttagccatgaattgaatttgaggaaattgcttttctccacactcaccatctcatcacaagtcttccttctgcctaagaacatagtgaaaatattttatttctgcgtgcttttgacacctttagcatgtattgcaagatgagctttttttcatttttatatgaaaaactattatgttcttttgaataaaaaataagctttcaaatgcatatgctgttttttctaagaccacacaagtccttaattgccttggttatatccaattatcatagactcaaactgcagtaaaaatataagatagggtaggcatcactgtgaagatgttattcacataaagccaatggtaagttactcattagaagtaagttgagtgatttcagggttgcccttagtccttcaggtctctaggggacccttgtacaaattgctgattcagaaaatcattactttggtggttcaagtggtactttagtggccttaaagagttatttgacacacctccccaaacagctaagttatccccatgattatgttgattaattgcacactctgtggaattagtgttattttcaatgaaagattttcctgcgttcggaaaatcaagcataaaactcatgtgctttaatttgataatgtgtgtacttctcctaagcaggatgccaagtgaggggctgattttggttgttgttgtctgggccatgtgaaatcatctaggacaatatttttattctgcactgaaaaggtagtttttgatggactgtaggatgttcactcaaaatgcttatcgattcggacattttcatccatcatggaacttgagaactctttgactttatgaattgagtttaaattatttggggagaggattacggtagtgagaaggcaatggttgttgctacagtaggcactaataatgatacatctagaaaactccaaacggaggtggcatattgtgggaaagccttggtactggaactggaggtctgtgtgctaacttcaccacttcatatctgtgcagcctttttaactatatgagctggttacccttaattttagtgacttcgtctataaaaacatggactaaaatgcccatttaatgagcttttagggtgtgttgccttaaataatgtaagttaaatttgcatgcgagatagtgcattacaaatataagtgctctatggagaattgaatatagaatctgaaattcttcacttaggcagagccctgaagtgaagacttttggtggcaccttaagatactatctggggtttcagtacccacactgtgttaaaggcagcacaatgcctagatgagatgaggggaatcagtgatgaaatgcagccaaaactccccaatttccagtgggatcagagctataggccattactgagtattctatttttaggactaaaagaacatcagcggaagagagagttaatgccagtcttttccagaaaaaaatggtttactgcccatttttcattatcccttgatacatacaagctatgtgcctagttagttaccttttcccccatttgtctttataggatttcctaggttgttggatgactagtttatttgctggaatggagttgtaattcttttagcacaaatttattttacatttagatttttaaatgactgtggatgaaggcagagttgtccctgtatcgtaagattctgtaggagagaaccagtactcttctctgaaatgttggaaattgaaagaataatgtcagcttctgcttttttgtaaacccagagtctcacctccaaactgggatcaggagtaaagttgactagctagtcagaacaatgaagctatacctgcatggccacagattaccgtaagacatataagccaatagaaaccagcaaattaaatagtcaaaatgttttcatatcaatttaaataaaataaaaatttaatttttgaacctacatcatttatctgatagaaaactacaaatatatagtaacctgatatattcttagtgttaagttgtaaataatagtagttctgaaaggtcatcagctcttgtattaatagacacaaaaaagatggggacgggcatgtatgctcaagtcagtttaggaaacattgtataaaactaaattgaaagccaagtacagtgtctcatgtctgtgatcccagctcctctggagagcagtgcagaagaatccttgagcataggagttagagagcaccttgggtaacatagtgagaccccatctcattaaaaaaaaagaaaaccctgaattaaatgtcttaactgcagtacttctcaagagtctttaacatgctagatacaatgtaaatctgttggggggcagggcaatagcttgtaacagttcgtagattcttttaattagtctcccttttggtttttggagcccgttgtgggatcactattctatagatgacactgagtgatgctgggttgtcctgtattataattatatttttacttttactcttctgtacatcttaatacaaagacatagtcttcacatagaggtgtagaaatgcagttttctgccatgtttttgttaattagttgctttgtgttaatgtgcggagatggtggcagtttattgtaagatgtcacagaatccatgtgtatcatttgtgcagctataaagtacctagagaccttttaggaataaaacaccatgtaaatgtaaattatcattgcctataagacactttcattaatttcatatcaaattcatgagtgttttgagctctgggatttgagagtcttcagtgtcgggcctctagtttatttatacttttttttttttcccccagagtttaaacaccagcagcatagcatagtgctaagagcacagtctgggcaaacaaactgccagggtttgaatcctggctctgtcacttgtacctgtgtggctgtgggcaattttctagatctcagtttcctcatctgcaaaatggtgtttctattacctgccttatggggttgtgcagattgaatgaatcattttatgtagagctttgagcagtggttaatacatgataaggacacagctattcttatttggacagggaaggaaaaggcaggcatggaaacgatgaaggactgtaaataataacctcatgtatgtgttcagaactactaaaaagttcagttgttgtttaatgaactagtcctttctacatatatatagattcacagggtaatcagagatggatgggactggggatggggacagaaatttattctgagtcaaacatgtttatgatgagttccctagtctgatgccagggaacaaaaggctcattcttcagttcccagaatgaggattaacagtgaaacagccttgcttggtgttgtcctgcagcatcagataatttttcatcaaggcgtttcacgggatgatatattctcccatatagatgaatctatttcagcggtgggtgaaacacctaccatttatatataatttttaaagtggcattttacaaatgaaaggctacacaaccaaacatgaccctgttattatcctactggtcaaccacaagagggatcatctctgttagagcttatctctagaaatcattttattgataagttgctcgtctgtctctagctctttctaggtggtttagaactgtcatgtgtatccaggggcagtaatctaccaaaggtgatccttcttagaagtatccctatgagtggaatggatttatgagatcatttttttcccttcatgtaatattttcattgtcacccagttcccttacaataggataccatggatgtatcggaagaaaaattggaagtcaaatggctgataatacaagaatataaaaatattcaatttgaaattctatagacatttgttaaccatatcaccctcaaataaaaagcaaattttcctgctccttcttgggacagcaagataaaagattgttgaatagatcagcaaaacattgacttttttttttttttttttatatggaagttgcttgcctttcctgctcatattagtttttctgggccaggggaagcaagtgaatcctttattgattgccatttggtgccatttttaataatcaaatttaaatataggctttagcagcggacgggttcgatttggacagaacacatgttgacttcctggactgtttgctcactggagatgccgacttgttctgtagacggggctgcatgttgatctcctttgtctccagaaggattgattgacggatgttgtgtctgctcatttacagcgttttccttgtttaatttaaaaaattgtgacatagtattacatgttcccttgtatacatcatttttgcagaagaaagttgtttagccaatatgtcgacttagtttatgaaatcctctctatagctttcattcagcccttcgtgtactccattaggtcatattcatttcatgcacggcaaatcgtcaccagcagcaaaatttaacatttggtccttttaggtataaaaatgaatcaaatgcctgacaagatttgtttctggtatatatttcagaatctccccccgccccccgcaccaaccccatctttatgggcatacaacaaatgttactaacgggtacttttagttttaaaaatatggacaacagtactccatgcagtaaaagacttgagcgattaatgctacccttatgcctcttttgagtagttttagccatggggcttggcactgccaccattgtctttgtgccaaaaaatatccgcagcggctgtcgcattctagtaccggagggttgtctcgaaaattccgcagtgaacgcgccgggtttgttcatcactgctatctcttttaaatattggaaaaatagaatctttagctctttcaaagccccgttgtggttgtggggatggggggaggcgggtggtgaagaatggagaaaggaggaaagaggctgtccgcgccagccagttggtataagtgacaaaaatccatgcctgacatagagtaaacacagatatttaagagcttttgtgttcatgagcacagatagttacttaaggatcctactcaaacatgttatcagcgctcttgaaaattttattatctgaaacaaatgttccaagtgaattttaagcagaaaatcaacatcaagaccatagctaatttttaatggataatttacacaaaagatagtttcttttctagaaactgaggtgtccttttaaaatggctgcttttagtctttaaaaaaaatgataggaatcgcgattttatgtttgagaaggtgcgtgggctttatccacagtgcctgattattttgctcccaaacaggggttctggctctgagggcagatttatagttgaattggggaacaaaaagatgtaataaagttaaaagcttacactatcagaatgaaatgtgtttgttcatgatctctggaccgatctatttgatggtaaaagtggatgctacagatgaaatctttacaaggagcataatccttaaaaaaaaaaaaaaaaaaaaaaagtccacctcccagcctcctgctggctgtgctgcctctttggtacctcgcagacttcgacagagccctggacgggtgcccattgatgtcatggaaacactcaaattactgagaatgattcatgtctatgctggtctcttatcctcccccacacaaacaggagtagatttttaaccctgacaacttgtaatttgcagtgggtttatttttgtatctggataaatattttttaacaagcaaaattaagattaagcagtctgtatctgatatgatagtaaagaatgctgggttccatgtagccaagagtactttggggactctgcagcgtgaattcatattcttctcctcctcctctccctcctgcctctttcttttcctacctcttgctctttgcattccactcttcctctctttgtttttctcctacttattctctctctccttttaaaatcctgcccttttatctttaaaataatggaaggagtagcccaacttatatctataagtgaggcaaatcctggcagaaagattcctccctcctgttctgtgtgttggagtcaagttgggaaataatgctgagtggtgaaattctacaggggatagcttcaggaattccttctagagaaaaaaatagatgctttttcttccttaaactgtattttacaatttggatttttagaaattaccaaaacaggacactagatgttcagtttcttaggaagtcagagcagattctactttatccatctttctgtctttctgcctgcctccttacctgcccagcttcctgcctgcctatctacctgttaaacaagtgaatattacatcaaagtaagtgatgtaatggtgatattgaagcattcttagatgcaagagcttaaggaaggacacgcgtcctttgatagctcatgaaggtcgagccttttctgttagtaatatttatagagagaagttaaagggtataagtagcttaaatttgatgtacacagatgagtaaatatgtctttgtgaccattcacactgctgatacaagtataaatttatcttttcttcagtgcaaaatcctcatacaatggaagttattctgttagatcttctaagactgacagtctgtgcgatggtgtcttgtttcactgaaattgaaactgatatggggcattgattttatactttgcgctgagcgctagaccagaaatggggcggaggtgttttcccaactttaagattcattaaaatcagtagaaaagttaatactgggaaacggggttaattttaagacttaggtttggctttctttgaaaaccaccatccattttatatatgtaatgacttggatacaggatacccttttgaccacatagaaaaatttatggatataaatgtatcaaagatacattctttgtgtggggtcaggaaggcatactctaataacattgccattgccattgacctaaaagataaaaagactactgttacttttagcattcgtgttgagttgagaggggaaaacttgggggttgtaaacttcagaaggaaatctattcagcctctcaaaatacaagtttagagttttcctgttggaaaaaggaatactgtagtcctatgtatcaagtacaattactgtaaagctccagtcttgacgaaagaagtatcctttagacttgcgtggggtggggtcttaggcacctgcctgcctcttttagccccttttaatgttctggtatggacagatttctacaatgattctccacatgtcactatctggactctactgcttagatctcttgtaatgtgatttcattatcctccctaatgattattggggttaaactttaaaaagaaacaaatgaacacccttgattttattcttagatgtggccgaatagcatcgaagggtctatagatctctgtagagcagtctacagataaaaattgggttgttagaattggaacaagacattcacattccatgatcccttgtcctgctgggtctattggtggaatctgaacttgggttcagagtaggcaatttttcaaaagccctgtttcccaaatgtaaattccatcatcatcttgatcatgatggggttcactcctgggaaagggagtttttaaaaaagagagagagagagagactcagaattttgaatagtttctttgctaaattcaccatctggagagcctgtgattgattagttttggcctcactattaagtgtcaatataatcaatgggaattactaggctagggtcattacatagataatttgcctgctgtgtaaataaaaatgaaattgtttaaattttgtgcaagagaaagtgaaaataaggagttacgatttgtttgttagagaaagtggaggccattggaatgacagtttttggaagtgtggagcagtttggctaagaataggaatgaaggatatttttttccagtttatcatagccagagtgaggaagtgttattccctctcttgcttgcatacattgccagtagtgcctactttacgtatgtaaacatcggggaagagcagtagatgtctgttacctggaggagatttttttttaaggaaaaacacaatttacacttttttgtcgtttctcttggcaggtaaaacagaaaggggctcatactcatcttatgggagagaatcaaacttacagggttgccaccaggtaagtgagaatctctgttgcggaagggttgagaggattaacctggtaaatcagtttgttttctaaattagatgatgcattttaaactgtgacaccaaagatgcaccggcaagtcagatgatggctctctctttaagtaatgaaataacacagagcttagaactaataaacacctcatctttagatcgctgctgtatcagaactacattcatgggcttgtttttattttttaatccatcagccggtaccagtggcactgtttgcaaaccagcaatgtcggtgaaagtggttctattaaaagagtttatttgcaattaagaacttaagaatttcttacgcaggaaatacttcgcggagtcatgtgtcagaccctgggtttcgggtggctattgccctaaattatagttttcataggggctgtatgatgttgtgtgaaaacagggttgtattgagggataaaaatgtctgtgaaaatatgatttgttgtccctttttgtttctgaattgtttttggctggaagtcaaggccagcaggctaacagcaaagccgtctcaagggaagcatgcgtgagctagaaaaataagagtactttaattaaataataaaatgccagtgtaatacaaaggtatagcatgtgtgtgtttgtgtctctgggcactttgcatttgtatactttaaactctccagagagagcctatttctaaaaatactgtcaatagctaaaagtataagctttgtttcaagacaactgagtttttatagatgctttctttttcagttcagtatcagtattaatcatgtatttaaaatcttttttaaaaatttatacttcctttttataagtgcattggtttcttactttggaaaactcttgatggaatttaataatcctctttaatattcagagctctctactgtttttattattcacgcaaacaaaatgtactttttttttttcaaatgctggaaaggggatgcttactctcttgaactctctcaccctctgatgttcttgatgggggaaaaaaatctattttaattttattttaaacagcccatttaatatacccctgaaaaatgtaagcaaagttttgtttttgtaattaaatcgagcctatgaggaaagtttcctttacgtaccagacataggaaggtacgacttctggtgggttggtgtgtttgttttttccctgtatatatttgcatttttaaagtttactcccttggcccagccaccaattcagtcatattcggcatctgaaagatttgttgcattgaggtgaacagtgcttggttaagagctcctgccggagtgcagttcatggcagtttgtttggaaagaattctgcaggaaagaaatttacagccattccagcgcaacggaaacatctttggaatgtgagtgcaaatgttcgggctagatagcctgggcgacaagcctctgagtgctgtgtctctggtgtaaagctctcagttcctgcagaagaccgtgttcctgtgggtctggtttctgagggtcaaggcggaggtcattagagttttggggagaagaaagttgacaacatccttcctttctgcagatggtcatggcagaggtctctgttttcgctgggcccctttttctggtcattgagagaataggcttcctcacccctgtatcctttcttactaataggaattggcgtgattcctcacagacacaaagatttcctctgctgagtaagcgtgaggccccttaacttgtgaaagcatcatccagaccgtgtgagtctgtctgtgtatgtgcagaacacagaccctcctttctccgtttgtggggaatacttccctcgggtgaaactgaagttaatttttttttttttccaaacacaaggtgagaagtggaaaggggcagagggtggaagagaggtggatggattggcatgtgatggctgaatttctgggccttgggaggttcgttttgaggcattaatgtccaggaaaattcttttgtatatagcactatgactgcatatgcttttcttaaaaagccttcgtaatgtagccgtggagtgtggagattccttcattcttaatttgtgcttcatggttgtgagtcttgcaagagtctactatctctgtgcttagcgtggtcgcagcaatctccataaacagtgtgattacttagggataaataaaagtgaaattttggaaatttgctgacagagggaaaatagggactgaagatgaaaaatgtacagagtatgaatttctgctttctgtgaaatttgagaatagaacagaccatagtgtgtcttccagtgaatcagtttctcttgtgccgtattgttatttgaatccctgtctacaacatcagctatgcaaaccaaagagaaaggcaaaatctcagtatcttgggcttcaagtctaaatagcagatcacagctgaaatgattccccactgtgtgacaaggtgagtgactcgtggaggggaggcttttgttttcttctgtttactacatgattgagatacggaataggaaaccttcagatggtgtgccctaaggagctccaaaagctgctttatcgtattataacagtgtatcctatggacttaaaggggtgagcagtgctatatggaaacatgcttcttccagtctcaatagccttttgtttggtgtagagacagagtggtggtaagcaacaggtagcaaagcgctgtcctggaggaatacattattattgtgagacgtgtgttgtttcagaaatatatcaagttaaaaatagatatatattttagatttctcctaaggatttaacactaatactgatggacatatgacgcttttttaaatggatatattttagcagaagaatgaaagccggcaggttctttattagcaattaagttgttttcattaaaaatagtaatgagatattatttcattaatgcatttccacctgaagttatcagaaataaacatggtgactttttgagacttttaaaattgtgttgaaaatgaatcaatagataagcaaaagtagccaaacgaacttttttgagttcttactaaatatgacaaaactaatttaaatcaaattggggtacagaaatcacacccagcttaacatgttcttgccaaatggtaacctcatactccttttaactggcagagaaaatgaaatttataatggaaagtctgacagaaacgaaaatgagtgggaataaagttttttgcaagctagtccaaccttaatactataatagccaataactaaaacttaatgggcatcattgcaaatgccagaagggaaaaaatgtcatttgttttggtttctttttgctgctttgaatagaatgttgggtgatttgcaaacttttaaattttgctaaaatctatttttttaatgagatgatgatatcaaaacaaatacttgttattacttctccccttaaatggaagtttagagttgattatcaggaattgtttgtattttctttctgggatatagcccaggtctaaagccatggtttcatttttagtattgtgtgtgtgtgtgtgtgtgtgtgtgtgtgtgtgtgtgtgtgtgtgagagagagagagagagagagagagagatggggagagagagagagagagagaaagaaagctgcctatctgagaccaatcaaattagaatcttgtgagctgggcctgtgcttttctgacaactccccaggttattctaatgtgcagctaggttttatcatttcctagaatgttctgtagaaatataccctgtattaatgacttgtgttcaacatatgaccttgaaaatgcttttaggctttttgcattaatttgattattcaaggcatggaaatatattgcatatgaacttcatttaaaaggcagtgaaaattagtgatatagtgaaaatcttcaaatctttatatagaattccacaactgaatgtcccagcccatatcttgttttctctagtgaagtccaaggctttaacctcatccaaattctttttcttcttcagcaagtgatcaaataggactttgctgatacagttatttaatgtttacatcttaaaatgactaatggaatttaagaattagacctaatctaggaggttgttgttaatttccagaaacttggagaccagggaggaaacatattttcttagtttgcccataggcttgctcatttttggttcatcgaaattaagcatgtagttgattccaaaatgaatttcacatttcagaattgatttctttgtcttgttatttttacttttgattcaataggtattacaaatgacttaattctaaacttttggcctcttttagtttttcttatctaaagtcaaaatagaaaggatgtaagtgaaaaccgtacaaaattattttgtttattacgaaattggcaattgaggccaattaggccttgcgcaagcagaaatacacatcgctttttaatttactaagatgcctaagtgtttatcctgagtgttcagcacatccatcgaggtcttatgcatccttcctgggaagctctcccttgcagggccttagcacctgtcttcatcgtgctttttaaaatttgccatcatttttatgtgtttgttgcatgctgatttccacaggattctgtaaactcctggagggcagggaccatgtctgctttatcctgaatgtgtaccatgtgcctagcagggcaaaaattgcaatgacctagtgtttctttcctcagcatcacttttggaagccattttgagggagtaaggtctgaatagcaatgtacatgaaccatattgtgagcatctttttcatgcctacgaaaaccagaaaactgcactctcccaaaaaagtcctttggaagctcttccttctaacatgctgtgcaggctctggaaggacaccaaagtcataccgtggagagacacccactctgactttttggggggttgaatcgtctcattcacctggtgacttcactgttctaggcctgtatatctggaaaggcctgaatgagggaattatagatgatctgtggttctggcagaggtgttgttggaaccaaaggtcagcatcctggtccgaacattgaaatgtagcagtgtgaatggtaggacaggatattttaaattgtgacagtttcagacatcacagggcctgagtttgcagtatatatgtcatcgcagctgtgtccctgagcggtatttttcgggcagcggcttattcattttgggggattgttatgggtatatacccttctttcaaaagtcagccggtacttatcaaaggggagaatgggtccattctttcattgcattggttaagaaatacttattgaccctgtagtggtgtgttagatactcaggagaaaaaccaagggatcttgtataccttcccttctatccccaccagcagcttcctggatgttaacggggaaaatcgagctctatttatttatttttatttttaaccttacatagcataaatttttgagcatccagaacagttgaaaaaataataaaatgaatgccacatacctgctatttaggttaaacagttgtttgtatttgttatacagtattttcttgtgtgtatgtataatatgtataagaatacatatttttcagtgaaccaaccattttaagttgcagatttaataagaatgcacccatagatttttcagtacatgtctcttaaaaataagacatttgcctaactaacatactgttattatccctaaagagattaacagtagtttcttaatctcagtccatattcagatttcttcagttgtcctcatgcaaatgtcttcagtagctttcttaaaaaaggcaactaaaatgccatttacgcgtgtcatttgatttctatgtctctttataatttcttttaaactagagctgttcctctatttgtattcttttttaaattgtgtaatttattttttagggatggggtatcgctatgttgccaaggctggactcaaacttctgggcttgggattttcccaagtaatttttttgttggtttgtttgaatgatagtgactttaaagagaccaggccaactgtcctataaaacattcccctttctagaattattagatttcgtttccttgtggtgctgtttaattttgttcatcacttgttttgcctacaaatttaaaattagttctaaaggtttatgcaggttcaggttaaacattttcggctggagtacttcattgggggtgctgtgtatatcaaattacattccaacagaatattgagctatgctgctgttggtaatgctaactttaatcacttggcaaaagtggtgaccactggattgttccattgtaaaggaatctttccccatctgcaattaacaaatagtctttgtattgatactttagcaatggacagatacccctttttcccaacaacctttgacctaatagttttagcacacattgatgacccttgcctgaatcagttatttcaactgaagacttcaaactggtgattcttttaaaattccatcattccttccacatttatagctagtattcttctataaaagggcagtttctttcatcattcattttaacactatcagtttcatgtttcatattttatataagtgtcataacaattactgtttctaatgtttccttacctggaggatgttggaagcattaaagtattcttgaaatctcttaaggtatattgataagaaaagtagttatggctcaggctgatggtcagagaggctttaattgtaagaggagggaggtaattgtaggcatgtttccttgtaaactaaacttcagtattcttttggtgaaatttggaaccttgcaacaacctctgtgcccctagctgtgtttctctgattctcatattgccactctataattgctagtaaacatctcacaaggttgatcatcagtagttgactggccgactcgagggggttgctgtggtgctctgtgaagctgcgctatcagggatcagctaataatccctgcctcagtccttgcacaatccagacatggttgatagtgaatgtcaaaatgagtgaatttctaaaagatagtttgggcttaatctaaaggaagcctgagtaactagtattaggtgccaatataaatctctgagttggttaatattattgtcccttaataattaagaaagggatgctcagagaagtaaagcaagtagacctcaaatcatttgcttcaagtaagtttcagagccagactctgaactctaagatgttttgtttcaaagccagtgctttccaacttgggttccctgctacttaagcccatgaaggagtttttaggctcagaagtccatattagttctcatctagaaaaccctgtctggtcgattccaggcccactgggggatctgggcctgacacagtatctacaacagagtagctgcactcagctccgttcagggttagctagaactctgaacagtcagtagggaaaggcatagcggagggcagatcgcatcgttcctgactgcccagccttaagggggggaaaaaaagattatatgaataatctattcagtaacatcctcagaattagcatgtgcaatttccttaaaaccaatgaggatttcctgtgaaaaggctggggtggaatatgccaattcacattttagcaacagcgtgaacactttcttaaaaatgtatagattatgttttggctttgctttttgtgcaatgtaggcagaatatggtttgctattatataaatttggattcattatagatcacattattgttccaaaaacacaagagctacatacagcgagattctgaaacaatacctttagcaggttcttaaatatgccccaataatttttcgattatggcatttagccctcaagtaaaatatatgaaacaacagaatatgtgctaggagcataggcaagttttatacaacaacagttcaggcagttagtgcataaaaagccattgaaattgctttgagatgatttatgagacaccgaagaaatggactcctagtatccaaattgaaatttcaccagaatcatgggattaacttctcttttcttatgaaaaccattaagcgtttttaaaatagcttctagcaattaggactacagttcttcatctttatgtttctgataggtgtaaagacaaaggggaaaaatcaattaatgactaaagaaataattgatttaatgctgaggtgtatctgatataatttaatgttgaaacgtatctacatatcatgtagagatcagtgtagctctatagcctccttctgtaagaaaggcagtatactcaaaattcaacatcaggatagtgtttcaatgtgaaatgacagaaatatttattgaacgtcatgcttgatattattttattgttgagagctttttactgaaactctttaaaactgaacccccaaattaaaatattggcaacactgaaagatagcaacagaagcctgtaatctgaagtaatggacttattaaggacttcagaaaaaaagactttagaaaagaagcatatatcgttgagtctgctgccgtgcctgatagtgataacctgcttagaattgaagcaccccattctttgaaaaattgtgtgcgctctgtggatattgacgtgggtttgtttacatgtgctttcactcacagatcaactgagcttcctaaagcatggacctttcatgttcagcgtgttgttttctaatctcatagaagtagtttcatagggaggagaaaacagaaaccgacaagaatatttctttgcatttgccttagcatttccaacatgcaaatgttgcttttttcatagtatggcacttatttttgtcagacatttcttgtacttaacaaagggcaaagttacattttggcgggagagcgactttcgcccggcacttcaccagatctcgttgaatagaatatattatcactgttagcattcttagggttcttaatgaaagctacataccctttatctccattttcctctccttttagaagacatcttccaatgaacaatttctatgacttgaataccagatatatgttattttcaagctacctcaaagccatgtttatatgcatttgcgacaataacaattccgtgcttcggaataattatgtaggagtatcattgaggttattaggcaggacccaccctctagagttctgtacatgggggggtctctgtgtgttggggttttactgtgcaagcacacagaatatcctgagctcatttgtaccatgataatgaacagcagggcactgaatctttttagttttattggcattgtatacagtaagttattaaatttcatctctgtaatatacctgcagtaaaataacaaaatattggtgcacttaaagaacatgtgtgtgtggaacaatgccctccccatcatttcagccccctgcaaacagctgcttacagatttcaagatccattgtatgtattccctcgagcccacctctaataatcgagacacatctgccattgcagtattataggcatatgtagttttattgaaaactatacctgtaaaaaaattaaataactcctgcctcaattaaattggcaagctaccttttgcaaagatcatattgcagacctcttgagacccaagtgagttcattttattcttacattacaaatcactaaatatgttatttttatttagctgagtagctagctttcctcgtactttgatggtaagttactttcatccattctcacttttgttttccttctcccctcatctttacatattaaaaaaattatgcaaattgcatgaagcaaacattttgagaatctgaacagaataaaatcaaagggaaaggaccctaacatgcagctttaactctgaagtgattattaaataaatacatgcaaaggttacaaaattggggtcaaatttataactcacgttgtggcttgtgatttttacaaacttctttgagatccatttgatcatcataatggtagaataggaagtaatatgaagaggaaatgagttagtaggccatacaaagcatatgcagatgaattcctattggattaaataacttaacacttactcttaagaaaataatagatacgagatctcactctatcacccaggctggagtgcagtggtgcagtcatagctcactgcaaccttgaactcctgggctcaagcaatcctccctcctcagcctcctgagtagctaggactgcaggcatataccaccatggctggttaacttttttatgttttgtagagccagggtctcacgttgttgtccaggctgtctcaaattcctgacttcaagccatccttctacctagactttccaaaatgctgtgattataggcatgagccactgcacccagccaacagtcttaatacttgttgaagattgagtcagtaatagatgtctgcaaaatagttttttatccaaagaaggaataagagtaaaatatttaccgatataaaaatgtgagcctaaacttattttaagttatgtaaggtatctgtataggtcttcatgtgagttaatcatgccaatatatagtgatttaaccaagaagaatttttttgctttatattttcatagaaaaaatccaaaaagacaagttgcccactatatgggaaacatatatgtgtatatatcgtatatatctgaattatgtatgtctatatatatgaaacacacacacacactgttataagacagtaagcaggttccttatctatagtttcttagttaaaaaaacaaaacaaaacaacattttgtgctattcagatgaactgtgtataactggaccgagggagtggttagaggtgaatactgtcccaaagtgaacatagagtcagaggaaagactctgttgaaagtcagaaagtagatgatttcataggatcaagtcacggataaatatgaggtgatgactgttatagagaaggtagaaaatcgaaaatcaagcagtgatattctttttttttttttttttttgtggggttgttggggattgggtctctatgttgtccaggtgggactcaaacccctgggctgaatcagtcttcccacctcagccctctgagtagttgggactgtaggtacacaccaccatgcctggcttgtagtagcagtattgacaaccagtcaggatagaaaatagttacatgtttaaataaagaatttccttctttgggccgggcatgatggctcatgcctgtaatcccagcactttgggaggccgaggtgggtggatcacttgaggacaggagttcgagaccagcctgacgaacatggcgaaatgccatctctactgaaaatacaaaaagttagctaggtgtggtggtgcatgcctgtaatcccagctactcaggaggctgaggcacaagaattgcttgaacctgggaggcggaggttgcagtgagcccagatcacgccactgcactgcagcctgggtgacagagcgagactctgtctcaaaaaaaaaaaaaaaaaaaaaaaaaagattttttttttttcttttagatgaagtctcactctgtcgcccaggctgcagtgcagtggcacaatctctgctcactgcaacctctgcctcctgggttcaagcgatgctcctgtttcaccctcccgagtagttgggattacaggcgtgtgccacctgggctggctaagtttttttttaatatttttgtagagacagggtttcaccatgttggccagactggtctcaaactcctgacctcaagtgatccgcccacctcggcctcccaaagtgctgggattacaggcatgaaccaccgcgcctggcagaatgttcttcttttttgataggaatgttgattcaagtcagtgagtggtcgtttggttccacttgggcttacctgggcccaggagactctgctcactctgtgttctcccagggtattttgtgccccactgctggttcacagagatgccaggtttcacggaatggagggctgagtcctagagagggtcatcacttacaagtaagatatcaaaccctaagggaatcagaatttaaagtcttagaagggtttcagttttgtcatatagaaaaatattgaaaattaaaaaatatatatattatgaattgtaaacaaactttttgatcaaaactcatgaaagttggggaatacaccttaacttgcaccctgccactgctttgaagtcccatccctgggatgtggttcactcctgtggaaatatatattatctattacatttgaactgtgaattgtgtttgtcacactgagctaagcagctcagaactgtcatgtgtagagtgactggtacaatacaacatcagtggtggtaaaagatttgtatggacaatgacatgtggcaaagaagaatgtcaacagctgccactgctatgacatcgtccctcaaggagtctttctgcatctctgccatgtaactgtctcagccaaagagaaggcactaacatgaacttcttccccagaatgctactcccaactagcgaccacgtaagactcgcttgagtcttttttgagggtgcaagtcctgggtgccatttgtcaccggaaagaacatttaagtttggagttttatgtatagagggagggattattctttgatttatttcgaaagaacatgttcttaatgtccttttgcagataatacacacaccctatcagtttttggactccagactgtctccatccatatgtcattatgaagcaggtttttatcttattatgatttaggtaattgtactagcctctaaaattttataatgtacctttcagaagctcatagatgccaagatcagaggctcctttggagttccatctaatatatcttccttagccaactggtacagataattttatctttcctctagatagttacacatatagctctagaaataaaatgtagttatcctaaatcagctgtatagagccttaaccagcaatcagaccatttagaacattcaacaataatacattctaccaaactctgactttctgtgttcagtagatatttattaggaaactcaccctgtgtcccactgaagatcctcacatgctctctaggtagatgacttcagctaatagtatagtaaccatgaggccttagtatttatgacttttcttttctttctttcttttttttttttttttttttttttaagagtcagggtcctgctgtgttgcccaggctggtcttgaactcccggccagagtgatcctcccaccttggcctcccaaagtgctgggattataggtgtgagccaccacatctggaagtatttatcactttccaaattcgtattcttacatgtgtttggatttatttttcaagaagccagagtaaaatttggcaattaccaaattgtgagttgagaaaaatagataattcacctttggtattgtgcttttgaatttgaattccattgattggatttcagtccgtcgggattagttcttccatctgtgtcccttggtgtgatgactgactcccagccaccatctgagactgctcggtctccctcatctccaaaagtcctcagtttccagatctcatcaattctgcttgcaagataccaataaatctgctgctgcctcctagacccccagtcaccaccgtggctgcccgtgctgctctgatccctctacccaccttctccctcacatgcctcctgtccactgctgctggagtgacagtctccacaaaacattgttccttggctttggggcctgtccttagcatggtggtatcctggcccctgtttctgcctgcagcctcagccttcgtactcaccattcacatctcatgttccagccctactgagctgcttgcagttccctcaagagttctttcacggttctctctgtctttataagaacctgaaatacctttgccttgcctccccttcttcttgccttacatctgttctaccagctaactcacctgctttgttcaagattcagggaccctggatgttataaccagggcagagcgagctgcctctcttctgtgctcaggaagcctttggagcacttctttttcctcacagtcatcacactgtctacagccagagaagggcaaaggctaggggcaagggctaggcttgccgtctctatctgcagtgtctaacaggggcacccaggaagtgcttgttccagagtcacaggatggatgagtgaatgaatgaatgaactagcaatagtaagaaattgtatgtgagcatgtaacttactatatttaaatacttccatgcaaatttcttgacttaaattaaccatgccaatgacccctgaggctggatttatttatttatttattttttgagatggagtctcgctctgtcacccaggctgaagtgcagtggtgtgatctcggctcactgcaatccctgcctcccgggttcatgccattcttctgcctcagtctcccgagtagctgggaccacaggcgcccaccaccatgcccggctaatttttttttgtatttttagtagagatggggtttcaccgtgttagccaggatggtctcaatctcctgacctcgtgatccacccgcctcggcctcccaaagtgctgagattacagctgtgagccactgtgcccagccgaggctgggattatttttaatccagttttattgataaagaaactgagatttagagagatttgttttcactctgaaggcagagatgggactggggaacaaactcctttggatccagatttggcattttctttgtcacttctttagcactggataaagttggtgtagctttgtgtcatagcaagtagcccacagagtcttttcatagatggttccagctctctattcattattaacttagggatcattcatggaggcacttacctagttaccaggctgagacctctgtctgccaatgagaaaaaatgtgcatttctaaagaggatatgaagaacctagcaatctgtatatcaggagcattgtctttacatagacaaaaaagaatattttgaatgtttcctgtaagtaagtaccagttgcaatagcgtggtgcgtaccgcccatgctatctattgcccatcagtggtacctctactctctggttgtggtgaaaaggaccatggtcctcctggaaatttctggccctgaagctcaggggagaagtgcaacaccagccacatctcatcccccaagtttcattctccttcactctccctggtacaacttggcagaggatggggagaactgggaagaagtggatgcattgagtagatcaagcttttcctcttcatgtttactttatatgattttaattttgtaaccttgttgtaggacataaaaaatgaatgacagtggacttagcttttatttataacattgaaatccttaaagatagaatgttagagtcagaaaggacctagacatcatctggcatccagtgccgctttgtagcaagtggaaaactaaagctcagagatgttgaggttggtcgtcatcacacagcaagcagaccttgctcagacacagccacacaatacaagtaaaattcctagcctgtaacacggaagttttcctttgatgtctttgtacccgctttcttccaaagagcaaaaggtcacctagaccatgaagtaatagccagcagcagccggaaacacatcctgaggaaatttctagacgattgtccctttgttaagctaccattgaatcatactgtcacagagccagagggtgtcgtttgcttgtaaatactgagtttttgaaatgtcactgtaacactggaaaaatgttgtctctgaaggttgccaaagtgacagaatcccgacattgtaaataccagccaacacaagtgcttataaatgacaggaataaaatatacttgactaaatccataataatcactgataacactgtttaccctcagtgaccaggagctgtgaacttggataaaaagcacatgtgtgcagatatcattaatatgtctgagcctctagccattccagaatattttgatggaaaagctccctaaatatgtaaaagctttgcaataactaagaagctagtgtgtaaggtagggtgtcagtcgtccctgatgaaactagagagagccttgactatcttcagcccccagaggactgataaggcctcccttgttctggttagacccaaactctgagccaggctactagggcaggcaatgctgtattttcagtagatgtgattctcagaaggcccatttgccagaagcatgagcccacacctatatcatgttccatggagaaaatgtggaatgaacttagagattaaaaactttggagccataagtgggaggatcccatgaactaccctttgactttcaaagggtggatgggtggtcagacctttccacagtcctaatactctatagcccaggctttttcttaataataacttcctcctctctagaaatgattctctccctcttttttctgttctagtgtaaaaatggtgcctgtgtgtatccgagtctttaagaggaaatggacacattggcaaaccagtgcctcctttggctctgtgatgtggctgctgttactactcaactggagcaccccttatattccagtctccccagaaatgctcaggaacagtggagactcaatgacagagggttgagccctcctggtttttcaactggtgaaagagaaattcagatggttaaggagatagcagagtagccagcactccgggagctgctcttatctctgctatgaggctgtgcatggggaagagtagggctgcttggaatgacctccttacttttcatatattgaaacatatttctttttccttgatatgctcctgtattgtttgaattttattttattttattttttgtggtaagcattgttttcttaattaacaatgaaaggttgtagtcaataaactagtacttgatgagatttgagaaaaactacaaaactgtagattgcaagttggcatttgaccaagaaattatgattgtgctccttggatttttatgcttaggaaagagtgcacaagagggaaaaagctttcggtcagaagatacccattctagtactagctggaatggtggtaaagaatacgaaatggtctgaatgtccatggctgtgtgatattggcgtattttgctgtccatgggtctaagtggatggtattatagctttgaaagagtcatggcaaaggagggaacaggtgtgtcccaaaccctaatgaactcagcagattggcctggcattctggcaatgtagtcattcagcggagccgtggggactccctgggtggggacccagcatgcttctggaggtacctgggaggcgctgggagtagggcctgctgtactggtttgactaatgtggtgtaggtgttgatgttggagagttggtggccagtctcaggctctgttctggcactactccagcttgttggtcatgaatgcagattgagattgaatggctccttacatttcccttgaagaaaggcagctttgtcttccaggaatgagctgatggcagtggccgtgtggacattctgcagctttggcacccagtagcgatggcctgattgccttgaaactgggagcctctagggccctgagaacttgagcagggctggacaagccttggagcagaactttgctgtgaattctttcattgactcgcaaaagatgaaggactctaatccctgatatctacctttccacttgacctttttagtcttcagtggtcttttagaagtaattttacctggccgcggtggctcatgcctataatcctagaactttgggaggcctaggcgggcagatcacctgaggccaggagttcgagaccggcctggccagcatagtgaaaccccatctctactaaaaatacaaaattagcagggtgtggtggctcacgcctataatcctagttactcgggatgctgaggcaggagaatcacttgaacctgggaggcagaggctgaagtgagccaagatcgtgcattgcactccagcctgggtgacaagagagaaaccatctaacaaaaaaagttattttatgaaaaacatttggaggttttcttttgggtatggcaggcagattggcctcttatttggcataggtgaagaagaagagttgaataaaagtagttggggcatagaatggccatgcaagttcccaactaaatcagggtcaagtttaaatgtatttgtattttgttcaaattcatctttatctaaaacaggctgatgctgttttgtctctgtgctgcaggtggatagccacaaatttgactctatagttaccagttatccccctgccaccccttgtttttcttcctgatttctctacttccaatcagctgctcttttagaaaccaatagagaagtgagacggggtgggggcagaggaagagagaaagggggtaagggggagggagaaagaggaaagagaggttgttttttgtcattagtgagtaaaaatctgtcgggctcgggtagtttcttagtgaattcagcatttagtgattagattagaggggtatatttgagctgaagattttgggaactcacctttctgctctacagaatccctaggtttctcctttagctctactttctgattcattccatccccatccactgaccccaccgccaatattgaggtacttgtgaaagctcagaatctccagtgtcctcaaggagctagccccaaagtgccccctggtggctagaggagaaaaagacaagatggaggatgggaaaaaggtcaggtggatggataactttggctcttcttttggctcttcttttctgatagtatttttgttaacagcatctaatgggttgtcttctttcagtatcaatgtgaaccagctctgaataggttagtgtatcaatgtatttccctttttgggtgattttgctgcagggatttctttccctatgccagtttttgttggtctgatttttgtttctaggcatattgcattgacctgagccttctcacagtactgatgacactgggggtagggagaacaggagcagttgaagacgacacatgctgtcacctcatgtgctggtgtgagtggcgcagggaagggctgtgattttttataggcacactgattagccaagcacttgtcacctccactgccgctcattggcctactgagtgtgagcgtgccatctaattgacagctgtctgttgtcagagggccatcttttctccttttcagtttgagtgaacacaacagagacatctgcagagctctctgcagctctgacaaggttgccctgcctgccaaccctcagacttctaggcagcataattgaagagatcagaaaagaatattaacccgttgaccatcttgggctgaggtgtaatgaccaaaaagtcactttttaaggtgactgtgagtctttcttagtagaggaagacatgagattctctgtcagaagagtcaggccagtaggaagtgctatttcttggtagtgattgttcgtggggtttcagttcatctgagcacttggaagaggatgagaagttcattttcaaggtagacccagtgtttcatggtggggttacactgaagcctgaatgctgggtcacatcattcatgtctgatttggcttgtgtaatgacagtagtgctttggatgtgtgtagtttggatgagggttactctttttcttttaccgccaggcctgacactgcccttttagcgtaagattccagaatctcttatgcagtagcatggaatgtatggccaaccccgtagtaacgtggactgcctctttgggacatttcctgtaagccagagatatcaaggtggactttgtgatgggtagattgtttattatacagatatcagcttgggaatttgaatgtttaattatttgccttgtcgtagtgtcttcaaatgaagctctatttgagcatctactgggattggtacaatatgcagacaagctggctttgtgtgggtcgagtcacctgtgcttgcaggatgggggtgcttgctatatttggaagtgatttagtggtatcctaggtttatcaggaggaaaatacatctttgcatttatttgaacatttgatttagaaagggacagtgtgtgggtattggataaattgcttttactctttctttgctttgcattgttctcccctctgatgatttgcaacttagcaagccttcatcattgaacctgggtgaaaaagaagatctgagaagccttgagtaatttgtttcagactgtttatactctagtgttttacagatgtgggcttatttgaggaatagtattggcgaaaggtagcgtcattaaactggttggagaaatttcaggcaagtagatagagaaatttcaggcaactccttttccaagttgttgctcacagattataatagatgaattcagcagaatgttctgacctcctagactaggtcagataactgagttcttgtcctaactcaaatcctaagtagctgtttcttaaagctctgttctgcctctgcagaatgaaggcttggcctatatagtgtatgagattccttctagcttcagggttttgtaactatcagaataggtaatgaggaaggagactatgccctggtagcctttagccatatcacaaatatttaacatactcccaaaatagcacatacaagacagaaattctttgtacttgaagggaataataaatacagaaagcatttgagaagtacacatttaatttctgttaactctttttttcttatttatgtttattattagatgataaatgacttccttttttttagtattaaaacaaggtgatcaggatagtgagaggattgggtcaggtgaaacacatgactcacctgcgtgcttatgattccccttggaagatggttttgggtaacattctgggaaaactatggataaagtcataggcttccatatttaattaattctaagacttttttttcacatttcaacatctcagaaatttatggtatgccaattcaattggcaacttttttcctctcttggtaggaaatagataatgatgtttttgacattcagtggcatcttataggtgatgaaatacaattctgaggggaggaagcaagatttttttttttttaactgagaaaggctacgtgactaagtgacttctttgtttcaatgctgactaaagctgtgatgtcctttttaatcactttgaaagattcaaattgctttaggaagacaattcatgcatggagctcaccctcccagaactccacacttaatgcccactgaggaaggagagaaatgcatgcaaatatatatcccaatatagaaggaatattctagttcagtaacttccactcctgagcttttatcaaatttttctctatagaattatttttgttttattgtatccaaaatgtcagatatctttttcaaggaaggtcaagggactttgccattttctaagccagaagtattctcacctagtccagtactagtcaaagtttttagtaaatcacttagaatttccttttttaaaaaaaaaaaaaaacccttctagagtttgttgataccttaaagatcatcaaatccagctccttatttcacaaatgagtaaaaagaagacataagttgcttgttcagagttcagctaggaactagatagaacctgggtagcctgacgctcccattcttgctgctaaattccatgcaatgtaatgaaagcgggattgagtataaaaccgatactctacacatcttttgttgatatttctgagggagaaacttgaatttctgtaagtgcacatagctggtttccctttgctttgtatttctgaatgctacacttgtcttctgcctactacacttaaattcataggtgatttcacaaggcacagaagcccaacttgtcacatgtggtttaatatatgccacactttatgctgcagtagcaccatttggtcatatttagtgaactctgtggttgttgagaatgccaaagcagcaggctcagctattgcagcataggcctgtacttagttagcaagcttagcttaaaagctgtcagtgcagctaatgttacagtggcttactgagaccttggcctggttgtgatagttctccaaacctgggtgttttcacctttgaaatatgaatctggatttagctttttcttagaaaacagcaacaacaacaaaatggtgaaatctttaagctcgttaatgtgaatgcagtaagaatgtaaatttaatacatattcacttattattaaatgctgttgtaaataacatttttagatttaataatgatttcccaagacatttcgtgctattctttactttgaaactgatggggtgagaagagagttgaatcttaattattattttttagttaattaacatgtgatttaaaaaaatcgagatatattttgtgttagaccctaattagaaaagatgtcaagaataacataatgctaacttaattttaaaattgataaatgagggcaagatgattggaaagtatcctctagatcacacaggaaacgggttaatattcaaatgaatagctctgaaacgctactttcctaccagctcctgaagcaatttagtttttaagacctaaaactgactcacaatctgtggtatgaaggatagatgttaatagtttaaatatttaggcattgcgtgggctgtttgttaaaccattggtagcttgagattgaccacagtgggagtgttttcaccatgcgaatgagcatccctgctcacagtggggcatgagcatagcactgcaggatacggaactgacatttattacatacctgacatttccgttactcttttatttatcgttttgggctgcttgtttgtgtcctatccccactccccaaattcatatgttgaaaccttaatccccagtgggatggtgttaggaggtgaagcctttgggagatgattgggtgatgagggtggacctccgatgaaggaattaatgtccttataagaagaggaagacacactggggcctgtcagcggtgggggacgaggggagggttagcattaggagaaataccggatgtagatgacgggttgatgggtgcagcaaaacaccatggcacgtgtatacccatgtaacaaacctgcacattctgcacatgtatcccagaactttaaagtataatttaaaaaaaaaaagaaaagtaaaggaagagagctagccagccttctctcttctccatgtgaggataccacgagaagatggtcatctgtaaatcagaaagaggaccctcgtggtggctcacacctgtaatccaagcactttgggaggttgaggtaggaggatcagttgagcccaggagtttcgagaccagcctgagcaacacgatgaaaccctgtctctactgaaaaaaagaaaacaaaattagccagatgtggtgacacatacctctgtagtcctagtgacccaggaggttaaggtgagaggatcagctgagcccggaaagtcgaggctgcagtgagccatgatcatgccactgcactccagcctgggcaatagactgagaccctctctctccccaacccctccagaaagaggatcttgtctggaatccagccattctggtcctgatcttagaattctagcctccggaactgttagaagtaaatgcttgttgtttaggctacccagtctttcgtattttgttatagcagctaaattgacttagacatcattaattatgtattttaagtcctgtgttttagcattctggaatgagagcattgaaaatgatcatcaagccgagtaaattaactgaattaactattccaccaaaaaaaaccccaaaaactgaaatgttcgttgttcctggggaatggctatgcacttggaggctggtccccttcctccctcctcttcttcctggtgaatcccctgacttttctcaatcaggctttctgatgtggaggcttcctctgcttcccagggacacactcccttcccagggctcctggagctgctgcatctctgctaccctgagatgtaattcttgcctgagatttcagctcctcccctacacttcagaggcttcagtggactatttcttattcatctgtgcaggcacattgtccaatgtacaacctgctcaatgggcttgttgagttaataaactactctgtgttctgtattatgtggatttagatgttttgcttctttttcagccttcctttcgcaccctccacctacccgacccctgctaagatgctaccttttaaagaaaagaaataagttcttcacacttttctacatttataattcaatataaataactgctactggtatacttaatcacaattagattaaatatgttctttgaaacagggaggtcatctaatgaatagaagtgaaatatgtcagaaaatgtcacataactgagagtgtgacatctttagtaaatagaatgttgagatgattttagtgctaggctagttttgtaagagacatcttatttgacacctttgttcaaacaacttttgtggttctcaaactagcctctattgaaaagaccaagttccctacgtcttctctttgaacactttcttctttgcattaacctgttcttgctagtgcgtccaagtgtggaaagcaaagattagttttaaatcttccgggtcaaaactgttttggcttttttctagagctgataataagtagtatagttttctgtgtaccatgtgtaagagaagagaaaaggtctgactttatgttagataatccataattcggttgctctgtcccactatatggagaccaaagtcacactaaatggatgccttgggtaggggagaaggatgtagcctttcaatcagacttcttagctgcactagtcacatggctagcctggggcaggtatttaaacttgctatacctaagtctcctcatctattaattgacattaatatcagcaccttcttcatagggtttgtaaggattgaataatttaatgtatgtaagacacttagaagagtgtcttaaataatgtgagcaccttcttcattaacattagcacatatttcatatgattttgtgaggattaaataatttaatgtatgtaagacacttataagagtgtgttaaattacagactgtgctcagtaaatgttgtctaatattatttttaaactgatggttattagccaagctataccatatcttcaactttgggtgcacaagagtgggcagtatctttgaagaggtcgttgtttctcaatctgtgggtcaagtattcttagggaaacttttcattttggtccaactcataactttagtgacattagtctttgcaatttcctgctgagaagagaaggtagcctttctattttttttaagttttcaaagcctaattttatattaaaagaaaacaaggtattaaaaccacgtatttcttttaacttattaaaaggaaataacacagtaacattaataaaaagttacaaaatggcacagtaacattaataaaatgttacattgtctttttattctatagcgtgaatggaagaaataaagtaacttttctagagctacaaagtagttaatggtggcaaagattcactctctggcaatgtgtcttgtttcacaaagtaatacaagttcaacacagtatagaattgcctttgatttcaaatggtaacagcatttattggattatttttgtagatgttcaatgccacaagtaaaatgaagttttctctttaaaaggatgatagatgtggcagacccatcactgggtccctggacagtggtaacatgatggggtttaaagtcctttttgaaatagccaggttaatctgcataaaggctatggtgcttcattaagctttttgaaaactttctggggtaggccaagtggctatttgtatcagttaaacgtaagtacaactacttaaaataacatttcttcccacttgtgcttgagtctgggtctatatttttcctgataataacaggataaaatgaatcatttgattccatattccaagaaaaacgtgtccattaggtagaggaagctcttagaaattatctccaagagtggcttgttttgtacctgtcatatttattataaggtaaagggagatgtagactggtgggggtgatggtagtaaattgaaatgagttgccagctgtgttgcccaggctggtcttgaactcctgggctcaagccatcccaccagagaaggttcttaaaccttttgctttccattgggcatctttatctacattttacctcatcaagctcatcaagtgaatcagacgctttgactcagtcataacatgttgatggagagtcacttagttggaaaatatagacaagaagatgggctctgggaagaactggtaggtaggcaatggctctgaaagtgtggggccctggtttacagtgtaatgacacccaccatttagtgcctcagccattattcaagtgtgctgtgcctttcctactggccacgttaatgagagggtggagatagcaagttcctgctgaaattttcacaggaaagctaagcccttaaatgatgttttgaaggaatggtttctctaccatctgtaaaaaaggcttgattaattattttggtggcagaaactatatgctgtgcttcaggttaaacagcaggaacatattgaggttcttgggaagagttttcctacagccatcaaataggtgtccacacaggttaaccggactgtgcaataagaatgtgggacattggcatgccagtgtgaagtctggaaaagtcggatgtgatatatgcaagtggaagagaactgaaactatgaagagtcatttggaaagccccagttgtgagtttgtgatagttgagaaatggcacctcctctttgcatacttaggtttgagcaggaaacaaagaagtgacttgaagtcatgttatgaaaagaagaattgggttggaggtcagactctggattctagacctgattctgagttaactaacattttagcctagtttcaggcactccccagtggcccaatgagccaccccttcttgcaggcctcaaaatgcactgtgataaaactgcatagtattttcttttccttattttcatgttctaagaaatattattgtccgggcacggtggcttacacctgtaatcccagcactttaggaggccgaggcaggcagatctcttcagcccaagagttcaagaccagcctgggcaacatggtgagaccctgtctctaataaaaatagaaaaagacaaaaccctggtgtggtgatgcatgcctgtggtctgagctactcaggaggctgaagtgggaggatcccttgagccctgggggtggaggttgcagtgagctgagatcccgccgctgcattcaagactgagtgacagagtgaaaccctgtctaaaaaaaaaaaaaaaaaaaaaaggagaagaaaatataataaaaataatacatggatactttcttaaaatatcagacacttgagaatgttgagtaaaatataaaaggacttaatctggagatcattgccttagttataacatagaacctttctacttaggagaatttccctctctcctactccctatttgtaaaaattttcttttgtggcttcagtcaagtttcatacttttaaatgtttttgttaattttattctttgtgtttttttcctaaactgtatttttgttccattatgattttttcattggttagctgaggtataggaaagttgtcttttttattgtctgttaatcttataacccgtaactccagaactttcttactagcctctggtagttttttttagttgtttaagattttttaggaagaaaatcattggcaaatattgggagtgttgtctcttaaagtgtctttctgttatattttccttgtgctagtacattggcaaagacttacaggagagtgttaagagaatagtggaatacaggtcagcttcgcattttgttgacttgagcaaagaatcttctagtgtttcattattaaataagttttctgtaggcatctagtagattaagaaaactttcttatgatccaccacttcttaaaatgaatgtgtgtgttcaaactaaagagatatatgtatatagtagaaatatatgtgtatgcttgtgtgcatgtgtgtgtataaactttaaatcatcctctcaaaattcctgaagtaaaagtctattttgttgttttatgtggaattttattttatttaaatttttatatttatatattttatttaaaattttcatgaaatggccaagcagggtttaatataaaatggaaacagggtttatctcagaaatttggtggctaaattccttgtatcccgtcttatctagggatgttgtttgtttcaaggttctaccttgagaggagcctgtcattttcttttttgtgtgctgctttgcctagttgacatcttggctttatgtgctcctgttgaatgcattgggaaattttctttcttctttctatgtcctgaaatagcttatataagaggggaatttttgatatttgggggaaattgcatgggacttttttttttttttttttttttttagacagggcctcactctatcctcaaaactggaatggagtgcagtggtgtgatcatggctcactgcagtctctaccacctgagtagctgagactataggcacatgccaccaatcccactaatttttgtatttttttgtggaggcggagtttcgccatgttgctcatgctggtcttgaactcctggacttagccatctgcctgccttagcctcccaaactgctgggattacaaatgtgagccaccgcgcctggcaagactagtacttcagaactggattttttactaatttttccatttctgtttctttgtgtttcaattgtgatagtttttgttatcctagaaaacatccattttccagactttaaaatttgctacataaaattatacatactttctcttgttttaaaaaactccttatctatttagcaaatatattttgtaattatgttgatttctgttttctctcttcttgtttttccttacacttgccagaggtttgtgtgttttctttggttttttttttcaagtaccttcttttggtttcattgataatctacattttgttttatctaaatttagtaaattttaaattttattaattcatcatatttaaatatgttgcactttttctagctttttatattgtatgttttgttcatttaatttttatttttacatcttgcaatttaaggccattatttttcattggttacagctttggctgcatcccttagattttcttatatacagctatcactatcatttatttgtgtattgttttaaatgttattttgcattcttgtgtagttcaagagttacttaaaacactgttttcacagtcccactttaataaaatgtttttcatgttggcagtgctactgttttgtttttactatttaattttattgcattctgagtggggaaatggcatggatatttcctactttgggggtaatctagtaggatttttaaaaatgcttagttttttttaagcatttcatatgcatttgaaaataatgaatactatttccctattttattattattattattatttttgagatggagtctcactctgtcactcaggttggagtgtagtggcacgatctcagctcagtgcaacctccggctcccggtttcaagcaatcttcccacctcagcctcccaagtagctgggatcacaagcatgtgccaccaacctggctacattttgttttttttagtagagatggagtttcatcattttggccagcctggtcttgaattcctgacctcaactgatcttcccacctcagcctcccaaactgctgggattacaggcgtgagccactgcacccggcctattttccctattttaatatattaaaccttttattacttattgtccttctaattgatttaaatttctgagagatatttgttctagtcttctactttgattatggatttaccaaccgctcagggtatttatattttaaaaaatatatctcaaagctgtatcataaatgattagaagttcaggaatattttatatttttggtggactataggtttcatcagtatgaaatatccaacttttttctttttttacatttttgccttagattggctttcaatgtatagtaatgttctctacatgctttatttttgtagattttatattacatattttttatatatttttatttttcatagtctctgtgttttatttttgatggtttgttatacacagcatttagctttacatttttctagcctaatgtgacagccactgtaacttagttgaggaatataatatccaaataaacatagtttaattttctttttttccttggcttgatcacatttcctttgttttatattttttgctgcttaaaaaaaggtctttttttttctaatggtgcaggaattatacatcttatttcttgtgaaagttattcttgcctttctaactcacatatttcaaattatatatctctattaaagtctaaatctgtttggtgtctgtatctttcctaaaaaagatgacggagagtgttagcacatttttaattactgagtttctccctttgttcctcccctttacctctcatgttgaggttgatatgtttcctttttgacgttttaaattgcatcaacagtcacatagagtctactagcgtttccttgccccatcttgctaatttttgtggaccatgttgttctgggtttttttgggttgatttgtcattatacagttatatatccttatgtaatttttttcagaagtgtgggggtataaattttcagagtctttgcattttctaaattgcctgtagttagctcacctttttgaaggcaagtttggctacatataaaatttgagttttaaagtcttgtatcccctttttctgtcacatttttgttctggcttgccttgcagctctaaatgtagcaccccaattaatcacccgattattgcatcacactccactccagctccatgtatgtattgaccctgggattggagcatcctagatttagctgtttctttgcagtcttcttgattggctgctgctttttggcttgtgatttatttatttttcctctgtagagcaaatccatctacttttatctttaagaataattcaaaattgttattccaccgaagctactcttccttattttctggcactatttggcatgtatatctcttctaaattcacacacacacatacacacacacccagtatcatttatgacatatgaggttagaggaaaagtagaagcttatgtttaatctaccatcccaagccaacccctttatatggaactttacacattctaaatgctttcaaatacagtaccttataaggaaggagatgctattattctccttttataaattagaaaactgagaggttataagtcattttatttatttattctttcatttatttctccattaatccattggctaaatttgcatcatctgctatgtataagcagccctcagtgccagagacacaaaaccccagcttccaggacctcacagctgagagtggaagcaagtgggtaacaatagagacttgtgacaataatttcagcatagggtggatttcagttccatgcatgtttgagacacgtgctaggtgcagaggaacctggggagaggcgtctctatgtcagacttcccagtggaagtgttgaggagtgtttcccagcggaagtgttgtcattgattaaaatccatgctgtaaatgtaggcatgagttgactgctgtgctcttggtatctagtaaagttcctggtccctggttggcacttaaaaaaaaataagtgaatgaacaaacaaagcttccttggctctcaccgaagcactccttttgtactaacatatgtgatagtctccacaggcatgatttctttatttctccaagcatctctttgagtaggtacagtgaatgtctcctgtccacaaatgaaggggccaaggctgtggggagttaagtgtcttgtctaaggaggcttggatcccaggttcctctgactcccgacaggcaagactcctactggccctatggccccctcatccagattattttagcctcttttttcaaactctttcctgccctctgatcatgtttctaccaagaccaagtatcacaaactaatgaagaggtataactggctgcctcctggaggaggtattaagaagcatacagtggccaaagtggaggaggaataaaaatacctccagagacctcaataataccaaaatagctagtcacaccatatatgtctaagctttgatacagcctttctacatgacatgttcatttggaattatattagacattcaggtttgaatcagggcaggtcacttgaaatgtctcaattcaatgcaaaagttataagaaaaataacatttccccccacacaagtatatagcatagtataaaacattctcaaaaactttgtaaaggaaacacattttacagtttaactcatacctacttcacttccttctccctctcctgttctctgttcattatttccctacttactaactggctcttagttaatattttcgtggcctcacccccacacctttttagttggtctcttttttgtgcaaattgattttattcctatctaaggagatgctttcatcctttttttcatgctttgaggcctcattagatcactgcactctaattttgggggggagagttgtcatttgcactatatgtacagtctgagcatcctaaagttcttgttctgagaaaaacatcgccatggtgagcggcccattttgaattaggaggactggctaaggtgctcacttaagctctttgtagttttgttcagtcaattgagtgtttctatgttacatctatctgtctatatgtctgtctatctatctatctatctatctatctatctatctatctatctatctatcatctgtctatctatctacatacctacctacctacctatgtactgagcccaggctggagcagtggtgcaatcagagcttaccgtccccttgacctcccagactcaagtgatcctctcacctcagcctcctaagtagctgggaccacaggtgtgcaccaccatacctggctaattttttttctattttattttctgtagagactgagtcttgctgtgctgcttaggctgctttcaaactcctgggctcaagcgatcctcctgcctcagccccgcaaagtgccgggattacaggcatgagccattgcgcccggccttctctttttaacgtaatattgagattggggtcagactgtgctggttgtgggtaaagctattgcagccttccagctatgaaggcctgccctccacgatgggatggccaggctggtacctgagactagtgttggaggcagtggcagcttccctttgatctattgcagaatgcattttcaaacacacacacacacacacacacaaataaaactctgatgttcactttttaattgaaagctaaaaatgcccagctcctttctgcagattgacaagctgatatttcagcagtagctaaagaacccggtttagtaagctactgaattttgacgtttataaacatttaatgaatacatttttatttatgtcagcttaaaaaatacagctgctgatatctgcgccccccaacaactttttttgtcttaatgccaaaattagaatatttaaatattttaaaatttcctgatgagcacctgtgcaggtgtgagggcagcatgaattcacagggagagtgtatgaagttggttatcttgatgtgcttgtggggaatgtgtatttccttgcaaggactgtcatgtgctacctgatcctctttcatggacctcagccactttcgcctctaacttgaaaaggaaactggcattgtggcacaggggccaaagggacacatttgtagccttgtcctcaaatcaagtgggacttctggttctttctctgaccatctgcttgaccttcagtctggtgtctccaaggagtgtgtctctatggcagtttaaaaaattctgttacactgagaaagagacaaaatgtaaatcttaaaggaatcagtagatttttaaccccactgctggtgttgagaagacagtttgagtcttaatctctttccttaagtttcaaaacatgtaggatttatgttattgacatgtcaaactttttgtacttattcattagggaaggtttcaatacacacaaaaatagagtattataagatgcgctactatgtattcattatccagtttcaacagacgtcaccattttcccagtcttttgttatatagtatccccttcactttatgttcctgaaatattttaaggcaaagccttgacagcatattatttcacctataaatatttcagaagcatctctaacaaataagccccctcctttgttttacatagccatggtgccatatcacagctagcaagactattaggaattcttaatagcattaagaactgacgttcctcagttgtctcacaaatgcctttttacagctggcatgtttgaatcagaatccaaaccaggttcacacgttgcatttgattatcatgactttgaagtcttcttaaaatctacaacatggccagtctccctctttttaaatatttaaactgggtccattttcctgtagaaagcccacattatggatttggcttattgcttctttgtggtgtcatacaccatgttcatctgttctccatacttcctgtaagctgatacttgcatttagggcaagcttgtctaacccatggcccacaggacacatgcggcccaacacaaatttgaaaactttcttaaaacactgtgttttttgtttttttgttttttttaagaagaccaagtttgtttgcagtgtatgaatgtctaggtgaggctgggttaatggggagaatgagactaacataacatctataactctcatgactttttgttattgttgttgtttgttttgtttttggagacagagcctccctctgtcacccaggctggagtgcagtggcgcaatctcagctcactgcaacctccgcctcctgggttcaagtgattctcctgtctcagcctcccaagtagctgggattacaggcacgtgccaccatgctaatttttgtatttttagtagagtcggggtttctccatgttggccaggctggtctcgaattcctgacctcaggtgacccacccgccttggcctcccacagtgctgggattacaggcatgagccaccgcgcccggctgaaaacactatgaggttttttcatgggtaatcttggatatgttatttgcttcattcaagaagtagtatgtggccattcatttctcaagatgcttagattgttcagtgagttcatgtgctgcccaccagatctccctaatacagagttttacattgtctttcacctgtttgttttaggatctattgatgattatttcattggaggttgcaaaatagccataagtaaattggtttaatgaagcttcttctccctactaaatcttatctagagtttaactatctattaatcattcatttttgcacatttttacagcttttgtggggtattttacattctttcttctgtttgaatatagagggtgccttgcaaacttcactcatttcactagaagaggcaactgtttaaatcctactcttctaatatatttcctggttcatgttttcctgcacattcataaatgaggaggacgttgatttgtcagttatcttcagtgcttagaatagttgctgaaatgtgacaagaatgtttatggaagaaattaccttataggttgtacatgtcctctaaagacatcataggcactcctacattgcattggtgaaggggccaccaaacagcagaatcctgcaacttggttgaactatgaaaatgttcttgatacattataatttcctcaacccctttagccagtattggccattcaggcaaaggaatagaatttccaagacttgtactgtatgtttgcagaaggagggaggatggcagataggtttgtgtgtgttgggatggagaaagtatgcaaataagctaattaatatcaattgtttttatatctatattacacatacacacactcgcatacacataagcacacataattaatcacacccatgagcacatgtacacagctggtctacaccagattgccctgacaattttagagctgtgtgctgaaaaattttagaggaatttggctttgaatgtgcaacacgtattacagagcaaagatcaccttgggtcctaagggagatgactttcatctctaccatgtgagtaaaacctgggtgattgaaccataaattattttgggtatatagaactttcttcaaataacacttaaaattaaatgtccaggtaagtgattttcaaatcagaacaaccaaaattgttaatagttatgatcatgcttatatacgtatggaaatgtatatgtatatggaaatatggaaatttgtgtataagcatgctctgcagtaaatcaaaaaatgaccatggagcaaacatatgaaaatgctcaccagcaatgaaaaaaatgaccctatggcaaacaataaagtaaaatgctacactgtcttcctgtagaggacctactaggtttggacaaactggctgtgctcaaatacatgtgccaaaattgagcaggctgggtgcaaatattctaagggaattgaaagacactttttcgtgaaataggtttaggtgttgacattatctctaaaagtaattaaaagatgattgatgtagtaaattttcttttaagccatgcctttaagcacattgtaggaaaaggactgttaaacaccacattttcttatttagaacccttggggccataggtatttcacaatttaagaatcatttgcattttatgaagttaatatggtgtatataacatgtcctgtgtaactctccagtgaagtctgaaacagccgcaatgtatatatagattattatttctatagcaaaacatatgaatagatacacctagtaagacaaaaacaaaaattatagatacgtagatattctcacattagttcaggttttgtcacaaagtacagctttcaaaccttctggaatttttcaattgagggaaagattgtgaaccttcaaatgaacaaataaataaatatctaccttttctgaagaaaaacaaaagccaaataacaaataaatcaagaatcacttttcatggtttttaaacccctcaaataaatgtcttccttctttcagttcatagaagatttagaattataaaataaagaaggcctatccacatggtctatatatgtcttatatatctatatctatatctatatctatatctatatctatatctatatctatatctatatctataaacaattttagaattagctcgtcccacacaaaaatagtttttttgttgttgttgttttttgttttgctttttttgggatggagttttgctcttgttgtccaggctggagtgcaatggcactatctcagctcagtgcaacctctgccttccgagttcaagcgattctcctgcctcaccctcctcagtagctggaataacaggcgtgcatcattaatttttttatatttttagtagagatggggtttcactatgttggccaggctggtcttgaactcctgacctcaggtggtccactcaccttggcctcccaaagtgctgggatcataggcatgagccactgtgcccagccaaaactttagatttttatcctgtttgtgcctcaaagcctattcagttgaaaggctgatgggctcgctctgaggtccattgttggctgggggagagcattagggagctgacttttggcagatgaggaaaacagcatgatcactgcttttgccactctgctttgtggaattgacccactctgaagttgttctcactcgacagcaatgcaggcatttatccagtgcttctacaagaaataatttgggcaaaagcagtaaggaagtaagccttaacagaaaagtgggacccagcaataggagaatctacacatctgctaagcccagccatcatatatatatgtgtgtgtgtgtgtatatatatatatatatacacacacatatatatacacacacacacacacatatatatacacacacacacacacacatatatatatatatatatatatatatatatatatattttggagatggagtctcacactgttgcctaggctgaagtgcagtggcatgatctcggctcactgcaacctccacctcccgagttcaagcaattctcctccctcagcctcttgagtaggtggcactacaggtgcatgccaccacaccgttaattttttgtatttttagtagagacagagtttcaccgtattaggatggtctcgatctcctgaccttgtgatctgcctgcctcagttcccaaagtgctgggattagaggcatgagccaccatgcccagcccttatatatttttaatgtgcattagtaaattataaataatgacagtctccatgtggaaaatgaaaatcaacttagcttatacatttttaaaaatcagtcaagtggtcttgtctcatatacatagaccttgaaagatttgttttcagtacattctgtagaaggctcttgaatatctgatagactcccctggcagctttcacctggtgtgtgcatgcacagatataatcaccttagtctttatcctgcagtaaacaaagttcaagagagatttctgaaatgaagataatcttcattctgccttttgccgctacctaaagttcccttggaggactctgtgaagttactcaggttatattttttataacaaatataaaccacagaatttgccagaatgagaaatattctgatgaacatcatgatttgactgaggatggaggaattgtagggaatggttaaacttgaagatactttttagaaaaacaggtcatgtgctacagaagctacttttaaaaacatgctttttcattaaatgtaaatttaccacattattttatatatcttcattaatttaataaaactcctgctaggcttttgtaaattttcacagatataatgttaccataggcatctatgcacatgtatttttgtacacttgtccaatattatccatagagttaaaatttttaacttgaaacttctaagtcagaaggcatatgcttttaatattctgcagtacattttaacttgccttccagaaagtttataccagattacattcccattagctatatatgaaagtgaacttcctcactggcagttgaaaatttgtcttattttaatttgccagatagcttgtcatatatttattgccaaatttcaaattcattccttttataaaggaatggttcatgttcttccccagtctatttagttttattcttattacaatgtaagagcttttcatttattaggagtatcttctcattaaatatttgttaagaaagatttttgttcaactttgtatggtttggataatgttttcatttatttttatttatttatttatttatttagagacagagtgtcgctctgtttcccaggctggagtgcagtggcaagatcttggttcactgcaaacttcgcctcccaggttcaggcgattcttctgcctcagcctctctaatagctgggattacaggtgtgcactaccacgcctggttaatttttgtatttttagtagagacatggggtttcgccgtgttggccaggatggtcttcaactcctaacctcaaatgatccacctgcctcggcctcccaaagtgctgagattacaggcatgagctactacgcccagctgggtaatgttttgaaaaacgagtatgtagtctgggtcccaatatgttctaatttttctagctctaatgtcatagctaacaaaggccatctctacttaattgcttgtactttattctcaggcttttatgttttaacctttgcatttaaacatattttagtatgaagtgtgaagcaaaaacgtaaatttttccccttaaatgctaaacaaactttagttaccatttattgaataatttatcattttctcattgatttttttttcaatgacagcctcgccataaatctttctgtaatatttcctgatctggcagcagccgcacattgctttaatttactttgtttaaaatgtatatattctcaacttacatctttgtaaaaattttcttaactattatcatgcattaatattccagataagctttagaatttgtgtcttctctaccctatccatttttctctctttggaatttgtttgaatttgcattaaagtctcctttaattttgagtcatccaatcacatttatgcaaatactttcctgggaaatatttgtgtgaaaagattttcttttaaaaattgatatacaagattatttcggtcttttagaagtgtttatactgctgaatcctttcatgatttttgttaaactggcttgtgaactagttcagcaagtcagtgtcgtatgctgaatatctaaatatatttataatgagaaatataagaaaacataataagaatatttctgtcttacatccgtggagagaaaatagaatatttataaatgcaaatgctctacaattactctaaggaaacttaaagatcacagtcctattctaactctgtaaagttatttgcttgtttgttattttaacagcatctttctcataagcatttaaggctggttataatgttttgtgtgtgaatattgagtaaaccaaatgattggaggcccgttatttttacaaagattttatggaataagcaagttcggaatggatttcgaaaaagagacagtccctgtttcagtgtggaagggacattggagtccaaaggtcagggtcagatacatgttttcttctttttttttttccttccttccttccttccttccttccttccttccttccttctttccttccttccttccttccttccttccttccttccttccttccttccttcctcttttttttttgtttttgtttttggagacaaagtctcattctgttgcccaggctggagtgcagtggtgcgatcataactcaccgcagcctccaactcctgaactcttgggctcaagtgattctcccaccttggcctctgaaaatgctgggattacaggcatgagccattacacctggccattttcttttgactagagctgaagttctgaaactagcagtcattggagataagacaggagaagacagttgggaggctccaagcatgtgatttcaggaaaagcatgagttgattattgagaatttcagatgtgagatttccaggaacagtgtgagtccagaagatgtaagaaagatcagtggaattcacacagtttggttattcatgcatcttcgaatatttttcagataatctcgggtggatacttcagttatttctgcctcagcccaccttatttgtaaagcagtattagtagaatcccctccttgaggggttcttcatattaaataagttgcatagccaacagcctgaggcataccaaacactgtatagatatttgctgttatttgtatgattgctgccttttactgagtggcatcctgggctggtgcttgggactcaacagtgaggacattccctcccacatctgcctgtaatgccaaggccttgtgatagggagtggcctgaagcccggggtagaggagtggacctccccagcatagctggggaaggagtctcaaggagatgacatttgaccagtcctcatggttgtttgcaagtggcttctctgctgtggaatgggaagaaagggtcttccaggaagaggggttagcctttgtaaaagtgcagagaaacgtttgtatgagcaagagagtaattagggaaccgtgagcaattccatgtgactctgactataggtaggctgcagggaagggaagagacagatgaggactgtcttcctagtgcctagaacagtggctggcccatagtaggtattcggtgcatcttagtggagaaatgtgtgaaagaggaaagagagggctgggaggtagactactactagattggctatgggtggagctgggggctcagcattttcaagctctgaagtttggtctccttgaaggaacaggagcagctctggattttagaaggccaattctgtccacagtgcaccagtgttctaggtgaggttggatgatggggagagggaagtctgaagatagcatccataaatctcatgacatttctatcccagcagtgcaatcaaatgttgagaatatgtcctgtagctttcttttagaaaaggggttagcaggccaggtgtggtggctcaggcctgtaatcccagcactttgggaggccagcgcgggtggatcacgaggtcaagagattgaaatcatcatggccaacatggtgaaaccctatctcaactaaaaatacaaaaattagctgggcatggtggcatgcacctgtagcccagctactcgggaggctgaggcaggagagtcgcttgaacctgggagttggaggttgcagtgagccaagattgcgccactgcactccagcctggtggcagagtgagacttctctcaaaaaaaaaaaaaaaagggtggggggcgggcaaattatggcttaaggccaaatccaaccaacagcttctttttataaataaaattttactggaacactgtctgacctgtttatttacatattatgtatggttgatttagcgtaacaatggcagagttgggtgttttcaacagagaccacatggccagcaatgactaaaatattttctatctggtccttcaagaaaaatgtttggtgacctcagtgttagaagattgtttttaggtatttaatggtgccattctggaaaagttggcattgttggaagagttcaaattgatgcatgtgtagcctaagaaaaatggggccatatcacttcctatgaagaaacacaccaaaattttaattcaattcttaagttgttgtcttgattatctaagttctgtctctagtctcctatggctatttttgtggctttgaccctagctgacccagcctattgtcagtagttaagaaggtagattccaagtgctcaatgtcatgttaagacttccttgctacctactaagggaagtcatttttttagccagctgttttaagttctcctaacctatttcatatgctatgttcccacaataaccattcccttctcttgccatttctttgtcctctctcctgcaatgtttcttctactgaaagaatacggcactactgaatctgtttctcctgggcagggcttgcattatcccacctgttccaaattctttttagaaccgggccctttgggtgaatgatgaaccatttaatagccccatgtactatagaaatttaaccattttcaaccaaacctgtcatagataagaacaaaggtaagccatcatgtgtctagaaaaacatacaactgatttcctcacagacattacaagttcttactcttcaaatgtactttaaaggactgagagtgtaattaggaatcagcagaagttttgtggaaaagaggcattgagccttttgcatattaaggatcaaattttatgttttgtatgaagcattcatgaggtgatgttcttaaaaaccactccagaggcacaggaggaacgctgaggacaagactgaatatagagatggaggaattacgtgtctactgggtagagatggagaaggcatatttatactagggatggttgaaatcatgcaagcatcttccatagctaataaattattttatccagttggcctttactgagggcatactgtgtaccggggcccaccctgttggatgccaggaatacaaagatgatcagagttcactttctgcgcttgaggatcccacagattagaaaggaggaaaaagagttactttccatacaaggctataaatgttacaacagttgaatttttcagatgaagtggaaggaaacgtctagaaggaagaggactgaaatgaaagaagactgggggaaaagaaataataataaacaaaaagaaaaataatttgaaactttttagagaagatgattgaccccattgtggagatcaagattaaagatgaatggcaggcagctgtggagagcagaggtggagatattgggaggatcagactaaagaactgaaatttcagttgtccaagcgggcatgctgttctacagcctcacatgtcttgggcctattagaaatatatataatctatctatgcatgacttatataccatacatcacatcatttcttccaaacttacattataatataacacattctgtattagtatatagtaagattttaaaatgtacaacatatttaaatatactccttacaattaagcctcagtaagtgctaggaactttgctaagcactttgtattatctaactgaattcttaccatgggtaggcactcttatacaacatttcccaggcaaggagttttgcccaccaaggttagacagattgtccaggattatccagggggtaagtggcactcacaccagggcttgtctgaccctacttaattagatgggctcctatgaagtaaattttaggataagctcttgacttaaaaatgagccttctaatggttgtgggagagggagaaaaaacaagtttacagaagatagcgggtgagtgtggagcagagaactagcataggctttgaagtcaagcctaactgaattcccagcttggctccactgcttgccagccacatggcattggtcaggtcacataaccactctgaatgtccccatctgtacattggggtttgtagcatctgccttgttagcatgtaaaggatctgcacctgtgcctggcacttagcagacactgtgacttgtagctgctgctgctcctgctatacctaccgtccttgccactcttcttatattcacatccacccatcctcctcctcatactactattactacctatgctaatactatggtggttatgatgagcagcagtagtagttggaatgcctcaaagataagatttatgctaaaaaacagaagcacagtagttatttaagacctcgatttgatcaatagcattagttctgcatttacttcaatatttagtgagcatgtgccatggcaggtctctgcgccaggcactgtagaaagttaaaacatgaagaagtcatttcctcttttagctgccatatcctctagtttgacctttacgccatatactcttggtcagatattcaagaaagaatcttgggagggaaagagttagtgctcatcgagtgcagactggcttgaagctgtgcatagctttggaaggaatgtcaggacttaaataatttcaggatgagttgaagattacattgagcatttactacttctccagataatctcaatttccgcccatcatgtgatggaggtgtcaccttatttacaggttcagattgttagcgggacactttgttatagtgatatcttacagagttggccattaggctataattgagcctttatgtggggtgctgggtaggccacatgaccctggttcctgtttccagggaggccaacctacataaaaatggctgtcatatatcgttgctcagaggggcagatatttacaacaaccttgaaatggaacttccacccaatatgatgaagactgacttgtgacagtttgatatgcctttattttgctaaaatagcaacctggccaaatatatttttcagcacatttattatagctacttgtttatatttatagcaaaagtgttgctaattccctagtatgttaacaggtcatattcaaattgttctatttttactttggcacaaaattgctgaaggaaacatttttaaggcaagtagtgattatagcatatcaactcactacatagtgaattatatattaaatgaacttcctgaactgagaaggagcttaaactgacaaagaagatagttttcttaaattctgtattgtttacataagatttcttcaaatccattttttattataggttactgattgtctcaatgttttctttttgctaaatttctaccttcccgccaacaaatataatcccccttttaatatataatagatgacctgggattccagaatggattttcagaaaccatcaaaaaacctcctcgctttagtgtatacaataaataatatattcttttttaaaaatatgagagtcaaataggtatatgcgtaaacctggccaacccttgggcagttgtaatttccataccaaaatgcatgagtctttacttgactgttactctgttatacattaagtactagttaccatggcaacctttgcatcacattatgacatttaaatataaggtggtgtgtttccttataaggaaagacaatgtatttgaatttttgagtgtttggtgaaatacaatcactactaaaataaataattttgtttaaggcaattgatttctttgggaattacgtacatttccaaccaaacctatggagtgcattcatttatttttatttttttgtgatgtcatggagaagtaaaagattttttttaaaacaacgcttgataagtataacataataattcattaaatgcctataattaccctcgtaagtggcaaaacacaaaattgaaccatatttgaggttatttatcagtgaccaatactgtagcaagagttcgaatgtaacatcacaagatttatgaaattctatcgcatataacacatttcttatttttgtatatctagttggttaactgtaactagttttgatcttacctatagttgaattaacagtagcagtttgctcatgcgtgcaaaagcaaaattaaaggagccactgaactcatccttgtggcatttccaggaacatggccacttaaatttaattatgaagattgttgggcaatttctttattaaatatggaaaaaacctagtcatttcttgttgccagtgtagctctaggccataaggctatcatctttgttatgtagactcccatatataactcatttttaactttttatagtaacttttccaaattattatcacagcttgtactttttaatctgaaaatagagaatctaatgatcactcataacttttggtgcatcttttcaataataatcagtggattgtaatatgggactgttttgtgtgggacataagaaagaggtaagctctgtgctggaccctggctctgcggaacattttacatatgttgtttcatctattcctgataaccctatgatagagctcttattagtccctttttacacgggaagaaagtatggtttagagcagttgcataactcacccccaaatacattgtctgtatttctttgagctaaggttcaaccagattggtctgaccttaaagccctccctctttccttaatagatttgacttctacttctgacttgttacagacacaatgtgcatgatatgtttaatgtagaaataaaaaacactgacaaaaaacctttaaaaatgtttgctaaataataatttcagtaatttgtatttctctgcagcacagcagttttttaagtccctgatttgcaagatatcttggtctttgtaagttacccaagtcctcttttgttgaaaccaagcataggacagaaataaaaataaattataaaggtgtactcttggaccttcaggaatcaggaaagaagactgtccaaagactgaccttcaattttgagctttgaagttcaaaagtggacaggtggaaatactgtgttcttcattgccctttggtgcgagatatattctaggttgcagagtaagtgccaacagcagcaaaattatcgcccccctcctgctactgtagtaagtcagcaatggcccttctgtggtcagaatggcacattcagcagcaactattcgacagggatttacagaaacttccccatggctgttaggaatcttattcagcagtgtctttgaaaacccgattctgtgcagaattagctatgtagaaatgacctaggttgtgataaaaggtattttaaacaaatctaacttgtaatttcactcaatgtgtattttgcatttaatgccacaaagtctggtagatacctacacatatattttgcattcataagttttatagtggttcagaatttttttccatattaacattttaaaaaatcctggctttatagagtcagttcaccatacaaagccactatacatcacttaggtttgtgatgaaagaatggaattgcagctgtgtgagtactagaatacccaaacatgaattagactcacaagcatttggcaatagttcagaaaaagagcttaatctggtttcatctgagactgcttttctctgttctgcaacatccccccaagatgttgtgtctgataccggatcacaacgtaatgggagtgacgcagaatcgagaaagccctgagaaaccaggggcacatttgcttttctccagagattttctttctcctacttcttttttcccctcttccagtttccaactctgaaattcaaggtcattcacctattagatgcattaattataagccaaaaaagcagtattcatcgtactctgatctcagtcatatctataattaagtgtaaatataatcttcctttttagaaatgtaccacccacccattacatttaaagtgctgactgaaatgaaataatagttcagagcaagatgattttagtttaactagaaaaaagttgataatttaagcttcaagcagtgagttctatttttgattaccattcagttataaatctaatttgagatatatgctgcttttctgttactcaagtttaattcatggtttgctttcttggttgtataagcaaagttcagtggttgatcaaggctgttaagaagctcccctgaaaaggaatgggggcagggttgagaatgtgttcgaaagacattctgagacctatatctgatgtaaaacaaacaaatccgatgtaaaacaaacaacaaaattttaattgaaaaagacactcacagagtgctgtatttggggatttgaatggccaagttaggaatggccatttgcaggggaattggctgcagagggtgaaccccaaaacattccaacctggttgataaagtcagtgtgttttattctttggttacagtattttaggtcttttgggaaaaaaaattaggagcgagtaaggggaagggcttgtctcatcacactgtggacagttaagcaaaatgctaaactatgggtttaagatttacaggttagctctgccagatgccacatctgcctccagtgtttcctggcagattcgggcagcctactactgggacccagcataaccgcagaacatgagcttgcacaatgtgaaaaacctaaaaccattataatcctatttaaggccaggatgaatttgcccattttgaaagtagatgtagttttcaagcttaacttttattaagcagaaacttgtcttcagagctatatctatatatgcaggtaaattcataatataaacaaataccttatccattttgtgcaaaatttaatttactttaaatcaaacgccattcactttttaaaattcataaactcaggtttttcagccagtggaaaatttatctttctcattgctacagagagttaagtatctgacgtaaaggccagacaatagtaaatggtcattgttcgctttataagtatactctacaataagaacacatatatttttatcttcattttccctaaggaggtgtttagggcccccttaaatgtgaggaaatgtttatttttgttgctttagaagaatgattctattgtccaagtgagaaagaaataggaacaaacaggtctaaggagaaagaaacaggaatgtgctttgtgaaaaaaataaagattaacaggaaccactaaaggtttgtaagtgctatctggtcctagtgctatgttactgcacatagtccttgcgcctgcatatgtaagagttggatgcgtgatttattatgactggcccatgaaattattttcttttaagttaacaacaataaggtcaaccacagcctgtagctgttttgtagttattttatatttttcacagctctattgtgaatgctgctaaaagacagtatagcaagtgtgtgtttttaggttgaccccttgaatgcatttaatttcttgagagtgaaaacctttgccaccaggaccaagaggaattaaccaatggttaaactcatttaaaaacacaagcaagcatttcaacatatttgcttagccgttttctgaatatttaatatacttctagagaaagaaaaatgaagaaataggggtgatttgtgtctagaatacaaagttattttcaaactcctctttccaatgaaatgaagactcattcgtagatttaccaaactgtaaggaggttgtgatttcaaatcattcacagctttattgatggaaatttcaaagaaaacttggacacagacttcactgtaactttctttgttaataagaaatgcgaagagtgaaatttaggttgagattcaaaaacttttgaatgccactcctaaatgataaattatttgttactagatttctgatttatgcaaaactttattataataagccttatgttttagtttgtcattgtgtagtgttttaatatgtctcataagttcaaaagaggcaatagttgagcatgcagatgtcagatttttatctgataaatctggttttatcaggtatttatgtggtaaacattaagatactagcaatgagtttattactcaaaatgtgctttcaatctgaaatctcatccttgaagttgtattttgaagtaatgtttattacatatctcttgaaaaagtcttaaactggaatcagtaaaggcgagcttgtcagtagctgattagtcctttatatatgactcatccaacactcagaaaaaccccttggaatagagaggttctctttatgatatttagctatatggcggtggaaaggggaggtttgaatttttgattttccagcttatgggtcatatttgaccaactgctttcactagaagacatgccactttgttgagctatttaggaatcaaaaagactgtcttaatttaaaacaaggaccctttgttttagttggtgactgccttgtgaaatttttcagttctcagcgggttaaccagggaacaggggcagagtcataattggcctatttagagtattttgcatgtgaatagtgtgttagtgaagcatccctaagtctgttgtgagtgacatggtgattagaatttagattagggaaaacacattctgtactttatcaaggacagtaattagttcagtcagtaaaagttgattacaagtaacgataaagttagatttttagtacttaattttaaaatttctttattaaatagtaaatttgttcttaatataaatggtactatctactcttgttttattgcatatcagaataattaaaagaacaatgtgttcaatgcagagtataatcaagcgatttatatattatgggtaagtttctatgtagtttttagaaaatgtaatattatataatctttctgatgtcatcatttttagaagtttaataattgtcacactgtgataggttattgtggaagttttctagtgttcaggtaaatgtttaatctgtgggatgtgtcttagcttccgatagacctcaagagggcattctgaagtcctttgtggctgttagcttggaatatctgctatttctgtaattttgagagttagtgtgaggatttgaatttcctcttggttcagttggcattttctcttctgtgggtgctatgtcagttcgtggagaatcatgatatgcggtacagagaggcagggttctcagtcgagttcataggctacacttacccccagtgtatgcagccaggggaagttgtgtgcgttcacaaaatgaggttcttcttgttaaggaaggggatgaatagttcccagatatgagcctcagtctagagaaaggaaacattagtcttatataaatgccatttgttttgtgaaatgaaaacgtgagtcatcttaaaagacttaaaaaaatattgtttaaagggaatcatctactttcctcctaaaagtaaagaattaaaaattcacaaactttgtgatagcttcttagactgcctttcttttgggtttttgttttgttttaattgtctcagcttagcagatgctgtttgctttattgcattggtttaagtactaacaatcagttgggaggtggtgaaagtaaaaaattaaccttatatgtttgttttccctttttaaccttttagcagagtctccttggaggtgacatggatatgggcaacccaggaaccctttcgcccaccaaacctggttcccagtactatcagtattctagcaataatccccgaaggaggcctcttcacagtagtgccatgggtaaggtattcctttgtttgaatgcctgagggatgattatgcctttttctttttttctttctttctttaaaatatcgcccccccatcctacctcccaccccaagaaaaccataaaatttggctcagttgtcagcctggagacttcccccctagtacactgagtaggtacgttaacagcttatggtagcagaacttttttggtgtctgcttatgtctagttttctcttagctgcacccataaggaagctattaaaagatcaaagtagcaaaaagttaaatatcttcatttttatgaacaaagcagaatttgatttctgctagaatcgaatgtgatcgtggtaactacagtttgctaaggtaatgatttaaggaaatgtggtatcatctagaagtctttgtggtttaacctatcttagttaggaaaatgggcatttgggagctgaaagcatcttcattttctttcagaggtacagacaaagaaagttcgaaaagttcctccaggtttgccatcttcagtaagtactgcttgtttctgctttgtatattgcttattttgttctgttttgtattgatgggaaggagatagaagtaaatgagtttccatgcgcccagagcagcacgtttatctagaaggtggatgaggtagaaatgacctgcacatccagccacctgacccacattggagtgattaattgcacatcctggaagactgggtggttatgttgatattcagcaggttaagctctaaagagagccttgaaaaggtgcctgaagtttgaggagttttacctgtacagggcttgcaagagaatgagtattagtttcatgtgttggttaaattctttgtcagtattatgatgatttatggatttgcatgcgaaaggagatttgtggagaggatttaggaaaaatttacatgggtttcagcccagagtgcaggaagaatgtctctattttctggagaggttgctgaataaaggctgcaaaggtagctgcatcagtagccatttgtgtctttactaccaggtgacaactagaagtagtcagctgtaaccaagagcattctgggtctttttaacagctggagctctatgcagaagttgctgatatcccccacccacccccaggtccctagtacagcaaaagttggttgtgatcacaactcaatacatgatatcatattttgaattcttacgttcctagataattgtatttaattttatttaggactagtccatttctagtaattttctcctcatataaaatgaaaacatagtttcctctcttctttctttgtttctttatccttcctcctttttttcattcttccttgctgtgatataaagttttgatttaattctgtagagtactagtattctttgaaaagaatgctgagacttattgtttttatactttaatataaaatcatatttagatttcttaaagtatattaccaatcaatgcttgcatattagtttcatttcatttttaatgtattagaagaataataggtcttgcaaatgtgctaagattagattaacccaaacacctgtgtatttgacttgatttcagttcagctcatccaaacaattattaaatgaatatatcagaataagtcttatcaggaaaaagagtaaattttgtatgctgattatcatagagttggtgatgttgaagaagcatcacaaaattattcataaatatagaaaaatattgtgtaaataagattgccaatggtgtatagtcactttcaactagcaataagtcacttaaaattgtactcagttgtttattgtttgaatttctgtgttgtattgaaattgactaatatgcccaaaggattttataagcatattttaagcttgaagttaggggtggatttaatgttgatgaaactttagcttttaataggttttatgacaacttcaaatgatacagtcctaacagctgtttacattttaaacatgcctgaacttaatatggacaatattaaatgcatttggtggacctttgaatgttctgaaacaatggaataactgtcctataaaagccataaaaaacttaaagctatcataccctccttatgcttcatattcaaattaacttgttttatccaatgctaagattaggcagaaatctagacaatttctaaggagtgcattggtgtggcattggatggtatgtatctgcttaatcactgtcaacaacaattttcataattcgttgtaaatgtttaagtatttccctatagctaactggcccctttagaaaattttactggtacagtgttttctttgctgttaagacaatttaggtgttgctgctatgtcgtgatacattcagaaatataaaaataattttcctttctttcccaataaacaaaacttgggaattaggaatttagttttattctatttaattttctgtttttagtggtcagtttaggatttactcttcttagaagatttatcttgactaaatgttttcatggtccttatgaaacattttgatgaatagccttttttctgaaatataaggaggaagaaaatacaattcaaaatgaaatttttattgcaattttttgagcaagaagaacaagtttaggtaattttataatttaatcatccatttactcattacctaaaaaaatcccagctctattttcatagcaatttaacttagtttatgtaagctttgttgtaaatatcaattgcttattacttacaacaagatccacatggcttaccaccacacaaaatatttattttaacttgattccaaaaaaggtctgcagtagacatggtcacacttttctagtagcagatctgtatttctatatttttagacctctgccatgctttttttaaagctcaaataaaattatgactatttgataagagatacttcttaaattgtttcagtatgtatgagtatttgtataacagatactaaaagattggagataataaaaggtttcctttggagtgattatgactacataagacacttatatgttttctttgatacatatttaccatgacaaatagtaataaatctgtcacaatctgttgtggcaactcactttaccccccattttgaagtgggccctctctttcccttataataaaaggaagaaaacttaaacggtgacactgcatcatcaggtattatttgtgacacgcctgtggtacagagactggacttctgccgccattaggctgggtcttcctcccaggcaatcaggagagagaggggattgcctagccctgttttgaaaacactgcagcatctgtgggagagagaaaacgtaggcctggccagacatcatgccatggatctggcaggatccacgaatgtgtgtttgtactgtgtgctgcacctagagacctcacgtcactgtggaagtatgacacgatggtgggataacagaagacccaccaggcagggtctacaggacaagcacagcgtgtcggggggaagcctgtccctctagtgcacatagaccagtacttgctaaggtgattttttttttaaaggaaagcctgtgtgaaagacagctatctaattgcccacgagagctctgcttattactgcagtacatttttatcttctcggttcgtattttagtatgttgctctttttagtcacgtcccaatttctcgtagccctcgttttttgcgaagaccttagtaataaagtgttgtcttttgttgatgtcagaatttattttgcatgtctaagctcttgaatctacatgagaacatcttgttttgctagatttctacattttggttttccatttcaaaccatatttcatcttaaactcaatattttgcaactttactgctcatttcaacaaatttgttttatataacctaataatcatacacattgaatcatgaattcatacacagaaaaatgtactatagtaaattaaagttggaaaaaaatgatttatgattcttaacagaaattaacatgaaagtactaaaatctagaaagtagcaaaaaattttatattgtgctgttttaagatactttcatcaaacacagaaacaaagcaaaggcattatcttttggaaactttattctgcccatcaacatgtaaacatgtaaaacttttatcttagaatttgaaatatttcaaaattatatacgttttatcagaaactgttaacaactacaaactttctacttcagactttggtggaatttgtctccacttgtaatccgatttgcatctttaatgatggtctcaccatgaccccagttggaatctcttgaacatcagatttttctggaaataggatattttatccttagaaatagtttatgacctctcatctccagtgatctttcctaaagctgtacttctcagtaaagtcttttttctacgttaaagtacagaggggttttgtgtgtctgttttgttttaaaactcaggaggacctggcaaactttaagtggtcagagataatttgggacacatggatcccaagataaacaatttctactactataaagattctaaaataaggtttggacgcttcaagaatatttgtgacattagttaatcagtaggtaggtttgaaaaataaaaacaatgtgtattagatattaggttcaccaattttcataaggaaagaattcttaaataaaatgaaatatttaagtatggattagagtttcctttacagaagcaattattaggggtatcaagaaaaatgagtaatgctaatggccttaaatgtcctatgtattttgtgttatataaaaactttcctatttgaagatttcaaacatgatgttgaatccatatcttgagctatttagggaaaaccccttttatcccaggtgcttgaagaaatcacaaacaatttaaaagagatattggtaaactgttttttccttattagtgggctggaaattatgtatgatttaaaaaatcagtactgaactcagaaatatataatttcctacatcacttttgaaattgatcatagggaaatcagaacgatgctttttcatgtcaacaaattttaacaagtaataatacaattttctttaagatgaaagttttattgaaatatgatatcgatcacaagtgaacgaaatatcagccatctgggctctatcctttttaggaaagtctggaagtagccgattgtgtggtaagacgtaaaaggaggaaactcttcaaggttcatccctgcagggatagatactttgtgaagaagtataattgttaagtgtttaaaatattaagatagctctcagtattcacttttaaacttagtgtgcccattttctaattaaagatattggaatatgaggtttggatattaaaattgtgcttattaatgtttaggcaagaaggaggttaagagtggcacaattaagtcatctcaaataggacaaaactattcacacaatttacacggcatatataacatgacaatggggaacagtgaaagctgagaaaatattcatgacagagaaagtatttttgtgtgtgtgcagttaatgctgaatttgctaaaccagacttctagttcagcatgtgcgtttttttttttttgtgaaaaccaatcttatcttctctattacacattgagactatagagtttatgatttttatgaattgctgatatatgaaaaaatataggagaatctttatatttgttttgattggaggcttttgttccattaaaaatttttcagaaagcacacaagaggcttgcacatactcaacatacatactattaggcattctaatatcccagaagtttgctcaaggatttctgaatttttgtttggaattttggaataatgagctccttcatccactatcctcctcttctctgccttgaagcccaatcctgcaccctttaagaaagaaggcttctggtgtgcatattttagatagaaagagagaagaaatataaaggaaaagacaagcatgaaggttaactgtggatgaaaggtttgtgtatttttgagctattcctgctttatctttacaaacaaaaaggttgtatgccccaaacactcaaacaaaacaccaccagttcattccttcccccagaaagaagccttcctggccagcagcaccccatttttctactcagtgatctcttctaaggagtggtgcctgatgtatcttcctactctccaatgtgtttttatttttaatcaagtattcaaaatagtattttgcatgctaagatttatcaggactttcgttaagatgttagcagctgctaacataaacaataatagcatttagtgtaaaactggacttgttgagaaaagagaaatacatttctgggaactgctattttgaactttatcattttcactgaagagtatattttggtgtgaagttttggactcgagagtggtttaaattactgagaagtgtaggaaaccactgcagggctgctttacccagagagaattataacagggcttgcatgtattttgaaaataaaacctttttctatggcatccagcttaactgtgaatttatatttacgaaataatgtagataaatgccttgataatttgattgaataccattttttaacttttaaaatttaattgattgaaatagttttatttgctaacatagcaaaatgttctccttttttccagatcactgacaatttctgcattttctatgttttcttggttttgaataattctaaaggttttcattgaaagtaatgaatcaggaattggagggctaaataagattctcttagaagatgtggcagtaatcctaaaagaataaggagtctcttcaagaattgtcaaagttgtattttcttaaggcagaatccatacttgtcaggctgttgacagacacttgctttgtcttggcttttgtttgattttttacataactgcactggattattaaactgaacataaaattgcacctcaaagcaatagcacaggattttcagccttgatcaatttctactatccccggatgtgtgtgtgcacgcgtgtgtgtgtgcacccatgtgtatgagtgtgcttcttttaaaggaataggagcttttatacaatgtggtgcaaaacttatagttttaaatacttaattattttatctggaaacagcagcatgtgagtgattcttttttaagttgcagctgctgcataggtgtagagctatttgaggagtttgatgctttacttgagcatatactccctcttcagagaagttaaggtagtgcagaagtttctgcattttgtaaaatttcagggttgaaaataaagatgctttatgatttggtgagatggatagatttcacttctgaaagaatgtgcaagttgtattttgaaaggaacattttaagaattctacttaagtggtttagtgacacccactcttgtctcttgtctgactttgtcatctgaggaattaatcataaataagccactagggatgaaacttgatatataagtgcttacttccagagtaataagaagaggaactgtgtgtgtgttaaatttcactaaatttattttgattattccgtagagcaggaaataggaacatttcgtagtgaagctctcttcatagcaaactgtaaagaaaatttctcagtgtgttgccatatgttggcagtgattaaagggcatttcctttgtgaaacatggagccatattagaaagacttatattttctcataaaaatgacctttgcaagtacatttaatcatgaaaactggtgtcattcgtcacatacacatacaaaaagtgtcactgttaccattagggattttaggaaaatgctactttggaacaattattttgatggcatctgagaaagaatacctaagtgtctacaggagcctcctccctccatggcccatatcattctaaatatgcctcctgaattacgcttataataatattgtaatgtctttcattctaccgattggcacagtatatcattatatcattagctgctatgagaaagcagtttcaagtaggtggcagattcttagcattaatgttttcaagtaaccctgtttggagaattgggttgtttcacaggtgctcaggtacattaacacagtacaataatattttctggcttgctttttatgaaacgaacttgaagtacaaaataatttaataacaagtggagtataaaaactggagctctagcttaagaaagtttaataactcaagacgttaaaggataagaaaaaaattgtctaaggaggcagcagtgtttagctcattttgcgttactactaaagctgaaatttattaggagaatgtttatggcctgattatttagacttgttgagttagtttaaattttttaaacgatttggtcaagtagaaaagcacagttctgtatctattgtactatttgaaagtattgttacataaaataaattcgaaattctgccatttaatactcaggcatatgattcaggagtgaaattgcattgccagaaccttggggtccctcatgtatcttaatatgaattttatttttagaggtgtataagacattggcacatataatctgtggcttaattgataacagcaaagaaaatggaattaaaaatatttattattaacagatacagttgggattacaaaattcaaactgcagtcagtaattattttacaaataaatgctatttcattttccctttagtaaatatatcagtaacttcacccaatattgatgtaagtgaaacccgacagtaacaagctgggagtgcccaggtagaaggggaaaaaagcatgttcatttattcattcattcctttctccgtttatacttattcaaagagtatttttcattgcagctaaaaactagacacaccatgtaacatggaacatgtctttttcttctatgtattcttatttaaatcgtggagcttttcaactgagattcttcacgtttaatgaaatttgcagtcttgtgtcacttgcgtcacaatttgtaggaataaccttagcattttaaagagtataccgtgtagccttttgagaaagtcatgcatttgaaaaataaaataacccacaaagtgtaacacatggacttttgtcccttaagctgattgcccttactcacttgtcaccacctttacgagagtgagggatatgttttagatacatttttttttgtcctatagaaaccagactcactgctttacttatgcgtattactctgaaatatatttccagtgaatgaatatagtagtaaaagtggtgtagcaaggtagaaaaaacactgcactagacataaaaagacctttcaagtataacgtctgacagcctctacttacacacccagtggccttggttaggtcacaaacctgcttctctgtctacaaagcaggtataaaatagtgcctgcataataaggtggtgtcaatatactgataacaaacctttatcaaagtacttattccatgccagagtacttattccatgttctaagtggtacactattacatcatttgcatctattgaatcatttattcctataaaaatcctgtgagatgggtactactgtttattcaagagacttaaaaatgagacacagagaggtgaagaaacatgtctgcggtcacacatagtaagtggcagagctgggagtgagacctgggcagcctgtctctaaagtttctgtgttcttaaccatagtgctgtctatgctgcctagcgtttcagacactctgtagaccaaaaagctctctacagcaaggttgtcattaagttagcaagtatttgactatctacaataaattaatattcagaaatttcatttcactgtagagtgatcatcagtatctctgtatagtcatgtcctataacttttgcccaagcaaatcagtatgccaggcagtccaggggagcatctgtgtaaacaaagacagtataatatagtggttagagtatgaaatctgatcaactgggtttttagggggctatgtcacttcctagctacacagttatttgtaaaataagtactcattggggtttgaatgcatttatgtaatatccttgaatgttacatactattgttacacataataaaaagcactgtcatgctattatcagtaacaaggtaactacctttcatttggcatttgagaaacaaatctaacatggcagcctacttaggagtagttagcagtagaatagaaactaagaccagggtctcagctatgttcaaaagaattttacctaacagaggtcacttgctttttctgaaattatgtaatattgcttttttttttttttttttttgagatggggtcttgctctgtcacctaggttggagtacagtggtgcaatcatagttcactgcagtctcaaactcccaggctcaagcggtcctcccacctcaggctcctgagtagctgggtacacaggttcacaaccaccacacctggctaatttttttctttttttttggtagagacagggtctccctgtgtttcccaggctctgcaaacccatctctatcaaaccaagacacgtagtcagcccttttaatcattagacctagtggtctgcaaagtttgtgttggaaatactttatcttctctcttttgaactggtacatcggctgtgatgcccggagctgcttatactgtggttcccttggccaataatttgtttatgcctaaatcagccttgcctctaagtgataaggagatacgtgctttttcttttgttttgtgtcagtggtattctctaataggccgggaacgggtctgcccaagtgatgcacagccccttggtggggctggctatagatccccccgcaaaactgaaggttaggcctaagatattagctttgcctggcaagatgaagatgtgtggactaggtagacctgtgtggcagtctgtttcttttataaagtaaacagagttcagtttgtttaggactgcttaggtagatttcttacactgagcaggaatatttgtacagatgttttaaggtaaagtcaaagaatggctagattgtagcctttgacgcattataatgtatcttttctcagtgcccctgttgaattcacaaaagaaaaggtatttttgatcatcggctatgagaaacttaaaacacttttttttatatataaaggctgatttagttaactcttcttgcatttaaagaaaaaaacatctgctgaaagtagggaggggggaggtgtgagcggaagcgtggtctccacattccacaatgaatgtcttttcccagccaattttaatttgcagaaaaaccaggcactgagttagattcctcgggaaaagtccctgttggctgatgagccctgaacttcttccgtgtacaccctgaacagggactgatgcttcagttcacagagataatttttctctggaaagccgatagatccgatttagccacccctcatttgtagtcattgccaccttgtggattacaaaggatattggttttcatcaaacttccatttcgatttggctttttatggcaagtacacgttggcagtggattgccgtgttcctcaccaaaaggatcctggtttgttcagcaacacctcacttctccactcacagttcatttatgattctgatgagagtgttttttcaggaaacacacatttcactttttgacctaggagcatctgttagaatttttttttaatactactttggcattctgaaagtgttaatgtctttcatatctgtttaatgctatttagggatatttatgatcacctcttggttactcagggtaaagtgtgtcgcaattttttttaaacagacaggaaagcattcacatgaggaaacagattgctttaaacatgtgcttcctgtgacagtaaaaagaacaaattagatttaacactgtgtaatgaatgcataaatgtgtacatttaagcttttaaaagctttatgttcagttctggtcacaacaaaaattgagtcacctgtaaaaattaaagatgcccagggtactctcagacttttgaaatgcccagcaattgcagtcctcacctgacgatgcctcgttggaattataaaaagcatgatctattagtgctggagagaactagaacattacaaggcacattcagaggttaaaccaggttacagtcagattccgtacatttagcaaataaatcagaatttgttgtgggggggagaatacttcactctcatcttcctccctaagaatcaatgaaaaaatcaattttcgggaaccccatatattcctctgtctttcatgaaagaaaaagaaggaaacctgatgtttacttactagcatttactacaatttaattatataagaaaatgactctttttcttatgtaattcagtttgtgttttgtatgctggcagggagtgaatagaatctgagttaatatttccagttagactagagtgtggaattggagggcctgaatcctctccccggaagaagaggcactcatggccatttctgtctgagcctgcggatagtgcctctccgtcccctgtgctttcaaagctaaggatttgtggcacgcttgccatctctctggccaaggagggccaggagagagtccctcgggggagggcacatagtttgaggacatctgactctcttctatcacatactgaggtactaatatcaaaacagactgcttgtcgtcgcacggtggggcagtgctttttttggctgccgtggtcgaaatgaaatgggcaagctgtagtccgcttggcatcagaatgggctaagggaagcagggaaatcagagtcagactgtgaatgcaagtcacagccaatggttaacttcctttttgtgtgtcacttggcagcagcgagactgatggtgatttttttttttaacatgggtgagagttcagtgccctaggaagagccgtagatgctgttattgtgcttcctcatacagttgacttgtgttgatttcttgaggccagtacagctgttccaagagccagctccaggagctttgtgtgtatgtacatggccatcggacgtcggatgaaaaaggtaaacagatgagaggtgatccatacaaaatctcactgctgatcactaggcagtcttaggggaatcaggttctggcataaggcaataataccaaagaataatatatagtgcacttgaagggatactcccttgtatacagacacccaaagatatttttaaattatcaccactccgcacccctcatctcacatacaggattcaaatcaattttggactgtctggaaaatgtaggactaaaatagccagattgaattcagataaaattaccttctgcttttttgggaggttgttgctttttggttagccacattattttctttgaagattcatttggaagagagtttggtagaatttctagcctctctcaagattttcctcccatttctctgtttgcaaagagctgttccccaaaggcaaaaagagcgagttgccatcttgagcgaattgtatgtttagtgaacaccaaatggtctcagagttaccctaaattttcattatatctggttgctttcaaatactatttattcccctcaaaactcctaaccatttatataagatatcagtaagatgaccaacttctgacaacccaaaagcagggaaggaagcttagaaatagaataccatttgtctggtaattagagtgtatctcttaagagttcgagagaattctgattaacctttctgttcccacattctcacgtaaaattagcacaccttttaaattattatctagtatttaaacacatatttttgagtcttcttaatgcaacaggttctggggacactaaaagtgtgttatagttttctaaaaaacttcatttttcttacattttaaatgttctgtttgtgcaaaatttcgagaatcaccataagggcttctttgcatttttaatttagtaactaacatatgaataaatttgcatattaattagttgcagattaaatcatgcatacataattgcctccttactgtgtttaatgtttgtcaaaatctccagcctggtttgatggatgtcgtatgaaagattacaatttgatgtacccttggaagtatttacaccaataatgcaagattcttaatagcagaattttctagttatatacagttactaataaacatgtaagataggtacatgtccctttgactaaaatttttttctttgcaccaaatcatttactattcataatcattaatgcatctcctaattatacagcatatgtctgttaaccctttcattgctggccttcaaatggtagcttctttctttttcttgccccctaaagaaagcaaaattgtttgataatactctgaaattactcgattgccttttatttatttctctcctagtatatggacaaacctcatttgccatttattttaacatacaatagataattatatgatcattttgtattttctagttaaagatcataaaatgacccacgtgcacatggttagtagctgatgggcttttgcctttcttttaccaatgctgaaaaaaattgaaatatttcagatacttcatatagtagtaaaaaaaaatgtatacacagacatactctctatttaggagggtaattgtagaataagtaaaagtattaaaattatatttaaattcattttgaatattgaaatgcatttaatgtatcatgatcaaacataggatggaaatgtgattttttttattagaattgagatctctgaagtagaaactgacaagagaatagatgctcttgatttgacataattttaaaatgccaataaatgttttctcaaatttcttcaggtatttaattttttaagttttatcttactcatataaaaagtagaccaactggcttttttttttcctttttactattttgatgtctaagctgcttatcacactgtattaccctgcattaatgagtattcctactgtgcaaaattctatcaaaaatgatggtgtgaatgtcatttttaattggaagtttatacagtcaaatttatagtacacaacaaaaaatatgtatgtagttctgctccaagcctttttttaggcttttgatctttttagtttaagtatacatttttattaatctaagtgtcatttgaaaatctacacaaatatgactacattttttattaataccattgtattatggaagagagggaaactaaggcatagagtaattataatgtctgtaaactgtaagaagaacaaatacaagaatgaccaagaatagattttcaggggtcttttttagacatgaaaacttgctgaccggttctgtatgtttcacataagtcagactgtatgatttctgtcttctttatttttgaatgcctgcatttatatgcctagtaaaaaggcaaaggttaaaatgagttgaaagcataaacagctgatttcccttctttgattctttcataggagaaataatgtctcctggtcacctacctcaggagcatttatttgcttatcacaggacacaatgaactatttattgatttaacacaacattcttttacaacacgcaatattacattaaattatttagcaatgtgaaaaatgaaatgaaagctgcaaaacttataaaaggaagcaaacagtcagacctgaaacatatttatccacagccattgtgcctaggtaattcagggcatatggtatgtaaatgatatttggagatccttgccaaatctacacacgacgggataaattaaggacaggtttccctgggtgtgagtcccatgattgtggccggcacacttcctgcttgaatgtgtgtgttctgttcttgtctttcagcaagagcgtcacagagcattcagtggccaaatctggtcctcagctgacttctaagacattatttgcaattcccaagaattgattttatgattaaatttaaaacatagtaccaatttgccaaactttccctttgctctcacatttgaaaagtaagatctgaataatttgtcaggatatgtttagatattaagccatttaaatgggtatctttgacattagaaattgagtgcctctgagcttcttagtcactgaagaaaggtgttcctgagcagtgacttttctctaagctaggattaagatgtttcctagaacagactatgaattattttgaacgattgataattttggttccaggttggcccagtaataatttattaattcaacttgacaacccaaattactggtatcacttattttatttttgaattattattttgaagcatatactctcatttctagaaaggtgaaggcactgactcctatttagaataaattttaagtaggtaagaggttatgctgttttctttttttttgaaaggaatgtcttttctaagctgggggtcttagctcagagtttttaatgctttaaattaaggttcatttttatcttggaattatgcaattggagattttgattagaaactatggcagaattttttctcctataatttattggactatacctaaagagtgcatttactgtgcacacttaattataaatacaagacttatatgttatttataaaagttatttcggggtattttaagacatgtagagtatggcttaggatgttttattgtttttactattaagaataatgcttttactaaataaaactgtgtttcttttataaaagataatgctcttaatattatggttttatttgaattagcagtttagtctgtgtccccacattccatttcatttatggaatgcaaataacactagttactgcatagaaaatgaaattaggctgagtccttgttcattgctgtgtaaattgggtaaaaatcagagaaaaaaaaatacccttgagatcaatgtaaatcaatactacttgagacagatccagctaaaaattcatgaaaggggtcacagttctggaggagtttatataattatcatgtagcctatagtttgtgaactcagggcaaagttctgagctggttgttctgggaccattccttggttcattgaaactactttgcacagctgtgcttcaaactcaacaacagagagcaaaaacaatattcactataaaataaacctcgtcctgcctttcaacttcactgtgaacttgcagtcttgaaaacaacaaaagggataatcgcaattgagattacagaatccagattagatgtaatacacagtagggtggtatggcccaattttacttacatggggcaagtggaagtgctgtgaatgccaacatgttaagcatcatagccacttattaagatgttagctttaaatgtcagtctttggaccccatttgaaatgaagcacctgcattttattcaaagaaattaagatatattggggaatgcggaggtgagttgagggttttttttgtttgtttttctgttttgttttgttttttttttctggtgggagaaagtgccatagacaatagagataaaatatctcaagtattaaaagtctatttttatacactgtatgattcaaaatgactgagcagttttgaaattttgtagaaagaaaggaatataaggagaataagaaatgatatttgcatctttacagacaactctgtatagcacatttaagattctggcaatttccttacaagtatctgaaaattaggaattatgaaggaaacccagacagatacttaactatagcattgctaccaggtgtctctttgatatcaatgagttaggaaaccttaagaaaaaaaggttaaaacatccagaatgataacttattttagaatatgctttcagacaaaatatttctttgttaagaatgttgaaaggttttatttaattgttcacatatatttagtaaattttttggtagacttgaccgattaggcttgtttcataaaagatgtgggcttctgtgtatttagatcttaagtttatttcaaattggcctttataaaactttagtgcctttctcttagaattctagtcaacaaaattatattcatcaagtgtatacatcacagaagtaactggtgatacagagtataattcctaccatattgtcaaatggagtctatatctcctcaaagggaaagaaacactgacgtgagtcagaagttttcactcacttggcactgaatcagcttaaagttcgaggttgaaaaattcacaaatatttatagcacacctactaagtgccacgcctcctggaaggtggacagcaatggccaatgtttctgccattggaaagatttgcaccgaagtgtgtatggccacatgtagttgtacaaatcagagttcattttgtaatgctttataagggtctggtaccactgattctccttgcagactaataaacacagagcttatatgactcttaaaaatacagtgatagcaagtgcatcctaaattatgtaatcatgtggtccatgataacagtgtaatatatgatatacagatggaatcagccacctggcttactgtaattgttgttgaggtcctttgttatgaacatatatttctgttaacaatgcaacaaaataattttttaagctgtttttttttttctgtactgcctcaaatctagataaacggaatgtgttggaaaggacaacaaataagaagttaaatatgtggaaatgacatggaaagcacctgtttcttccctttgttttcttctacgtcatcaggaaataatatttaaccatagaatatggtgtccctctaagaaaatgtttataattgaatgttcaaagtagaatatagattaaataagtaaagatgacttgccaaaaaaaattaaagaacatttgaaacaaacagaagtctgcatcacacataataagtggcataacagtatcacctctcaaaagtgacaatagatgtgtccatctttatgcctttagcatgttgttggcattattagttattgtattgagagagtagccacgctatacaagagaaaggaaggtaaattagatccctcacgcccccttcttctgtgaattgtatatgtttttgaatacactctctgccaggacagcaaataaaatttggttcatccctgatcctcagcagattataatctaggtaaaggacagaccaggttcatgaaatcaaaaataataattagaacatttggaaactaggggaacaggtcctcatattgtgtgcatgttttatcagtctaaagtagatatagctctattgaaaattgttggctagtaatatgctcattttcccatttcatgaagacttattctcaaatggaagttacagctggctatcgtgtttttccgacaaactctcttctctgtggacatgatgatttctgttgttgtggaaaggaaggaaataaatctctttttgttcctcattcactcaatgagcaaagtgtgattgagctcctattgtgtgcagattatattgttggagcacaggacaaagaaagctaaattatcatctttgtttagaaatttaagatatttgggagcagcaaggtagatgcctatgcctagtttatttaacaaggcactgaactttgctggagaatcctatattctagaatatagtccttatctggaagtgactacagaacctgattctggatcacagagagctgcagatctggtgtgattaagacagtggccacagatactccactgagcttctgtcttgcagcttctgtctgtctcttccctgaaaatcacagggaccacagatactccactgagcttctgtctagcagcttctgtctgtctcttccctgaaaatctcagggaccgtgtggagttttgcttggtcaactggagaaacaacttttgattgtttttatgtttttcagagatttatttgccagagatattacattataataaaaacataaacacagaagttagggattggaacaaaggttatatggtcacaatttaactcatagttatttgaaaattattggtttataaggaaacagatttagacaaagctagaacttatgcaggtaagttacaaagctagaacttactcaggcagttgctcacgtctgtaattctagcactttgggaggccggggcgggcggatcacgaggtcaggagttcaagaccatcctggccaacatggtgaaaccctgtctctactaaaaatacaaaaattagccaggcgtggtagtggtgcatgctggtaatcccagccactcaggaggctgaggcaagagaattgcttgaacctgggaggcagaggtggcagtgagccaagatcacaccactgcactccagcctggtgacagagcgagactccgtctcaaaaaaaaagaaaatgtagtggacacaatacatttagatttttaataaagtagacatatgtttattgcagaacatatgagcagttgattagttaaagatatccaacatgccaggcgtggtggctaacacttgtaatcccagcactttgggaggccgaggcaggcggatcacgaggtcaagagatcgagaccatcctggccaacgtagcgaaaccccatctctactaaaaatacaaaaactatctgggcatggtggcacacacctgtactcctagctactcaggagctgaggcaggataattgcttgaacccgggaggtagaggttgcagtgagccgagatcgtgccactgcactccagcctggcaacagagtgagactacatctcaaaaaaaaaaaaaaaaaaaaaaatccaacattgctggcaagtttgaaggtcacagcccatgtacaaaattggtatatcttgaggaactcttgtctttatcatatgttctgtaccatttccttgcacacaacacagttactatatgatggtactaagtagatacaggtccagaccccataaagaatgtggcattcagttcttgaacagatgttagagaacacaacccactcggcagtaagggatatcttcaactagagggaagggtgagagttgacctgtttgtccttttgactcatatttagaaatgctaaagttgttttatgttcaaaatgcatttgataatcatgcctgaagaggtcaaagtgctgacattgttgaaaacaaatacccctgtcaaacaaatagagacaattttcatgtctttggttggtaagcaccataatttggcctttggcattgctgtcagtaaagctagttgatgacttttacatcaatttttggcccaaccataaatgaaggaaataagaccaatactgccacagtactttttctcactcatcacccatacctgattcagctgggttaatgttaaaagccaaaatttatcaatatcaatttttttcccaaatcattcttattttagtactgtttatgctcaataaaagtttatgaatttctttcactgttatttaatgaaaacccagaattttttaaaattgcacattatctctttaaaaaaagtcttttagattactcgtgggatttactctaagttgttgtcttttaatagaagatgatgcaaaacttgtctcacctgttccttcctggtcgtgtctgtgtttatgtgtggggtgggtatataagtgcttttgattaacagaatgaagagagtgcttattttgaaaactcagtcgttaaaattcaagtttattttgagttaaagaacaccatatttagattaggaatggaccaatgacctgcttaagctttaggctatcgattggccttgagggaacttagatctgctaaacacgaacttgaaaaggcacttcagtgatggatgtacgttggatgctctcactgtatggtcattcacttgcattttaaaatttatgttttgtttttcctttatacctactcttttcattccgtttgtcagaggtggccatttaaagtatttgacaattgtttgttctctgcctagcaagttgtcctattgctccatgatgtgaaagaacaaaggtaatcaacagttagaaacctcaggaaattgctagaatcttcacccccaaagagggttaataaaccctagataattagttcatttagaatgaaaaccattttcattgtaataatcacatttcccctctgattatcgagcaatgcattgggaagcctgatatttattcacaaattttttaaaattgagaacatcctgtgctgagattccagtcagcttcatccatccattttttgttaaaagtttctcaactatcatccttcatccagacaaataaacataaccaggatttcccctctaactttttgggaattcatttacacgtgtaccattttgagggaaaaaaacaattgtcctcgaatttcatttgactcaggtgattgtggtaagctcgctaaccagcttcatctaggaagtgcagcaatctgagtcaacttcctccatctctgtttttacattgtccagtgtgatgcttcctcattgtaccaaaatagaaatggtttgtttttgtatcaaacttggagactggctatggattacactgggttaggataagggtttgttatttttttttttttaagaacattccacttatcccaagggaaaaagattgacggcctggggaaaaataagaggcataatgaagtcttttctccttaaataaaaatcacatctagtcttcagatgtgtcaattgcactatgtttgcctaatttcatttaatatttgagagatttagtagtaaatttatgacttttgcagttactttgcaaaaaattgaggaaggaagaagtgaatttcactttgagtcaaatgtgtaggttccagtgtaattaaacctaaaaatctatatattctggtcttgctacttggtattacactttgccatatcacataatgctattagctacattttaccttgtttgcagggtgatgccattttgtatctctggtttgttgaatttcctagaagatgttatgttcatgtagataatggcatactcattgaattctttacctcagacatgaaaatatgtggaaaagtggggaaatgaatctgatcagatttcactgtatactgaaatttgagaatctggtttttgcatctattttgcatgctgctgtctctccaaaccatatatgtctgtgtgagtttttataatgccacataaagcaaaatgagaagtctcttctttcttctaaagggaaatagtgccacagaaaggtagaagtcaaatatttacttatggatcaaaaatctagttaaaaaacaacccattgcttaccttagtaatcaatgtgaattactttataatcaatatgaatacaagctatctgaccagtcactcagaaaataaatatttgatcatgtgataaaccatttgaatgtctacatatgaacccaggccatataaaaataaccaattcaagataacataggaagtcactaaaaaagacacaaataaaattagatttcacagtttacgctgatattttgatacttttctgtgataaaagcatcttccaaactaaatgtgtccatatttgaaccatgtaaatagttaaaagtattttacctgagaatatctaaatgatgccaagaaaataagttcatgccactaaaaagattgagatgatttgtgctttatctgacttcttggtgtaatatggatttacttcagataagtatattttctacttatccgataagtgtgtttatctgagataaatattttctccagatacgtgtgtatattgaaaaaaaatttaaaataattaggatcccaattgaaaaagtaaaaatcttaattgcttaataagaaaacagttatttcatagtcttaagatttcaatacaaagaaatatgggaatatacacgtaagaggtttgttggtgttcattattaaattgcaaggctgtctcaagttattgtcatcagaataaattctgtgtgtgtgtgtctgtctgtctgcgtcctcctgttagtaattagatcttttatgaagttgtactcatacctattagggatttttgtcattgcagttttaagttgaatatgacacatggatcctttgttgggtctaagctatcaccatttattacaattttttataacattccatatatatgcatctactaactaaacatcagccttaatttagcttatgaattaaattttttgttaggagtgactcctgctggagagcaaaaaataccaattagtttagcttctaaataaactatactccttttttcaatggacaagggtaacctcctattccttggcttggcaacatttactattcctctaagtttaaagatgagaacatagatttgagtactaacacatcagcagaaattatatttttaagtacatacataattctcaggccagtcgtgtttggtgctccaaaaagatttgtgattgaatatctttgctccattgggaagagtttagcatggtgctgtatttttataattcttttttccattttagcagacttcacctaagtctattttaggtggagattttttttttttttttttttttttttttttgctgctgctctttaaggcactcttgcatagaggaaacagcagaggagacacaaggaaatgcactctcctttataacatgctgctgattctctgaactaggtgtcctctcatttaagcctcaaaagaagctgtgtattaactagatgaaggaactaacactcaaacctgtgatacagcttggccagagtcacactgctggggagcagcaaggttactcatcaagatgtgtctgaccctcaagtttaagtgctctgatttaataactttgctcacaccctgattccagtgtcttagtagcttttgatctataaaatgtcatctaaggatctttgagccttaattctttgtctttaaagtgggaatgataatacctgccacagagtactagttatggagattaaataagtgaaggcaattattatatgttctttaaattgtgtgtcactgtactgtgcatgtattaagtgtcgttttattagcaaatatctttttgatgggtagatgtttacctgaggtggttatttaatttataggctggcttgttcacactatgttatgtaatcattgtatattaatgaatatcactattttccttaggatatgatgtttagctaattcagccatgctaggcaaaagaggtcagcattgtagaaataagcaatgtcttatactgaaaaaaagaaagacaacaacaacaaaacaacaacaacaaaaaacaactttccgtgttcagtgacttaaacagaaacatggagttgttcaaattctaccaagttatattcgggaggagaaaaatgggaattccttccatatgaccattcttcattcattcatttattcagcttctatttgttgagttgcctgccttacactgcaatatgcagggcagtttgtgtgtgtgtagatgttcattaggtttatttgcactttgcagtaaccatgtaatattatcattattcagaaataaaggtagaatctactctaatgagctctgtggtcgagtggatagttcagctctttaccctgtaatagtttgttatctaattgtttaatgtatgtgcgattgccttcacaattaaagcattattctttagtcatattttctctcttttctcaattttctcaggaagaaaattgacatgtctgtgaaccctgtgcatgtccccaaatggagcttaacccaaagttgggaatcactaaataattgttcatgaaatggttgaatatagctcttcattcaagtgatgtagattctgaatatttacttattctttaatgcagttattcattcattcggcaagtttttattgaacatctaccttgtaggtaatactatgccaatgcattgggggttttaggtcaaatatttcccagtttcttataacaaatgtatgtgtgtgttgtcagttctgcttcacctcaaatatatctgtcaaagactttttggaaaattacaaaagaactgtaaactttagattctagaagaaaataagaatcgtgtgggtttcatttaagtggtcaacacttctagacagtttgctggtaagaatttttttccccaaaagtggcagaaaaagacaactgggttcattgcctacccccagtgtcctcaatagtgctttgtctaagcaccagagagggatggtggctttctgtatagtgtggctaaccatcattccccatcatttcagcgataacaaggctgggcatggggggtgggggtggtaccaagtaggtaaccaagttacctactgctggcaaggtaacttgtccagttatacactactgtgaaaactgtgtctgtgaaacaagcagtagactagttcagggtcctgtaaaaattggctgcttaagattaagacttctttaaaattattctgaaacacatggatttatgcatatagcttcagttgttcttatacttctgttctaactccccacgcatcacactaaaaatttatcatggatgatatttctgtcacaaagaaaacttcaaaggctgagatcgcagaaatgtctcagttgacaagccactgacttgagttctgtgattgaaatgtactccaaggtcagcaaaccaaaaccaaacatcactggatgataatacgttcagtgtctcactggctataattcgtagatcacctttcaaagcattatatctttattaatcattgtaaatttgtgcttttgaaatcttagactcgtttccattaggcaatgaagcccagaagcttaatgttctagtctcattttaattttttcagtcttatgtgctgaattgtcagggtttaaaaatcgatttcacctcatcagattaaaaatatttatttatgcacatgttaacaatatattaaaagaaatgagagcttcaattttaaaaataggaattgtagctcattaagccatgacaatttggtttatatttacataattaataggaaggcatttatatgtttgcaaaataggtaagaaaaggtatttaacgtagatgaagcagaatgattgtttatcaaaagagtttagagatctttctagcagtctacccatggaaagttaggatctagaaaagccttctcaataagggaagaaacaacaaagaaacaacaaccaggaaactccccaacttatctctttaaattccagcctcttttctaagtggtggtttttacatactgtcctctggtaggtgggtaccctggccttgtgtattaagcagtgagggtggtttaaaggttacaaatgtgatcctgtcagattgacaactaactgttctaatgaggaaaaaatcctcaaagcatgaaatttgaatgaaatgtgtgattataattcaagtactgtttacacaaacctctggggaccttccgaataaatgcagagcaagtgagttagacaaacctctgggccttcgatacgtgtgtgtggatgtgcggtgtgtgtgtgtttattttagagagtggggaaactttccaccattagcccgggctttgctcctcggaaccaacaccactattcctccttgtttattaatactgtatgtgttttgttagcatattgagttgtaaggaaataggtgctttgaattattaaagttgattcttgagaatagatgtatgctcgggtggcatttgcttcggcatatgcaaatgatttagtttcatttgggatcaattcccagaggccctcctttcctgtgatgctctgaatttggcaagctcaagtcagcccatctcctctccccacatccctccctttctttctttcctttttttgtacctccccccgcctttttgttgattggtataatatttttaaaagacaataaataaatatatcaacttgcttgtgagaaaccttgccatctataaggattctattgttcagttgtgatcaataaaggtgaacaaaggttttcacgttcttaaagtttagcaaaatcgaagtttagtaaaaatgtgcatgagatgtttgctaaaatatttatacagatactgggctgcggggatgctgcaaaactctgaaaatgtggtctcaggggtgcctttggggaaactgacagctgtaagatattcgtcggttcgaaggtaccaataaacttgctttagagcccagcaaatagcgtgaagttgcagtagattgtctaaagctacagtgaaagcacccaactccagagtggagaacgtgcgcccttggggcgcccagcgccagcgaggggagcagcgccccagcccctccgtaggctctgggcccatgcggctgtctgcggcggggcgaggtgaagttcatgggcggccgcgcttcccaccagctccggggaggccggggcccgcggagcccggggcgggccgcactgctactctgtttcattccgcaaccccgttttgtaggttgttgaccaagcagtcagaaaacactgccccctctctccttttgagcgaggtcagagacgtggtgtttttttttttttttttttttttttcttccctcccctttccctcccctttctccgagtcgagttctcaggcagctgcgtacaatgctgggagctagccagcagcagagacagatggcagagttattagatgtgcatcatacgattcccttcctgccactcgctttttaatcaaattaaaacaaaaaagaaagagagggagagagagagagggggagtcaattaactgcatttgtattctgctcaataatggaccctgttccacttttaccctaaggcagttgagtggaaattttagagaagaaaagggtgcctagaacaaaacaaaacaaaaaaaaaaaaaaaaaggaaaaaaaaaaagaaaagaaaaagaaaaaagtgaagactgcagaaatttgtaagaatcggcattattcgaggaactaataaaaacccctcggaaaagttgaatcgatctcgcgtatgcattaggatttcgagctccatcagggccgggctgccttccagctccgctgcgcaaagttgagcgtctgacagcagcgccgcggcctcccccgcccgccaggaatggtctcttcctgctttgcatattcaccacgcttggcccggccatatgggaaaatgcaactgaaggaattgttgtgaaaaaagggacagcgagtttgaaataaaagttgttagagtggtactgaggagaaaaaagaatccgagaccatgtactgcgcatacacaatcccgggcatgggcggcaactctttgatgtactactataatgggaaagcggtaagcgaatgcgggctgcgagggggatttttgacaagttttattgtcgcagggatgagcatcctaggtggtgatcattgtttgcaaagttgtgcaggactgccgcaccttcctgggtgccatgaaatatttatcatttgccaatcctaagatcttcttcttgcctacttcttctccttcgtctttttttccccccactcctcccccagagtagaaaaatagatgctttcagagctttagagagtggatcctagagcgaaagtttgcagtcaggtaaagttgagaggtggtatgattttttttttttaaagagttttggaaaattcttattccttccaaatgactgttagaaaggaaaagcagatatgagaagcagaattgagaaagcccaagttaggctgagaggaaatttggggtaagtttctccctggattgaggttttgtgatatctaaagtcttactaagttggaagcttgagtgcagtggatagagtggagagaacctgaaaggttaaaatagagcaaacacataaaactgagagatcaaattaaggagtagattatataagcttagatatatatttaaagccaaaatggggaaggaaaaacaaacgggttcattcatgcatataacagtattgtcataagttatttgtgctgtgtggcttcttccctcaatttcccccccttccaacagaaacgctttatttaagaaaaaaatgtgtctggtattttgtgcataaccccagcagaaggtttatacttgccatctggaggtttattttttttttccttcgtctgggcccactgaaggaaaaggatttcaatattttcaaatcggtatgtggggctctcgggaagagttgttgggtgatagaggagcaaaaatttattgttttaaaatagaaaagaagaatgagagaaaagtgaaaagcagccatttataaactgttctctttgtgtactttgaacttccatttggattgatcttaatcagggatagttgggccaaaggggacagatcagagctttcaggaaggcccagttcagctgtagcaattggcgcaaacgaattaaacatgtgtatgtgctgctatatgcctgtgagtgtatatacatacagatgcatgcataacggttatttctagatgagcatattctgtaatacatacatatacacaactgtttgaaggtgcagtttcagaagattaataatttcatttaagaagccagttttatgaatgggcaacttgaaataatatcgtttacttttattttgaaaagtacgagtaaatcatcaaaagttcatagcgctatcctatttttatcttttttaaaaaagagcacggtgtaattaaaatagttaagtgtggtaagggaaatataattttaaaacaaatggttttcgttgtgatttgatcaaagtgtttaaatctgtaaacataaatattgggattatgtaacatctttttttttttttaacaagtacatgatttgcaattggtagttactcatatatagataagacttttgcctattatcttttagatgttctcatacataacttattcagcacctttcattttaaagcacttttaatgaaaattttgtgaatgatgccatcgtagtcagtaagcaaaagtgtctctgaagcagattcagggattagatagcccttatccgtaatgaaagacttacattataaaagaatataagtttccatggtttttatctttcaggattaccaatgatgtgacttttacatgttaattgttaattttgcatcttaaatatctgaactgacaaaattttaatttaagttttgtaccttttaactcccttttggccaaaaggaattttcaaaaatatgtattccattcccacagcttgccagttgcctccaccgtaagaaaatgctgaatatgacatcatatcactaatatgccctctcagttgccaaatattttggttgttagattttttttttttttgagaggatggtactcataaaatcaagatcgctctgtcacaggaaatgtatttataggaactgttttaaggcgtttattaaaaacaaatctggtgatgtgtatctctattgattcaaacactagaaagaggcaaattgtacacacattatagttagaaaaaaaatagccatttggaacaccagcagaaagcttttgaaactgcggatggctaccagttgtccatcttagctttatgaaacagacagcaaagtccagttgtgtgtgtcccaaggaaggggccaattctataccattttttaaaatgccctcatgcatacactgaggaagcagatttttgtttattctacagtgtgtattctgctggctctaattctgcattgagtggcttttgatttggtgccagacatgttgtggagattgtatataccatgcgttaattgttcaaaatgcctatcgaagagactttacatttcttgagttttacttatcgtttggaggttgaatatctatgcttttttgtgtgtatgtgcatgtctaaccaatgtgtgtttgaacctgaattgttgaagttaagtgtggtcagctatttgttgcacaagttttcctctgaagagaacacagcactgaattccttcttttttcccagtgacaagtcaattacttgtttaaattcagtttgaactccctgaactgagagaggccagaggaagcaggttttccctgtgaataaacaaaagaagaaaaatggaaaatcattccaaaacacagtgattttagcttgtgggaagaatataattaagcattacaagaattatggtttcttcttttatgaactggcaactatagggtttgtaaaatcagttgtcctctaactttctagcagaaatataatcaatgatattttaggacaaacgaaaaaaacgtgaatttttttactaccttaagttatgaagtgtttccatgtccatatcccacaaaaaaatttttccttgtttctgtgaacaactgtacctgtccagaagtgtggactctgaaaaaaatacttaacaaaaaatcgtaacacaagagctatcaaagaataaattttggatataaaccagaatgtatttttaaaaatcagtttctcctcaggtgagagtttcatgaacttgataaaataatttttgtgatttttttttcctctatgcattagaggtttaaatactaacggatccaaatctaagcttaaaaaaaattaaagcaccacttctgaactacgaaacagatttttttttgcagagaaaatcagtagcttattttgtgttggaaatacaagcttgtatcaaagtgtgccaatgtgtctgtccttattaaggctataagaagtattaggcattacctgctctccaataagtgtagttctagctctaaattttgatctttatggcttcttgcatgttcattgaagaagaattttaataagtgattatttggtcaaatttcacatatctaatattatagcatatccacgaagataaaattatggcaaataaaactgaaaacaaaagtggcgaaatgtcctcgtaatggtaattgaagatcacatcatcagctctcgccagcatgtgcatgtgttaaaccgtagagagaaacctgtaattattgtaattgctctttttgctttatactaacaagcttcaaaccatgtttcaaagtagttgttttgaaatagttatttgtcaaatcatcaaatctcggaaagtaaatggtaatgagctttttatgtttatattctgactgttggtcatattatgcagcttttcaagtccataaagttcagagatgaaactggatgttaattatttctgatatcaaggccaaagaataaaataatgttacgagtcctgcttaaggtgaaaaattaggaatatttgaatatcagaatctctcaattgggaaactctctattcttagaagaaagttttcctgtaaataagtgacaatatcagtcagcaacctaaattttttaaagctgaaaattggggtatgaagagtgtagctttttctcatttatcacaggaagtgctaagataaaaagatcaatatttaaatgacgccactaataacatttttcagtacattttacatatggctcttttttttccccccaaacctcacagttggttggaacagccacacataggacataggtagccactgggttttaaagtttccagtagagtgtcaactatgcaaattacatttggcattttaaaaatatatttcttatacttactattttcagaaccatgattataaatgaaagcagccagtataaatgcttttattttttttaattgctgtttacttgctattacacagcaaaaatttgcttaggccacaaagtaatcaaatttttaaattccccactggttcaataaaataaaacatatcaaagagaaagcatgtaggaaaaactgcttttttgtgagcttattttttaaatatagttggcactttaatttacccatttaaaaataacaatgaaatttttttttatgcttcattactttaaaacaaaattatgttgattttgttctttatgtttaagctgataaaaattcaccagacacttaatcttgacattgtggctacatcttgccttcctgcctctgattaaattttcaaaatccctgcatgagattcacagataccagtttgaacgtttctgtgaggctaatttctcagggaaaaaatatggatcagttacatctttggttaattttatctagttcctaatttctgctaggtctaagcattttaaatatagtgttggtaaagcatccttctgtcgctgggtgatggcattattgcaggcagaattaggagaaaggacattggcataggagaaagagggttggggagaaaagtggtcaggaaaaaagatctaatagttgatgcagtcttttaaatacctttccaactgatctacaggaaattgtgctgaagaatcatttgtttcctgttccactataaatgtggtttgcattacatcccctgttcggctttttttgttgttgttttgtttctactaaattgtagtaccacgatggaggcttgagaataagtgatgtcttcctttataacttatcttttaatggcttgatcatagttggattttagacactgtcatatttcattatatgaattttgtatgtgtgtgtttccaagcctacttgaaacttctattactgctctgccactaagaaaaacaatgctgcagtctaagttctttagaatcactattgtaggtcaaatacatggtctacatgctgccatcagggatctattaaatgaatctcttgtttactcattcagaaaatttagagattttagatgtggttctggcaattgtaaaagttgttagaattcagatttacttttgccttaagaagaaaatacagtggagacatatatttgctctgcacagctgacctaaatgcatgccttgtacctgtgagaatttcagtatgcggacacataaaagattactgggccttttttccccctccaatattatcagagttacaaaataaataatctttcacagtcaacatagtttaaaagtaattttagttttaagctttttcaagtttttatatgtttaattgcactttattagcccttaatacttcaaacataactctaagatgacacaggctaaagttgtatatgataaacattattgattacttaaaaaaaagggatatctgtatattcataaaacatttataatctatttaggaaatcatcatagtcctaaaaaaaaagcagttgtttgtataccaggaaaaagagatcagtagtgacaaaagtggaaaagatacttgtataaaattgtctcctttagtgtgaagtgatctactgaaagttatacttggaattttcagaaaatgtccatagttgtaggctttataacatttcaaattctgtaataaactatttggcacattatcatatcattttaggtatatagataccatggcattttattaagcaaaacaatttttttcttctgaagaatacttaaggtgaaatttactggttttgagcttgaaagtggtttgagaattatacatgaactccacttaaactttggagactttcctttttgcagtgctaaagatccatgacttggttccaaactacaaccttttatttgcagatgtatttatggcacagtaccacattctgattagaatttaagagttcacatttctgatatttctgtctctaaatgctgtgttgcttctgtttacctagttttcttcctattcttcctaatttcttaaagaaatctgcacatattcattgaggtatttaatccaaaaagatttaaaagagacactacgcctctaacattctgtttaggagagtatactactttaaactccgttctccccacctaaaaaaggggggctaaagagtgggtttgaacacctgagaagtcagaggtgggaacagtgtagatgatggtctaatttcaggctcaaccaaaaaaaatgcaggctttggctggcatcctccagggacctagctctgtgctttcctagagaccaaattacactcatcttgagagagggcatgttgaggtaattggtgggagagagtggggagagttgaattccagctgcttccattgtagctgtcctgaaaatgaataggggatgttaacaatggaggctaacatttgacttggctttttcacctccacaaacctaagggtgagaattatagagtactgaatgactgcaccaataatgatcctgtttaagtgggaattgctatgttgggaaaaactcacaccattttaaaaatagttgatgcatttaccaaccacagtcctattactgtagcccaataaagtttatccacagtatggaaacactccttttttttattgtcagccatctagtgtgtgtattggatcttcacctctttggttaccattttaaaatgctcctactgaaagacatttggaaggcaccagaatcccatctccaagaagggaagcaagatacaagtgccctgtactccctttctcctagaatgtgtggtctttttttttttttaaggagaataaatactgtatgactcaatagcttttctaacgaataaaacaaattaaattgatgttacatgcgtatttaaaccctatccagttaagtactgatgtgattaaaataatcaaatgtattacttaaaaaattaaaaaggataaattctgcaccccattattttattgacttttaaatataaattgcagaaatgtttacattcctaatggcattattaagctaaactgacaaatcagaggaaaaagttgattggccagcacattattatttctgcacctgttattacagaagtggaggctcagcattaaaggagctggatggatgctgttttcttaggcttcctttgtgtgatgtgggggttgggataaatgtgtaacaagtgtagtttcactttgtagtgcctttttgtgtgttgatgtgattaaaagactacagtgtttttcatgtcgctttgaaattaatatgcaaataatatgggatattagggcttccctctacctgctgcactaagcttccctaagccaaatggggtggggattggtgtcaacttttttcatacaagttgtttagttgcaaatatcgccaacgttttatctctactctgtgaatttgtaagggggggagggaaatgtcaaactcattgaagtaggattgaagatctgggatgaaaatactttaaatttttattttctacttatatatcagccaggatgttaggagaccttgaaaacattttgaaaaagttgtgtaacattaccaaggctttggtataagattatacttttcttctggttgagttcttccttgtattaatcatgcaatatcatttctcagacacttgagcccggctctcccctggagcataggtggcaataattgtttgttattataattctagaatttcttgggtgttcattgtccgtaattcatttcacacagagaaatctaaactttcttcagccagtagaataaataatgccttccctgtcctttccttttcttttttaaattttgagttctttaggaatgtcattatagtctttgaaacgtaatgacattaaatttggattgaaggggaagggagaggaacttttatttcatgccatccagtggctagtttgagtttgcaaagaaatagatacaatgccattattttctgcaagatactagttaacactattctcatatcagtttagactttgtcctgtgtaataatttaaattcctagattttaataacacttaatatgtagcatggatcccacttaatctccccccggcttcacaacaaaatgtttacataaatgaactctcaattttgatatcaactatttaactcactctttcctgagttaatacttccataattaaacatgttccacagttgccataggagtgtatcttaaaaatgatgttcttctctgttcttttgagccatctgtttgctaggtcagtaaagaaatgggagcctgattttattttaaagccaataagttattactctactattgtattagacattcagcttcagagggagtaaaagataaaattccatcacatttccactttcttacatttgcagcagaaacttgtatgctcaaattggttattttcaactcatgacagctgtgatatttaaaatgatcacagctgttgtgacttaaaattgatttttctattaacacctgagaaaaagacctgtgccgtattaaaaacttaaataaggtaactgtaaaattagatgtgttgatgtgaatctggtaatcctacttcccagaggttgcaaagtgcagcacacctcttgcatgcttccagggaatgagctaaaactgctagaaatagatgcatgattgttaaaagcgtttacattttaaaggattcctgtaatagcagatcctcttggcccaactttacagtgtcacttttgctgataaaatcatttaggattcagtttccttaattaaccccaagaaagatgacttacatgaatcattatgatatcctaacctctagactagagaagctgctttacctttcagatatgacattgaaaaatgcaaaaccatacggaattgtttcttatgaaggaagttttggttttatggtgcttttcctccattatctttagatgacgaaaaaggaaaaacagatgagaaaggacaaatagatcatggctaagtagctttaggctagcacttgtttttggaatctttaatacatttttaatcttcatgttgaagatccatttaacctgttttaaagttagatggtgattcctgggttcagttggtctgtttaaatgtttaccttttcaggataatccgtattagaatcttgcatctctcaatagattacctatttaacaaagtaaccaatttaagaaaacctaaacacatttatacattaagatattttcctgtttcgagttagatgatgtagtatataaaatatatggctggcctgatgtggaattatgtatagacaacagtgtcttcacagatgcattgccaatagggagctatgtagattaaactctttggccagtcctaggctttttacctgtgtaactcaatcagaattgaaagcatgacaggttttatgatgatgaatgtatggctggattggagaaagtatggttgggtgggtagatagatggatagatttcataactagacagtaatagataatgccaattatttattactcaaacttgtttattcctcagaaatttttctgcagagtattattttgattattgcatgtagttcagaacatttagttgaaaatgataaaatatttgctgtcacataatcaagactgctatagagttggttctaaaagttccagagtgaacatacattacctgtgtcaaagttagaggctaagactatggagggccataagatcacaaagtcagactatcacatactaagtgatcatgggtgtcaatggctatttccttgtttagttgaaagaagatactcctcgagatggacattgtttatatgaagatttaagaaaatcaaagtggatatttgttgctgacagactaagattacaaacatatatctttagaacagggtgttccccaggggacatacggcaatatctggaaacgcttttgattgtcacaactgtgggggtcaggcaggagcttgctactggcatctagggctggaggccagggatgctactaaacatcttaacagcgtgcaagacagaccctcagaagtgctgaggttgggaagtcctgcttgcaaagtgatatatctggaccttaagaattaaataatgtcataataagttccataattaaatcttggcattgtgaggcatttatagaggataacatttttttgttttttttctttccctttctatttcccttttccttttcttttctttccttttttcttttgtttccaaaacattgttttttgtttgtttgttttggcatagcacactatagcattgcccaggtatttctacgttttaccatgaaaacgtgagattttatagtgtattaaatattgtacattatttgtgaaccaactggaatggcttcaaagcagctgttagaatatgttgagtcagtaacacaacatgtctgcataccctaaacatatatttgtcttaccttttaaaatgtttagaaccctctatcagtgtaactattggtttgtcttgaatcatcctaaatgaggaagtgtattaccattttttccctacaggacataaagtggaaagaagaaattagcataaagaaactaattaataattatgttttaagttttttggcattacggacattgtttacatcatcattaacatcataacatcatatcgtctgttatcaagaaaagattaaaatttaaagccaacattgaagatgttctttccagctttcccaataatgcaactcctttacctcctcacaactggggacctctctccctgccactgctgcgcttctcctcaatgtggataattcttggccatgatacggaagtgattttgaaacctcagttgccttctgtagcaccctgtggaggaaggtggcaggatctggtggctgagtcttacatctgccaacttctagacctcactccttaggtgccacattttggagctagttgccaagcctcacagtaacttgagccactcttcaatttcctccccatgatatacaaagttctccaaggtttaatgagagtagatatggaggctgggcacgggaatggcagctctgatttgcagtatatctttggtgtacagatatgctttcatttattgcttagcccattagctaatggaatttcaattccttcccacaggcattctcagaccctgcacttcactcttcctgtttccctgtccagcttggtacaacacattctagtaaaatcacactgatgtgtttaggtttactttgtacatcacatctgtaaccatctataagtttgccctaaactggcatttattttgaactgtcttccaccttttattgtacagcgttgtctgtactcaaagtgagcaactgaaaagaaaattttaacattctttttgtgtgccagacaagtaataaagattactatttttatggtaatttttttatttgaatatttctgtttctggaagatggtaatttttttaaatcatgaatttcctgtaagtgaaactatttgagggagtattgacctttttttgatcaatcattgattatctgtgttgcactctcagtatttctcttatagtccatatgtccctctgaataattgtagaacaataacttgcttacacagtgtttttagaatatgcttcaggaagcttgcctgtgtggtatttaactcagacatttatggagtataaaaccaatcttactgtgacttttaattattaggaaagtggcttacagttaaaataaagcttacagaaaatattgtagcaataattaatatccagtaaaatacagttgtaagcttcggttctttcagacattttctcaacccagttctaatttgatcgttactgcacctcagtaagataggtgatgcaggagtcatcatcccatttcacaggcaaagcctggcctgttcagtgaggtagccactggccccatgtggctattaacattcaaatgaaggccaggcacagtggcttatgcctgtaatcccagcactttgggaagctgaagcgggaggattgcctaagcccaggagttcaagatcaacatgatcaacattgggacaccctgtctctagaaaaagttaaaaaaaaaaaaaaaattagccaggcatggtagcgctcatctatagtcccagctacttaggagattgaggcaggaggatcattgagcccaggaagctgaggctgcagcaagctgtgatcatgccactgtgctccagcctgggcagcagagcaagaccctgtctctaaaattaaaaataatgataataataataataataaataaatgatgtcagtcaatgagaattaaataaaactttaaaaagatcacttccttggttgcactagccaagtttcaattactgagttttcatatatgatcagtggctactgtattagcacagatacagaatatttgtatcattgtagaaagttccatggggaggtgctggcctgggaaatggaagcattgagggattaaaacttgctgaagatcatgtgggtcatgacagaatagagtcattgctgctatatattccaataggatatttttacatttttcttagctttattgtcaaatatctgatgtaagaattgacattttaatgctaccttgtagcactttactgaatgcttatctcaactgaatttaaatttagagcttgagttacacaaacttttcaaaggatacagccctttgcctgtctgcacacaatggggaccttgaatttccagccagtgataccctccagaagggaccatgtcttaatgcatctttgtagaccttttggcatattgtagacaaccaagaaatgtttatgcagcctaatgaatgtgtcacatccaccatacgggcatatgtccatacatacagttagacaagacctttgggtagaatgctcccgagagagctggtgtctgccaaattttacagagctcatgcctctgctcttgctgttttagtaaaaagtagtattttatcaaaagttaaattgggttcaatattcaccatttgggtaatgggtacattagaagcccagtccccagcagcatgcaatattccatgtaacaacaagcacgtataccccttggatctaaaattttttaaaaatatgtatttactcacataatccaaatatttttcatagtaaatgaaaacgtctgtccatcttgtccttagcagtcatttagtccctaacctgactttgtgttgttataaagttgtgtcacttaagtagtacttaagtaagtacatacctacatccatactatctttccatttcctgcatcactgagttggacaaatgtgcccagttagcgttggtagtgctgaagaccatgttcattcatacatgcactcaaaatcatattaattacttttcagtgataaccataggtggcaacagatgaatgggctagccctaggctattattaagcactgggaatgagattgttggtgccttgtacctgtgctactttaacaggtgagacaattccagagctttccccatcatcctctcgttgctacagtctagacattgggagcactggaagcctatggtgacacagactggcagatgccttgggcttctaatggtgtatatgtaagccatcattttgtttgtaataattatggtgttgagaagcatttgtgtgctgtgcactctttcagcttgtgccacgtttagttcctgttatgcaaataccactttaaacttagaaattccaatttgcattaatattttggtttcatagagctaactattgcatttcacaaacaagtgcattttaatgagtaccggcagaatgatttaaaaatgttatttattaaatactattgtagaaaatgcagtctttggttgccagaaactattaagacgaaatataatgtgtgttgaggccacagagtacacctcttcaagagtatttgacccttatggctttcagtgatacaacagccaatgctcttcatgcaggcttggagggcagaggtaattaatataaaatagaagccagcgtaccattgacgtttgggtttacttttaaaatgtaaacatatttttactatttgacatttgtcataagaccataggtcatttacctctgagttaaggtgaaggactttaccagtcataaacacccaagttttaaagcagtgttttcttatatcttacatcttgatgttaaatcctgaaatggagtttgttgctgctttataatttttttccctcttcctaaaagcctttttttaaatcagaattgtggataaaaaaattttgatgtacaatgtgtgggaaaataaaaattttgcaactggattttcagaaatgaactattttaacacatggactttgaatgctgctgtcatggttgtcatagcttgtggttcctaattataatgagcttttttggtggtgttattgcagttgttttattccccctgcccccacccagtcttcaactcacttttcccagaaggagagttccaagcctttgaaaattctcatgattttgcaaatccactctatttttgtctagaatacaggaaagttaaaactgtggctggtatgatgccatgttttgaatccaattttaaagcaaccctttgcaacccagggagtaaagctgacatctttgtatctgtaatgaagataattatacctgcaaggtgacatcactagcaaagtaacaaatacccttgaaaacggagttcctggtcttctctgaattctgtagaccacatttggcatttaacaccagacacctctttcatgcctgtcgtttgagaagttgctttcagatgaatttactaaagctgactgacacagggttaaattaattcttttctttattactcaaagtgatacagacctttcttggactaatgtagcttaattagtggtcaattaaaactgaacattgctgaattgaagttctttgatcaaactccctggcatgggcttgctttctttaactagccaccatcttgaattcatttggaatcagtagtataaacaagttaaaaactggttcttttataagaaagtcagcaggcttgtatagctgtggtttctttttttacttctgtaggcggcaattcaaaggcatgctaaatgaaaacagtactacaccctgaaaaaattacatttttaaaagtaacactaagcagtcagaaaacagtcaacacccttacctgtttattctagatacatttatcttctatgtagaacaaataattaataattcacttcccaatttcagtggttgattttgttgttacatggaaggtgaaaactccccaccctcccttgcaaagtctatagttataacaaaaagtgaagcaaacaaaatccaacctggttgttgggagtagagtcggaaggggcacggtaaatgaaggtgtgcccagttgctcctaaattcattctttgtcactcttgggaaaatagttcacctctgtatctttggagtgggagtgacacactacttcatttacttattgatttcatcatttattttgaagggcattatcctatcagtatggaaactgataatagcatatatttcatatgaatcacttgattaaaaatacacattgcttttgttagaatttgggtgaagttacaaaaaaagagaattaggggagctgaaaactggggcagaggaaatcgtaagcattggtaataagatcacccacctccatttatccagttacatgtcttaatatttaaagtgtatataccattcttgtctaaacataaattgataccattccgtaatcctagtttttgaaagcttaacaaccaaaaacatacatcctagctggcattcagttagtgctgtgcattctggagtattaattgaaactggtacttttgtactggaaataaaagtaatagattaggtttaaatagataatttgcttagttcatagtgatttcttctggtttttggaaattttcacagagaaagagttaaaggaaatttggaagtgaccatgtacagtgttccccctgtaagtgacagaatttttgtggttttcattacttagatcgaaaaattgtagttataatcaataattaaaattaaaaattttaccagttgacagaaagagaaattgtttatagtcaatgtgcctttcagccttctctcttgccttctccctaaaaggctgattaggatgtaataattggggatgatagcgggaggaagacgacaattccatttaattaaagataatttattttacttcaaattggtgatgtcccacatgaataagagtagctttagcagatagatttattaatgggtactgacatctcagttgacagaaaaagcaaacattttctttcctcattgtttttattgtgtcccgtcacctgaaactgctgtcaccatgcttcctttgctgcttgacagagctgtagacttttccaccaaatatgcaattattggtttatcattgaaacaaagttgatcctcttctgagttaaaaactaggccaggagcttgaaaggcggttcaggctttcagagctaatgctacaaatgctctcttcttaaatcacattttctcaactgatccttcccatatctagttcatgagtagattgaaccttttgaataaggaccaaagatttcctttggtcttgggtgaggtgcttgcatgaatattcctttaataccttgaatgtcttggataatgaaatgtgccccaaaaaactaccatttgcattacttaggttcattcctgacaaggaattctgccctcgtgtgatatgttcgttgttgtctcatgcaatcgtaaatggatcttggaagttgggacagttttttttaattaggaagtagattcaagaaatgcatgatattgtttttcatataatctcctcagtctatagtggttgtaaaggtgtgctgtttagcatacctttagcaaaactgtatttataattctatgtatcttaaggcactttttaaatgcttctgacaaactgcattctgtttttccaatgtctatttgatctctgttacattaggcttatttgtcttactctcacatcgaattcctatatttttgtttatgttttctggtgttcagtcatttctgtatgcttgcctagtatgtttctttcataccgtcttcttcactgaatgaaatgcagaccaccttggccacttccttccttctgggcttcttttcctattcacaacttccgccattcacactgaccctctagctttacttatatctattgctcctgctgctttgttgctctaattttcatatatatttcctttatgctaatatcctttccttaactctttggatttcactggtttgtctttccagctttatttagaaaattaggccatataactaatgtttacaccgtagaaaggaaaatgagattctttctttcttttttggaagtgaagaggtgagaaggttgtggtagaggttttcttttattttaaaccagatggatttattttgtcctgctttgctatttcactatttcaaattgattttaaatcagtgatggtgttttcaaggattaatttttattaaatcttgattttcatgtcgtgttaaccttttccttcccctcagccaaagggtcttcttccttttttctgtccatttcacttgtttgttttaataacctgatctctccagccattattttatcctcaaatcctgccacttttatccatctttttttattgcactgttgtccttacttcaccttatatcttttcttcttctgtaattattacagaatccatgataccttctccaaaattctaacaaagaattctggaaaaggagaaattgggaaagagaaaaattgcaagtaatgttctttgctgagccctaggaagtctgcttggatttttatattcgactgatattcctccctagagttgcagtcatgattctatgtagtagggacacgaaggcaaaagtttaaatagactaacactgacccttaattggaggtgataatcctacatataaactttcaggagggaaagcgatcctgcattttacatcaggtaaactcagttgcacccattgccagtagctgggtcaggtgtgtaggggtgtgtgtgtgtgtgtgtgtgtgtgtgtgtgtgtgtgtgtgtacgtactgggagccaggttggaagtaggaagagaaggaggttcttctttcctctcccacttgcaagctattttctttcttttctgtctgttttcattatttctatggcaagtttacttgccacgtcttaaacaccttcaacctttttgtctcttcctttacttttttgctttactgctatcaaagagttaaggaagtccattaaattggaggccattcctcaccataagagaaatctggatgggatgcttttgacaactgggctctctttagtagcttctctctacttgggaaaatgtcagatattttgagaaataaatgcattgccccaaactgaaaacaccacttttattctgtaaaagaggcattcagggaaggagacctcctctattcccaggaggtcacaggaactgggagtggcaagaaggaagctgctaaacgggctccagatgcagctttatccaggggacgcctcatgcctggtcatttgggtggctgggcttgtcccacctccccttcttcatgccctcctcccggtctcatcctaggccctcccacccctaggccagccacaggcctcacagcggacatctgcgggtctgagtttcatatatccagcatgaagttccctctctccctcccattatgaattctgggctgtggtcctgcttgctccttgtgtgtcagattgaagttctgatgctgtcagccatgtctgaccaatcagcaaacaacaccacaggatgaaatttaaacaatgcagatgctcagatacagggctatgttgcctggaccacgaagggaaagcagaggtaaggtcagagtctccccaaagtggtctatcctgagcctgcctgacttgacacctcttgggctgcactgtgctgctttgacttgtatgttacccatttgctttgcactacttctgtcttccctggcattcaccagaactttcattttaattcgctctgcccgggttactttaccaccttcatctgctcacgtccttttcttttggattggtgctgactgtcattacgaatgttcctggattgcctcgtggccgagggtccttggcaagtgccaccttgttcaggtcttttgtggccagacttttaggaatagaggactgctgaggatcagggcaaacggacggagttaataggccttattaattttccctctgcaggacagtggaatttatcattcggttacaaccacggttttgtttcttaccattgtgatgtattgaattgtaaattgagcttaaatcatctttttttctcagaaacggtttacttagaaaagatataaatagatacaacctaaacgaggatgaatcagctcatcttccaagagttttggagggggagaaagggaattgataactctcccccacccgaatccccccccacttttttttttttttttttttttttacagtttttggtgttagctcactagattactgtttgcaaaagaagaatctcatcatcatcctcttctgttttaagtgtttacttggcccttttataatttaaagtgtttacacggttctgtgctccctaggcccatctggaaaatatttaaacttcataagatctataagactagaatatcacatataatgggatagggggaaggaagaaaaattagagccgttgcgtgtgtttagaataagttagttgtttgttcagaagcggctgctggaggaattggaacaaatagctgtgtgcggtgaacgattgggtccagagctgtacatttcaccacagaatgagccttggtttgtgaaactgacattctgttgtgacttctaaatccaaacaaatctctgcaaatttctgcccgatcgagttaataagaaaatatatacatgcagaggcgagagccgtatgctacttgtacttctgtcagtgttggtggaaataagagacggattttacctactgtattacattcaaccagcaattggcagaacccccagctcagcgggttttcttgacttttttttctgctgtgagaacaatgggatgcaaaagggcttcagaaaaggagagcagcagatacgggattggggtcacttttcttctaattgccttgtaattggggagtggtttccactttcccactatctcactggtgggaggggaggaagacagatgtggcttagcggtaacgagctttctccaggccggatgtgctgagggaccaggggggtcattccctgctctgggcctgtgatctgcttcacacctgtgctcattttcccccatgatcgatgaccttgtattaacccagagtgaccttttgccttcgcctgttctctgggacgagctcttggctagtggaccctcctttctctctgatttacaggtggttactggagccacatacacttgtttttcatggtgcactgtgcacttagcagcccggcaagacctgcaatttcatccctctcaaggggccaagcaggggattggaaggtgggagggaggagggtgccgcgagagtggttgctgtttgcatgtgcttttctattttgtggctcatatggtatcaattaccatttgatggcaacgccaggcctgaggcccttcgcatgtttgtcctgtgagaaagatctggaagaaccgacatatggttttgattgcagcaattgcaggttgatagaatgaacgcaggggtgaggtgggtgggttttccttccggccctttccactctgggttgctaatgtgcttcgcttgtggaactggtcttttcatcatccagcccctcccccacttacccctcccccacccccaactccctgccactttgcattccctgcccctgccttccaaatgaccgccaggaacatgtggcccacattaaggaccttcaattaaaacaaacaaaaaattgtccactcttctgttcagtcccagagcaggtcagtccatcaagatggttggaagtgtaccacagttaagaaacaaatggttggcatagggggcagattccctccagaagcttgggacatgttttaaaatggctgttagttcagattgttaaacatcgaaatgatgctgaaaaatagcagcaatagagattaatgtggggtgtgtgtgtgtgtgtgtgtgtgtgtatatctgtatgtgtgtgtatttcatttaagacacctcttggaatctgtgcatctgctgcatagggacaggaagatgatgataatggataggagttctttggggttccatctttctgtacatcccaggccataagatgatggaaaagcaagtgaggcatgtgtgtctctatgagcatttcccttcagaaggaagatgttggagactcatctcccatgcacagtgacttctctcttactaaatttgtgatggtagggggtactcctcattactgtggctcagcagggattgcatctgtgaatatgccaagggagggtctactattggggaatggtgagaggcaaagaggagaaaagaacattataggcactttgaatgttacccagcaacattttttttgttgtttcaaagtaacatctttctataatgctttcaaatttacctgtctggtaatctgttctaagatgggcagcccatgaggttttgacttttttcactttggctattgcatttcaaaatattactcacaattaggaatttataccatttgaaacaataatgtggtatctcatgagtaaatgctgccattaacatcttccttcttttaaactgaaaacaagcaaaccagacccaaaaaaaaaaaaaaaaaagcagaaacatgctcccccaagaaagcttgtttttttctttgagatggagtctcgctctgttgcccaggttggagtgcaatggtgcgatctcgactcactgcaacctccacctcccaggttcaagcgattctcctgtctcagcctcccaagtagctaggattacaggtgtccaccaccacacctggctaattttttgtatttttagtagagatgaggtttcaccatgttggccaggctggtttcaaactcctgacctcaagtgatccgcccacctcggcctcccaaagtgctgggattataggcgtgagccaccacacctggccaagaaagttttttaaatgtgagatgaatttttagttttgaaggccagctattgaaacctaatcacactgcttgacatacttcttcatatttatctttatattagagctgatctttatcaaaaggtagtagaaactaaaaaacttaagttattgacctaaattgtagggaaatgtctgtctgatcgactctagagagaaaattggccgtatctttataatggttactgaatgtatatcttcatgaggctacagtttttttttctttgctccaactttctccttatgatgtagagattggtgtattaaataatcactttttcaacagtcttgatgacaattttattttgctatttcataatcttcatacaatgggataagtgttttcagagatacgtttgaattcagagcaactggcaattaagtgatttgctctagtcacatgttttagtagtagctatttggttatttgcctgatatttaatgcacacatatgtacccttaaatcatcattcagtgtgatagcttaagacaacatttctgtttgctgctcatgccactattagctacgtttgaagagtgatatactgagaagtttaatttgctggggtttttttctaaaaacattgctttcctgaaatatatagtattgggggctcatagcaaaaaaaccgtagtatatgggttgtgagcctgtcttcgaacatggtgggtcacttaacagcagctgtgctggagagatatttgatttgagaagactgttttgaatcttctcagccctaacaccattctggttttgaaatgggaaaatggaaaagagttttagggaatagagatatctcagccttgaaaggaagcataggtagaaatctttcagttctcactcagatgaaccagcattcctaatctggctaccctcacagaggacaaagagtctgctgggaaatgtgggtttatatttgtagagacacacttcagaggcatgagatagtgttagataccgactggatgcttcgtgcccaacatcaatttggtttgcagattgaaatttaggaaagcttgcagaggagccaatcttttttatatacagcacctttaaaaaaaagactgtccactactattaaaatctgattcagtcttctaaaatattactacattcaagacaacttttaaaatgatcaaatttagatagacatcaatgatgttaaaagataaaagccctcctacatgtaatatatagtgtcttaaaccttattttttaaaaaagggataccacttttgccaaaagtttcaatgtagggatactcaaactgtccttggaagtcctaaaaattgctagttttttttttgtttgcttctttttttgttgtttttgttttttgtttgtagttattcacaaatggagaaatatttataaaattatattataatttgtaatgcacgcaaacaaccatcagaccacacttgaatcagagagttacagttataaattgaggaaagaggatgccagcacaatgcctaatggagtgaaaaattgtgcttattttcacaggactctcttggagaggagctaactactttcctctctcttaatacccagaccctctccctcagccctgacagcacgttacagaatgcattcacttagtgtgtgaagagctagctcaccacctccctttaagatctattcttgttattcatacattgcaaatttgtacttttgtatccacaaggaagacattactaacttcaagaaaggcagtgtcaatgaggagcaggaaaatacagtatgatacaagcctgccaatgaaagaattatactcagactctatgcgctctgttaaacaaaatttgaacctttgaggaaaaaatattggggattctgatgagtgtttttactctttctttcctttttttttttttttctatttggaaatcatggcttcctgatcctaagggataaaaaaaaaaaaaaaaaaaaaaacctcaaagaaaagactcaacaggctttctggacatcaaatagttcctacaaaacaacattctgatgacttgcatgtaaagaaatcagaaacatatgaattaagcttctctcgaaatacatatgggttgaaaaatagagagaagtgctgagaaaatgtgttttgggttttgctgagcccatgacgtttgaaaaatagtatgagacattgaacaaacacaaagcatggcttggctcacccattcctaatattagccttctagttcaacggcaaatcagtttaccatgtgcctaaatgtgagccaccttggtgcactcccccacacttaattatatgcagtttaaattttttcaattaggagctcaaaaataacattgcatttcaaggaaatgcaaatcttagcattttcttacctggtttgttcacctcagaccattttagaaaacaccacagattatttcaccttaggagcagtcacactgatgtggccctctttgatgtggctggcatataacagaagaaacgtatcatttttaagaaactggctccaaagacaatattgctattaaattgaagccaaaaaccactgcaggtaaaacatgatgaagatgaaggacgccctctcttagccatatagtagaagcccgatcatagactctcacccttacaccatgacttgagttcctgctcatttttatccctgagctctgcagacttctaagcagtggaagttttcattctctttcccacattgcactcaagagagctaacatgagagattctaaatcctgggattcctctgcatctggctttaagtacaggagcagaacacagggaatttaaggaacaaaaatagccagagcttcaggcttcttccactgatggtaagtcattgacatgcacttggatgaaatcctgtatctgttctttggactagcactatcgcctgagattatcagtttcagagagttacagagaggcagtagatttcatctttcctatttcaggaggagttattttggttgtttaaaaaaaaaaaaaacactttaatgtacttttcctaactccttcactcagatggtggcaagaagtttgacagaataaagtaattcagctaatatttatcaaatgcctactatgagtgagctgttagaatataaccctgaacaagacaagcatgagataggcaaacagactattaaaacctagactgataatgcattgattggggtgtacaggctccttaaggtagatatacaaaggacaactagtccacatttggccttagaggaagtgaagtgcaaggatgaatgggaattaagctggcaaaatgcaagggttataactggaagcaggggtgagcatggcatatccggtgacccagaagtagttcagaatgccagaagcttatggtacaaaaggataacataaaagatgagactgaaaaggtaaacagtggcctgatcaaaaagcgacttgtgagccctattaaggagttgagattttatcatgaatgtgacgaggagcctttcaaatgggtatgcctgagaagtaattgaatttaaaagtcaagacggataggaggacctggaaaacttagagtcagagaagccaagggaggcagatctgaccagaaggaggaaattgtcaacagtgtcagatgttgctgaaagatagaagtgacatttggctgcagcatccaggaggtcttgagcagtttcattgaagtagtgagtgtggaaggaaggtaaagaagtggagaacaggcattgcaagataattttccatcatcgtcatcatcatcgtcctcatcaccggaaaatgagcatcaattatcttatctaccagacatagagagtgaccaggtaaggaatgacacacctgcagcctgggagatttcagaaaacagatcataaatataaaacagaagacagcaacacatggtacaacacatgcaaagggcaaaatgagcagtgtaggccaacgggatgaagaacagaaagaattagggggcaggtgaaatgggagagtttttcaagcagtcagtgcgcttgaggtttgcattctggattgtgcctccttataagtcagtccaacctgtttttgattctccatccagtggaaataggaaacaccatcaaagatgatgcatagtcttaacttgcctgtgacttctgattatgtttccgaattttgggaggaagattaaagtcataaactgactcttggtttgttataatttcttgcaactgttattttaaaaatccggacacaggccaaggcaggaggattctctgaggccaggagtttgagaccagcctgggcaacatagtgagaccctgtccctacaataataaaagtaaaataaaaagaaaatctggatgcagaaactgaggtgtagataaatatagcaagtcagagatattcgtaaattctacatcgatgagtttcttgagaaattctgcacacccagtgctggacaactgtggaattgcagcgtgatacctttcacatctgggtcatctccatatgatatcttcttcctggtacaaggccagaagttcaccccacgcacaacacctatggaagccacttacgattcaaaggacagtttttctgaaaaagggtgcatgatgtatacttcccttcaacactaaaattctgctgcttaaactttgtaagtgaaggaaaggactggttctcttctactttggctgtcttccttgtttcctatttattgggtgcttgctttgggcaacccattgtattggatgtgctctaaaccacaatctttgctcctaaggagtccgtagtatttatcgggggatacgacctggataattcatataagatatgaatttctttctttttcttttttttctttttttttgagacagattctcactctgtcgcccaggctggagtgcagtggcgcgatcacggctcactgcaacctccgtctcctgggttcaagcaattctcatgcctcagccccccaagtagctgggattacaggcacccaccaccatactcagctaatttttgtatttttagtagagatggagtttcaccgtgttggccaggctggtcttgaattcctgacctcaagtgatccgcccacctcggcctcccaaagtcctgggattacaggcgtgaaccacaatgcctggccaagatatgaattctaaaaaaaaaaaaaaaaaaaaaaaaaaaaaaaagtccttggaaagtttagaagatgaaatacatttaatgaaaattgagctcattcttccccaatatttgttccatattcctctccatattatactattagtacacaatcctgtttggacttactggaaaaaagagctgaatagcttatccacatgtcaagaaactttctgtttaagaacactgaggttcatcaacatcaaaaaatattttcagcatcattcaggcactggacatgctctacaaattaaataccttagggcccctactatttcagtgttttctcagtgtcttgttgcagtggcaaatgctatgaactacatttttcaaatgaatattgaagattgagaaagaggttaagaacctctatctattaacgatagaaccaaatctagaaagatgtctcctgctctgtagagcacattagggatcattatttatagccatttggctctcttaagacattttggcaatgagggaaaaatcataggttgattttcttggtggaatgaagaacattgagtttgctaacaaagagagcatgagtgactttggtaagagagcagtttttatttcagtggaaaggcagcctcctctcctaataatagctacattatttacctaaatgttccatgtagcaactgataacaaggcttactgcttaagaaatttggccatcatcttgtcctctctactagaattccatctgcctacagatgggcccttgctaatattttttttctgaaggacaacatgtaacttaagggcccactactgtgtgttattttgtttttttaattgaggtgaaagtcacataatgtaaaattaaccattttgaagtaaaccattcagtaatatttagtacattcacaatgttgagcagtcaccacatctgtctagttctaaaacattttccccagcccagaaggaaactctgtatccattaagcagttccttcctatccccctacttctaggctttataaacctttaattttaatgttatatacacacacaggcatacacatacatatatgctatacacacatatgtatgtatatatgtataatgtgtgtaaataatgtgtaaatatagacgtataaagatgtataatgtgggtaaataaatggatgtgtgtatgtgtatatacatatatgtacatgtatacatatatacgtatatatgtatacatatatgtatctacgcacatgtatatacgtgtatacacacacacacacacattcatgtctatttatagattaggaagttccaaacagaggacctaatatttcctaattatgtaaacaaagaactatctactttaatgaatgtttctccaccaggaaaaagaaaaataggaaacattccttgcttcttttaacctgtctgtatatttctcttaaattctcactagatgctaatttatcaaggaagacaaaaaagacagaaataatcctgagccttttgttgtgtaaaactgctgctcttcttgtaaagacattttctcattaatttcatcaacactgagaattttaaactgcttctcaattttaagcaattgtatgggttttacatttctatttttgaaaatccaaaattattgaacaaagtaatttagttagcaaagtttacatttcttggaaagaaatatgaaagggtcattcttactataatttttattgttaaagaaattgctgttgttcacatgtatttatgccctcctcattccggaagaatatttgaggtagccagtagcacatttttttgaattaagaaaaaattagatcaaatgaaaaaatacctaaaatttaaatatttagagaaagccaactcaattatattttaaatatgcctgaagtcgtgaactaactaatgttgatcatttagtcttctggtcctatctcaggaatattattgcccttcttaattcatctttcacctcctttaagaagtatttctgaataaccctataggataacttcctttacatttctttagctcatatggtttatacaaaaggctactcactttatcacattttctagttgcttattgtacttcataaatctcccaactagttcctagtgaaaattctgcccttctaattttttgtatgtaatttaccaaagcacctagctttgtgctagctaaaagctctgctctgagttaaattagtgaaatattgctggttgatttcacctaaaagtttgccccgggcaggagggaagagggtgggcatttgaatgggtaacagacagagaagcagctgattggacatagatgttgacaacttgcatacttatttttttcatttcaatctgtgccacagagtcatacatttggtaattatttcatgcttttgttttcagttgaaagtagttagggccatatgttttgacagaaaaaagataattcgtactttttttcagctttatgaaagggaagatggggtaacaattttacagtgtaccatggcagtgattcctgttcaaaactttaccagattggaaactcactgttcataacaattctcttggtaagcagaagatgaaggcatctgtttaaagcacccagagttaagtttgatgcttcaaagcacagcagagttcatttataactctacttagcactattagatatctttaacaaatatgaaaagttgtccaccagattccttagactgtaggtgatttggaaggatattctggtcaagtgctaacttctgactgaggatttcaaatgaaaagacctaggttataaccccattcctgcccttactctgtcttgtgactcatggaaaaggaaggcacttaacccgctccaagcttatgttcctgaatgtataagatgggtagcatggttgaccacttagacagataatccatctcaaaatgatgattaaagaagataatggatgagaaaagtccttttgatttaaaatactatgaagatgtgaacttttaataatgactaatgatagaattttgtcaaatttgctttacgtaattaagttcaagatcaaagaatatatctagagaagtacctatgtattttgtgaaatgtttctttgagtattattattatcattttatgtctgttagaatcttggcctcactgtcttttcattcttgcttgaatgtcgactcttcaaagtgtgactttctgcttgtgtctgatgcaactttcttcctgatcgctcttgcttcctgagaaggaataggtacttaggaatgatggctttttggctgtctgtgcttattaggtacaaacacagcactaaagacatttgggactggagaaataagaagagcgcctttagggttgtatgcaaaaggtcaaactataatgtagttagcatttttctttgtactgctttcccttcttgtaacaacctctcaataccctcataccttctctgctttccagaaatgctttctaaaaattgattattgggaaaagatctgagacctcattgccctgaagtgtaattactgctgacaaactgtgacagcatttcccaaagacagggagtgattggagatgtgatgaaaagtgggtttgtgactgtggaaactctttcagggatgtaggcttttacccctcttggtaatgtaccttgacaaaagtctgcagcaatgaaattaacttgttcactccaatcgcatctaaagttatttgagcttaagtcctttcttaaggatgtcagctttaggcttcaggcatcaacctgtggactagaattcaaagggaaaagggtagggaatggtgctcttaaaatctttaggaccattataggtaattccatatcctaaagaaagctcagccctaaacacattagagaagtggaatgcactaaaatatattttggcagaaccaatgaatgtttatctttctctgtgttatgatgttattcttagtttgacgtgtatcccatgtgtggtgtgtttattcattcatgcatgcatgcacttagtaaagttttgagcctattctgtgcccggcattacatgcacacacacatatgtccaagcacacctgcacatttttttttttttggtaatgccttttttaccttattgtttctgcaactggctatccttagcaggccttcttaatgtacaatagggtatagaagaaataacaatcaacattggagtaaacctaaaattaatttctgtctttattgtagagtcatagaatttgttttcctctggaagatgtgctgccctcatttaattgataaaacagtgctttcagaggtcacaaagctattttttggcagatataaccaaacctattttgatgttccagcacctcctaatgaagcagtagtcgtcatctaaaacaaaaagcagtcggttgctaaaggaggagaaagtgttgagatgtgagatgatctgttagacataattgacaatcatgaatttgatatgataggtgtaaacagagatagaaataatttagttacatctgtttaagatttaagataaccagaagcaataatgtttaattgaaataatatatcaggttctccttaacattaccttgaatttcttcacatgcacatcaatgcatttggtaaataaaagtttggaaacaacttagttaagtgtttagaacatattagagttgtgatgtgcttagcatccgcagtcttttatctgtgccaaccctgagcctggtaatgaagccaactcccacatgaataagtaacataaggagtgtaaccaggaagaagtcagggtttcacctggaccaaattttaggcaattaagtgtttcaagagatctttagccaggtgtaacttaatcagtttaaggcactctcagctagggccaaggtactcataatgttggcagtgggcattcgtctgatacaccacgttgaaagtaataggaaacatagagtgtctgctcagttattgccaagagcaagagaaatgcaggtgtaaaaatataaagaagtatttggagccagaggctagtacacatagacaagactgtatttacacttggctttaatagttcagataataacatggtggtttttaatcagtttagtgtgctgatatttagtcgtgggtctggtttcaccactaaaccctagtgtaactctcagccggttacttagcctctctctgtctctagtaatattaaacaagtgtattaatacctgctgcatcttagctcaacttcatgtctggaagacagatgaatggtcctgcttcttgcagtaacacacaagaacctcctttgtgctgccctgactgagatgatcttgtgttcttctctacgggcaaaacagccctaggctgctaaatggccaggcagtataggggacttaggactctacaaagctgggttttggtaggagtccatgagcaccgcggagagaattcttagttatcaggagatacggttgtagtacttaaaaactcaaactccaaaacaagactacgtggttttgaatctcagttttgccagtttattagctgtgtgactttaagcaagttgcttaacctctctgtgcctcagatcccttagccataaaattgggatgatcatgcaacaataggattagtatgtaagcaaaatgagtatatgtacagtttggctgcaatagagctgataggtgtaaacagatataaataatgacttcttttctgaaaatgacttcttttctgtttttctcgttggtgatccctgcttatgtcactgggatggctgcgggaattcagtaggataatattggaaaatagcttaaatctcaaatgttctatagctatgataacatcactatgacgtcatagcagagtgagtccactcacatctctcctggcagttttgctgcctcagagttggaataataactcactgaaaatacttccaaaatagtgagccactctgcagatttaatttgtaatattattctttctaattattagtggctctgtcttaagttcctttgttttaattgaagcagggttttttttcccccttgtaaatttctatacatgtcaaaggctaccaactcatttttatttagagtttgaaatttgatttgaaaaatatactgcagccagctatatgaaaaacataagaggatattgttgacttttgatgaagggaagaaagaacaaggtagagctgcctagccatgaagaacgccagggtttttgtaacccctggtgtgctttgcacgcagaaggcacacacttaaattggcatggctcactttttttactgtgcctttgctgagcttgctgcaggctgagtgcactggtagaggagtgcagggctgtgttctggccatccctgcctgctcaggcctctcctgctcctttgtggatcgcccaggtctctgctgcttcctggtgccgtctcctggatcctcttgacatttttccgttctgtaatttgattgacagttacagacaaggaaggggactgaaattcttaccgttttgtgacttcctaaaacgggaaaggaaatttggtgaatgagaaggggaaaacgcctcttggctgaaattatttacaggatttagccccaggtttaatgtactcatgaatgaataatgactcagctgatatttagaagccgggaaaattatgcgatttttgtgatggggtgtatagatatggatgtatacttgaagtggtttgtgttctaaatatattaacatgctcagggaatttctttttggggaaatacatatattctttttcatagatttttgtggtgcattctggtagacggaagatgggtcattgctcagttagtaaaaatgaaatatgaatatcatacacataagtggtacattttacactttttgatagttgtgaaatactctttttttttcagactaccaataaagagaatttgaggagtaaaactcttcttaccatgaattgttttggggcacttagaactatttagttaattcttttaaatactccaactgatttagatagaataaaagtgtcacaattttaacagcttacaccagtgaaatgtttccacttataagaaataccctcttatttgtcagcatactgaagacatatatgtgttatttctaagcacatttcctatttatgtgataatggagatcgccctttaaccatcacttggacgtgaaggaggattcttcttcctccattagtaaatattccttgacttgataatactgaaaatatgtgaggtgaatgagctttaatcctgtggtttggtttggtttttggttgtttgcagtcttggactgttcacctgcactgtcttgtgcctttgagtatgattaactgccttgacgccttacagtgcattacacaactctacttcttccatttcttgactaatctctcatgctgtttgactgcccattggaatctttaagttagctacttaggaaagactttaggaaggagaatgctaagagaactggcagagaagtcaggagcctgggctctgtccaggccctggcgtaagtcctttcacctcttcctttgactcctttacaaaatgaagttgaactcattcgagctttaaaaagatgacgccaagaggcaagacagagggcagtagatgtgaaagtaacatgaaagagaaaggaacatctgaaaaaaaaaaaaaggtagaaaaagattttgacaaatagtactaaaaacaaagaatatagaatagagagacccaattatactgataattacaattatcagtattgtaaaaactacagcaaaaaagctaaaaacatattcagcttttattgtccataaaaagtgatcacaccatgtctaactgtaattcgtttgtcaaaaacactagaggccaaggactaaattgcggattaagagtttcttccttttatttcctgcatatccagaaacctggggtcatagatactcttccatggtgtgttgtttggcacaacttgcaagtattttggcagatggttagaaaaaaagactttaagaaatatgcaatagtactcaggactctaaatataataaataaagctaagataccagtatcctgccattcattacaatcaacatttattgaacagcagttatatgccaggtagcagggatacctagaacttgcccctcccactagcactccagaagagttcctgctttcccagcctaaagcaacagcaagtcttacatgagctaggcttactgtgatagctgtcctgacggcgagtggcaaacatggcccagtgccttcctcatggatgaacatgactctacactgggactccccggtagacctttttgtgatgatgagaaagtcctgtgttggtgatgttcagtatggtaactagtgactgtatgtgctgttgagaacttgaaatatggctactgtgactgagggacagaacatttaattttatttaactttggttgagtttaattcaaataactacatattactaatggctactgattggacagcagctttctagacccattgttaaaaataattataagcaatgagtacctcttatgagatagaattaataatcccatttattgagggcccatgacagattaagaattatgtttgacatatattatccctaatcctcacaagaatggttcatttgacaaataagataactgaagttctgagagataaattgctttgttatgtcctcgcaaggaattgtgagagctggaatttgaacctaattggtcagactccagagctgggtgatttctagtaatctgccaaatctgtgtatgtactgtccggatgctgtgtcttctgagtacatcttctccttgctttatggattagttagcaatgtctttatcttggtcacataggacagttacagggtccatcttatctcttctgaatatggacgtatcactgcactggaaccattcatttttcttactgaggcctatgtccttcaaaaaatattaagagttgagggtccaacccagcttcttgagtagtaagctaatcacctacaagtatatttccccagtagatgctgagagaagcatcaaagtacatgggtagttctgtggacatcagtggcactcagtaaactcttggcatttgagtgtttaactgtcacagttgaggatatctgtgaactctcccaaggcctgagtcactgaatgagcccagccagtacttgggcgtctgtggctccattctgctttgctgttttctgctttccatggaacatacagtaactctcttgaagggtctgaaagcctcaattacaacgtttcagtgattctgaactgatttttctttggaaagtatatatgcagatggtacttgcagaatcaccagggggtagtaacgtggaggagtggtaaaggtctactggacaatcaggtggctaccacccaaccacacatggtgatgtgatatgaagccacttttctttattccttcagatttaaggtttccccttcaggaagcaggttacttaacaagtacttgatttcaccataacatgcattatgacattatctttttttcttttttcttttttttttttgagacggaatcttgccctgtcgcccaggctggagtgcaatggcacgatctcggctcactgcaacctccttctcccaggttcaagcaattctcctgcctcagcctcctgagtagctgggattacaggtgcatgccgccacacctggctaattttttgtatctttggtggagatggggtttcaccatgttggccaggctggtctcgaactcctgacttcgttatccacccacctcaacctcccaaagtgctgggattacacgcatgagccaccgttcctggccgatattttattttcttaaaaggtcattatcagatgccacaagagtatttctataaactatgacccaagtatagcctaatgttaatagcttaaaataggttttatttaccttttttgccctttaaaagcaaggaattattttttaatggaaagaacatagactttgatgatcagttcacatccttgctttaccccttgaaaaatgtgcaacctggaaagacagcttaacattcctgagtcacatttgtccaaataatacaaacaatggcaacaagacttcagcactaatgtctgatgttttttgtatgattaatctgtgccaggttccattctagtttctttacacacattataccatctaattctcacaacaactttgcatagcaggcattgtcatttccactttacaagcaggaatctgaggaccagagttaaaagtaactggtccaagattgcctagttaataaatggtggaatttgcagtcagacccaagctggtttgggccaatacacttgaccttcttatgatacgtcagccttgtgaaatagggcagatactattaataatatccaccttgtgtgatcattatgaaggttagatataatgtatgtggaactcttgccaccaaagtggttccacaagaggccctaaacaaatgagtaatcattattattttaaaatgtccgtaagtgaaaccgatatgccaagaccagtaaaaatgagagcttcttaaggaaaagagtaggaggcatacctttgtttcattttgtttgttggtttctgtgcttgctttttgttcttttctgttaggcacaggttttatttagaataaattaaatttttttttctttgatgagtgcagaaataatagttggaaacattgaatggaacagctaatgtaccatagtaatacttcttggattaccaaaaaaaaaaaaaattaaatctgtaaaatgaaaacatttttgtttactttggtcagttcaaggttcagtgttatctagagatttttgttaaactcaggatttctatatgtatgattgtctgctaaattcagaattagaagagaagagataatggcgctaactttgcatgttaaatatactgtgttactagttttccatgaagtttttactcaacaaataggttactaaaagagctgtgacctatgagtttcaccaagtctttccatttccaattcggcaacaaaagtttcacacttctcaattactcttgtgggaggaatcagaatgccaacagtcaccttgatctaagcgtattattggagaaaaattcaaggatagatatttgtttctcattagattttcctcatattttatcattggggtcactctagtacatggtactagaatttgggatttttatttcattttagattggactgattttctggtgttagtcattaaaaataattccaactctttgaagagatctgggatgtttgttattattctattgattaaataaagctattttatttaacaattgtgttgttaaactttctatatacttagaataataatactaaaaactgaatgggtatgagcttttcttattgaatttaatgtcagtattaaataccttattgaaacccatactttgaaagcttgattgagaaattggcaaaagagttgactgaagtaaaagtaatgaagcagttcactggtcatccaggttatgaaaaattaaaccattagagataaactgaactgtgaaaattatgatcatggtgttttcataaataccatctatgtctccgccaccattctaaaaaaaagtaccctatcaaatggtgaaaaataagagtgatgtttctgtgaccatttcattattcagttttcttatatttgaaatgtgggaggttgaactaaaatttgttggttcccttctttaaaaaagtatagttatatgtgatatttatttatttatataaacaaaaatatagagatcttaccttgaaaataacttttgaggtaagaatgataaagtatctaaatggaagatgaataacattgtatctgatttgtaaattatgatataaagaaaatgtataaaatatgtagaaattgtctgtataaaaaactataaacagtggtccgttgcctattaacaaagagtttcatgttatctaaaaagtcttcaattggctaaaacagcagaaaaatagaaattacatactataatatatcctaaaaacatttcaattccatagatactcttctccatgcagccaatatttatgaatttggagtaagtgacctactcttagatatttgagcttgattataattcatagtcaaagtagcctccttgtaaataaccaaaattaaccaaagatttttccttatcttccaaaagcaatgccaagtaattctatccaaattggaaaaaaaaaaagaaaaaggataaaccttattaggtgtcatcaaatggtgttgacataatgatatatatgtttaaggataatgtaatagaatatgtaattaaaattaaagtatatatgaaaagaattgattttaattgttttaaaacataagatgatttaataatatgggtcggagattctttttagttttataataaatatattgatttctgaaatttgggtatattccatagtacacttagcttatgttaatactgaggccagattgctgtcaggctaatagcgtgtagatatattatagtcacactacaatcattccgtcagttttcagtttccctttttcctgtgatgtttctttcatcttgttagattattctcaagaccttctctaaataccttcagtagtaattcacaaactctttgttagttaatagttctcaagaaaattctgagatgtggttgacagaacttagatcattggtttgtttttggattcctagccaaagttttattctttgtttcttaaaaatactcaaaaaagttttttttccttattgtaagccctctggaaatagaagcaaatcactgtttatacatttaaaatgtgatgaaaattacaaaataaagtccagtgaaatatagggcttgtatccattagtgccttaagaaaaatccctgttttctgaagtgcgagtgggcttttctggtttgtttttgttttgttaaagctccaggacctcccaattttcaagggcactttggggcatgtgtagcatttatttgatgtatggatgtagatgcatattttcccacatctgtctctgtggacctatcctttgtgaaatcctaaaccttgtattaatgcttagtttatgattcatggtgttctgagagcaattatataatttttctggggtgtttattcgatgtgcactgtaaaaaaaaatgagagttattttttggtaaccctgcacttgcctttttattggtgaatttcttttccttttactgtgacctgtgaatatcactgtaggctcactgccaattttgtgagccgctgcctgcttcaaaatggaggcaggaaggtatccattttcatcaagaggatgacagtgtttcagtctttctgaccatctggagagaggaactttgagagcaaaagaaaatggggattaaaaaaaattatatttagcagaaaaggcaagggggaaaaccaattaaagttaaactataccttatgaatttgtgcttttctactatgctgtcctgtttaaaaaaaacataaacaagaaaatacacaggctatttgtataaagaattggtttcccaagtctcatgagtattagtaaatgaatgtaagtaaattaggtttttggcacactttttaagtttattgtacacacaaatataataagcatgaaaaaggagggctccctcctcccgcttcctatgcacacactgattgttggtggtcttatgtagatccaggcttttaatggcctttttcatgcatctctgcaaaaagctgacactatgggaatttaatattctaagatatatttatcactttctgtggtttggatagttcatttgtgttctctctgtctcccccctccctacctcctctctgtaaaagtgaaaattttaattgaaaggtagagtttttactctaccatttgaaagaggtttgatgcatgtctttctgtttttaccattttcacatgcttatgggccatctgtgtttagaagaaaaagaaagaagtgcttagactcacaggattaccctatgggcattatacagtgtatttacaactagacatggtttacatcaactggaatataacacacctggttattttctgttcgcacaaatacaccgagcttttgtttcgttttgttgtgtttgttttagtgtgttcggaaagggcactgtttctagggtttgttcagatttaaactggaaagggtagaaatgtagcactttctgcctacttcttatataagaatggagcttgggctgctgtggtcaatgcaaaaagcaaaactcagttggttctttctcctcaggtctatgctccatcagcaagcactgccgactacaatagggactcgccaggctatccttcctccaaaccagcaaccagcactttccctagctccttcttcatgcaaggtaagatgctgctgcttctgagggaaaggccactggatagcattttcctgggtcacttaatgtcacagatggggcagaagaaatggaatagtaggcaagtgtagaatttttgaagtcatgctcttcttaggaattgaattccttaaaaattgatgtattaattaaaactgtactaagtctttctttacaattaaacccctttaagcagtaatgggttaagattagattgatctgcttcacttagagccgatgcttatgatggtcttccactcatgaccaaccatttcagcatcttcaccatccccaagacgatgtagctgtttgtttagaagtggttcagctccatgtatgttttgaacatcctggatttagccaactgggaacaagttggcctaatgtataaccttatgtaaaattttcacccacttactaatttgtaggtaagaacaagggtccaagatgaagtaacctaccacagactggaatattacatggtgaaagctctgtcccaacatagtaactggtttaggataaaaggcccaacttttgggggagaagacaaatataggaaattatggaattgtccagtatgtttaaatacatggatgtgtgcccccaccctgagcttgtagtcttgctactgatagcgtatacctttctgctgctcaaaaaagaccaagatgtggccgagtgcggtggctcacgcctgtaatcccaacacttgggaggccaaggcaggcaaatcacaaggtcaggatatcaagaccatcctggccaatatggtgaaaccctgtctgtactaaaaatacaaaaaattagccaggcgtggtggtgggcacctgtagtcccagctactcgggaggctgaggcagaagaatggcatgaacctgggaggcagagcttacagtgagctgagattgcaccactgcactccagcctgggcaacagagcgagactccatctcaaaataaataaataaataaataaacaaacaaataaataaatgaattttttaaaaagaccaagatgtttgaaatgatagcagctacttcaagaatgaaccacttggaggatgcccctaagggctccatcctgatatgtgtgtggcacttattttctaatgtaattatcttgttaccaagttaatgccctgaatttagatgtggaatttaccaagaacccctgtgtgcaaaatgttaactctttttgcccaggtgtgaaaaccttatttgtataagccttgtctacgggccatggggtttccttctttatgcatctctaggaagggccatgtcacaggaaggggagcacatttggggcaaagagtaccagggaagcagcctgatatagtggacacactcaaaatcattctcattaaaagatactaatcttccttcccttcagtgtgttagctcttttagtttgttagttcacgtgtgaaattccatggaaatctataaaattggatggaatggctctgttaggaatagagagaatttgttccacgcataatagagcccgtgtgtcagaagtcctttaactttgtgacccgtcctaggtgtaactcaaagggacacagcaggctatgtcacctgggtgcgttttgtgccgtgacaaaaagctaatcaccttcagttataaacagtagctacctcagcatcagtcccctgttttgtgagcagtgggagatattgtcctacaggagcttacagagattggcaactcaaggatccatcactcaaaacagatttcgattgaaaacattgacggaaggatatattttttctatctgcccaggaaagtggctttctggaagggtgcacattgcaggagaggccaggtagattatatcagtaggctcctttccctagcagaccacacaaaatatggggaacaaatttgtttatctgcatatgcatacccgaaaagcaaaaaaaaaaaaaaaaaattgagttgacatttttgatgagcacaattaatttgcacacatctaattctattctttctttcaaaagaacattatgccaagatcatgggatgtgataaatattaatttactgtgaaaagcataatttatgtaaaatatgtatttttataagtctgcatcaagcagagtactctgtgttaacagtcctaaacgcattgccacccagggtatcacattgtcaggagactcttgtttagtgatatatgttttcaatttatttgtcatatgtgccatctatttaaaatgttagtgatcttgaacttcatatttgaatttaaggtgacatttaaacctctgtaatctaaggactaaagctcaagtacatgaatgataactttaaaaaaaatcatgtgttttcacatgatggccacagaaacagttgcatcatggtcctgtcccacatcagcttcctttcagtagaggggtacttggtgccctgagaattcaagacttgaaggaatatgcaattaaggtgaaagatgttcagaaactgtctggggcatattgtaaactcactactgtggcctcttatttgtaacttcaatttccatcttctagttaaaactctgaagttgtcaaaatcacagacatgattttgcttgcatggttcttaaagagaggaatctgcaaactattcctcccaatatgaaatgagtccagttacaaaattctaacttccggatttaagaactcaatgaaaaagagcttcacgaaatacagtgtcagatttaacttttctattgcctaactttttaataggcctttactatataaaatgttatggtgaaaataatcttattttcaaggaagcaatatctgctatacatttaacagccagctgatggcctagtgtatacctagtactcaatactttttgttaaactattgaaacaaagaaaaaatgaatgaatttagcagtaatgtagatcatcttttcccttaggcttgggaaaccaaacctaaacattagcaatcattaataataacctgtaggccaataggcccagagaatgaaaaaatccgtagggatgtttttaataagaatgttaacaaaaggttaaccttatgttgaaagatactttatataattttaaacctctataattcataaatcgttttataaaatccagagactctcaaaaatatctgtaatataatagctacctagggcatgtttgtaccctttggattgctactgaaggtttaagatagctatatacctatacaccaaaaaataaaaataaaatatcctaagaactatatatttgagattcatcttctctgcatgccgtaatataattataattccaactttaattctatttattgtatatgttaaaaatgaaattaaacattttcaatctgagattttttaaaattaatacttctttacatgcttttaaaacttgtcaactttgtaatttctcaagtacttttcaccccaaagtttaggaacaatttaactttttagttggttttcatagaaaaaacagttagaagacttctaagaaatgtttcctttagcagtaattaccttgcgacttgacataattcatggtagaaatatactctgttgttcttttacagttcaatttttaccaagaacactttaacttttttaagtgtttatatttgtttgacaatatagagccacttgggaagaaatgatgactgtcttctgatgtaatcagctaaccaacacaaagatgaataacacaacaggcagtcattttcaagtatatgaaaaaaccctattctataaggcaaggctgaatgcctcagaaagtcatggttgtctttgtcctttacagatggccatcacagcagtgacccttggagctcctccagtgggatgaatcagcctggctatgcaggaatgttgggcaactcttctcatattccacagtccagcagctactgtagcctgcatccacatgaacgtttggtaaggcagacatacacggtaacgggaatgtcacagctagttgattaaacctcgtcctctgtctttccatgcatatacacaaggactctgcaaataagtgcaaaaatggcacacacccattattcttaagttgtattgtttctgtgatcaaagacataacaggttcaaatcacctttgtaaattcttccagattctctctggcattgttcttttgtttattgtgttttgctctgtgccttctttatcacaatgtcagcttccttgggtacataaatagatacctatttaagttgtagaatcttaacatggtggttcctggtttttttttttttttttttttttctatctgtagtttcaaaagatgtactgcagagggcagagtgacagtcggtagattatatgcatcacccaggagcatttcatttcccattgactggcctatgtcagctttggcctgttgtgatgtatccaaaagaaggagtttgtattttctgtagacttccatcagtaagagaaaccatgaggtttctacatagatcagattcccatttttcagtattttaactttaattcccatcccagcctgccactcatactgtgttttgcgtcactccaggtgaaaactggtgggctctagaatgttaggtctttcattactaaacatttccactctgtccatcacctacattcatctatcatagtatgtctctttatcctggaggaaacaactcagctgactttcttctagccttaaatatcaccacagcccagaatccactgttgaacttaagtctgtcattaaagagaggaaagagcctagatcttgagtgagatttgggatgcagataagatgaaacttgaatcccttgtgcaagaacatagcttaaacaatatgtggacctcacatcctacaaatgcgaaagcatatgggaaatccagtgatcccaggtgatacttacatcactactattcatcttgcatttgcccctttttcttcttctcatatctacacttaggtttctttctctgttctgataaaggaaatcattctggattcatgtggtctttgctctcttttgctcaaccagtacagataagaaacaggatctgatctcctactccaataatcaaaaaaattccagaagttaagatttctgatatccttgaaaatccgtatttagttggtcctagtggtagagatgctaagtagtcaattagcctatacattcctgagaggcagacagtggaaatggtattggcctttttgtatcacctcccaagattgaatgtgtaaatcacaaactatctcacatttcagcacatttccagtaaatagcagatgacttattttcaaattttctcttttcccacctcctatttggagatattagagtgaaagcttagagaaatatcaactatatcaactattattatgctagaatccgttttggctaaaattttcatttctgcaccatcattttccacttctgtgggaactcatggtcaaaactgtatgtgtcctatgagcaaggaaagttttgattacaaataaaagttttaggcactataccgcatgttggaatttcagttcttttaagagttgcccatttgacattaatttttcttcccttctgtgtttctttctttcttctcctatcatgctcaagagttttgagttaggcgatttgattttatcctagtccagttcactgcatgggaagtagctttaaaatgtgcttccatgcacaaaaagtataatttcaaaatggaaaccaactatattccttttagaaaaaattttacagaaccaaaacaatattatgaactagagagaaaatatcattttgaagtagtaacccagtaggctatatcagaagccatatttgcaatgccatttacctatcacgaaacacaggattttcatttttcatctgaacagttaacagatttcagagagtagagtttttgttttaaaggagacatgaataagctatcttgcaatgtatactaatgaattttcccactgttagtgaaactattgaattattatatctagttgtcattgtactttcagtatttaaccatgtgaaaatcttttactgaagtgacttagaagaatctgacactgacaatactttgaatatatagtagcagttggtgtcctttcagttgaaaataatggtagttccttataattttattcttagcatctggctagccccatactgaacaaagggatagtttaagaaaaagctaagcgctgttcctggattatttggggtataatttggccaagttgatattatctgtaaagataaaatattttaaaaacatcattgccttcatcactttatgccatgttataacagaatgtgtaattataaagcttaagatccacatatttcagtagcgactgtcaagttactgatgtttagtctttaaatcccctttacagttttagcctgtccaacagaatcccacagctaatcattactgtgttacacatacccacacaaaatcactcagatgaatggagtttgcggttaaagtttggaatgggttgttgtagatgattttatgtttggaatgacttggcagagttctttttaagaacaggatagagtcctcactgtctggcatgatttaggcatggtctttgcactacagggcgaaacagtcctaggagtctggaattttcctttaaaggaagttctgttttcttttatttttttgtaacataaacccttacttcagtaattctcaactgatggcagtttttcccttcagggaacgtttggtgatgtctggggacattttcattgttacaactaggggctagatgctactggaatccagtgcgtagaggctaggggtgctggtaaacatgacgtcatgtatgggagagcctccacagcaaagaattgtctggcacaaaagatcagtagtgctaaggttgtgaaatcctgcccaaacccaaagcatgattttattcttatttatgtgcaccagttattatatttttctaatgtttgaattatcaaccagtatatcagtaatggaaacatttccaacaattactctgttaatagacacgaaatacaggactcttgggcatcataagttaaaatgaacgaatagtgggcatgtaaagcctcgcactttgtcacactcctcatgtcctttgtagcaagcaggaaagacagtaatagctggagtaagagactaagaggacctcttatagtttatccctaaatcctctaaaagagacattattctctgtggtgtatttattacatctctgaatgacagtagttttcaagatagtttttaatgtaaaataatctagttataaatctcgttagtttatttcaacaactaattttctatgagtctctaaaaataactgatttacatggattccattggttcactcctttataatctatggggattaatttttctttttattctgtgaactcagcgttaaccctttgtcaaatcccaaattactgcccattttacataaagttaaaagggcccaaagattctcaccgatgtgattatctgttttgtttcatcttctgattattatagttagttaaatatttataattcttctcctctttttttgatttttgcacatttcaggcagatttgtagttcgtctgttcttcagaaattccacatggaataggactgtgtagaagtgaggttaaagttagtcatctctttttttgttcttttttccacattctgtttcttttcctccattttgttatagtgcttacctctatagcagaaatacctctatccctgctaagctttcagaatagctgtactatggaatgggcccactatatttttcattggagaaaattccatggactaccttgggtgttcattaggtggcaagtagaaatgagtttaacaggtggcctaaggaattttggggtcaaggaaagaaagaggtccatggaatttaaaaatttgaaaggcattctcaggaacttggaaagatttaaaggcatcatctcaacttttttacggaagtcttttaagttgggctattttggtcatacagaggtaatattttcaaaaacattcatgcgtctttgaaaatcctacctctaatacgtagattcatttccttagactagttggctctcaaataagttatacttcaatccactgtttattaaattctgactgataaccaattgttcattgagcgtatagtataattatgtgttcagtagttagccacaagttgtgggatgcagaactataagctctattcctttaaagagtttacaatacaggtgaaaatacattagaaaaagcaagaaatgaaaggccaaatataattaagtgttaaagacaatagtgcagaatgtaagtgcattagggacctagagagaagagatggtggaagagttggaggtagtcagggactcttcaagaaagaggtagaattcaagacggatctcacagagtaaacagggcaacactcaagagactatggtttcattcctcgtgagcaaatgcttgggttttaaatacccgtgactatcagcatcatattcaatctcttattttgaaataaacaatttttaacagcatttccaataatgatataataaagactcataatccattaatatattgcatatgaagaaaaagtgtattttagctttaatatattgcctttacataacacattcagatgcctatgagaataacttttgaagctgctttttatcttgaaaatagctcagcacttttttgtaaattactatgtccattttagtgagctgttcattcccaagcagatgggtggattgcaactaatttgccaccttacaggcactgtggcatacccaagaaacacagcttatttggaaaactaatataataattaaactcaaagcagagtcttaaaccaagtgattctgtaaagatgttgttctttcattgccagctatgtgaggattgcttgtaggtggggcatggaaagaaagtactcaaaccaaaataagtcatgtggtcctaatttaattcagtatagtcaatagttacatattgatgagtaagagagatatttaaccattagtgctttttaaattttttatttactaaattttattgttgctggggttcaaaaaaatttaatttgggaggaagaagatttgagactggttagtctttgccatttagtttcaagaagatcaggatgaaatgtaatataagccctgtggatcataatgttgttttattcattatatagtggaatctttttcacttgatcaataggccacacaaaaaaattaatagtagagtggtcttttatgttgccgaaaccctggagatgattttaagcagtaatctgtagatttcgagattgtgatcatttctcaatgtccctcattgccattatatccctccacagttgatgcaaacccaagctatgtttctgtataacttattatttgaaaaatgaaagctgtcagatctaaacaagatatattcttggctattttgaaattctaaaagctgtctccattgtaaaatagagagttgtgagaaaagtatttgaaaataactcactaaataccttatgattaaatatggccacctttttctgcttcttgctatagagctatccatcacactcctcagcagacatcaattccagtcttcctccgatgtccactttccatcgtagtggtacaaaccattacagcacctcttcctgtacgcctcctgccaacgggacagacagtataatgggtgagtcacagaaatgccaattctgataccaacaattggtgtcagagtttaatcatcaaggacctctttttccctttcataactgaatagcaattaggcactaaatattagtcacatgacagaatgaacacacaaatgtaccaaacagaagtaaaatcactggcttgagcataaccatatttttcgtcacaagacactgaaatttagctacgttctacgttgcaagtcattagattgaacaagggttcaaacagaccaaaactatcttgttcctcacattcaaaaagagtgaacaaagtcataagatgagccatcagtgactagtgagctacaaagcagaatagctcttaatggtagttattgaccacttcccaaaattccagtcattgtgctaggctcttatccatgatgtgccactgtcttccgaggactggttaatgtgaaattctcaggtgactgctaataactacatgaggttaatctcctggagaatgtgacactgtggagtccctcagaggggaagaagtatttgttcacttatgagagaggagatgcgtgggcatcagttggccagaaattatttgctgcttttttaaattaattaattaattaatttttaccaaggacatttactaatgagttaaggtccaagaagaatgctgttcccatgaactgagccatcatcctctcatttcttgtgatgttcactgtagtcttttccataggtggttccccagtcagtattcccactttgaggaatgaactgggctggatgtccagctgcccctggagggaagaggtggagttggtggggagatagctacctgcttctgaaccagctttgacaccttgttgttcagatgagcagcacagcttagtgccccagggtcttattaaaacctcagacttctcaggtagtcactttctgcggttatagctcaaactaactccttgcttggcctgaatgtcactgtcagagcgtcggtggggagaatactcagtgtatgtctttgagagaagatggcgcaacagaataatgctgctgttgagtcctcttagctctttgcacttgttttctttagagagtgtgtagaatttggggaagtggcgtgaatcacttatgtaggaaagtttttgatgttggaggagagatgtgttttgaaatgttggaaatataatttctgcctcaataatgccctccctgcgtattcaataatatatctcacacttgagatgagctatctcgcagcctctccactccgctatcctgtctaagaagcaaattgaggagagagtttccattttttttaacttttcctaaccaagcttctacaaatatgttgcatcagtttgaccttggagagctacagacagaggtcacatggggaagtttgttagctatcaatgcagttttggcagatttgaaaaacaagaagaaagaaagcagtgcagaactgaaagagtgagaaaagcatatttcacttcagtgtggtttgacaaatggaaagcccctttctgcagtcatgaggtctggttataaagaaggatgaccggtcattcatccttttacaagacagatttcctgtctacttgtggtttgagtaattttcttttttaggaaggtatgaaggtggagcagaaccttgagttgaggaaaacatacttaggctctgtttgaaaaaaaactttttctgattgatttgcaaaacagtcctcttgagagagaggcactatgacttggaagggacatatcaggaaatagggtggttatctccatgagctgtagacagcttagccacagctctcagtgggaatgagttttgcttggttttagctggtcatcttcattagtttgtggatgaacaggagaatctacttgttggtctagccagagtggagcaataggtgacttctatatgctgagaatagacttaacttgttaaaaaccatagggccttatttaagggtcttgacaataataaaggagctataatttaaaaacaaaagtatgagatttttagaacccagaaaagggctttttagaaatttatttcatacattattttacaataatggatgcacttgtcaaaatccactagcggaatgagaaaaagatgcataatctttaaggaaataggtagacatggtaattcagcattttggaggagcaaacctttattattatgcatagatacagatattactttaaggttactttaagggagaacattctagaatgtttttctttaaaataatatgttcaccaattgcgtacgtgaaaatgcagaggaaaatttaagcataataagccttagtattgcgtgatgtctgagtggcccatgttttttcacacttaagttctcttaggctttggtttgattttttgagtgtggtagaagtcagtgatggcagcgtgtctgtataacaagaagagaagctttctcttctgatgttagtgatactaccctaacaaacagtatggattaataggatacatctgcagacttttgaaaatatttggcatatactcactcattctgaaacgcaggaagtaaagaaatattacgttgcctgtatctcaaagaacaaacagagctaattaaataattggcaaatagggaacacatagcctgacacatgtttgagattacacacgattctgtagaaaatgactgtaagcaatactaatgccttaagaatggggttcgagcactaacacatggacatcacatttttcacgttttcctggtaaaaagttgcaagacagtgcagtcttttcatacatggtgttgatgtcttaggaagctgctttttcagttcagaagagggctgctgcccttcgtctcagtgtcatgttataatatgtctttctggtggtcagcagttgtcctgaactgacactagaacaacgcagtgcatgtggggtgagatacaagctctagaactctcggaagggaacctctctgtaaccacattccctttcttcttctgttctctgcatctcaaaggtggaagatgcccactgaggtttgctgtttgtttggcttgggggagtgaccaggtgtttcttgttttgttttcttttgccctataatacccaatatcattttttgagaaatccataagaaggataaagcttacttggattacattaatgagagattttttttttttcatgacacattcatccatggattttcaagagaattgtagaacaaggtattttactcattgcatacagtccactacttttctcaagccttgctggcaaactctggagatcatattagacctttctgaattgaaaaggtcatctaattagccctccaattagaggaatataatgtatgggacacagcatggattcacagtagttcagctggtggcgcacccagttaaggaaagaagctgtcaggggtctttgggagttaccagcatcagcaccttctactcagttcttcaaactttttcaatgttatgccactgggtattctcagaagcagtgcagttcagtgcctctgcatctgagcatacatacggaggaggaagtgtagtaagttattagataccagctatagagaataggaatgtctgcaggatattaaccatacacatttggttagccacatacttccttcctatttgcaataatatccagtagcccttcctgatggaaagaagtaagaggacctcctaccatagcacagaccactgagactgctcaagggtgagaatgcgtcgtctccccattgggacataccatctgtatacattcacagggtgtgaccctttgtggtttgaggctacacacactcccttgccctcagagagaactggtcatataactaacataatggttataataactattattgttttattagtctttaactggcctgcattctaatacgtggtcttttccacgtttttaaacctcaaaccaaacagggttgaaggaacagactaccaagattgatttaatacaccatatgctaaagattaccctggaatatctatctggttcatgaattaatctggcttagaactttaacttcgaatgacatgttagtatgtggcttgtctagtagaaacattatgtccttttctctttgaggacttggtttcacagtaattttattattagagtagtcacataatgttcactttatattttacaagaatattgagccttgaagtagtcaggcgatgaacaagcacagagcataagagtaataagaattgtatccagcaatgtgaaggcatcttagttaccaagaccaccagcagagaacaataaactagtttgatttaaatctcctccatttcctgtgcacgatcaggaagcccaacttccccctgaattcctaggaatccctcctgttaaaaaatagtgcattgtagtctatatacttgcgtttgtattttaaaatggttgtagtaggagtgctggaaatgttccttctttttgtcatctttatagataagcacatggcattgttatgctgtttctaatggtttaataacacgagggtcactcggacacagtttagaaaaacctactttgaaagcagtcatcttctctcaggcaaacacagtgtgaattgtgctgcttattcttttgatgccttcatgatgttcccagccttagatgatgggtgtgcattaaaggggcaacacattttccaaattctgatttttagtagttgatcccaaggcaccactcatcccagtgttttgttgagggtgtgttctaatgggaatgaacatttccccaaagctgaggctgagacagagggtggtctagcatgtaacccaagatacaaaacctttctttctgcttcatcttctagccagcaacaccacctgtgttcaagccatctgaacaatacttgggtggcaggcagtgtcgaagcctcctacaaaaattacagttcctcttaataactgctcatcttccattcatatttgtatgttacagctctacttagggactgattatatttctcttgggcaagataaattgattagagccaaaattagaaatcgataaagtctttaccaagcaaatgcattagttttcatctttctgttacatggacattttgatcatctctaatatgaattgacaaaaatcttgggcctcaaagagtaatcaagtcctgttacatcaaacccacattttcagctttaatgtatcttgctaaacatggcccacttctcaatgcaaaaaaaaaaaaaaaattctgccacttgagaattaaaatatatttcttttccagttataccctttgttatatctgtcacacaaataaaaagagaaatctgtaagagaaagactcatgtagcttaacatgttcaggcaatctagaaaatgtagcttctccagtgtttcctggaccagaacaaaaggcattccaagtgaaagggcaaactggccccagtaaactgctttgaaatttaagcccttgggtttggcactccagctgttgcaaggtaaaatcgcttcatgttaaaaaatagtctgttcttatcagtggtttccatgggtagcctttgtagttttctgaaatattttcatgacgcgatgaggtaagaagttgattctatttttaattctatttcctgagtcataatatctccctgcataaaacaggcactgatagaatgtttagttagaaaggtgtagttctaaagaaatcagattggtcataatatcttgcctcttctaacgtgtgatttttggggcgtatatatttagtttttaaatgctcctaaaatatttgtattggttttcaatactttgtttagtttcataaaaatatatatattatttgtaatcttcattttaaagttgtttaaaggaagaattaatcttttgaaagccactactgtagcagatattatctgtagtgaagcaatatcttgttcttttttggcttaggttctttgttagataatgtgatttttccaatgtagctctgaactttttgtgaaaatctatattcaaatcaagcagatatcacagattattttgactgatagatctaatttttaggtatataataatgaaaagaaatatcgcttctaggaaaaaaaaaaagataagtacccccaaataccatggtaatacatactgaaaaaaggttagtatcatctatatttcacatcattattattttctctttagaatggtttttaggtttgtttgttgttcttgttgtttgaggcagagttttgatcctgttgcccaggctagagtgcaatggcgcaatctcaatctcggctcactgcaacctccgcctcccaggttcaagcgattctcctgccttagccaggcatagtggtgcatgcctgcaatccatgtttttagtttttaaaggactccttaatgcagaaattcttctcattttcacactagatataatttgttgtattttatcttatattaaatatttttaatactcttgatatctgagctgctcccagtggtccaattgtatgatgtcagaccctcatttcaaagaacttgcttatacaatacctatcatgagtactaatgactcatgtattttaatatcataactttgtgatatggaagtttattttgtcacgagataattgtgttcttcttatcatgtgccagatttctttcagtattttagcaattaacaaataaatatgggtgtgggttttgtaaaccaaataaagtatatatcaaaacattatcggctgggcaccgtgactcagtcctgtaatcccagcactttgggaggccaaggtgggtggttcatgaagtcaggagttcgagaccagcctgaccaacatggtgaaaccctgtctctactaaaaatacgaaaattacttggcgtggtggcgtgtgcctgtaatcctagctactcaggaggctgaggcaggagaattgcttgaacccggaaggcagaggttgcagtgagccgagattgtgccactgcactccagcctgggcaacagaacaagactccatctcaaaacaaaaaagaaaactcatctgacaaactcaacatataaatatatgaaaataacaagcataaattagctatgctaagcagaggtcaggagaattaaattatgacctggaaaagccatagaattggaccactgaagatccgaccccactactgcattttacaagtgtggaaggtgatgacaacacatttgtaagaaagaaggctctcttagttcaagaatggggctggaaagtctttgaaattatatacctgtttaatgaagttttgcttggattcattgggtgatttaacctttccttttcttatttcacaaaatagtgaaaaacaatcttccctcagaactttaataggttttatttagatactatgtctatttgctaatgttgaggctttagtaaatacaacataccccaagtgctaggcattctgttaatactgaagaccacaagaatcctggaaatcccattttatcacttagttctaaaggcaagataccttccaatgatacatgttaaagaaagctggctttgaattgtatactgtaatatatgtcttttattattcacaatactctttgttcttctcttttgtagataaaaataccagtgtttaaggcagtagagataagcttcatgaatatgtagacttactttatctctggaattcgaggccatattgacttttagtagcataccagttcactttttttagtgtgaacacagacttttaaatatgtggagaatatatgttatttaaaacattaaaaatattttctctccttgttagccagacctgttgtggaaatttttgtttgtttgtttggtgtactgtaggactgtgagacgaataccccgttttgctatgtatcaaatttctatttatttgaaaacagatggaagttatttgtgaagataattccatttactataaaataatataaagaaaagccagactctgaggactccagagacctgaaagtagtctatacttgtcagcaatgaccgtcacatagcttgctacattcaccagctcatcaacagcaaggggaaagtcatagcaaggaaaccactttatctttaaaccaaggtgtcaggtttatattttatctgtaaaaaagtaacatgaatatatttgacatctacctcagcaaacaaattaatgctaattaaagattaatgtgttgtaattagcattaaaaatgcaattaaattgtgagtaaatggaccaggaatagaaaattgttagacgtctcactgcctggttttcatattctgccttttgtttttgcagcaaatagaggaagcggggcagccggcagctcccagactggagatgctctggggaaagcacttgcttcggtgaggaaatattgactttggactccatatgtaccattgtaaagggtgaactttaatcagaagtggacatttggaattttagaaaatgaatggcaaatagctttgatttttggaaaatgctagctttcttgcataacagtcactggaaaatttgagaaggctctgaagcttccagtatatagtctctttctctcatcctcaaaatggtactaagctgcactcaattatggatgtgggaatattctcctggtctttgggtttataggttttttatactgatgtcttatttttctctaaagtaatatgggtgcacattgaccagctaagactgtcttagcaaggaatagttctaaaacactttgaaagaggcatttgaaaaaaaaaaaaaaaaaaaaagacaataactgaggtccatgaagaactgtcacataattggcacctgggggactcagcttctctgctttgcccacctactgccagaaagctaaaattgaacatttcttgcatgttccctgatgacaaaatggcataccttcattgtctcagagagtatatctggtattttagtcaaaagctaaacatggtcatttagaaatgtaagtggagggccaggtagtgtggctcacactggtaatctcagcactttgggaggccgaggtgggaggatcacttgaggtcaggagttcaagactagcctggccaacacggtgaagccctgtcactactaaaaacatgaaaattaactaggcatgggtggcacatgcctgtaatcccagctactccggagactgaggcaggagaatcgcttgaacctgggaggtagaggttgcagtgagctgagatcatgccactgcactccaacttgggtgacagagcaagactccatcaaataaataaataaatgtaagtggagatttctttctctaagattttgtctcttcagttggcttttaccattgagagcattaaaaaagttcacactgtattagcattgtgccctaagtaaaagtttttgtttcatctgggccttctgatgctatgcaatcaaacgcctagatctggcaaaagagtggcaaaatatcttaggaatgatcctgttcaacctctcattgtgtagatgaggaaaggaaagttcaaagtatctgcttggcttgcccatagccacacagccagtaggaacgaagagttggtttgaagtctgctgaccccagcctggctcttttcccaccatcccataccacatcagtaattcttgttttgaaaaattaaaataattgttaagttcttcatttgacaattttggtactgtagttgattattacatgtatgctgtaacttgtaagttctaaatgaattgcgttgacaacttcgtagtttagaaaagtgtgaattattttaatgaatgagggtgttttttttttctccttattgttttaagatctattctccagatcacactaacaacagcttttcatcaaacccttcaactcctgttggctctcctccatctctctcaggtagtgtatttcaaatcccatttcatcatataacagtttataagaatgattccccccttgtacttcctgattttgtaggtggaaactcacttccccccaaatcccaaagctttaacattcctataacagacaaatacaaagggtgggagagacaaattaccagataacagtatagtcgtttacatccaaaccttttcttaaaaattagattatctttttaaaatatacaggcatatggaaaatgtatttcttacacttttcttagctctgcagaagacacccaacggcagaataatgtattccaataaaacgtctcagatgaaaaaaactcagttaatatagtcatgaatatgaatatagactagatagtcatcaaatatagactatttaaatggatcatttcctgcaggaatttcaggctttccaaattccctctttaaagtacatgccattgggatgtttagagaaaactataattttgtaaataaattgtgaaataattgtgtggggtagaagggatgtttgacttcaaagtataatacattcgtatgacctgtggcttcaaattgaataactataatttgtagaattatgtcagtaaataatttcacttttcaggggtccgtttaagagactcattgtctttccaatataaatgcttccagaaagccttccttggttcatgtctctgctctttggtaaggagacaggtggcttattaaaaaaacaaaacaacagcaacaaaacctaaatcacatctgtacctgatggaaaccttaccttactgtaatttatagtggagttacttgcgtttgttatttcctgcatgcagctctcatggcccagtgtaaactcagctccttggtcgaggacaggaggtttcacattgccacaaaactttcagaaatgatggccatggcttagctgggatttaatgtcaacctcttccaagcctccgtggtatgagaagatcacagaatagagagggcagtgggattctgaagtctctatgtccagagagaccgcgttgaaactgggaagcgattgaggtgattttaagaggataatcaaacgttccccctggtggaaatagaaactagagttcagtattgttgtactcctcgggttctgtaccagattcttacactctgaaaaatgatttcaattgtcagtaaccccctttcgagacaacaagagatacaacaagggatagaggaatctgagcaggtggaactccagtttccacatttcaaacaaagtagctttcattttattcattttctaatttagaaaaagaaatgttctatggtatcataatgtttgagaacgactaatgtagtctgataccctgattttacagatgagaatactgagtcccaaaaagggagttgagttgttgagtttattaccagtggtaatagcagagcttggacaaaaatctggtgctcacagttctgccatccatttctagattaatggtgggaaagaaaaattaggatgcacagtcattctagaaaacatcacaaattccctcgacctgagtagcatgatctcagtgaaaggcacagaaacaaggctagagatgccactttttgggtcttggtaatgcatcatggaagaccacatgttaggaagaaagaacttttatgaagatgcaaatatggggacagattgctattttcacaccgacggctctgtccaaattctgtcaagaaaagtaattgaacaaaatattctatttttatttagcataaaaatatacatgcacacccagaaaagacaggaagagtggattttaaaagtgctaacagtgtcggggcatgagatttcagtgagatcatagctattattttttccttttttgaattatgtattttccaagttttctacactgaatgtgtattattttacatttaaagtgttttttattttgtaggttagacatgtaatatgtattctaacagcaatctttttttaccttcaagtttaatgaatcataaaaaaattattttcttcagaagaaacttttagtcattgctgtatattgactttaaatttctggcttagtggatcactgataactaatcttattcccttaaaaagtttttcaagatttatctttttctaaagattgttttaaaaacaagtggcaaagctgttttccactggtgcgagaattttggtttaacataaactagccttgcatgaaggtctaacaaaatcccatttttgtacccttaaaagtaccttgattccatggtgatagtttttcttccacaggaacccttcttaccaaaattcagaatcaattaaatgttctcttttaggagacagccagcctgggggaattgtgagtctatgtaaagtctacatattttacatttaaaatgttttccttgtcccaaaattcttatatgggaagtttacatgtatttacgttgttgtttaaatgaaaatcatcattgccattgccatttccaaaaggactgtttaaaatattggcaagcgtctttttacatgtgtctagatctgattgtaattcccactttaatatcagcaggcacagctgtttggtctagaaatggaggacaggcctcatcgtctcctaattatgaaggacccttacactctttggtatgtctcatttgctaatctctgtcccacccattttcaggtcatgttctttcttgttcagtctcctttactctccaagattttgattttccctgttagtaactttaagtcagcattaagcacacaggtttgcgggagccagagtcattagcctatgcttgctcctatttggagatgggaacccagatactactgtaatggcagccccagggctctaaatatctagtagcagataaaatcctggaagggcaatggccttctccccatctctaggaaagatccctgtcaatgattaaatcactttcctgctatcagagtgctggaactccagccaggtcctatacctggaacatttgattccctctacctctgctttactttccagaataacaggtttacaggagctttccttctcgtagaaacccagtggtatccttcgtggtagagaaatgcctactcttccaggagtgaattgctgaaaatttccatggatgtagttaattattataaatactcacatgatgattcagtgtctgacacttcagtctttctctcctcatgatggtgggggccagaaatatgcaggaaacaatgctggttgtgcagcatttaggctgtacatgaatttagcgggaaggaatagcagtaagggagaggagccttttagttcctcggggttgaggttttcttttctccctcctatcttgagatgacacatggaagaagacatagatttatctatctgctttagtgttgtcttatattcttccctttcagcttaatcttaaggaaaatctgaaaagaaaagcaaaggtggatttccctcctttgctgtgttcttccttgctatagtgtatgaatcattcagctatgcattttaaccagtaaaggaaaccagacagtgaaacatatatgcactacccagcccaattaatctgcggaccacatccacataattagttgttttagtgtttaccttcatcagttattctctggggcctattcatcaaaaccaggcttcgtccaactatagaactgtaaagacggggtgtatagttatgggccacagcttccattctgtttgaattctgaacactgaagaagagatttacaagcagaaactgctgtctctaccaggaagctgtgagccagaaactgtgataggcacatgtatgatttcttttcctgcatacatttacactcagaagtaagtatgtattatcattcccatatttataaattagaaagcatgcactccaagaggtttagtaacttttccaaggccaaatacgtagcaaagctagcagtctaggggaggtagtttaactcccaaacccaccaaatcagaatgttctgtaccatagactactatattagacacacattcttcctgtcagtataaaatagaaatgttttttctcatgcaatagagctggtacacttgtttgcacagccgattcaaaatcaaagtcaattgtagcatgatctagtgcaaagagtcactagatttaaaataaaaagacctagattccaactctgactttaccatttcctagcagtgtgacactacgtaactaattcactttgtgtctttgagcctcattttcatgtctgtacggaaggaatcataatgtcttccctgcctgcccatacacacgtgaaacaaggatcaatgagatggtatattttaaagtgtacactggagagtggtatttgatatcattattgatcagtttttaaaatgaatacatacctttaaaatgaatacatacattttcttcactaaaaactatacgcattgtctagttgtgaaaaactagaatcctaatggcaaggatgaacaaaggttggttggtttttaatggtttaaagttgcgaattctatgctatagttggggctttgaactcagttagatgcccccagtgaacagttgattcaagtgtttgtgattcttcagtcttaaaatcttatactactttagttgacagaatttatataatttttttctgtaaccattttgaggcccttacacgcataccaccacacacccactggttttgatgacaggaagccagaaacaccggtaaaaactcaacaagaaattatcatccatttgcttttccctgtctctgatttggtacttagcactgggtcatataccacagggaagaccaaagaaatataccttcaggaaaagaatttaattaagaaactataaataggtcatctttccagtggtaattgtttaaaactctttaacttaatacctgccagaaagttccttaaattcagtgaatgtttttctcttctaaaataaatttaaattgcctttcaaaaggcagtaccgtatatagcacatgtatgttataatgtcctggaataattattgaatttagtttgttcatgaaaaataacactataattttaacattaacacgttctaccagttttctggaaacaacactatttgtattattgttttaaggaaatacattttattggaaacatgtatttagaaacacagtgtgttttttgtcgactaaaattttacttgtataatttaggcaccccttttgaactaaatcaaattttacatcatttgttaaccaacagcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtaagtgatgaaatttatagactctatagttatcatatagagttagaatttcagatatagatactattgttgctgttttttaaaaaatcagctttattgagatataattcacttaacatacgatgagcccatttcaggtgtacaattcaagtgttttagtgtatttacaaggttgtgcaaccatcaccatagtctaggttttgaatatttttgccccctgcaaaaagaaaagaatccccgttgcccattaagcagtcattccccatccctccacttccagcccttggcaaccacttgtctacttcctatgtctatagatttacctattctggatattttgaatatatggaatcatacaacatgtggtggtcttttttgactggcatcttttacttagcatgactgttgcagtttttctacagtttgccacgtattagagctttattcatttttattgtcaaatagtatttcactgtatggacataccacattacacagttgggttgttccaactccttggctatgatgaataatgcttctataaatattcatgtttaagtttttgtgcagacacatgtttcccttgaggatgaattgctgggtcattgttggtgtttgaaattattcattttggtgaccctggccaaagtgtacaatttgagttcatattataatatgacattgctagtaattcaaatattagtgttttttttttaattaaagaagccaaaatagtgtctgtcaattctgagtctgggagatagaaatatatggtatgtttatttgtataaatacattgcatgtgactgtgtaatttaatagagtagctttactactacctatttagaataagtctttatttgaattatatttaagcagatttgtccatattacaattgtgatttttttcctcattacttttgaaaggattttggagataattctttttgaggatgattatgaagattcagagactcttcttaatagaatattaagtgatgacaattaatgaggtgaccagagtggtggagaatgtaacttgaccagtgattctctgtagttctgatcctcacaagctctacctcgtctctaagcaccttagtgtcctattttgccccttacaggctcgctaaaagttgcttggatgaaggtatattttccattatcactgtagcatttctcgtttaagcatggtcccaaaaggaaatgcaaaatacatacaaattattatgaggttcttttaagttcttgctcagtagtattctcctgtccatctttcagtttctcttaataaaagtctaagattaagagtaccattctgaacggtgtagtattgaaatctgcaaccaatttgaaaccaaaaatactggtttataaatagaagcaacgaactcacatctaaaatgtggaaagatatttttgaatgccaaagagaaatctttttttctttcccttgacctctgccctaaaaattcatcattgaataaaaattgtttatatgttcatggcagttgcttagagtttacaaaagaaaagtctagattttaatttagcttggcctcaggtaatgtgttaaatacacttgggatgcatataatatgagattttcgtttgtacagctcttttttttctaactacaatgtttaaacatactgcttttaattaagaaatctggctttattaaaagccagatctgtgacttataaccatttctgtatatctgctctcaatcaacagaaaaatagtttaatttctgtagctgtgttcattttgcatatgttaaacggatgtaacatgcacccagggcattgcttcagagactattttttccataaatatgtaaagtttttcttaaataccatatgtaggttaagtggttcttttaaatattaaactatacataaatacttttggggactatttgacctttgaattgactcctttttgagtcagattcagaggtgggatgggaggaaaagactagaattatttttggagatgggaagttggactgacctcagtagaaccgaaagtgagacgactgaatagaacggtagaaaaaaggaaataattagccaatattacatagaaacccctttaatttgatcttgatatacacacacacacacacacacacaaaagcaataaagccgccagttttgctgataaggataagttcctgttttctcctctgaagacatttaatattcaatcaaggacagccacagagccaagcagatcatagcgtaactccaaagatatggcatgtcatcaccctgctgccctttgaaccaaatggggttttgcagtctctctcctttcttcctgaaaaccattcaacgtgtccccagaatctgagctcctcagcctgaaacactaatgtgtgtgaaaaggattggtttggcctatctttcccgtgcaaactggtatgaattttaaaacaaaaacataagaacaaaggaaatagtttttgaatttaatcagtctgaagttagcctttgaccatttgatacattccacaataaaaaggaagtttaaggggaaggcaaaaaaaaaaaaaaaaaaacctcatcccccttccccacaacaacaaaaaaattcaaggaggatactggtaatgttttccacatttgaattttaatacatgaaacaggctataaaactttggccagctgcagtaaataaagtagccgtgggaggtatgcaccggaaacttcagcagagagcactggtgagagtctcattcccaactacacaccttcgtttgttgttctgggcggaagcgagttgcagtaacttgatactcatcccagtcccggttttgtattgagcacatcgcctttctaactctcctcagtaattccttctgattaaagagtagacagctctgaatcctctcgacctccgtacgcttctcatttcctttctccctgccttccaaaaatcaaaacaaaatggcttgataacttggaaggtgatataagcatttctttctgcagcagcttgaagttgtggtggggaaaactgtggttctgcctcggctgttatgttatctcatttaattgctaacatattgtccttagcttttgattcataaaatgttttccttggagttctgaagtaggtcttcagtgatttactaagtattagtataatgaaagggatttttttttttcacagcggcatggctcataacacaagagcgaatgtttgtatacttgcaagctctctggatgatattattgagctatgcttatttcctgctcaaaaaccttccctgcctttccattttctacaagataaagaccaattccttagctcagcatttgaagcctattaccatttaccgaaagccttatgttgagctcttccaatctgcaacaagtcttccagcaagacaaggctgggcatattaccagaattcaccctgtatgttctccttcggaacttttgtatctctttgtcttgtccagccctatctgcttatctctgtacacctaatacccacccattctcaaagcactgactcaaatcattcttcttccaggaagccttcccttgctaccccactcatgctagccatttttttctctattcttacagccctatgaatcataccatttctagatatttatcttaaccagctccgcatagctgtgcatcttttatagatatgactctgccttaccaactgttgtaaattcctcgagtctcacatattatattttgtctctctccccccgacccctgtaaatagatcatccatagaaacgggagaaaagaaacgaggaaacttaacattctgtgagtgtgagttggcagcccctctgctaggcgctctgcatgtgttgtcttaggcagtcttcacaacagcccagtgaggatgataatagtggtcatttcaggtgtcggtaaagtgagccttagaagtttgagcagttagtctcaagtcctgcagcgggatttaaactcaagcacatcaactccaaattcaatgctcttttttactaccaggcatactctccagagattatctatgagaacaccttttcagaacttattttaaatgctaggagcttgtgattttcaaaacttgataagtgttggttggcaaaagaagtttccaggtattccatggctgggttcccagagcagctctcttcccaaatgtatagacagagaactttccctccaaagtggtggcatgcttggattaaaacccacattatctatgcacttattcttaaaccaacatgtttgcgctgagtgcctaagaggtgtgaactctccctaccagggtccttgaggtagcaaattttaagttatcaagttatttttcttactataaccacccacttttcttccaaaattaaagcagaaatctctgaatgtgggagaataaggaaatagccaggtcttcactaccctagttagaaactcttaccaagtatgattccctctctgcctcagagacctccatgattaatcctgatattaaatgattagatttcttataaattatggaaagggcaattttccagatagaattctctctgttactcattcagtattcacatccacagatgaggcctgaaaagaagcgtttcaaatgacctaaccgcttttttaactgactaagaacaaaacccacatcaaacttgtctttatgtgactctatgtgttcccgtttatttgttggtagagtcagcaactacgtgatcattgagctaaaaatcccctctactattcatatatcgcattagtgtagctctcagatccttcttgtttaaagtctatttattcatttcaataacatttatccgtggttaccaagtgtaggttctgtgctctcaaggaattcacaggctagtaggaaaagatgtgtacttaagcagattgctccctgccagtctgctatgccctctaaaagaccaggggcctgacccttatccagtagtgaaagatcacatggttgtttagtagaggagtggtcatctccagttgacttagggatgggggagtcatgtgcaactcaccccacacacctgtcctccacagcatcccttcagagtcctgcaggtgggggatgtggaacccatttcagaaatcaccaataaaagtggatctttgcccagttttcctcttttcagtaacaatttttgttttactttggattaaatgcagtctatcaaaagagcattccttaggaaaagtggtatctttttatttaactgacattatatacatgagaacttttacctcttagggcttcataggacaaacaacttcagttagttttccttgtatagttaagagctcagaccactgaattttagattctaaaagtaccctggaaatcagcccattgcccttctttgaagactaaggcctaggaaggggaagtgaccaaaccatgggtactcactagtagaattagaaaccagacaaaagaggctggacacggtggctcacccctgtaatcccagcaatttaggaggccgaggcgggtggatcactcgaggtcaggagttcgaggccagcctggccaacatggtgaaaccctgtctctaccaaaaatacaaaaattagccgggcatggtggtgcacacctgtaatcccagctactcaggaggctgaggcaggagaattgcttgaactctggaggcacaggttgcagtgagccaagattgtgccactgcactccagcctgggtgacagagagaccctgccacacacacaaaaaaggaaaccagacaaaacagcaagcagaccagcactccttgtgctatatcctacactgctcagccgacttcctctttaccctaataccataaccatttcaaaactgtgagtggtagaaattagaaaccattctgttactctgacttaactaatgaaatccaagaaaactctgtagttggccctaggctgcctgcaatgagttgctatttagctctaccagtaatatttggcaaaaagagagggtagtgggcattgatgtgatgtggcagttattggtacatagtcatgggagcagcaggagtcagaagattctgtttctatgtgggcctcttcaacaaagatatgatcaacagaggcatcagcatcttcagttgataaagttgataaaatagaaaactattttctaaatagcctgttacagaatttcagcgaagctattggtggtcagcatcatcttttaatagctactatcttgtttttctttaaattaggatatttgccttctctagtgttctgtcatctctcctaatctccacaactatcaggtatttcggagagcagattagtaacctcaactgaaagttttgatctttatcaatttatcagttgctcctcttgggctttcacaggttttgattccataaagttctgtgtctatttgagtgcatacttcatttctaagcagttattcccatggactctcagggaatttaagagattatctctactgaaatctccctacagatttcctgccaagcagtcaacaagtcttgatcagcctccttccttcaagggtgactagctccaaatgcccacaaagtccattttcatcaaatatttgaaagttcttcctaggtccagcccaaatttgcttttttctacagtccttatgtttctgcccaatagaattgcccacaaatcaagtccaacaagcacttgagaaactcagttatttgaagacagtctgctgagtgttttttccctctagacgaaacatcactatcttcaaatatttaacctgaaaaaaagtttggactccctgtcatgaactccattgcttcccagtgcattctccctagtttagcaaggatgcctttttctccacaagaaccttttagtgtgtggaaccgcaaactgaacacagtgcttaagaaaggatcaagtggactagggtggatctatctcctcccccattcagtaccttgtatcttcattaaggccacctaacaatatcctgttttgctatgtttgatgctttcattgtcctgctgacatatattcaatttgtaatcaactgaaatccataagccacctatctccccagtctcattgtgtactttttgttgtgtctgtacaaaacttcatgaaaccccattgaatgttatgttgtagcctcagtctgattcctgtttaatggtttccctgaagccctcattcagtcacatactctgccatctctgttgctggcaaatgtgatgggtgtgactaatgcccacatcaaagccaccaatacaatattttcaggggaggggattgaccagaaggccatgaggctcagtgttacagacattctttctacacgagtgctgtcttctatcctttgagtttaatctcagctggttctgtctccctccttatacaccgtatggcccacctttgctcattttgtccgtagcgttgtcacagaagccgggcatgcagcactcactgtgaagcaggaaatgaggcttgtccagaatgccttgctctggtggaaccaaactgagtttgagaggccattcctgtgtttcagagcactttcaaaactattttctaaataccctgttacagaatttcacccaagctattggtggtcaacatcatctttcaatagctactatcttgtttttctttaaattaggatatttgccttctctagtgttctgtcatctctcctaatctccacaactatcaagtatttcggagagcagattagcaacctcaaccgaaagttttgaactttatcaatatcatactttatttttttaaaactgaaaaaaaaaaggacagaaaggtaaaagaacttgaagaaattcttttagccatggatgagtgataacagctgagaatccttgagcttaccatttgatatttctatattaatttaaagaaaagtcaaaagattttgaaaacagcaatagaagtaagatcctttaagctctattcagcagcccctaagaaaagtgatgaggacactgtgcatgcccatatgtgaacatggttggccaccttaggtatttccccttctctccacatgaatacatattttactcaaattcagactctatgatgttgaaacagtctggcattggatgtttacctcaaaaccctgctctctctgcacctaggacaaacaaatcctagttctctggtgtttagcatcttggagccatgaattttaaataaatcaaagacaaaaaccttgtctttcccagttttaaaatataaaagatacacacacacacacacacacacacacacacgtgtatttaaaatagaccctataacctcatcatattcttacatccttacatggttttcttcttaaattgtggaggaaaaggcaggcagacacatttaatagcacagtgatcatcattttttaaatgaactgttacagggacataatcttaaactatccataatttggaataggcacaactgtgcatttaaaaaaatgcaatattacccttattttctcaggaaagcagattttctggagggaaaagtatatattgtatatattagaaaatatacatatgttcattcactctttctgcatctgctgtgcttcagatgcttttggggatgcataaacgtgtaaaagaaagtatctgatcttacaggccttttatcctggtagagtgataatacaaatatgggtctaactataatgcaaggtagaattatgaaatgacctaaggagcaattcagaccgctaggaaaagcttcccggagaagatgccattgagctcatattcgagtccacatagaatttcaacaattagagacaggatagaaaaggcgtttcagagccatataataaacatgatttaaaaccaaaaacagaaaataaaggctcatgcacctaaatggaagtaagaaaactgcctgatgataccagtccttgcagcttgccagccagggctgcattgggtgaaaagcccctccacagcacggcagctccagcagttggctcgaatatttcacatgagagtccacaggaagagcgagctttcatgtatattttttacatccaaattaagttaactcatggaattttccacccttaggaattaaagtagcaactcatgaagtaattcagttatgtcattcataccaaaacagaaaatactggagcaacttggcactgtttaaaagccaagattaggccttggccattttatattttttcacattccatggccgttgtgttattttaacttttattatggctgtaaatttttcaaatcaaaagtatcttaattgcttagaaaacagaagttgaaaatgggttcatagtaagaagagggtttaggcaaagcagctttaggagtgagaactgaaaaaaagctgtagcattacattttctgtaatgcgagggttctacctatttggttgacattcacagttgtgcataattatagcttcctctatatccataaatcatcttagaactataaagttgagtttaaccaaaagatctgtccaatattagtgaaatgacatctttagggaagcattgtcctgatacaatagccacattcattttaaagcagttaattggacacattgtcaaaaaccacggtattgagtttccacattttaatttcacatttgccttctccctggcttctgcacacggacgggtctcttttggagctgaaagtgtgtgaaagttattggagaatggtagtctctgggtaatgtttctgtaagctgcccaaaattttccccctgtagtctagatgggaaacagctggtatttgtttaaaaagctgttttgcaaaatgtctaaaccttgagatatagaactgaggtcaccattaaagcaggtgcttaagagcaagtgagaaagacttcagaggccgactggctctggaatcttctgcagggcacttcctattagaagaaaaagtgttgaagtttgctcctttatttaggacacggctataagtattaataagtaagtgcactagcaatactactagaaattgagtatttttgaacatagccagccctcaagtgaataattagctcagtatgaaaggaactaaaatggtcatttttctcacagggcttcaagatacaagagcccaaggcgctctagtctcctttgggtgtttgaatttcctctttaaacacaccaacagtaaaagaactactatttcaaataagcagtaccataactgactatatcttccaaggttttggatgcaatctaagggaaagggggaaaagagacccgacttggcaagacccgtaccgaagcagtctggaaaaaaagcaaagcaaaaaacatgtggaaccactaaaggccagtgcacgtcaggtatccaccagtctgaagatgaaaggaagtaagcctcctcccctgggagctggaggttattagcagctgtttatccagtcgggaatagagattaacattgtactttttttttaagaactagaagaaaatttgtttgggaagttggcttttcatatcaagtcactgtgctttgccaaaaaaaacttcctttctcagaactcatgtactagcattgagcaatgttatgattctctgagaaactctgaattaccaaaaagtctttctccattaaatagaacagaaaaggacagagaaatgggtgaacgtttgccattgacacattgcagttgtactctttaccatgtgaaatttgccgtttggtctattacctgttctccaacctgactctaaatgggacactctgccctctacccctcacacgtaccctcacaacttaatcattgccactctaaggtgcacacaatgggttctgcagatacctactgcttgcaaaaagacctttcatgagatattggggaaactgcctagtactctgggtgctttattctcaaaaaacaaacaaacaaacaaacaaaaaacgagttggatataggtatttttcccctgatttaatgctactcttaatgtcattttcttttattaaatcctttcttctgcttttgatcttatttatagcagagccactggtcatatggaaactattactgtatagctgcgagatgaaagacttcatggcaattaaataagagtgaatcatttgggccaataatacacacatacagtgaggtaccatttgtgtccaaaatgccctgtgttgttcactttgtagcaaagccattgagctttacaaagggctttacaaaaatctgctttttgtcagaaatatgtagtctgacaatatgaaaacacatgttaacacacagtccttagctgcttgcttcttcacacatacacagtatctaaatcatgccacttattgatataaaatgaaattttcacttaaatttgggatattatttagttgtgttaagcgtcagctctttaaaaatatatttggataatctatatcaaaattcgacccatcactcaaaacctgcctaaaatgtcatgttcttcttaaagtagtccctggtttcctaaacgggtatgacttcatcattttttaaaaccctacatgaccttgtactcctttatgacattcatcgtattttgccttgtatagtaatattatcccatcattaaaatatcagtgcctgggctaggcgcggtggttcaggcctgtaatcccagcactttgggaagccaaggcgggaggatcacaagttcaggagttcgagaccagcctagccaacatggtgaaaccccgtctctactaaaaatacaaaaattagctgggcgtaaaggtgcacgcctgtaatcccagctactggggaggctgaggcaggagaatcgcttgaacccgggaggcggaggttgcagtgagccaagatcatgccactgcactcctttctgggcaacaaagcaacactccatcttaaaaaaaaaaaaaaaaatcagtgcctgcaaagtcatagacgtgtttatttttccttgcaaatgcccatgtagtgccttgcatatagtacactttcataaggcgcttgtcaaattaagtgaaatgtttatttgatagaaacatgctaaatgtatatttggcaatatcaaacaattaaatttcagacatagtctcacagatccatagcatttgtgtcatcatttgctaagcatctaactgcacattgtactattacactcccgtgcagtgacctgtgcagttcctgtccttgggatgggatgcccacaaatggagacaagtataggctttacgaatggcagcaaaacaaacttattgaagtttatgccctgcaccattcaacaatgaccttgaatgtgttttaagggtggtgtctgtaatgcatagtgagctcgtgaggtgacaagaaagtggagatttctggagatccactcagccctgaagggtcagagagtgaggggatctgtgaggctaataaaagagaagcagttggtgagttaggaggaaaaaactagcccagcagacagagcagggagggctttgctcaagccttagtgatgtgggcgttaacccagcagatgagaggccatgcgtaggtaattgaacattgatagtgaggaatttaaaaataggagggaactgcattggtcctgggagtctaggtgaaggatgcatcagcacaaggtggacctcttagactggatccatacagcaagcaagagccaggctgaagccttaatattgcatcaactgatggagagagaatattgcatttaaaagatgagtatttggaaagtgatggggaagaaatggttcattcgtttaggtgagcttctttatacttctactctcttttcaaatatattacagtaagcatgtgttacttgaataacaagaaaagcatttaagaaataaaggccaatgggtaatggtaaatccctagggatccttagggatgggccacctggactggctaaaaactgtgtggaggtcagcagcatgactgtgcactctcacaggtatgcttgcacttcaggcattcagaattccaagtgtaaatcaagtgtccagttgtcttttcctttaaacaaaagctgtttacacataattgctagacttcaccatattctctgtgctagatatgtttggttcactaggatggattaactttagttccataccatctacttactagcctgctatgtggagcaaggaagagatagaggaatgggctctgttaatctgccagtgtccccgctaggtgagctctctccagttatggtttccactgtataggaaaatgatgtcgagaattgagggtgtgggacacagaagagagaaatgaaacagttttaatagatggaacgtatgagttagtacaagaaagatgaactgaggtcggctcacatccgtttgcatttcttgaactatatcatagaatcattcatttaaccattttggtgaacatccaggggagtttcagcccagctgatcatatgatagacaagcactgccaaggtcaggatcatttagatcatgtttaaatcctcttgaaaattactttattatctggagaatcaatattaaataaatctccaagaattgcacaataaggaattaccttacatttcatacagaacataagagaagctgtgatgtttctggaaaacaatgtaggtgttctcaagacagttatgaaatcttctcccgacatacatgttaagaatcaagtaaaaatccaaacaaaagaattgaatccagatctgatgttaatgaaaagtctcttaaaggtttaatcacatgtactaaagaaaaatcatctgataattttttaaactgagaaatatggaaattatgtttgtggttggagtgtcccagatgttagctctttctcccacaacaggtggttattagaggtaggtcttgttttctgcagagcctctgtgcctctagtgttgttcctcacagtatctatctactgctgccattccatgaacttcctaattcccatctgtgagccattaaaaaagtttgcatgaccgcttcccacctctttaaaagatgcacttttgtactaaatggtgttttgcacatttgagaaaataagtttgctttcctctaatatgacagaggtctggcaagataattgaaactgaaatctagtactctacaactgtcatgtataattgatatttcatggggagattacagttcagacaccaaaactgttttctgtatcaatgggtttctaattacagtgaaaacccatcagcttttcttttgtgttaatggaaaaacaacagagaaaagtaacagtaagttgcagttaccaggacttctgtctttgtcccattttgttgttgttcttctttctaaaaaccaaaaaaatctatgtccaaaattggaaaccagatgccattaatagcaaactttaattttgatgtaccaaaatgtttataatagtatatccagttttgtgtcattatcacttggtctagaaactgatgacaagtttcctaaagttcccattgtatactcttttagaaggattatggtagaatagaagtgactgaggtctgaaagcctgttttgaagcagttatctctggagataacattaactaggattgaataactgccaaatgaaatttaatacattttcccatccatgaaataggcctcttaaatacaacagaataattactttcacaatactccctggaaacaaagagagcaaaaatattgaatgtcttttttgtttgtggtgtttgttgttagctagaggataaggacaaggatatttaccacaatgctgaatgcatctccatataaaaacagccttgccaacagccacctaatttgaatctgcatgtcttttaaatctgtttatgttggagggatcgtggcaaatattaaattttataatttagttagacatcttggccttggcctgagttaatgaactatgattttccccctgcaataaagaaaaaggaaatgattttcctctatctatatatgtacgtatatatatgtatgttatatgcttgtacctaggtgtgtgtatacatgtatggacacacacacacactgttttaaaacaaaagctctgggaaataaacgcatcttgccccctaactctcctcccctctcctatataattgttcagtgttgtaagttttctgagttcaaaatctgttttagatctccaactaagcatcgaaagttggatcttaagtcacttcaccattcttggccttagctttctttgtaaaatgaagagtttgacctaactgatatataaccaaggtcctccaagccctcgacgtctaagttctgtgatttaaaagtgtttctatcagtttgtcaagccctttcttggaaactaaggttatttaaaattatatggtgcttacgtgattcaaaataattattgcatatctaatgacatttaattatttccattgacaaattcacacaggagaattcaaatagctgtgttggaatttgaatataatttgacctaagatacaatgtaactcagacatttacacctacatgtaccagtcaatatgtggacgggacaggccaagccgcctgtgtttggactacatgatcttatccccccttcctcgtttgtagctctctggaccgggaaaatgcctgtcattaaggtggcccattcatagtatgacctatgtctgcttcaaaatgagctgggccatccagtgatcttggcattctgagcttagaaatacaaagacaaagaggaaattagcaggaggtacagaaccagaaagaatgcaccaagaggtatcatgaagaaagagtccaatctgtcatcatgagagggcagaagccagagagaagcagaggtccccccagagagaggagagaggctgaatagcccagcagaggcgaggagtggcattcggttcccaagagctctctgagtccaaaacctaagctacagaaaactatttatgataaatcttttatttgaacaaactcaaataggtttctcttccttactattaaaactaccccactaaattgatcagcatacaaaaatccccccaagaatcattatgagttccacaaaaaccaggaccacatctgagttatttctcattctatccccagtgtctcccaaagtgacaggcatgagctagattagaaaatgtttgttaaattagtaaatgcattctctgatcaatcaatgaataatcattgaataatttttaaatttcacttctatcttctatttttagcatagatatcactaaaactgcattatacgtgactatgggaagattcacatttacaatgagtattaataaaattttcataagctggcttttaactttagactattgttatctctatgaaaaggttatcaaaatagagctttaacgaagtatggattttctaaaaatagggacgaaatgtcatgcttagaattgacttgtgggaatctcctttctcctagtcacattatgacgtatttaagttcagaatgccaagatcattggatgccccagctcattttgaagcagacatgggtcattctatgaatgggccgccttaatgccagtgggcaaatccctgacccttgtatatacagagaacagtgtgagtttctccatctatttctgtgttattctagcgatggatttgtgccgacagtccactgtgtttcttcccttgtctcttatgtgaccagaaataatgtttctgaaagagaagaaaacagggttagaatatgccatctgtggccaaggaaacaagcaaagccaagccaattattcaaattggaatactcttccacagccacaggcaatggagttgatcctatcctggagaatcaagctcattattacatggctctggacctatcagagggcattcacatgacctggaatagacacaaggggagtcttaaaacatcacgacaaattagccggcgtggtggtgggcgcctgtaattccagttacttgggaggctgaaacaggagaattgcttgaacctgggaggcagaggttgcagtgaacggagattgcacccctgcactccagcctgggtgacagagcaagactctgtctccaaaaaaaaaaaaaaaaaaagtcagaacaactttgtctctaacattctttatggaaaatgattgatattatttaagatgatctatagaaaatagatggagttaggtaacatatgggcctaaaatccaaacaaaaatgtagttggaacaactatatcctcagatatatttataatatttaagagtttacagtcattgtataggggaaagatttaaaattaaatggattttaacaaaatagagacaaagatcaccgtaactgaagatagcttgagttttgagggggttcttgaactacacaggctattatttctatataacatgcaagtattttcagtcaaaacacatgattctgtctgcagttattatgtacctattacataccagttgtcatgtacgattgcatgggttctctttttctcttttgagaacttacctcaatgtgatctagagggaaaaaatttcaggagcagtaactgaatatattttaagtaaaaagcaaaacattactcttaagttatgtcacagatgcttgcaaagaaatcttgagagtgttaatgattctgaaataggagtacacttctcctctatgctcaaatctgtggttaccttcagtgattttgacttagagtcatcctttgtagaaattcaagaaattagatccattgggaatacaaataaatatgaatcagcacgaagaattatttaggtttatattgattgacagacataaagagccaccatttgatcaaggcctgtaaaaattcatgcttacaagttgacatcttagattgaaaggataatcattgattgaatccgttttctaatgcatgaatataaaaatagcaaatcaaaacctcaatggaaaatagctatcatgcttctgaataaaaattaaaatatataagagagtgagttacaaatggttgctggagcaggtgggcgtggtctgcctataagagagcagacttcagtcacagaggaaaggagtggtgtggcaggcaacagggttgaatatgtttaaaaaaaaaaaaaggtttgtacttaacgccacagagctctagaagctgaaactagaatcagtgagtgaaatctacaaagaggccaatttgtggtaaaaatggaatgggcttctttgggagatatcagtctcagtacatttgaagcaccccacagaggccaaataaccaccattcagaaagttctgtgttgcgacacaggcaccggggagcagtgctggacttcctacatctctctgctgaaacattcatttatacttcctgaggctcataagcctcaagtgttgtcttattcttgctgtattttgaatccaaacaattaatatgatttatgtgatcatctccacccaaaatttaaaaaaaagttggagtgcatacacacacacacacacacacacacatgcacacatgaatataaaaatggcatacttcaggatcaattacttaaatatattttcagtaaaaagcaaaatattataggtgatacttaatacatggctgcctttaaatagcatgtgcttattaggtcctgtgaatttgttgttggttcagatacttattgttgatgcattctttggaaatacccttttaaaatatattggtaacacaagagtgatgattctcctttctggtttcatatttttgactggaaaaaaaaataaacctgattcatagcagtataaatgtatggttaattttttgtgttttagacccaccgtcctgtgtaaatgctcacttaaccataggctaagaaaatacttggaaatagaaaagaaaatgtgaactactgattgtcctcttagttgacaaatgcttcatgttttcgcttgaaggcatgtgctatgaagtaggcagttgctgtctcagtgccacaagttcaatgtctctggaccccagagtcgatagtagtagttaataaaaagctcagcagtatttttttaatgaagtaatcatgctgtactctataattttattcttggaagcataaagagtatttacaatatggtgtctttctagggtcagaatagtgaggaaaaaaatggaaaaatgtccaaacatccttccttgcatggcaatgatggcattactggtgtgtttaataaaacctttattggtacattttccggtgtggtggcattggcagaaaccatccccctttggatttggaactcagcagctgatgaaatacagtaaacattaatttggaatgggctgccagttttggaaagccaggtgacattttattatatttgtaccaagcagaggctgtgtcccatactgctgtagcttccgctgtcagaggcttagctggcattatggaaaaaaaaaaatggcaggcctgagaatcttatcccctgaaatgaaagtcgaatgccaaattgaaattcctgtaggatttccgatagcaatgggggaattgagaagctcacaattaagcatatgggcattaagataattgtcagatctgttggcggacatgatagaagacagatgggtacgaatcagtgcgctccactgcagcaccctgggaggcaatttgacgttttacctgcctgagctactctgccatatttgtcactgaatgtacagcacggcatcttactgagtgttaagtgttttcgccgggaactataggtgcatgtgcggtccttcagcgccctctagtgaaacgcgtttgggagtatggtttttgaaaagccagccttcatcaggtcctcttggcctctggaaatagctgtcgcacctccggttcctgctcacctctctggttcctctcgccctttcaggtggggacccatcgtgaagatggcgtggccctgagaggcagccattctcttctgccaaaccaggttccggttccacagcttcctgtccagtctgcgacttcccctgacctgaacccaccccaggacccttacagaggtaggttggcctcaccagggcacttctgacctcactttcacaataggaccagtgttgatacccagcctcttggtgttcatccctcaagaagcactggcagaaacccaggaatcaaattgggcacaaaaatggtaaggaaatggcaaagtatttagaacttcgcccgctaattgtgtttctccagggactgttttcctcaaacatcctctgaaatcctggtcctatatcagcagggaatgaggccacagactgatgagaggaaattttattttagctatttccacatttttctcattcaggtcctctaatgtggttagttgtggcctgaaaatgatatttccaaatgaataggaaggaaggaaattgtttttgttgtttaagatggaaggaaatataggtgcatttaaaaaatggagcttggttgcatgattttcgctcttgagtcatctagccctctaatgattgcctcataccggtgattacgagcggcttttcatgaccccaggaagttgggctattgctggccagctgactaggagtcgcttagataacatcttctcagtcccttcacatttaatataaaaatgataacattgccacaggaatacatgtgggcattttttcagctgttcaacattgtacagatctgagtgtcaattatatgtatgggtatgtctgcccattttttatgaataataatcattttatggactttttttttttttttttttgacagagcctcactctgtcgcccaggctggagtacagtggtgcgatctcagctcactgcaacctccacctcccaggttcaagcgattctcctgcctcagcctcccagggggtagctaggattacagacatgcatcaccatgcctggctatttttcgtatttttagtagagacagggtttcaccacattagccaggctggtcttgaattcctgacctcaagtgatgcacccgcctcagcctcccgaagtgctgggattacaggtgtgaaccaccacaactggccaggacctttcttatcaggaggctttggattttgccctctttgtcctaaacctgtgcttctcaaactgcacataagcacaacctgagcatcttgttaaaatgcagattccacttctgtaggtctgggattgtccatttctaatgggctcacagatgatgaggccgcatggaccaaagtttgagtggcaaggttctagaatacacagattacaaataaagaggaatacttgacagatatgcttctacctttaaaaaaattactacattagggtcgtgttttaaaatgcagtgtgacttggaaagttgagcaatgataaagctagaaatttctaaaatgagtagcaaactgccttccatatgtaccattttaaaatgctgattacttcttgagaataagagaagcctaatttcagaatatcattagggtacctattgaagtcttgactgcacatatttagcatactccctgggaattatattttaaggacatttttctattaaatcattgcatatggaagaaactcaatataatagctgatatttacttgggttcttaatcagaacattggctgtgtgattttcatgattatgattttcattgcaattaagttgatgttttgtagacagtgaaattaccatctactccaaaagattgcaaaatagaatttaaccttagagccaatgcagggaaaacttgtttctgcaggtgcattttttgaaacttcaacagatagcagggggaaaaaaaagtgacagaaggatcacagttcagcagtatgaattgtctgctggcagccttgcaatctggtgtgcaggcagtgagattgtggtgtacatgtcacctgatttctctttttcggcaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctaggtaacagtatataatactgtcgcttcatttaattcctttattggactttgatgaagtgaacagaacgggaagaaactattcagttttttcctggcaggtaaatttacagctgaaaagaaaattaaaggcctactctagaagtactaaaagtatcgtttcagatacctgtactctattggagcctaaactgttttggcatttatgaatctggacccaatgctaatgacacacagtgaaaaaatttgtctctgattcaagtacagtttatttgtaaaactatacttattctacaaatttggtcagaaatgttgtgtctataatatttctaaaaagagattgtagccatgttaaaaactcaactgatgtatgtgccaactataactcttttcttacctctaaagtaagaaaataatttcctagatttatcctaaacatgctgatgtatataagagtaataccttaattgtttatggtttttcttcctggacactcttttctacagaaaacacaactgcaggaaaatagcttctgtctggttttcttaaatatctgctatctttaaattcaaatctatatctccttgaactttaatctggtaatcagatggtttttgaataccaacacccgtgtactttgcctcaattccctgaggttgtttttattcacaaattcaaccaattgtcctaagactacagctttccttctaaaggctgtggttctcaaggttctatctggaatcttttgtgaattaagaacatgctgcctctttatgttgctgttgtaattattgagataaattccgtgtcttgccacaagtttaaaaatgccgaatacttctagataacccctttccttccttgttgtctttttctgattcttggccactttggcaagaaatcccaaggaggggatttcatacctttagcagcttctgtgttagaccagtcagttcttggtaatttaacttattgtggccaaacttatgcatgttaatggattctttgaagttttggaacaacattttcattcgctgttgagaaccttcttatttaaaaaggtcactcttatgacatttacttatgtatgcctccaaaactgtattataaggcagtgctttttcaaatctaggcagttttatttgcataactagtttatttgtaagtgaataaccaattctaattggtcgttagcctgaaaatctttggaagaaaagttcctattttccagtctcctttgtgtaaggtgtagcatttgttggatgtataaaaatatcacccaaatgctcagcttccggacaggcctggcagagactgttttcatttgctttttacagcctatttgcatagtagaatataggagtgaattaatcattactgatttccttggcactggcagcagttgggggtgagggcagaggagggatccgcagaaggcagagaaagagggccttttccagtggactcagttgacttccatgtttaccatacacacctgtggcagacagtgccatctggaaaggcgcttacgctatggagagagaggagcctggtcttacagcatccttctgtggtgtcatcctccttgcccctaacttttctccttcacccaagtgttcttgacttacgtgcattatctttatgtgtaacgtatacttgcaaccgaagaataccactcccacttttgattgattggagcttctcaagtgtaattggtccttattgccacttggaagttacccagagattctccaaaatggaacatcagagtcatatattttaaaccagcattcattaaatatacatttaattgagtagataatttcccacatcttccaactccgaaatgttgtgattaatcatctttattctgtgaacatttccaatgtgtgaaattaccctttaggttaattgttagtcacttccatggagtttcttgtgatggggagtctactgatgttcagtgaagtttgtttcattttctgtgtctctcataagccccccaaaagtcctcactcatgtttattcacaatagtcattcagagctttatagcacgtgctgctctgccttcttgagacaagacgtcgtgcacacttctcttttttacatgacagcccttggaatatttgaaccctgctgctgtgacgacttcctcatatgatatgctttccaggtggctcatcatcctctttgccttccattcaaaagtttctaatttgtcactgtaacactcagaaatggacagaaccgatcttatcttttcagactattctgggcccggccatgcatttgttatgaatcatggaatattttggttttcacaattagaaattaccttttggcttttttttttttttttttttgtaagagacagagtctggctgtgttgcccaggctggagtgcagtggcctgatcacatctcactgtagcctccacctcctagattcaagtgagcctcccacctcagcctcctgagtagctgagaccgcaggtgtgcatcactgtgcccagctaatttttttttattttttgtagagacgaggtctcactatatcgtccaggctggggttataggcatgagccactgcacccagctttctggcttcatttttgactcacaatgaggtcatggtcattcataagctgcaggtgtttggtttgttgaatcgttttgcatgactgatatcagttcaggtttcccaaacttgttctgtggatcataaacatctataagattaaagaccatggaagtcatgtttttgtaactttttgtttaatacatagagaaaatgagactcacatagtgggttgaccaggccttcaaagcaaggtaatggggacacctgaataaaagcctcactgtcttcactcccattgctctggtgtcttacatataggcctttcttcttactcctgttaagctgccttgtatttttttgacctatcaaaatcatttttcaattacttgtttcccctagatttcagatgtcacggtatgaaaggttttatatatatttaaaaaataaagtataaacataaagtctttttgaagcgtggttatgcaacatatgctaggcgtaagttggtgaatgcctgctttgcagagtgtaaccccattgaataaaaaaagctttgttttccctttctgcccccctgtatcagtatgggcacaccctgcactctaactttaatctacgtcaccctcacctgtttggtttgggtttaatgtctgcgagaaaaccaaatatcttgtgtattgtgaactgtcaaagccatctaaaccaatcccaaggtcaagtggatataaaaattctgccaaaaacatggcataagatggaaaagttccctgaaaactctggaagaaaacaaagtaatgtagacaccttctttttccccacaccattagaaaatgttgcatcccttttgtcccacagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgaggtcagtgcaggccagcctccttgcagagctcgtgaggagcttgtggcaggcacaagctgagatgggcacgccagtcttgagcagtggcagacagtagactttcaagcatcattccaaagaattgtttccattgcagactgtgtctaaatccataaggcagcatccctttctcctgtaattaagttgtgggattctcttataactaagattatattgcaactttccctatatcctttcagtaatttgagcttagtttatttgctttaccaacctttgcttactgtaaagtggctgtacacactcacatgcagttcaccttttactagtgactgaccaaatggattgccacagtacttagtaactgttccttttgttctgtaatataaacactgagaaaaaggtcagacacgcaagaagagtgcattgctgccctctgccagaagcctcagcattaaacaaaggttctgtgctttaatcctccacagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggcaagtttgttttcagccatttctgagatcgatcattcaaaactctcatcagtgtatcagccataaaagtgaatttcacccaaattgacagatattttctttcatggaaaaagaattttttttaaaaaaagcatactttttctgttacaaatatattaatgaattttttctctcttttttcctttctcaggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaatatgttcagtagcgataaaactaaaataactttgatttgttgataagttcctaaaatgtggaggtggattaaaaccttaggagaatagcagaaatcaaacttcatgaaaagttattttggggctttcctgtgaaatgtatgaacaaagaggctcagagaaggacatggaagacaataatgtatactctctcctcctccctgaataatgaaaaccatgtgtatttgttccctccgtatgttaaagatttccttttagtggtacattctgcactcattttgtatagtctaccaaggcgggtatccctaggaacaatattatataggaagcaggtatactctgatcacattcaggataagtgtacagaagaaaatacggtgtttactctttagggaactggaaacactccctgcattgatgtacattttaagaatggcacttttgatacatgttatcataaaggtgcttaatagagctgaattaaagtttttcaaatctgtaaacaaagcaaaaaagtaaattgtagtcatttgattattttttaaattggtgctttatattttgttctcactcagagtaaaagctgcaatttattgttcaccagctttgatgtattcattactcagtaatgcaatacctctattgttgaattccctttggaaataagtgaaaattctaacggccactgaaagctgctcgctaggttttgcttggtggagaaacataatctgcacctatccatattaattgggttgtatccccattaaaaaagaaaaaaagggaatgtggcctttttagtgtgttttttattgttgttgttttgtaattatcaaacccaggtaagatattggtatcctgcactggattttcaaatgaagttcagcagaagacagttaagattaaagtactatacaaaaatttcaaaagggtccatactacgctatctgtatgacgacacttaggctggggatctctttcagaaactcggactttaaaagcaacttggagcagttgatccacctccacattcaagtaatttatgaatatgcagaatagggatctgttcatctagaaatttttaccatttgtcttctgtgtagctgcaaggaacactaatgtttatacaactgtcagtccacccagtggtgcaactggttctgattcagtcttccgattcctttttatttttcactttttcctatttctgaatttttttttttatttgtgatcttgattttgatgaggggttggggagtggggagggagtcgaaccaagacttggagttaagaggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttataaactgtttctgacacttgtttcatttcattttgcattgtccatatagctatgattctcttctgtaagtaaaacgcatctatatttcattttccaagtgttggaggtattgacagcttaacaaacaaaacatacaaaaaaaatcacaaaaacaaattgaaaagcaaagcacatgattgatcaaggaagagatgcccttaatgaaaatggaacgggatgcatgcaaaacaaaaagaaaactgtctagaggattaactaattgaaggaatataattaatgtgtgtgtaacactgaagctatgcatttgaagagctctgaactgcaccagtgttttcggttgtgctgcaggttgctaagtcaagtcagccttaaccttttgcaccagttggtcggctgtttggcagaacattctcagatcttttcagtcaaaaatctaagatgatttattttgtatcactttgttaaaagctgaatattgttaactacagttaatattaacactgtatttatactttctcaaactacatccgccccaccacttctggttgcctctgttgactattaatccagatgtaaacaaccagatgtttttttctaacttgtacaaactgacgtgtgtcaactatcatggaaggaaaaaaatgtacagattaaaattattcagtgttatgtactgtaagttaatatttttgtagaatggacatcaatctactttgcaaaatttggaggctatttcaacattgcactgtagaaatgtaaagtaatgtatgcaatgtaaaggaaagcccgcggtagctgagcgcttcataacagaatgttctaatcaagtacgtggtatttggggatgtctccaatattgctcttgtattctttctaattgggtttagtgactagttgaaggaaaatgttataacgccatttggttcacatgtgaagtgccctccatagccaaatgttgggatttttttttttttcgtttttggttggactgtttgcagatatttaaattttatgaaatttccaaagattttggttgataacccccttttaccttctaaatgatttgagatgttcttatgttcttactgtgtgttttaaatatatataaaagagccacaagcattt

SEQ ID NO: 6287 - DNA, 55119 bp, Homo sapiens
gaagggcaacacggggaccttgaagcggggtcgcggcggcgccccagcccgggccagggagtcccggcagcggcacctcccagaaagggcggagccgacgacgccttcttccttcctgaccggcgcgcgcagcctgctgccgcggtcagcgcctgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgagcggtcgccggccaccgggacgccctgtggggacgtggcggggccgagagccggggaaggcgacgggcccagcgacggctcaggcccgggtcctggggaagttggtctggcgatggagagctcggaggttcctcacttgtcctgtttctgtctccggccacgctctctttcctgtggtctggaagagggtggcagtgggggcttgggtgacctgttctgagcttgttccatctgtggtcacctaatttctctgtgtaggatgtggcaccagaagaagggaggaaagtgggtagagtgggatagggacactacttgctttttaaaaaattctgctacatgcgcacgaactccaaaatttaggagctctaaccactttatttcctcttctcatcacctgaggatggaggtggaagcagaggtaaagagacacaaacttcctcaagcacccggtgaaactgccttgagtacttgacataagtcagcttggtcttctaaagagggcaggttacttttcatcaactcctttttacacctcaggacactgagactcacagggcggtattgaatttccccttgtcactattagccagcgacaggatggggcctggaactcggtgtcctgctgactccttctgggggcttttgcttggtttaatagctttgggaaagagcacctcagtatttgtgtgtctgtagtttcctcttttaaaactggagtggggcagtgtcacgctgtgactcgttaaaccaaatcaggatgagagtgcctccggggaattgtgtccttgtgcacattaacgcccctcacataggtgtggcgtcaataggaagtggtgaatcaggggagagggggttccgtggactagaaaaaactctccttcgacttctatttagttctcagaaggggataggtgatgttgatccaataatggactaagagccaggagaagggctccgcgggaggatctcttgagctcagcagttcaagaccagccggggcaacatggtgaaacaccgtcttaaaaacattttgtttttcttttcattgttgaggttgaggctgctgtgagctgtgatcacgccggtgtactccagcctgggcaacagagcaagaccctgtgtcaaaacaaaaaagagagagaaataaataatagcaattatgtgccgtagagaaaatgtggctattctgtttccctagagttttttaaaatttatttttaaaatttatttattttagagacaggttcttgctctgttgcccaggcgtgggggcagtgtcgccatcatagctcactgcagcctggaactcctggcctcaagcagtccttccaccttggcctcccaaagcactgggattattgtgagcaccactcctggcccctcctagagttttagatcaggaccttaaataggcttcccttttttttggagacagagtctctgttgcccagtctggagtgtagtggcgcaatctcggctcactgcaacctctgcctcctggattcaagcaattctggtgcctcagcctcccaggtagctaggattacaggtgcccaccaccacgcccagctaatttttgtattttccgtggagatggggtttcaccgtgttggtcaggctggtctcgaaatcctgacctctagcgatccgccctcctcttttggggattacaggtgtgagccacctcgcccagccaggcttcacattattaagtagccatctcttaagtattttttaaatctcaagtacccaaggctgatggccaatgagtgcttcttttatgacatttgggataggtcagaggtttgttgtaagtctcttgcaaaaatgcctggaggccttttcaaggtctgtaaaccttaactggaaataatcctattattattttaaaaattcctcatgtctgaaagctttcagtgcacctgaacagattggggtggagccatgaagccaaacagattgggagagagagtgtgtctgcttttagaattcgtaccgatgatagcagctcattagcttcagtctgagcgctagtagagttctatcatggaattatggactagttgtcctgtgtaagatctgaaatacatgttggggggatttttgctttttcttaatgttcaatatgtacagatgatgtaataacattactagactgccttgtttttaaaaccctgtagtcatctaaaaactatatgcagttttgagacatagcctttatttttcccggctgtaattttggtaagctttatcttgagggacttggaacatagagaagcctgggtagaaattaagcattaaaatggcttttcctcagaagactgggaatggttaatcttttgacctgtgagtgattaagaacaaccatctgaaattggaatgactgtgggaaatctttccccatctttcccactccttgactgatgctgtgatcagaaattttactaacataagtaatcaaggggaaaatgagatttttttaaatttgagccagtgggcagagggaaaaggactcgctgaataggcctttgtattcctccagtgtttgttatattacccagaacaaagaatcactctggtcatgaagacagtgtgctctctctttcctgggtaaccctccactcctaaaagggatgcagtattctaagcatggcagattacctacagcggaagcctggatcagtcatctctgatctcgggtgcccctttctgccctttgacctccagctctgtgaagggcatcagctctccagtcaaattgaactgcttgctagcaaaatcctgcccatcttccagggccccatttcacatgctacattatctacgacattcttgtcctgttcccctaactagaatgccttccctctgaagttctgaatctttatttaaactgctgcaacagcatttgctgcctcattaaaagaccttggtgtgggtcttgactcttctctgttcccaagagtgatcttgggtaagccagttatcctctggagcctcagtttcctcctctgtaaaattggattaactgtgccaactatgcttgtgaaagacaaatatttcctaattgaactaccgaattgcaggctccttaagagcaataactgttgctctccaatatcatctacaaatgtggccaggacacttgacttgggactcttttttttttttttttttttgaaacagggtcttgcactgtcccccaggctgaagtgtagtggtttgattgtggctcactgaagtgttgaccctgggctcaagctatccttccacctcagcctcccacgtagctgggactgcaggtgcatgccaccatgcccaactaatttttaaattttttgtagacacaaggtcttgctgtgttgcccaaggtggtcttgaattcctgggctggagatcctcccaccttggcctcccaaagtgctgggattacaagcatgagccaccgtgctggccctggaatctttttttttttttttcaagaccaggtcttactttggttgcccaggctggagcgcagtggcacgatcttggctcactacagcctcgacctcccgggctcaggtgattctcccacatcaagcctcccgagtagctgggactataggtgtgcaccatcatgccctgctaattttttgtatttttagtagagaaggggttttgccagcttgcccaggctggtctcgaactcctgagctcaagtgataccatccacctccgcctcccaaagtgctgggattacaggtgtgagccaccatgcctggcccactgggattctttgatcataagatatttgggccttgaaatggattttggggagagacttagaaactagtggcaatcaaaattggatttgcagttggtttctaggtgatggcagtgatcagctgcggccagccaggtttttcttcatctggactgtgcctctcactttcaaatttttggaacatttgctttggcagcaaaacttttaaaaaaccaactctctctggtgcaggtgttctgttggaggatttgagagaagctttaaaattttatcttattactgtcccttgcttaggtcacaagaggagctcaaaataatttcataaacatgaattggcttccctagacacaacaaaggataagatcaaaagaattaacccatttaaaaaaatcagtctaggctggtcctaaggtagtgtgttatcaattgatcaaagtcagttacagatcgaactccttgatctactctttcctcctgctcactactgcacttgactagtccaaaacaataagtaagtagtaaaaaaaagaaaaaaagtccgtctatacactgtaaagtgctgtgtaaatgttcataattactatcactgtcttcttcatagttgatggggggaaggctggatacataaaaaaatggtaatacagtaagaagtgctcagataagaataaagataaaatgttatggagagtccatttttgagctgagctatggaggatgaattaatgtatcaggtggacaagaggaaaactagagaaaatagtcgggagagttgcctaattgttgccctaaactattgaactgttcacttgaaaagggtgaattttatggtatgtaaattacatgagtaaagctcttaaaaaaatttgcagggtgctatatactagattacataagactagagacaaaagctacccaaattttgcatagtactccattgctatcacatccgatcttgttttatcctcacagagcccctttaaggtaggtgtaatgctgtttttcctattttatagatgcagacatcaagggtcaaatttgtcccaaggtcacatagctagtagatggcacattgggtgcttcaactgccatcttctgacttctgtgccctagttttttgaaattcaaggctagattattggtgtttagcaagcttaattgaatgggtgttcagcagatattccacttggttagtagagcagtctcattcaaggcctggttccgtccccagtgtggctcttccagtagtccgtaatagatcaggaatgggtttagcctgctggcctgacccctgattcagtcaccacactgtgaacattccatagggaaaaaactgcagacagtgtatactggcacccactttcatagttttgttttagttttgtggctcctaaatgtctaagactaactagtaatatgaccttgggtgagtcacataaaaaaccagaagctaaaggggttatctgtaaaacgaagagttggactagctgagcacacctagcactcaaaatatatgacttaaacacccacatgcaggcaggcctggtgcacacacaaattatcctttgttatgtagatacgttcatgccaggttggctataaaacacttccagagatttccgtcaatagaagtcagaccagcccggcagcctccaccctaaatgccctgccatatttgtttggtctgcctccctgactccaaagaagcagcaggcagcttaatctctggacaggattcttcatgccactccctccactccagcctgtgttgtcctgactggccaggccagcctctgctctctggagaagcaatgaggtagggaagttaaccagcaagcccctctcctccatcgcctcactggagcttgagctgggtatctctccatgttttgccattagctttacccatccaggacaggggcacaagtgttggtgccaagccctgcactcccagctctggtggatggccaagtcctaccctggggttgaggactgtcagtgatactgagtaagggagtcattgcttgacaactgcctagagagatactttaaaagataggaatgggaggcattatttctacaagtgaacaagtttatattgaaggaacacttgtataggatcatcatggatgggacagttcatctccagtgcattctccaattctgaggatacatcactgcacaaactggactagagtttaaatggtacagaagctgggggtaggggaggcaggaggacaagggggatgggtggagaatgcttaacttggtgttcaaaatcatgttatttatgagccatgtgacctcagagtatctttgagcctgagttcacttacctgtaaaattctgctgtgctactgcatagagtatctgagaaaatgaggcatgcagtcgatgtttggtatttttgtttcatttatttattttactgccatgcctcgagaacaatagatgttcagtaagtatttgaatatgttagttaatgctttaggatttcctaaaggcagtggaatagaattctcactgagttcagagcttttctgataataatgtgtgcttatggagctcctgaatggggtccaatttagcagttgctatagttgctgagatatagcacaaggggcattttttttttttttagatggagtctctctctgttacccaggctggagtgcagcggtgcgatctcagcttactgcaacctccgcctcccgggttcacgccattctcctgtctcagcctgtagctgggactacaggcacctgccaccatgcccggctaattttttgtatttttagtagagacggggtttcactgtgttaggcaggatggtctcgatctcctgacctcgtgatctgcccacctcggcctcccaaagtgctgggattacaggcatgagccactgcacctggcctagaaggggcttttttttaacctttcctgaactgttcctatcgttgaaagaagcttccctatccagtcattttcttagtaattaaactctagagcatgttgtgaaatatccatatgatctaacctttaaaaatagaaactctttagctgtgtaactactaaattctgggtagaagccaaaacaatcagcacttctcatttctgaacttagataatccagttgtactccctcagctcattgtgagttttgacaagttctgcatccatgaacaccagatgtaatacaatagggaatttcaaaggaaggattacacacctaggctctgccctctaggattttaccgtcttacaagggagttgagacaaaagtgagaaaatactctggcaacttctcccaacatcacaactttgcaattctcataaattttgcttgatcctagggcatgaccaaggcagaggcaggcaggtcctacttcatgtgggagagaaggaaggaagggtaggcagttagagtgataggtttggaatactgtagaaaggagagtgggcagagccagagtgaggtgtctgaagcttgtcgcacaggcagtgggaagggtgggttggaggtttctgagcaccagaaaactttgagcattgttccggaagaggcaagcggcaggcatctgcaccagagacactgccgggtccgagtgagggcaggaggctgcacgagggagcctccctgggagtgagcgataggttcgctatgggaggtgggttcgaaaggtgcctgagattttcatttgaaactctgttgaagaggaattggcaatagaggaggaaatacaaatagaggaaagattggtttcgtcttaagcactgaggctgttgggcagctagtggaaagtgctgctggagagaagctggagatcactgaagctgagagaggggtttgtggatataattagagcagtgtttctagggaggtgcaggtgaagggactgagagagagatgaggttaaaaacacagaagagaaagagatggaggtgtggaggcccctgaggtggagcagctgcagaggcaggcctgggggccaggaggctggctctccactttcagctgttggtgagaagggagtgaaggctgagcagctcccattgtgcagctgttgagtgcacaggtgctcgtgctcttgcacacggtggggtttggggagggtgtgatgctacagggaggactttcatgatgcagctgattctcttttattgagagtctgtttctggagtcacctgctctgttttgaatcctggctttgccactgtgaccttggacaagttgtttagcctcagtgccttcgtttctgcatctgtaaaaggggtataataacgcctccctcatcaaactgttgtaggattaattgggttaacatattgagaggtgacagcgtgctggcagtcctcagagcccttgcttgctctcggcacctcccctgcctgggctcccactttggtggcatttgaggagcccttcagtcccccactgcactgtgggagcccctttctgggctggccaaggccggagcccactccctcagcttgcagggaggtgtggagggagagacacgagcaggaaccggggctgtgtgcggcacttgcgggccagctggagttccgggtgggcgtgggcttggtgggccccacactcggagcagccagccagccctgctggccccgggcaatgggggacttagcacccgggccagtggctgcagagggtgtactgggtccccccagcagtgccggcccaccggcgctgcgctcgatttctcgctgggccttggctgccttcccacggggcagggctcgggacctgcagcccgccatgccagagcctcccaccccctccgtggcctcctgtgcagcctgagcctccccgacgagcgccaccccctgctccacggcgcccagtcccatcgaccacccaagggctgaggaatgcaggcgcacggcgcaggactggcaggcagctccacctgcagccccggtgcgggatccactaggtgaagccagctgggcttctgagtctggtggggacgtggagagtctttatatctagctcagggattgtaaatacaccaatcagcaccctgtgtttagctcaaggtttgtgagtgcaccaatcaacactctgtatctagctgctctggtgaggacgtggagaacctttatgtctagctcaaggattgtaaatacaccaatcagcaccctgtgtttagctcaaggtttgtgagtgcaccaatcgacactctagctgctctggtgaggacgtggagaacctttatgtctagctcaaggattgtaaatacaccaatcggcactctgtatctagctcaaggtttgtaaacacaccaatcagcaccctgtgtttagctcaaggtttgtgagtgcaccagtcgacactctgtatctagctgctctggtggggccttggagaacctgtgtgtggaaactctgtatctaactaatctgatggggacgtggagaacctttgtatctagctcagggattataaacgcaccaatcagcaccctgacaaaacaggccactcggctctaccaatcagcaggatgtgggtggggccagataaaagaataaaagcaggctgcccaagccagcattagcaacccgcccgggtcctcttccatgctgtggaagcgttgttctttcgctctttgcaataaatcttgctactgctcactctttgggtccacactgcttttatgagctgtaacactcaccgcgaagatctgcagcttcactcctgagcccagcgagaccacgagcccactgggaggaacgaacaactccagacgcgctgccttaagagctgtaacactcaccgcgaaggtctgcagcttcactcctgagccagcgagatcacgaacccaccagaaggaagaaactccgaaaacatctgaacatcagaagggacagattccagacgcgccaccttaagagctgtaacgctcaccgccagggtccgcggcttcattcttgaagtcagtgagaccaagaacccaccaattccggacacaatgtgaagagcatttaaaatagtgcctaagcctaggacaccgccagtgctttgtaagtctttgggtcctgctggcttaggttgcttctttcggcaggatgactttttttttgagaccagttttcactttgttgtccaggctggagtgcagaggtgctatctcagctcactgcagcctcaacctcctgggttcaagctgatcttcccagctcagcctccggagtagctgggactatgggcatgtgccactaggctcggctaatttttggctgttgttgtttttgtttgttttgtttttttgtttgttttttgagacagtttagctcttgttgcccaggctggagtgtaatggcacaatcttggctcaccacaacctccgcctctcgggttcaagcaattctcttgcctcagcctcctaagtagctgggattacaggcatgcaccccccacacctggctaattttgtattttcagtagagacagggtttctccatgtcggtcaggctggtctcgaactcctgacctcaggtgattcacctgcctcagcctcccaaagtgctgggattacaggtgtgagccaccgtgcccggcctgttgttgttgttgtttttaagagacagggtttcactgtgttgcccaggctggtctcaaactcctgggctcaagcgacccacctgccttggcttcccaaagtgctgggattataggcgtgagccaccacttccagccaggatgactttttttttttttttttttttttttttggtcttctctgctgtgtctctagaagatgaccttttgagaagcaaacctgaatgttgattcaagcccaaatttcctgggctcaggtgttaattttttaagtctttggaacctctttgccgaggtctcaagcaggtagaagacattaataataattccttatatttgattgcgtggtgctctgtagtttactgagtacttactatatatgtacagataggcccttatttgatcttcacaggaacctgtgaggtaggcagagcttatgagcttcatttcccaggtaggaaaactcctacgtggttacgtaacctgctccaggtgtgatcccaggtgcaatccagctcaacaagcacactgagcctcaggagctcttgggatcagaacccaggactcgatcccactccgtgccgccttctcacccacccctcttccaccaagtgggtggaaatagcacttgctttgaaataagtaacgaatgatctttgtgaaaaggaacctaaacagcagtgggccatctttattcacatctatagtaccaagtgctgagtaaggggattttagactccagacacccgtcctgtttgtcaggccagagctgcagtgtgttgactgcacatctgtctcttgtcactcctgctcctgtgggtaaccagccagagtgcccctgaggcagagacaggccaatccctggagagttctgcgaggtctagggaagagttctttgtatttaaaatttcatgtgaacttcagcagtttcctctgcctctgtagtcagcttttgccttttcaaactttagttagatggataatgacttttactcattaggacttttttccattagttggaaacccagagttgcaatacgtttcttttttccttagaatcaccgggtttatgggaataacaattgggattctctttatataaaaatagtggtggaatcttggcacagggttcatatgtggctttgttgaaggcttgttgtcacttccttatttgtataatttccctcctttgtggcctaaacatgactttcaaagagtcaagaggagttaagtcctaatttttattttagaacatctgaaaaatgaattcagagaaaagtgatattgatgccttggatttccccacacatacaaatcccaatctcctgctgactttttctcatgtttttgggcttcagggactgttgtgggatttgtattttgatactgaaggaccaacacagactgacttagcttcttgcctgtgtgcaggtcatgtgccactgtcactggagagaatttcatgttgtgacttctgttcagatttgttttttttttatggctttcccatcagggttcttgggagccatggctgcttcttgatatcttctgtttccctgtagaacagacgattgcaggcccggggccctggcaagctgggccctctgtggctttctgagtccattgtgaggcagaggatcaggtgcgttttgggcagcagccttcagagcaaggcactgacctgatgattcacactgacccctcccctccgctgaattttctgacaaccttgtgactctcacatgggaaatgtgagtggtttttgagaaatctttacataagaggttttaaaattttcttttgagattgcctcggtgtttttccttaaagttagcacattctttgctttctacttcagcctcaaggacaggaagttcattctcgctctttacattggggtgttgatgtttgtggttttgttgttttgttcttcatgttactcatgatgtattgatattaattaacctaaatacatatggaaatattctttcattacttagagcttatatagttcctggtgcagatgtgcaaaaatagtgctttagtaattgctaagtcactatcttgcttttctctctactgtgattgagtatttcttacatggaactatagcttcctcttatcaacaaataagcaggaaatagaaattatgtaaataagcaatttccattacctacttcactgacttgacaaataggcatttggtctgctttaattaatatttttcaaaatgttaagtgcctgttgctgttacttaattttgcaggtagcattggaagtttctgtgattgtacttgagtgggcacttcttgttgaaatttaccattgagaccctggtaacactgaagtttgtgttgactttctgtaggtgttttcacagtcctgtgtttggtatggagagtgtggaattgcatatggggacaagaggtacaattgcgaatattctggcccaccaaaaccattgccaaaggatggatatgacttagtgcaggtaagttcattatcttaggcactgggaacacaaaatgctgatcacaagatcctctgtaattattccttaaatgttattgcagggtggaggtggagatgagactaacaggcttaagtcttatcccggactctcaaactctaacctgtggcatacagtgcagagaaagaacaccgtaactccaaaggcttaatttttcaggggctgactttatacctctcataaagtttcccaatagcaggttgctatttagagactgaccttggtacttcgtatgttgcccttgcagcatctgcaaaatatattagaagttagctggttttgattcctagatttcaggactcaaatggactctgttgctaagtggctttgacgtccttgtcccctggtcatttcagtgttttctctgtgttccactgagagcctgtgaattttggctgctaccaggattctgattcctgttctttttttaccatcctgtgatacacagggatattagaactggaaaaatcatgtgaaaagcctggttttagaggcttaaagtaatcaaaagtcaagtcgacatgataacagagttcctaggctcacttgttcgtttcttttctgtttttgagacagaaggagccttgctcttttatcctggctgaaggctagagtgcagtggcacaatcacggctcactgtgtcctcgacctcctgagctcaagcaatctctcaactcagcgtcccaagtagctgggactacaggcacatgccacaacccctggctaattttttaaaaatttggggagatggggcttcaccatgttgcctagcctggtctcaaactcctaggctcaagcaatccaccctcctcagccttcctaagtactgggagtacaggcatgagccacagtacctgtcctcacttgctgctttcatcataattattaaaggtttcaactttccctggaattactaatagaaatagtaagtagcactctggttgaattgaatcaaacaaacaaaaaaccctaagaagacataaaatgattgtcaggagaggagagaaagcttccaaataaaaagaaaattagaaacatctctacttgtgaataaatagtaaatgtgtagccttttaaaataattctataataactttgcaaatacaggatgtgtcttacccttttgtacttcaaaaggattacatgaatgaatgtgtcttagttcactgaggaatgttgaccttactctaactgttgcctactcccgtgtctgtgctctttcacctgaaaggaactctgtccaggattcttctttggcaatgtcagtctctgttgtgatgttcggcagcttcagacactaaaagacaacctgcagctgcctctacagtttctgtccaggtaggttctgctggggaaacagaacaactgggctgtagatacttgtgaactggtaatgctcagctttccatttattctttgtttacatatttttatttattatatgtctatattatatgtatattatatatttatacatatatgtatacatgtaaagtaggtgaatatatatttatgtattaaaaatacatgtatgtataatgtgtatgcatgcgtgtgtgtataatagagacagagtctcactctgctgcccaggctagagtgcagtggtttgtggtgtgatcacagctcactgcagcttaaacttcctaggctccagtgattgttctaccttagcctcctgagtagctaggactacaggcatgcactaccatgtctagctaattttatttatgtttttctttatttttttttttttttgagacagactcttgctctgtcaccgaggctggagtacagtggcatgatctcagcttactgcaacctcctcccgggttcaagcgattctcctgcctcagcctccccagtagctgggactgcaggcacatgccaccacacctagctaagttttatatttttagtagaggtggggtttcaccatgttggccaggctggtctcaaactcctgacctcaagtcatctacccgcctcagcctggttattacaggctgggattacaggcatgagccactgcacctagcctaatttttatttttttctagagatgagggtctcactatgttggccaggcctggtctcaaatgatcctcccaccttagcctcccagagtgctggattataggtgtgaaccacagttcccagccagtttttttttttttttaaagtcagtttttgttttgttttaagaaagcactcttacaatttgtcagaaataaagagaaaaacaataattaccagacttggttcacttcccagttgcattcagagttgatgcttggtttcctctgcgatgttctcaccctgcagggtgtctgcactgcggccaggctcctttcaaacttgagctgtgcactgtggggaagagaggttcctaggggtcctgctcaggtgcctggcctgagactctcatcatgcagtccttcctctccccccatgctttgctttgcacatcattcttgtccctccctctggtgaagggttgtgatagagtcaggtcctcagtagagccggcctcggggagctgttaaaaattttgttctgctgtagctggctggttttgtcaaacttagttttttatctgttctgttggctatgaccctgagcagtgaaaaagggcttggtaatagatgttcttctctaggcctagccagcaattctcaaatatgcaaaagagcaagctggtagtggtctttagaacagcagattgtggtatctttctaaatttttcagacttcagcacactgataaagatgtttgggaagcaaatattaaaaagggaaaatgcttctctgcacaaatatcactgcaggtggtgatagggcacaagttggcttccagtgaagaaattctgcttcttaccaaaagttaacaatagagaatggaaaaccaccactaaattgttttttcagaacaacaaaagttgaggctgtaattgggccagcatatcctatgaaaggcttgtgaacattgatggaaccaaattggagccttgtacactcagtcaaaacacatttatttaggatccaccgtaggtgaggcattatggacatacggacataaacataaaaagatagccaacctttctccatattatcagaggtaccaaagcttgatttataatagcaaacaggagaaacaacctgatatttggaaaaatatacagctgtcaaaattagtgattgtgggcattaaatgtagtaacatggaaaaggtttgaaaactgtgtaccccaagagtgattcctattagaataatacaattgtggtttctggctttgttgcagtaaagcagtggggctcctgaaagaaagagagtctgtgcttctctgtctccttcactagaacagagactcttgaaggccaggacacacttttttcattctttgtcttacatggtcactgggactgaatcggagtctaaagtaatcttgattgcaagaatgcaagtctaatgaaacagcttttgcaagtaacagtggaccaaagggaaaagagagctcttttatcatgtaacaagtcaacattaggagcttaaactttgaacctgaaggatagcaggcagcttatggttcttgtgcagttgtgtgctcctgaagtgcatgcagccagagaacaacattgctgttctctatctttacaaaccatggggatttctccttgtgtttcaggagggcctagtgattttccggggcttgaaagaaaacctttcaataggttataagatgaagattctcataattctcattattttattttcttcttaatcaaaactgtcagctggtgcagcgctcatgtcgataatcccagcactttggaaggccaaggcaggagggttgcttgagtttaggagtttgagaccatcctgggcaacacagacccacatctctacaaaaacattttaaaaattagccaggtgtggtggtgtgcacctgtagtcctagctacttgggaggctgaggtgggaggattgcttgagcctaggagctcaaggttacagtgagctgtgatcacaccactgcactcagcctgggcgacaaagtgagaccctttctcaaaaaataataataattgtcttcctgatgctccaaagtccctttactctaggtcagagaatgtatgtctctaaattataaagtgcagaattcagagaagcatctctctctttttgaaattataattggacacaataaatgcagaaagtaattagggcattttttaaaggtgtgcctttattttaacatgaagttttaagtttagaattgctggtttttaatatgttctcttggtaatttgtcactttacagtaagtttaaaatattctttgtctatttaaaatcgttcttgctggccctattatgtgtgagatcatgcagaatataatttacttttcctttagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatggtaagtaaacttttaattattcctcttttacagctggcatcaggacagcagagcaaattgttccttttagttgtcctgtcaactctggaaaatcacaattttcagttccattggccaggaaataagagttgttgctttgcttgtatcctaggacttgaactgcaacgaatataaaaatctccttaaagcgcttgctttaactccccctaactttaacttcccacatggaaaattttagtatgtgcaagtttgcatccatacacttcagtaaccattggatctttgactctaacagacatgagttgtgtaatgtcataaattactgcaagactgagaagatagaactgttaatagttggcagagaagaggtcatgacttgcaagaatcagatcaccataaaggaaagtcagcaggtctaacagatagcagaaatgatcccccagcattgaccaacatacaacatttaattataatgacaaagtaaaaaggtaacaaaaaaattccatagaaaaaaggtctcattcacaaaagcaacaaaaaataaggcacttaggaatccaaaagatgtgacatacaaggcaacctgactgaatggagagaggtcattttgtccagaaacagaagcctgcatgtatggaaagtggatgtgtaacacgtgtgtcattacaaatcattgagagaaaaggtgggctagttgataaatgagatgagaaaatagattatatttatctaattttaatttttacagaaaataaaaaaatcaattgtgtagattaaaaatcccaattggaaagttttagaagtaaatatggaaagatttctagacaggagaggaaaagcagaaaccataagaaaaatatttatgaatataaacaactgttatctagagcagacagcgaaatgcaaatttgaacagtaaactaccatttcacacctcatcagcttggcacaaattaaaaagttggtcaatttcaactgtgggtgaaaatgtgaagcaataggaatactaatgtactccaccacttacaaccataatttggtacaatcgtttcaaaactacttgaaaaacaactttgcagtacgtagtaagttgaagctaaccctcctcccagaaatttcacttatagatgcctgccttagagaaactctaaatgcatataaacctggagacccatataagaacacccactgtaacactattgtgattgtgaaaaattgaagacctcaagaacgagaagacaagacacagactgggagaaagtatttgcaaaagacatgttagtaaggactgttattcaaaatatacaaataactcctaaaactcaataagaaagcaaacagcccaattgaaaaatggacaaaacaacctgaacagatacctcaccaaagaaggcatacagtggtaaataagtacatgagaagagatgctcaacattatgtcattagagaattacaaattaaaacaacgagataccactacacatctattagaatggcaaaaattcaagacgctttcaacaccaaatgctggcaatgagctctcattcattgatggtgggagtacaaaacggtacagccaccttggaagataatttagcggtttcttacaaaactaatcatactccttggtatttacccaaatgagttaaaaatgtgtctaccccaaaacctgcacgtggatatttgtagcagctttgtccataagtgccaaaacttgtaagccaccaagatttctctcagtaggtgaatgggtaaataaactgctacatccacacagtggaatattatttggtgctaaaaagccatgaaaattcagtgctatcaagccatgaaagtacatggatgaaccttaaatcctattactaagcaaagccaatctgaaaagactactcactatgattccactatatgacgttctacaaaaggcaaaaccgtggagacagtaaaaagtcagtgattgccatgggttaggagagaggaaggcataagtagagcacagaagatttttaggtggtgaaaatactctatatgatactataatggtggttacatgtttatatgacattttgaaacaaaagtactacatacttaaaacaagtacacaaacatgcatgggaaggataaacatcaaattcaggattgtgtttaccttagggaaggggctactgtcagggaggggtaattggggagcttcaactgaatctatagagtgtgtgtgtgtgtgtaagtattttattttttggaagagacgggcctcactgtgttggtgaggctggtcttgaactcctggccttaagtgatcctcctgcctcggcctgccaaagtgttgggactgtaggtgtgagccaccacacctggcctatagtgcattattatttttatttagtttttaaattatgccatagccagttgttctgaatagtgcagtactacaaaacagagtcaaggtctcatgctgtcacccaggctggaatacagtgatgcaatcatggctcactgcagcctcaacctcctaggttcaagtagtccccctgggtagttggaaccacaggcatatgctaccacacctagctaattaaaaacaaatttttttttgtagagatagggtcttgcttttttgcccaggctggcctcaaactcctggcctcaggagatcttcccacagtgctgggattacaggtgtgagtcactgcacctggccgagtccattatttttttaatgttgaggcaaatgttgtgaaatggtatgactgatagttaactgggtaatgaggaaatgagaattgtattattctccatgtgttttgtatgcttgaaacataaaataaaacctgaaaaccaaatggtgagctggaagatacgagggaattactcagaaaacagcatacagatacaaagacctataaatcattaaagaaatgacatataacatgagaagctccagagagttggggagagacaataataatcaaagggataatgaggattttccagagtggataagggatgaaccctgagaacttagagaaaattcagcatacaaaaatcagttgtatttctgtacacttgcaatggacaatctcaaagtgaaaataaaacaattccatttactttagtatgggaaatacttaggagtaactataacagaaggcaaaacactttaaagaacagccgggtgcagtggctcacacctgtaatccaagcactttggaaggccgaggcaggcagatcacaaggtcaagagattgagatcatcctggccaacatggtgaaaccccatctctactaaaaatataaaaattagctgggcgtggtggcgctcgcttgtaatgccagctacttgggaggctgaggcatgagaatcacttgaacctgggacgcggtggttgcaggagctgaaattgtgccactgcactccagcctggctgacagagcgagactccatctcaaaaaaagaaaaacagaaaaaacacactaaagaacattattcagcgaaattaacgaggatctaaataaatggaaagacattccatgtttatcaatcaaaagacttaatattgtttagatatcagtattctccaaattgttttatagattcagggcaatctctgttataatcccaactgacttctttgtggaaattgacaagctgattctgaaattcacatagaagtttgagggacttagaatagtaaaacaaccctgaaaaaagaacaaaataggaagactcacacttctcagtttcaaaactaagcaatggaaatcaagacagtggtactggaataaagatagacatatagatcaatggaatataactgagaataaataatatatctatggtcaactgatttttgacaagggtgccagggccattcaatgagaaaagaatactcttcatcaaatggtgctgcaataactggatacacacatgcaaaaataaataaataataatgaaattgggccctacttcacaccatatgttaaagaaattaactcaaagtggatcgaagacctaaatgtaagagctaaaaactataaaacaataaaacatagggattaatttgcatggcctcatatttggcacttgattcttaaatatgacaccaaaaacaagagcaataacagaagaaaagattaattggacttcattaaaataaaaaagtttgtatttcagaggacgccatcaagaaaagacaagaaggccgggcacagtgactcacacctgttatcccagcagttcgggtggctgaggcaggaggattgcttgagcccgggagttcaagaccagcctgggtgacaaagtgagaccctgtgtctacaaaaaataattagccaggcatggtggcatgtacctgtggtcccagccacatggttatctgaggcaggaagattgcttgagcctaaggaggctgcactaagtacctcgcactccagcctgggtgacagagtgagactctgtctcaaaaaaaaggacaagaatatatttgcaaattgtatatttgataagggacttgtatctagaatacataaagaactcttggccgggcgctgtggctcatgcctgtaatcccagcactttggggggccaaggcgggtggatcacctgaggtcaggagttcgagaccagcctggccaacatggtgaaaccctgtctctactaaaatagaaaaattagccaggtgtggtgatgtgcgcctgtaatcccagctactcaggaggctgaggcaggagaattgcttcagcctgggaagtggaggttgcagtgagctgagatcacaccattggactccagcctgagggacagagactccatctccaaaaaaaaaaaaaaaaaactcttactactcaatgataaataaataacccaatttaaaatggcaaaagatctgaatagagtagacatttctctaaggaagatatacaaatgaccaacaagcacatgagagatgctcaatactatgagtcatcagggaaatacaaatcaaaaccacaatgagataccacttcacacccaccaggatggctagaatcaaagtcacataacaagaagtgttgacaaggctgtggaaaataggaacctttattaaaaagaaatccaaaaaccaaaaacagctgggcacagtggctcatgcctataatccagcacttcggacggccaaggcaggtggatcaccttagctcaggagtttgagaccagcctgggcagcatggtgaaactccatctctacaaaaacttagctgggtatggtggtgcacatctgtagtcccagctacttgagaggctgaagtgggaggatcacttgagcctgaggggcagaggttgccagtgagctgagatcacaccactgcactccaatctgtgtgacagagtgagaccccactttggaaaacagtttggcagttcctgaaacaaacatagaactaccatatgacccatcagttccactcacaagacgaaagtataggtcaacacaaaaacttatacacaaatgcttctagcagcattactgataatagccaaactgtggaaacaactcagatatttatcacctgatatatggataaacaaaacatatgtccttgcaatgaaatgttgttcggccgtaaaaagaaatgaagtattgatacatgccacaatatgcatgaaccttgagaacattatgctaaatgaaagaagccggtcatgaaagaccacatattatatgattggatttatgtgaactgtctgaaatagtcagataaatagagacagttcagtggttgcttagggcttagggaagtagggaggtagttgtgcatagctagaatacaggatttcttttgaggtgatgaaaatgttataaaattgactatggtgatagttgcatatatctatgaatatgctaaactccattaaattatatagtttaagggggtaaattgtaaattacatgtaattatattgtaaattatatagcgccaccacacctggctaatttttttttatttttttattttttgtagagacggggttttgccatattgcccaggctggtctggacctcctgagctctggcagtccacccaccagggcctcccaaattactgggattaaaggtgtgcataaccacccctggcccaaagacaaatatcttaaaagcaaatagagacaagacacaaatcaccttaagacaatgataattggagattttcttaccagccatgatagagcctggaaggcaatggaataatctgttgagaattctgagggagatgactgtcaccctagttaacctgtctttccagaacaagggtaaaacaaaatgaatgtgtaagcatctccttgaagattagggaaagaagatcctgggaagtttctagcaagcagagactggtaaatgagaatcgacagtacaggacccattccagctattttcttaggtgtaatacactgatactatccttatataatgtgttgtgtgtatgtgtaagaaaataaaatccaaaaagataacagtattaggggttttttttgttttttttttttgtttttttgtgatggagtcttgctctgtcacccacgctggagtgcagtggcgcaatcttggctcacttcaagctctgcctcccgggttcatgccattctcccgcctcagcctcccgagtagctgggactacaggcgtccgccaccacgcccggctaattttttgtattttcagtagagatggggtttcactgtgttagccaggttggtctccatctcctgacctggtggtccgcccacctcggcctcccagagtgctggaattacaggtgtgagccaccgtgcccggccaacagtattaggtttattgacacgtgacctctgctctaaaaccagttttccaagtaagttccataattctctggctgtgtagcttcctgcggcagaggttttctggaaccagctttgttaactgaagaagtactgaggctcttagctgcgtcttcctgggccttggtatactcttctatatagtggggatttgacttctccaagctgttgtgagagctatgagataacgtgtgcctttccctttcctgtctgttttttacttttaagttacttggaatcgggcctccatattatttgcagggtgataagccaatttaaagggaatctctgttcgtgcccttagttagtgtttgctgtccagcattccagcatggtgcatatggagttcgtgtttcccttcaagaggccttttgtaagatcttgcctcgtgaattacagcaagcatcttgtctcctttttcctttgggtttcctcttctagcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcaggtaggtataaagattccaagtttggtgtgtttatgatattgttttaaagccaaggaactggctgggcacagtggctcaccagtgcttggggagactgaggcaagagaattgcttaagaccaggagttccagaccagcctgggcaatgtagtgaggccccatctctatgaaagaattaaacattagccaggtgtggtggcatgcatctgtagtcccagctacttgggaggctgaggcaggaggattgcgtgggtccaggagttcaaggctgcagtgagttacgatcatcccattgtactccaaccttggtgagggcaaagccctgtctctccatgaatgaatgaatgaatcttagttgaggaagcataatctacaataggaagataaacacattcaggtaactagttcatagtttctcccagtaagagaggtaactggtacatttatcctgctgtggctaatttagggggtgctgggagtgggaatggaggaggaaatgaattgccttcaggcattgctgtcataattgaaagaataagcagttaaaaagggggtgggaggcagcttttctagagctctgctatagtattagctcctgagaatggagatgggacatgattgaagggttgccttggtatgtggtgtacttggaggattcctctatcagtgacaaacccctacgcgcaagtttattgaggtaacttaaaattccataggacgaagcagcaaaacataatttaattaaactaaaacctccaattctttttcttctttcagttgttttatgtatttcagtgggcttttctttgagtttaagtataatacaaaattttggatgtttttaattgagatttgtactcaacacaattcctttctgtagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacaggtaagcagttttgtttgtcatccagggcaaaaagagcaaaattgcccactggcactttgagctttcatttgtcagagcttggttacttaggacaagaaacaaatacctccatgaataccattgcatggattattgtgtcctacagctattctatagtaaaccatcaaagttctgtttaacactgcaacatctgaaatgaattttactgatttattcaaaatgatgtgtgatttaaagcactgtgcattagccactgattctttttttttttggagactgagtctcactcttgtcgcccaggctgaagtgcagtggtgtgatctcagctcactgcaacctccacctcccaggtttaagcaattcccctgcatcagcctcctgagtagctgggattacaggcatccgccaccatgcctgcatgcctgactaatttttgtatttttagtagagacggggtttcaccgtgttggccaggctgatctccaactcctgacctcaggtgatctgcccgccttggcctcccagagtgctgggattacaggagtaagccaccgtgcccagccggccactcattctttagaaagtcagagtcaaggccaggctcagtggctcacacctgtaatcccagcactttaggaggccaaggcaggagaatcatgaggtcaggagtccattgcaaacagccctggcgacagtgcgagactgtgtctcaccaaaaaaaaaaaaaaaaaaaaaaaagtcagagtcaaatgagcgaaatcagattcaaatctaattaaatggagtactatagtccttttagatatttgcatcttaatttaggacagtactttttttactttttattttgaaataattgtagacttaaccaaaaagttgcaaaatggtagaatttatgtgtatccttaacccagtttccccgatgatacaacttacataactcatagtacatctagaactagaaataccatttgacccagccatcccattactgggtatatacccaaaggattataaatcatgctgctataaagacacatgcacacgtatgtttatagcggcactattcacaatagcaaagacttggaaccaacctaaatgtccaacaacgatagactggattaagaaaatgtggcacatacacaccatggaatactctgcagccataaaaaatgatgagttcatgtcctttgtagggacttggatgaaactggaaaccatcattctcagcaaaatatcgcaaggacaaaaaaccaaacaccgcatgttctcactcataggtgggaattgaacaatgagaacacatggacacaggaaggggaacgtcacacaccggggactgttgtggggtgggggcctgggggagggatagcattaggagatatacctaatgctaaatgacgagttaatgggtacaacacatcaacatggcacacgtacacatacgtaacaaacctgcacgttgtgcacatgcaccctaaaacttaaagtataataataattaaaaaaaaaactcatagtacaatgatcaaaaccacgaccatgccattattattacattattattagctaaaccagagatcttaatcagatttcaccagctttttctctaatgcccttccctgtttcaaggtcccatattacatttttgtgttttatgagtcccctctaatctgtgacagaaagttcctcagtctttccttttctggccttaacactcttgatgatactggtcaggtattttgtagcatgtccttccatttggctttatctggtattttctcatgatgagattgaaataaggtgttttgacaagtacatcacagaagtcatgttatgtctttctcggtgcatcatgtcagggatccctgatgttgatgcgtctctttcctggtgatgttaaccttgatcacttgctcaaggtgatgtctgctggctatctccactgtgaagttactgcttttcccttcgtaattgataaatatcttgggggaagatgctttgagactatactaatattttgttcctcctgaaactcaaccactgattttagcattcattgttgggtcttgtctgcaacagttataactaaggtgtttgcctgatagtgatttttttctctttccctctcttcctctgcatttactaactggacttctgtacagaaagctatcccttctccctcatttatttactcagttatttacatcatggacttttaattctgtgggttgtatccaacactgtcatttatcttgttactcaaagttttccactttgggccattgggagtgccttctggctggcttctgtgttcttacatacacctcccatccccagctttatcttacatattccctgtccctgccctgcaaggagctctggttccttttattggagaatggtatgtagaaacgaagatctgggcactaggtatgctcattgctgctggaaagagtagcatgtttttgtttgtttgtttgtttttttgagatggagtcttgctctgtcaccaggctggaatgcagtggcgcgatctcagctcactgcaaccaccgcctccctggttcaagcagttctcctgcctcagcctcccaaggcacgtgccaccacacccagctaacctttttgtatttttagtagagacagggtttcaccatgttggccaggttggtctcgatctcttgacctcgtgatcccgcccaccttggcctcccaaagtgctgggtttacaggcgtgagccaccgcgcctagcccagtagtgtgtttttaaaggacctaaaagttttaaataaaatgagggccacaaggtgaaattatcctttattaattgttctcttaacatcttcttaaattttctcctgagactggtgagcagagggacccagagcaaggggacttaggggaaagaaggcagtaattagggaggaggaggccaggaggaggaagaaagcatttcatgggattacaggaatgtcccaaaaacaacctcactgtgatgaagtccactaatgctatttcttcacttctgtttttcagaaaacggtattttgtctccgagtacactcccatcgatagcaatatagctttttctgttaatgcaagtgacaaaggtaggcatatttgtccatgaataaaagggttcagatgatgctgtctgtcatgagagcattcgtttcctcagtggggttgcagcagtgggtgaggtggtgtgccagtgccgaggacacggctgcgaccaaggcagacatggtccttgcctttgtggccctaccatctagtcagggtggcacagcagaaccaagtaattaatcatagctggggaggcgcgaaagcagcaggacaagagtgggaatagcagggcagggttgaacctcacccttcagaggctcctgtgtcggcatctcctctgtggggtgggaatagcgctcattgagggcagccaacaaaggtggctttgctgagcagataggtagctgagggcaggggtctcatatgtgtccccaggtgggcttgattcctgccatgagatagcaactaatgctttccctgttccgactttcaggaacggcttggctcttaacctccaccttcccttcctctcccgttcttccaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggtaacctgctgtttgaagaaataagtcactctagatgaccttgtggtttgctggcttttacatgttgactactgctagatggggatttggggctgaatgtcatggtatatcttgaaaatcttagcgtataatggcaaagctgcctttaagttaggtttcaagaaagtgaatgatgttgaacttaatggaatatttattgttgctcacttttgtatttacttcagatagtagaccttgcctttttcttgaaattgagatgagcagagaaagaagacttcagtggcgtttctctattgaggcaggatatatttattaggaagtcaccttaggaatttgtgaaatgttttctgttggtaactgaaagtaatatgcaaggacccagaggcatgaagcccttactgctgtcctgggggctgaggaaggagctgccagattaccatccctgatccaacctgtaggaatgaacttatcactcactgcctgaacatgggcacccagcctgtttttggtgagaggcgcatttggggcaagatccatcccattgctcctagaaaggcatgtaaaccttcccattgtccctgtcacacttgccttggagaactgtacctgtgcataaactgtaccggcttcttttttaatgaatgtataatcacatggtttttcctttaaacattgctcatgtctacaagaaagtctgcaatcttgaaaagcattaaaatggtcccaagacttgaatcttttctctacccagtgactgtctgttgctttttccagcttgttgctgaaggtgaacagcatagtcatttacctccaagatcatcttctctgttaggaaataaggggacatatataaatggctgtagtgcagagcaaggcaggaggttatgtgttactattgagaggagggtcagggagaccaggagtccccctccactctcccctctggcctgctggccaccactggagaacggtggaggggagatggttgtgtgtcctatgttgatagctgttctggtcatggtgttccccctacccctcgccgcctctgtggacgcctctaactagtttgctgttagagtgggcctgtggcctgaccagttttcttactgtattgcatcttaattctctccctcatcttaggaagtattttccccaaatactctttgtcttctgaccctcagggcaatgctgattaatcaagatctgagagaaatgtgacgtgtttctgggtttgcttatttttaaaatcttctttcaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacggtaagtggcaagagacaatcattggtagacaccattcttgggtctgacttagggtacatgggcaaaagcttgttttatgagcataacccagaggtgagcaaacaacaagaccttgccctgtgaagtttacatcatcttttttttttttttttgagacagggtctcgctctgtcgcccaggctggagtgcagtggcgcaatcttggctcactgtaacctccggctcccaagttcaagcgattctcatacctcagcctcctgagtagctaggactacaggtgtgtgccaccacgcccagctaatttttgtattttcagtagagatggggtttcgccatgttggccaggctggtctcaatctcctgacctcaggcgatccgcccacctcggcctcccaaagtgctgggattacaggcgtgagcttccatgcccagctggaagcttacatcttaatggagggagacggttgatgaacacataacatgtgctatcgtgccagctagagattagtgctatgaggagaaaaataaggctggacagagtggggggtgcattgcttaagcgtggagatgtgcacaaagggagaggaaaggacagctgggcacatcacagggatgagagttcccggcagaaccagcagcaagtgcagagccctggcaggaagctctcgtggtgtgtgattgaggagtgcagctgcctctcaccctttacctcgtgcctgggtcgctaacacagtgtcatgtatcacaccccccacaagatttaaagatagaagagcctttggtgccttttgttctgtctcagatatatagcccagtcccctgtagtgccccagctatttgggaggcagcctccctctgaggagttgaggcagtataggtctgcagctccgcagctttagattggagggccctgcagctgcttcccttaggaggcatgtctagctgggcagggtgcgtttataattgggaatagtcaccccaggaagcggtgctttggtgacctgtaggggaatcttaaggcttctcccagtaggggaagagtagcatgatgccggatgggcctactctccctgaatgctagggacctggcctagggacatttgttcagccagttgagcaaccacagtggctatttcttcagcatgggaacagagaaattattcctttttgcctttaaggacactgctcagccgactacttctcaagagctaaggactctcacttctggttctaaagaactttgaccttgagttctgtttgtttgttactggagtaagactttttatgcagttgggctatatttactctgtttcaagaatatcacccctaaaaacatgagttatactcatgaaaacacaatagcttatgctccataccctaaaccggcattctccacagggtagacggtgcagacgagccatgggtaatttgaagaaacaaaaaacatttaatgttacataatttttataattggacaaccatttaatgttacataaattttatagtttactctctgtggcacaagataaaagtcaacaaaaatgatgggggacagaggtgcgtgagccttgtgtttcctcaaagcggacgtggttcccaccagtgtggaagcggtacagggagtggcaggctcctggtggcagggacctgaattggtttgtagttatgcttgtgcgcgtcctcataaccccagtctcgccctagcgctgtcccctttcctctccctccagcttttcctggactttttcacctgagggtcctgcagtaatggcaggtggcctgcccagaaccatgcccttacctgcttcttctccccattttgtttaaaggcagtgacagctaccagttactcaggcttgaggctttatccctgaattctgcctcgccctcgccttcctcatggggttcttacgggtctgagcctctggatgctctctcagatttctgctgtggatgaagggactcagctgctcgctgcaggtcacctgacctccctcatgccgtcacccatccactctgacgggtgggtcatatgcagaagcttctcagcacctggccaagttgtagctgatggtctgtccgaaaatgctggttcactctccactggccaactgtctgtctgcactgcactgccagttgcctcttgcctgcgccattgcgctaacatctccacttactgttccacctgcttcctgtttctttgccgtttccagaccttccactttgccacgcaagctatctttgtaaaacagctcatgacatttctttcccggaaatctctaattgttccccagtgcctccagaataaaaatccaaactacttaactggcactgagtccttttattttgcatttgtctgtccattactcttcccagactggccccctccttcaggagcccccttggtgggcaccccatgctctaggacaggacatcttttctttgaattattattattttttttttagagatgggatcttgctatgttgtccaggctggactcaaactcctgggttatagccatccttctgcctcagcttcctgagtacttgagattaggcgtgccaccatacccggcatacaggacttgccaaaccaccatcttgctctcattccctctcactgttctctctccctccctttttcctcccacagttgtaattgtgtgagacacccttttgtcctccctctttggtgaaatccccctcatcctcggagctctgggtctgtacagtctcttcctcttggctataattttgccttttagtgtttgctccctcctctgtgcctgcatagcgccatgcaccatgtgccattgatggcactgggctgtatttgcctgcctcttgcccagtgattctgagctcccaaaggtgagtgctgagctgtattactcaactgagaaacctcagggcccatgttgtccttagaatacagccagcctcatcaaatgttcactgtgtaaatgtttaggtccctgatgtcttgaggcccttctaactgggaggtgttttctaaactttttggcagggctcctgcctctctgaatgatacaagtttgctccatgacccttgtctgggtacgtttggtggaccagtgttcccgtggcttgtgttgggaggctatgatggtaagtaagagaagctttgacttttccttttagataaagtcatctcggttttgtcattagcatcaagtggtaattatgaagatttcataaattgggcagttttgttaatttcttacctcttgaatcccagaatagtatctcctttggctttgggtttgggtttcattccagatttaaaagaagtggattgggttagccatttttaggtcacacatgcctttgagaagctgtcgaaggctaagtacctttccccagaataatgcaattgcaaacctctgcattgttgttcagcttgaaggtcatgggcctccgaagttcatttatagaccctctagggagctcatggacctcaggtaagagcctctgtgatagagaaaagatagtatgtgaggtatgtggaaaaagaaacaaagttgatggattttttttcttctaagccagtcagttgagtatttggacactcttacagtgtgaagagcagctggtttgctctttcctggttcctgtagcactttagaaccaattgtacttgacaaaatgaggtgattattcatgtgacacctttggcatcttaagccaaattacaggctcaacaggttttgcccaaccagttaagaatccagataggttttcttctcctcacttggtggcaggggagaagttgcaatctgtatttaaaatttactgtgcatcagagaggaaaatgccatttctaattgttggagaagggatggtgtcagcaactgactagccataggggaaacaattgactttgatctctgacttgttcatttcaccaaaataaattccagatggataaaagattgaaatgtaagaactgggccaggcgtggtggctcacgcctgtaatcccagcactttcggaggccgaggcgggtggatcacaaggtcaggagatcgagaccatcctggctaacacagtgaaaccctatctctgctaaaaatattctttaaaaaattagctgggtgtggtggcaggtgcctgtggtcccagctactcgggaggctgaggcaggagagtggtgtgaacccgggaggcagagcttgcagtgagccaagatcaagtcactgcactccagcctgggcgacagagtgagactccatctcaaaaaaaaaaaaaaaaaaaagaaatgtaagaactggaagaaaattcaggaggcatttttaaaaataatttttaagtggaaaagatatttctaagcaagacacaaaactcagaagcccgaaaaggaaagactgatgaagttgagtacatgttcatttgtggagaacaaacatacagttaaaaaaacaaaactgggccgagagttattcatgcctgtaatcccagcaatttgggaggcagaggcgagcacatcacttgagctaggagtttgagaccagcctgagcaacatggagaaaccccgtctctgcaaaaaatacaaaaattagctgggcatggtggtgcatgcttgtagtcccagctactcgggaggctgaggtgggaggatcacttgagcccaggaggttgaggctgcagtaagcgagattgcaccacattccagcctgggtgacagagcgagaccttgccagaaaaaaaaaaaaactggacaaaaatattagtatgcatggcagtcagcattttcttaataaataaagatctcatctcagcctggccaaaatgtgaaaccctgtctctactgaaaatacaaaaaaaattagccacacgtggtggtgtgtgcctgtagtcccagctactcgggagactgaggcaggagaatcacttgaatcctggaggtggagtttgcagtgagccaagatcattccattgcactccagcctgggcgacaagagcaagactccgtcttaaaaaaaaaaaaaaaagttgtgaaaaaaagatcaacaacctgaaagaaaagtgggtgaggtcatgtgaaagataacaaaagaagaaatacaaaaaaaaaaggtttttattttatttttcagagacagagtcttgctctgttgtccaggctggagtgcggtggtgtgatctcggctcactgcaacccctgcctcccaggttcgagcaattcttctgcctccacctcctgagtagctgggattacaggcatgtatcaccaggcccagctaatttcttgtatttttagtagagacacggttttgccttgttgcccagactggtcttgaactcctgacctaaggtgatccacccaccttggcctcccaaagtgctgggatcataggcatgagccaccacgcccagcctcagtaaatattttcttgactaaagtaatgaaaagggaggccaaggcaggaggattgcttgagcctgagaagtcaaggcttcagtaaaccatgattgtgccactgcactccagccagggcaacagagtgagatcctgtctctaaaaaagaagaaaaaaaggaatgaaaaatagttaagcttctttggaaggcagtttgggagaatttatcaaaattggaaatatacatagtttttgattcattgattatgctttaagaattgattctagccaggtgcagtggctcatgcctataatcccagcactttgggagggcaaagcaggaggattgcttgagcccagtagttcaagtccagcctgggcaacatgacaaaatcccatctctacataaatacaaaaattagccagcaatggtggtgcacacctttagtcccagctactgggaggctgaggcaggaggattaattgagttcgggtggtcaaggccacaaaaagccgcgattgcaccactgtacttcagcctgggcaacagaacaagacactgtccccctgtcaggcccccaccccaaaaaaagaaaaaagatttatttctacaagtatgtgttttacacattaaaatatttataggctatttatagtaactttgtaatagaaaaaattgcaaaactactcatcagttgggggggattggctaaagtataccagaaaatactgtaggaaaagaataaggaaactctttatggagcagtctccaagatacaaaattttaaaatgtaatgtgcagaatagtattttactgtttgtgtggttaagagggaaaggggaagaatctgtgtgtttgcttgtgtgtgtgtggagtggctctggaaagattcgcagatggtcacagtatggggaggagaactaagacaatgaaacagatgttggagaaggagagaattttcgataaacacttttctgttctgtttgaaattgttaacatgcatgtactgtatcctttaaaaaaaaaaaaaaaaagagttactcttcctgaatgataaccatgcctacctcagataaaaaatcctttttattcattaactgaagtacataaagactatttcagcaaactcttgtttaattcttagagcccagagatacagtccatagctccagtgagaaatctgtgttgtgatttttcccctggtatgtgtctaattttctgcatgcttgtaatctgctttttgatgtcacatttttcctttctagatcaaaactacaataacgccactgcccttgtgattaccttccctgtcaataattactataatgatacagagaagctccagagggcccaggcctgggaaaaagagtgagtcactcatgggtgtgagcagactgtccttgcattgtgggaagctagacacttgcggcaagcacttaaacttcattttctaaattaaccaatggcagatctgagttacgtagttttgttcacttggtactaatgatgctaagaagaaactgtaaacacatttacctttgagcaggtgctttaaacagctctccctccacaggaatgcaaaagtgtgcaaaaaaaggttccttgcattgtttttacttatttcatttattttttgagactgggttcacttttgcccaggctggggtgcagtgactgaatctcagctcactgcagcctcaacctcctaggctcaagtgatcctcccacctcagcctcctgagtagctgagactacacgtgcatgccatcacacccagctaatttttgtatttgtttgtagaaacagggttttgccatggtgcccaggctggtcttgacctactaacctcaggtgattcaccctcctcggcctcccaaagtgccgggattacaggtgtgagccactgcacccagccacctgcattgttttctaacagcaaaacttgggagcatgctgaatgtatttaataaggaatgaatacaatagaatattgtgctgtcataaaagacagtgaagtaaatggtccatgatgtatatttgtataaatatatattgtttatgctgctgtccatgcttagaaaaaaatatcaagcaaatgacctcagaaattaactgtgtttgtgacctctagagaatgggaagagaggacttaggaggccaggttgcactttatgccctccagtacttttaaaaaattgttttactgagatatggtatatgtatcatgcagttcacccacttaaagtatacagttcaggctgggaatggtggttcacacttgtagtcccagcactttgggaggcccagacgagaggctcacttgaggccgggagttcaagaccagcctaggcaatgtttgcatgtctctaaaaaaaagaaaaaagagaatttaaaaagaaaaaaaagcgtacaattcagtagctttactatattcacgtgtatgtgcagccatcaccacagtcaattttaggaacattttcattactccacaataaaactctgtaccctttaactaacaccctccatcttttcatcctcctatccacagccctaggcaaccactaaaatactgtctctggagattttcctattctggacttttatgtgcatagaataatatgtggacttttttgtctggctatcattgaacataatattctcaaggttcattcatgttgtggcatgtatcagtactccattccttttcattccattgtatggatataccacattgtgtgcatttatcaactgacaaacacttgggctgtttccattttggctattatgaataatgctgctatgaacacttgagtacaagttcttgtggatgtgagttttcatttcttttgggtacatacctagtagtagaattgctgagtcatagggtaagtccaccttgaatagtttgaagaactgccagactgttttccaaagtggctatagcgctttacgtcaccaccagcagtccatgaaacttccaattcgttcgcatcctcgtcagcactttttattatctgactttgtgattctagctatcttcatgggtgtgaagtggtatctcattgtggttttgatttagtagactgaatgcatttctttttttttttttttttttttttttttttgagacagagtcttgctgtgtcatccaggctggagtgcagtggcatgatctcagctcgctgcagcctctgccttccaggttcaagtgattctcgtgcctcagcctcccaagtagctgggattacaggcaccttccaccacgcctggctaatttttgtatttttagtagagacgggctttcaccatgttggccaggctagtctcgaactcttgacctcaggtgatctgccagcctcagcctcccaaagtgctggaattacaggcataagccattgagcccagccctaaacttactttaattcagcatgtatggaaccttagctgtaatctgatagtctccagtgtggaagaccctaatgcagtggctgggcatggtgcctgtcatcccagcacttagggatgtggaggcaggaggaatgccttgaggccaggagtttgagaccagcttgcacaacatggcaaagaccccatctctacaaaaaatttttaaaattagccaggcatggggatacgtctctgtagtaccagctactcaagaggctaaggcaggaggatcccttaagctgaggagttcgaggctgcagtgagctgtaatagtgccactgtactccagccgaggcaacagagagagactctatttcaaaacaggaacaaaagcaaacaaaggatcctaatgcaggataaaggttaagaaaacatggcctttgagccgggcacagtggctcacgcctgtaatcccagcgctttggggaggctgaggcaggtggatcacttgaggtcaggagtttgagactagcctggccaacatggtgaaaccctgtctctactaaaaataccaaaattagccgggcctggtggcgcacgcctggagtcccagctactcaggaggctggggcaggagaagcactcaaacccgggaggtggagcttggagtgagctgagattgcgccattgcacttcagcctgggcgacagagcgagaatcagtctcaaaaccaaaaaaaagaaaacgtggcctttgtatcgtgaaagttagggagaagtttcttacttagctgtcagttagtttaactaaaaatataacattttgcttaccttttaggtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatgaaaagctgtcgcaggcttctggtaagccgggggggggtggtgtatgttctagaggttaacagcagtgcacagtgtaacgtcatatttttgcctctttattcttattccattatgtttaaaactgccataaattcccccatgttttaattgtatgtaacgtttctgttgcctacatctattttcttcattccaactttttggtttatcttaaagtttatttcacataatccagttttttcttatttgtccagtccatcacctaagaatgcaaactcataacatgtgttgcccgagcagacctagaaatgtttacaagtcctctctgaaacacagaattgtacattcaactctaggtttaatacagccctgtaaagtaaaaaggaggaccttttagtaacaagtgggacagacaaccctgtaactaattggtgattgtgtctgtcgcctctctcaggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccaggtatacttccatattctcacagggctcagcatctgttcaagtttcagggactgtgaatggctcctgggctccgcattcgtgagtgtgacctgtgagggtgttttgtttcctttccctgtgtggctcatcggtcgtcttgacttgctgtggacatcttaggaccaagaatttcacccctctttttggttgttgaaatagtagatataaagtaagaattgtgttttaaattgtatctttaaatagtgtcttttaatagtatcttttcattttaaatagtatcatgtgtacaagaagggctaacacacttttggaaaagattttgggtacgactgctgttaaaatgatgttcagcatagtatagaatgttagattcattttgcccaaaggtgccactaaaaaggcaaaaggtcaacacgtgtcccgctgctgtagaaggtggtctcagtcgtcctgtagacccgacgtgggcggagactcagtgcacgtgagagtgatgttcactggtccagtcccctgccgcctgtgttccgagtgttttcctgataatgtggctggctcagctttccctttagtttctcacttggtacctagctctgtagtgcagaaatactctgagaacattggagtcccccaccgaagtttatatgcttagaagacactgctaatcgtctactaatcatttatttttacccttgagttaacacaaggcagcaagaaatggcgttgttattgagaaattttaatgtcgcataattttttttttttttttttaagagagatgaacgtcttcaaggggaaaccctggatcagcagctgggcagggtcctaggagaagtggctcccagtatgttcctgtcatccttttctgagactgtagcatttttcttaggtaattatgctttcaatcctaccagtcctgtagtctgctgagcctggagaaagaaggagctggctacctgaacatgtccctttgtgttgcttcctttttttttttttcttttttttttttttctctgagacggagtctcactctgccacccaggctggagtgcagtggtgcaatctcggctcactgcagcctccgcctcccgggttcaagcgattttcctgcctcagcctcccaaatagctgggattaaaggcacgtaccaccatgcccagttaattttttgcatttttaatagagatggggtttcaccatgttggccaggctggtctcgaactcctgacctcaggtgatgtacctgcctcggcctcccaaagtgctgagattacaggcgtgagcccccgtgcccagcccgtgttgtctcctttttttaagctttgttctgcactgggaaagtatcactggaccacagaaaaattggcagcagtaacttaggtgtgattttgcaagtggcttccttctcatttaactgtcaggacagcattgatgttggggttcagggtgaaagagacctagagttcgtcttgccactttccccttttagtagccactgggaatgttgatagttgaaaatggcatccttgagtagccactgaatccttctccacatgacactctaagcagcagctcccaaatccacaggcactcgcttacaagatgtttgccgttgttttcaaaggcagtctttctcttctgtgcacacaactcattggggaagcagccttgttaatgaccagaagctcttgactcaccacattacaaggagccagaataagctggaacaaagtcagcacttctgtgtttctttcacatagagaatcatcaaatagacccactagtggggctgtctgccccatgtctgaagtgtagtaagagcaaagtgactctgtccactataggggaggctggactggaatcactcagtccaaagaagaccatccacgggccacaaactgcaatgcctacatggctgggaggtcagcttaatcagggccattgtaaggtcattgtaggtggtagtctttcaccacagatacactgctagcttgttattcttcatctccacaaagccatgtgcttttgaaacctgtagccctgtagttccttttgacaaacacaggtgcagaaaaaaaaaaaaaaaagaaaaaactttctttttttcactactattataagaaaaccagtgcaagtgtgatgataatagcagcagagactgtgcctcaaggttggagtgaccttgggacagtaggagtgagtagggattgtggcaccccaactgcacgtgtcctatctaaaaagacagttatgtgtgtggccaacccagtgctacaaggtctgtgttgttgttgttgtttttcttccaagcaaagctgtgaatctagatttttgtgtaaaatgccattgttaaatattggcaacttataaaaaaaagttttttaatcttaagatgggttgatacagtgtgggctaaacaggaaccatctgattcatgggctgccagtttgcagtttccaagtcttaccctcatgcctttgatcctcactcgattgtagattacctcttaactaaactgggaggctagtagtgttgatgtaataaatggaaaatactgtccatttcttacagtgaagcacagaaagtactataagaaatggcctgtattagtggttctcaaattttaatgtgtgtgaatttgctgtgaacctgagtatagtagaattggggttgaattcctgtcataactaggatggggcttcccaaatggtctggtgctgagtgtgctttgaaaagcactggcttatcacctcctgtcccacttctggtgtaatgtccagccgcagcatgccttctcatgcgtttggcctgtgctggctccttgtatctgtacatgcacatgaacataagacctgcagagagcccccggctgtaaacagaagtgacgcagagcccttctctccccgacaggagcattgtccgtgatgccagccgtgcacaccttctctctctttgcgggattggcagtcttcattgactttcttctgcagattacctgtttcgtgagtctcttggggttagacattaaacgtcaagaggtaagttggtgccaggattatagtctatttaatttgagtctagaatctagaggaagcagctagcgggtataacctttgtttccctctgtcccctcagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtggtatgcgcttatctgtggtttttctctttcctctcactgaaacagattatcacatgccttctaagaagccagacagcctgggaaggagattcttaaagctgttaaaatgtatctaaaaaaaaagcaaaagcaaatgtggaacagtagataaaatgtttttcctgtgagcttttatcagtccatataaacaagagttttaagttttttattttgaaatagtttcagattcacagaaagttgcaaagaaacttttatttttcctcttaataatgaggaaatagaagccaagagaggtgaagtggtttgccccaagtcactcagcccgtaagtggcagagtcaggatttgcacccaggaatttggactcctggtgctgtggtctcacccactgccctgtactccctattagcctgtcatttaagcttttccattttaaaaaatcctgctttttgtgtgtgcttaagattttatttctggtcgtaagcttatttactaagcagtctctgtcttatgattcatttgttgttccagatagcaatatttgtgggtgttctgtcattcagcatcgcagtcctgaacaaagtagatattggattggatcagtctctttcgatgccagatgtaagatgacttccttttttttttttttttaacttctttagctgatgatgaatacatttttcaaaacatgcacgtaggtgtttcaagcaagtgcctgcttctaactgcaaatggtgacagggtttccagggttaggagaactgtcgcagtgcactgctggtgtgggctgtctggcattctgactgagcccctctgggcacagctgcagaacacgaataactagtcttatgaggttactttatgagatgctctcctgattgtggggctagcaggaggagcaccctggggccctggggggaagactggtggtgttaggaatcatgagtccagctggaggcatctcagccaggaacctcctggcaccctcttattctccatgatcctcgccttgcttagttactatcagagtgttcacactctctcctattcttttatctttctttcaggactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactagtcagtaccaccttgtcttgtacttcagaagcagcggaggaggctctcagccaggcagtcagctcaggcctgaaatgtctcactgaaaatagactttcttggaaaagttgtttttatgcaaaatgtatgttaaatctggctttaccttaaaaaacctttgaaaggactaatttaccacctaatactttgaaggcttttttcattaagtgctcatgtagtttttcttttgactgttagcagtataaaacgtagaaaaggaagttaggttttaagaaaaagtactgaaactaaagacttcctccctgtggagcaggtcagtaaccctgtctgtcctctctagtacccgaataggcttcgccccctcgtcctggatcgacgattatttcgactgggtgaagccacagtcgtcttgctgtcgagtggacaatatcactgaccagttctgcaatgcttcaggtaccttctcctttaccaaatctttcctgttttgctgaaaaattttcaaattatcatttaaaaatcatttgcatcgtgcctcagtttatacctatttgtatatcaaagctgggtctccctgtgtcatcattcctttcctcagtcattcattctgaaattgtcatgttgttcctggctcagacagccaccctcggggctgcaagctgaacaaggtccacatgttcggagtgtggtttccacataaggtttctcatcctgttctaactccagcgattgcctctcaggattggtatctggccttagcttctcagaggagggcttttctttatcactttaccctgtggttttgtaggagcgtcgaggttgccctggaattttcttaataaaaacatagaagccccgggctctgaccagtcaaggccatacttgaaggaggagatctacttcagggcagaaaatgatgcatagtatgcctaagatgaaaatggtatttcagattcattaaactgtgaaagtgacatgtggctgaagcttttagataaggggaaagattatccctcactagtaaggaaagtaatcgatagagaagaaagtaatgcccctcactgtcagtattttaaaatgttttacaaaaaatctggagacctattcttctaacagtcctccctgcatgtctccgccagtggttgaccctgcctgcgttcgctgcaggcctctgactccggaaggcaaacagaggcctcaggggggagacttcatgagattcctgcccatgttcctttcggataaccctaaccccaagtgtggcaaagggtaagtgctgctgccattgcagataagcatccactgcaactttaatttgcagtagaaaactaggagaggactgggctaagacagttgcatgggaacgtctcttctccgccccaccctgtcctggtcctttggtggaagcaggaaaaccgaaaacacctttttaagaaaatgcctcatagtgttcaactgattctgtcttagcgtgggcattcacatctcatgctctctctgtgtcctggccccctgggcatgagaatgaacgcagattcctgtgcacattccaagcggggctgagggagaggacggcctgctggtaatccaggcctgaaggaacttggcctgttcacttgtactgatggcagctggggcgtgatcttagctttagtaacattatcccacattaaggttgcgattcttttagcctcgtcatgctccttgccagcccatccatgtatagggttatgggctatctcactcccccatccagccaggcagccagttacccacggaagccagatatatggcccaaaaatagtgatgatgaccggaagtctctggccttgatttggaagctttgggaggtggaagatgagtatccccatgtatgttaggtaaaccctgaacttaggtttttcataagaacatacatctgaccagagtcatatcagtgaatcatttatatcatgcatgtgctttgagacctattcgaggtatcatgggatgactcctcctaaaagttaagtagaaatgaatcttgcagcttgatttactcactgactggatgctttggcctacgtaaaataagttgaagtagattcagtttttctgaaggcagtagccaccgttcctggggagcctccagggtgccagcgtcatgccaggcactccctgacattattccatttctcatcacgcagcctatgagtaggtggtggtatacccatttacagaagaggagactggggctcagaggtggtcattttgctcggggttacatgaccagtaagtggcagggctgaggttgttcccagggcccttgccctttcctgcttcctattacacaacaggactgagtaaaccctgtacctttgattatacatgaaaccaggtggagaaacagcagctatgtaccaaagaacccagagcaatcgagaaaagcccatctggccaggcgaagtggctcacacctgtaatcccagtacttttggaggccgaggtgggcggatcacctgagatcacctcaggagttcaagactagccaggccaacatggcaaaaccctgtctctactaaaaaaatacaaaagttagttgagcgtggtggcaggtgcctgtaatcccagctattcgggaggctgaggcagggagaattgcttgaacccgggaggtggaggttgcagtgagccgagatcacgccactgcactccagcctgggctacagagcaagactctgtctcaaaataaaaaaaaaaagaagccagtctgggagagaacaagctaaacctttggtgttcccttatctgggggccttcttcatccctgaaatgtacagctgggtctgacctctgagtccagggtcaggtgattttgcttagcctcaagtgctcagattctgctgatattttgcaagacctggactctcttgacacccaggattctttcctcaggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacaggtaaagcctgccctttttcaatggggtttacccagcaaagggcctacactgggtgggagtggggagggttcccttggcaagatgctgattttcaggttgggttctggcccctgctccattctgagcacagggcagtatatcaaaggaaatgggtgctgggcaaaggagttcagaatctaaagtctctgtgaaggcctgagggctagagacgcaaaacttgatctctgcgccactgcacagctgcaagagacacacactggaaaatggcttaaggcagggggcgcttggagagcaggcggctcagagcagggcccggcccacattcttggccaacaatgaaccagaatccctaactgctggttatttgggatgctgcctgtatgtagactttttatattgttaggggttttttttcccaggaagaaaagtattatgtatgaactactgaatttagaaactgtagaaaggtaggagaaacaagtgatttatttttcctgcctccccatgatctcgcttaaagcaggaaggcctggatttgtttggaagaagttaagagccggttagctctggcagaaaataaatgaaagcatgttttcctcaggccttgcacggaccccgctgagcctgaggtagtgtctcaggatagatcaggattctttgtttttttgtgttttttcagaatgctgtggaatgctctctgtaaatgtctataaaatagcatagattgggcttataaacagaaactttatcaaaaatatacattttgcatcactgctgggcccttctctgggtggtcagtggccatgagaggtcaagtgagttgctttcggtgagtcttgtagacagccagcaaggttttctgcaagggatgtttcccaaaggagtctgaccacttggcagtggtgacaggatgaacacgcagtgttcgggagtgagagcgagctttaatgaggcctcccctctcccctccagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatggtgagtcctcatacagtctcagtttgtccctagctcctgtttcacttgggggaattggctgtcttagattccatgtaaaccctaaagatggagtaagataccaagtctggcgcttgctcttggcacacatggagaggcaggatgagtgctggaggagtgctggatggtggtgggacagggcatagagggagcgagcattgagttggacatctgggagcataggcacattacaggcaatttctgttcaattttttctcttgtcccattccttgcggctatactagtatacctgatggtgcctctgaccatggaaatgtgatttcctggcctagttctgggctagtctgcctgtaatttgttattctttagagattgcacaagcctgtagcctgatgacagcaggatgttcactttttacttagaaaattgcaccccgccccaggagctctccgaccagtgccttttgcctcctatgtggttatcaggtacttttaatcattaaagatgagagcacttgagaaggtattcatggaaaatagaacagtgtatccgtactctcagatatgagccctgcttcagataggggagcactgaggtccaagaaaagaagttgtgacaatgcgccagctcggtgcgggtggggtgaccttaacgggttccagcaatttctcctggtcaacacaaacgtgccacagaaaaccaggcttttggctgtgtgtagagagggccccaaaaagttcctggtacagtaagattggtgtgatggaggccttgtaagtccaatgggatgcttggcctcctctagcacccagggtgccctgggtaattagcacccatcctcagaacggggtggctgcctagggtcttcaacaggaagagagccatcctaaaggaagtgctttatttcagagctgtggcatctccgtggagttctgcagccacataaccagagcgttcacggtgagcatgaaaggcagccgcgtggagcgcgcggaagaggcacttgcccacatgggcagctccgtgagtaccctgagcagggccacgccggcagagtcgcaccacaaagtaatcctcctcagtgactgaagagtctggatcctgtacttacaaagcagcttctaaggattgcaagctttcaggcaattcatgaattagctgccacatcgtggacagaacggacgttctgtggaactgtacctgttggtacggctcctttttaggtggcagtgtgctgaagcaggaaaataacagacaagttaaacatgagacagctggcagtctttcccatttaaaatgcaggggagcccgggccagaacccagcgtgtgatgtgcggttggtgcctggagagtcgtcttggttcaactctacaccctggcttagcctatctctttaccactgtagaaaatacctggtaaagagtaaaaactaaaactttgtttcgtaacacttttaaatatttaagttttcacctgagaatataaagaaagataatcaattgggagacacgatgcagtgtctgtgcagaatacacagcttttaacttggtcatacctctcccccaggatcataaggcagcaaatagtgttaggtagtagatgatgctacctgggttcagttcccattgctttgaaccttgaatattaagaaatccccataagggctggccacggtggctcatgcctataaccccagcactttgggaggccaaggctggcggaccacttgcggccaggggttcgagaccatggccaacatggtgaaaccccatctctactaaaaacacaaaaattagccaggcatggtggcgtgcacctgtttaatcccagctactcaggaggctggggcaggagaatcacttgaacctgggagaaatccttgtaaggaagtgtttttgttcaattacaggttggtaaaagtggtttctaacacagtatctcttcttttaggtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacataggtaagagttctcatcttaaaagggtggcacaatagaaggacattactgaaagggaattctatcctgaggcattcttttcaagtatttgaactcatactaatggtcatttgataatgataaatgatactgagtaaaaaaatttcttctaaaagaaaaaacccatccaggggattcatgatggtgcagactactttattaggaagttgtcgatgttttttctggaggcctgatctgtctgcttcacaaaggcctggagccagtccttgaatggatctgagtgtcagcaggcagggcagctcctccctgccactgagatgaaggagtccatctggcagccagctctcacaccagcagtgctgcagaacagctttttatgtccctcatggatttcccgtttcttagcaaagtgcttgctgcctttcttcatctcgagactgtccttgatccttttacttctatggccacttcaccttgcacaaaaatgacccacggttgaaagaacaatactgatttgcttcatttatagctttgtcactaaattgaagcactgaagtagaagattaagaaaatgaggggctttttatcatctccgggggatagaaagtagttctattacaatctaatatactagttccttttaagaaaaaaaaaaaaaaaaagagatgagcactttggaaggctgagacaggagaatcgtttgagaccagcctaggcaacatagtgaggcctccatctctacaaaaataaaattagccaggtgaagtggtgtgcgtctgcagtcccacctacttgttaggctgaggcaggaagcttgcttgagcccagaagggtgggcttaggatgcagtgagtcgtgttcataccactgcactgcagcctgaggaagaaagcaaagagcccatctccaaaagagagggagagagatgtggtctcactctgttgtccaggctggtctcaagcaattctcctgcctcagtcttccaaagtgggattacaggcgtgagccactatgcccagccaactagctccctttctcctgcagaaataagaaaaagtctctctctctcatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaa

SEQ ID NO: 6288 - DNA, 300019 bp, Homo sapiens
gatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggccatatccttttgcccgaaccccagcagcagctgcgcctccccctcctccctccgcctcccctcttccaggctgggagagagacccgggggttgatgggaggtggggaggaggggggtcttccaggggctgggagagggggcaccgggaggagtgtgaaagaatctctccaccccgagctgggttgagctaccctggaggcttgggaatgggtttgtggggggctggggggtgggcagcggagagtggatccttcccaaggaccgactctagaatgagatctggggcctggggtcgtgcaggagccttggtgggggctttcgagccaagtccggagggtttggagttctacggagtgagcttggagcgggctcgggcctgggcgcttctggccagggcaggggaactatgggggccttggttgggttttcttggccgtcgctcactggagtccacgcaggggaagctggacagcctctccactactgctttccccaaggtggggggccgccgcacttttagggcagggcgcttgggggctcccagggctaagagcaagagggagtccatgtggccttcacactgagaagccagcactggccgaagtgagtaccccagggtgggccgctgttcctatctggagaggatagtgatgggctggggggcgcttatgtttccctcatgtgtgcaggtcccattgcctttaaccgctgattggggaacctcatcatctttgggggtgtcgagaaagagatcccacttgctttatctgggcccctggcctgggaagacctgatctggacactttcagtaagaaagacagggcaacagcaaatgaggtggtgggtccattttagagcaccatgtccagcttttcctaccccgagtagccgagagggaacaccaggagaatcagcacccatgtggacatcttaggtaggtaaatgccttttaaatttttttttttttaatcaaagatccagaggaaaaaggtgaagcccacattttcttctgtggagatgctatcaaaatgcagatcttctgtgtttctttaaatccctgcctgcttgaaataaaccttgaggagggcttaacatctatcgagatgtaggcaggcaagggtgggtaattagtcgggctttctagcagttatctaagcatgacccagattccaggaggggggacacaccctgctgcccaggctggctggccactgtgccatgcccagatgtgccgcttctccgcacagttccaaccagctgccctctgtgtaaaaatgaacgggctggatgggtccctggggctcagcgatgagtcccctatcccttttgtatgtggttttgcagttatagactaaacggggctgggccctgtgtggtctccgggggttgctgtttgaggagcatggcgggtggtagagggactcacttcaggggggttcaaaatcgagcctggcgcttggatcctgggtgctgggattgcaacagagggcactgaggttttggagtgtgtgagtggtctactttgagggtggggaaaattaagaagttcagcagaggtgcttttgaggggagcatacctctaactacgatgccatctccgttggtgcccaaagcaggtgccaggtctttgcttcctaagtttcagactcttaaagaggctggttcttaaggttagcaattcctcaccatcccaggcccattgaagtgctcaggggtggcttgattactctgcctatcaacagagtgaggagtgggagtgccttgcaggaggacagggtattcatgggtgcacacccagttagctccaggagtgagagggctttgctcggctgacaggtttcctcattgaaaatggctttagatcgccttctggagcctggatttggagacttctaagaggaaaggaaggaggtggggagcccttctgctgtgtccttagcttacctctgtccagcctgaatcctgcagattggagggctgttgggggagagggggattgcagtggcccctcggaagggggaatcgtgggagagggaggcaggtgaattgcgagtgttgcttgccacttcatctattctctggccagctcgcccggggctttcttgctcttatgatgagtttgtgcattatgctctctgcagactgtttttgttctctttgacccgaggtaacaaacacattatacagccctactctggaagggaaaactccccacctcacaatctgtcatcgagctgggtcatccaggactgagctttctctgtcctggatggagcggagggcggtggcggggtgggtgggagggttggagatgagaggggatggacagagacctggggagggaggtagtgaataaaagaattcaggccagtgtaaagagaaagacacgtggaatgtcagagtcacgataccagggcagaacattctactttttaatctaaatatttctgccattaaaaaaaaatgtttcagcatatcctgagagtgaaaaaaaaagtgtgtaggtacttaaataaagtctaatatatgtacaggcaagtacatatattcagatgcatagatttttacaaaatgaacacacccacgtatccagcacccaggtcccgatcagtgccctggaagtccccctccccataccgcctcctagttgctcccccaacaagggtaccgctcacctgacttctaaggttcattttgcctcttttaaacatgtaaatggagtcacacagtacgttcttttgccactggcttcttttgctcacatctgtgtatgtgactctactacaatctatccattctactgttgatgggcatttgtgtcatttctgtttgtgccactgggaacattcttgtgtcttctattatttttttcccacagttctcttagataggagtggaatcgcccctgctactttttgatgcatgtgttgtgggatgtgtatttggaaatggtgttgactaagggttgcaggtcgatatggaaagcaggttcctccctgtcttgtttaagagaagtgagtgaatgatccatgaacttgtcggtatgctcacagggcctaagagtgctacttccaaatgtaaattctggcatggtacactggtgaaggatgcagtcttgctttctccacactcggggcaatttgtcactatgatttcttcctctttcatccctcagtgggtcaaacttgaagccatcaatgacaattaagaatcctcatttatttcattttttcccctcttcctaagtgaggaaacccaaatggaagtctttgatgttcaaatttacattgccgtgtttttctcatgccaggcagcaagccgtcttgaccacacaccttggtttcatgttttcattgactggaattgtgattcaaatagggccatgagggtctctgatgattgccgaagagctcagatctgtcagctcaaaaaggagcatctgtcagccttcctagagttccctccccacttaatgccactcactccttctaccaagtgccaaggtgaatgtcatctttccagccctccctgtgccaccaggtctcccactgaacatgatgtagaaactcaggccatcggaggaacactggaagcaggtcagtgtattatcacgcacagttgcctgaattacacgtagaattccagcttttcatccggtttgcagaaatcttaacaagacacctaaagtcacattgacatcaggtgacatcactttgacatctgtggacattggctgattggcactcctctcatttttttttttttttttttttttaagaaaagctctctaaagagaaactttctgcatgagaagcgctgggagacatgggagcaggttatcagactcttggcctgtcctgagagatagaatgttctagaaggtactgccgtagagggcaggatggtgtcacttacgtgatccttgtactagaccggcttggctggtatttccagaggagcaaaattctgcgaagtaaaatttagcacggcttttccaatgggagtattttcaaaaagggtgcaatttcttatccacaattccccaatccaaaaagctccaaaaaccaaaagacgagctcatatagaggtaaaacctaacctgaactgacttcagtttgaagtcttaatttacagttttcattcattctacttggtgtgcatttgagtatgttttgcagcagaaatgttagatgtgcttgatgatgaggtgctgcttcagctcctgactgttaggtctgcattgtagtcctgtcaaactttcaggtgtatggaagttgtcttgttaacaggatggttctggtccagcaggatttgggtggggtctgggattctgcttttctagctagcttctagggattccccatgtggtaagttcatgggctagggttggagtatccaggttagatcatagagacatcttgttatcatttttcttttccttaaaaatcaggtttataggggccgggtctggtggttcacgcctataatcccagcactttgggaggctgaggccggtggatcatgaggtcaggagttcgagaccagcctggccaacatggtgaaaccccgtctctactaaaaatacaaaaattagccaggcgtggtattgtgcgtctataatcccagctactcgggaggctggcaggagaatcatttgaacctgggaggcagaggttgcagtgagccgagattgcaccactgtacttttttttgagactctgtctcaaaaaaaaaatagatttattgatgtataatttatttgtagcaaaattcacccttttgacatactggtctgcaagctttgacaaatggatgtagttgtggccaccacccaaatcaagatatgggacagtttcatcaaccctaaaatacccccacagtgcccctcttgagtcagcaccccacttctccagccccttcaaccactgatctgttctccatccctacagctttgccttttgccgaaggtcatataaatgtaatttcacagtatatagccttttgaatgtggattcttttactcagactttgagattcattcatgctgttgcctgtgacagtagcgccttcctttttggtgttgagcaggattccatgatatggatggaccagagtttgcttcccagccgaaggacattgggatgcttccagtttcaatgattatgaatagagctgctataaacattggcttatgggttttagtgggaacatttcatttcatacatttcatttctcttgggtaaattaacccaggagtgagattgctgagttgtgtggtaggtgtatgtttaattttataagaggctctcaaactgttttcctaagtggttgtaccattttacattcccatctttgcaatgcgtctaaaagccctgagttctgaattccaaagcacgtctggcctcgatggcttaggattaaggatgtggatctatggaaaggagtggaagtaatagtgttaaatcccggtcagagaaataagaaagattaaggatgtcattcaaagctatgtgcctgcactagagagagagaaagaaggggttctcttgggtggggttccacccctccctggtagttctaccattccccaggaaaaagtcaagctctgaggctgtgagacccatgatctttaccctgttcttcaccactgcaaccccagtgtgtgggacaaagcaggcgtcctataaacgtttgctgagcaaatgagaaaaggtacctgtcttcacccattaactaaattgtataacatctatctgatctacccttgtgccaacgttttaggattttgatgggttttagttgcagggggttgagagactgtccatgagattatcagaccaatgaaagtttctgaaatgttagtgcttgagtagattggatgcagcggccccttgagaatgaagtctttcttcagggacttggagtgggaggcatctgttgggtgcgtagggcttatgcttccccctccctgtttcccccccagtagcaagcacacatatacactttctcagcaataaaaagcaccgccgggaaggtggactccatccagaaatgatcagagcctaagagccgtgcagtaacgcatttccgagaatgccagctcagctcctgagaaaagggccggatgggatggtgcctgctctgaaagagggcagagaggagagggaaaacactccggactctgggtcagactggcccaggttcacattattcaccagccatgttatcttgggcaccagagcctatttcttgacatgcatgatgaggatattccttctagtagcatctcccttggagggctctcaggagattaaatggggtcgtgcgtgaaaaatggccagcacagtctccagcacagagaaaaaccccaaaacgccagagccgtaatactatggagtcatttaggttccagtgttctttttttggaaaccggccagaaaagaggctttctgggtgggaatgggagcgaagtgcccccccccaccaccccctgcgactggtcagtgtggattgattaacctgatcgtggcgctctttaaagccacctttggacattttgcattctccgttctctctggaagctttcaggggaaaaaaaattcgtggccacttgacccatttttctattcccttgagtctaaggtaaaaattaattctctttcctcctttggtccctccctctctctgtgggtgacaaggtgagggagttttaaagtatataattagcttccctcttccccttttgcactccctgtctcttcctttggggccggtcgagagtgcagcccaggatggccaccccaggtgtccactgcaaactccacagaaaaactttgctcaacttttggtttagaatttaggtacccccctccccttccaaactttggtcttctttctcctcactccctaaaaaaataggaaaaacaaggaacattcctggcgagggaaccatgagtgggcacagcaacttaggtttcaaaaaccactgggcctcagttcttatctgagtagggtgacccttcagccagggttgcctgggactatcctgggtttagcatctctggaaactcacagtcctgggcaaactgggacgctggtcaccctaatggtgagttcttaacacctgagagagaagaatggtgcaagagatggtgccgttgaccaagaaagggggagagtcagttacttattccctctgaaaagccaagactttttattggaatgaatgcagcttttagaagccgtctttaaggcagctaatacaagagagattccagctatgaagggaaatgcctgagttaagtccggatcaagttttgacatctcgcttcggtcagacacggctttatctgccgttcagactgggagcagccgtgagtcttccttaaaggtgcctgttgctcaggcggcacctgcagttagaaattagcagcctcccacccccagcccccaaataacaggattcaagagtcccctctctgaagccatgagggaaacccaacttagtcacccacttgccagtaaataatattcatgctgttaagttctgttctcattttaggcctatgtgtaaaaaatatatgtaattttaaactgatttttaaagtattttcatacgaacagcatttgcaggagggcgaagtctggatgttacctttttgtaaaagtggatggatttgtcttcaatgagactctggggcagacttaaaacttggcccgcagtggtgttacatggattctgatcttccagagtctgtcacgttcttttatctccatgatctttattatcttctttattgagaatgatgggcatggtgtgtgtgggtgggagggctatgctgaccatcactgcagtgaaatgtgttcgtggcatgttgtggcgtctgcataggaatgtgtctgtttgattaacagcacaagcagtggaggctgtaaggaggaaaagaggagggaaggtgatattggatggaggggagacatatagagcttgggaacagtccaccctggctgcaaatctcagctccagctcacagttgtggagcctcagtcttctcctctgtaaaacggggacagtagtcctatgtccgaggaattgtaagaaggttaaaagatactgtacccagaaagcacatggcatatataatcatcctgtgaagtagccaactcaatgaattttattttatttattttgagtcagagtctcactctgtcacccaggctggagtgcagtggcatgatcatggctcactatagcctcgacctcctaggctcaagcgatcctcctgccttagcctcccgagaagctgggactataggcatgcaccaccgtacccagctttaacaacataaatttatatatatatatatatatatatatatatatatatatatatatatatatatatatatattttttttttttttttttttttttttttttttttgagatggagtttcattcttgttgcccaggctggagtgcaatggcgcgatctcggctcactgcaacctccgcctcccgggttcaagcaggacgatgggcatttgggatgtttctagtttggggtgggggattgtttgtttgtttgctgttatgaacaatgctgctgtaaggaatcaataattttgaatgaatgaattcgaggtgttaattttagtctgtgtacttggaaatctagcttcacctagaatcagctgagattcatcagcatttatggcaggagctaagacatttcacagcttactcatcattttctctaagaggctgggtcaaccggttagctcttggtcctgcttgtattctgagagtcagaacctgtggtttagacactggcaattgatatggttgtagagaagcagcatggttgagttgagagcatggattctggagctaggtggctggggttcaaatcccagctctactagtcactggctgcgtgatcttgggcaagtcacttaagtgttctgtgcttcagtttcccagtctgtcccagtggtgattctaatagctccatggggatcctaatagctcctatctgggaggattaaatgagttaatacatctgatgtttagagtggtgcctgacacttaggaagcactatatgtgtttatacatggaagagtggatagatggatggacttatgtgggtggccatatttgggcttctctgatccactgctgagaatagtgtgtggcacacagtaggtgctgcataagtgttaatattctgctctttcttgccaagtctctcaactcccttgatctctgttatttttggcgtctgtgttgttaacccattcttctgaatgatcagctgaatcactgttgctccaatatataagccaaggagaacacaatcacaaggtctcattgattgtccatactagaattccatgattcctaggcccaagtaggattttccccacgtctcagcaatccttcttccatgtttctaatctttttctctcatttgttatgccccattgccagactctccaatctccccacagcttccccttcctctaactatactgtctctagtcttaccttctccctaagggcaccgtctttgaagacatcaaatacttcagagcaccaaatataggttagcttctctgagggccttacaaggacatggagtgtttgggtcttacacaaattggaatggtcagaaatgtttagagacttgagttgtctttgaaagagttgtcagaatgcaaatttttgacttgtggcctgtttctgatcacaacgcagtcttttaagttatggatcatagctggatgtttgtggtttagaggggatggaggcatcctctgcagttagtgttggatgtctgggtggatggatggatggatggatggatggatggatggatggatggatggttgaacagatgcatggatgagtggatggatggatggatgggatgaaggaaggaaggaaggatgggtgattggagggtaggtgggtggataagtagattggtagatgactcgatgggtgggtggacaaatggatgggtgaatggatgactggatggatgactggatggattggtgtatgagtgaatatatggctggatgaataaataggcagatgactagactggattgaggggtaaaaatatggatgactggatgggtggatgagtggatgatagatggttgaatgggtgggtggatgggtggatgttggatataagggtgtatggtagggtagctgtctatgtgtgggtctccctgatatttggtgttctgtttgacttgggaatgaccaagtctctccgcttaccaccttatttgtaccttttccagtatcaagtgaattttgcacacttttgtaaaaatcaataagattgtatgtttaggactttgggaggccgaggcaggcagatcacaaggtcaggagatagagaccatcctggctaacagggtgaagccccatctctactaaaaatacaaaaaattagccaggcgtggtggcgggcacctgtagtcccagctacctgggaggctgaggcaggagaatggcatgaacccgggaggtggagcttgcagtgagccaagatcatgccactgcactccagcttgggcgacagaacgagactccatctcaaaataaataaataaataaatattatatgcttaggttttacctatgtaattagaaagctccttgagggtaggggacagtgatttgccttcctcacatccccccaaagttcctgcactatatcatgcataagtatttaattgagtaatggtgaggaaagtaaacagtgttattgaacaaagattattaaaattctggaaacacctggttttgtttcagcactgggactgaaagtggaattccttggattttgctccattggtggataggatagcatgtggtggtggactggtagactctttctcttccaagcagattgggtaaatgccccagattcttacccactagtcagagattacagattactgattgatatggtttttctctgtgtccccacccaaatctcatctcaaattgtaatacccacatgtcatgggagggacctggtgaaggtgactggatcatgggggtgatttcccccatgctgttcttgtgatagtgagttctcatgagatctgatggttttaaacttgtgtgggcctctttcctctctctcctctcctgctgccatgtaagacgtgccttgctttccctttgccttctgccatgatttgtaagtttcctgaggcgtccccagccatgcagaactgtgagtcaattgaacctcttttctttataaattacttttatagcagtgtgaaaacggactaacacactgatgtagcaaggtcctttaaggccccatgtgatctggtccctgttttgtctttgatctcatctctttcattgtctaccttcctttcattgtctattctgtctcagccctgctgaccattttactcacacccatgtcatttgcattacatgacattccttctgttcagcataagctatttcctctgcctgcatcactgtttctccaggtctccccatggctaactccttctcttcatttaggtctcagcccaaaagttacctcctccaagaggcctatccttttcatttactgaacatctcatgtacaaaaaagaatataaaatatatgtatactctctcatccacaaaaaaatctctgaagacattttaatgtatttcatcccatacctttttatgcatgtaaacttttaggaacacatttccatgccactaggtatccttgaaaaaataagggccaccatgtatagttgcacaggttgtgcactgcacaaagatagcatgtcacatatcttaagtatcatggagcttgtatgtctactatttcagtaccccagctgataaaagcttaagtatcttgttctagcaagatgaagctattatgacaatttttgacagagaaaggggtgttttgtttaagttcacaatcagagaaatgggtgtcttgtttaatttcacaaccagagaaaggggtgtcttgtttaaattcatacagtggtgctgtatgggttggtggcaaccccagaaaagactgttgttaatatctgataatgttccactttatacgtgtattatattcatgtaacaatctctggctgtttgttttgccattataaataacagtgcagtaaacatctttgtgtgtgaatctctgtccaaggttctgatagttttctgaatgaaattcctgtctatatatggcactccaagcccataattgaaactctgctgttaccactttctttgaatctgtagaaggaattttgagaacaggtgactggtatattcaggatgttgatgacaaggaacagagaaagaacagttaaatggtttggaatttttcctgggctgcatgtaaagcagtgcttttgaactgggagcaatttttcccccaaggggacttttggcaatgtctggagacgtttttggttgtcacgaatgtagggggagggggcaagatgctactggcatctggctggtagaaaccagggatgcagttcagcatcttaaaatgcacaggacagcctttctcagtaaagaattatccagctccaaatgtcagtaataccaaggttgagaaatcttgatgtaatcgatgtcatgggtttcttcaagaggagtgggtggatttagggtttttgggtgacttaaatttaatttacagtttgtcttcctagctgggtgtctaagccagctttctgtgaactttagatcccacacaagaagcaacaggcttgctaccgacagattcgttgatgtaaatatagatgagtgtatagaaggaaatctcacccagagctggaaaatgttggaatgaaaactgcggcggcctccccttctctctccttccccttctgttgccctgtttgaaaatcgtgccttactttctttggtctcctggcatggtgaatgctgctggtatggactgtgtttctatatccccttgatccccacacccttaggaacgtacaggagagagaccctggagcatatcagcttagagatggaggggaatgggaaggagtgcgttcattcattcataaatgttgactgagcacctactgtatgctaggtgaatgggaggacgtgagggcagggaggtgacaaggttggcttattctgggctttgtgaactatggtgaggattttgtttttttccaaaggaaatggaataaccactccttttttccccccgatatacctaaactttttgattttcataacaaaaatgggcttccttttgtatatttgttttgagaccagccgtttttccaccaacactgatcacactgcagtgagcatcctggtagagaagtctttgcacacttctgtcactgtttccctaggacagattcctggaaatggtatggcaaggttgtatgtcaggcttttgggccaggttgcaagaaacaggaagtctgtgccctttcaaattccaaggtcccctttccctgacgacgtggcccaatcaggcttgccctcccttgattttacatcttcaccaatcagataagtgaaagtgaaatcctgttgtggtatcctgtgcatttctttggtgacttaagacatagagcattttccagatctctgtgggctgtttggatatcctttcctctgttttctcaggcacattctttaccgatgtctttgagggattgagcaagtttctgttgaaattgaggcatgtcatggctctgtgtggggcttgaggcagtccagtgtagtggagggagggaggctgtggagcctggctgcctaggttcaaataccaactctgcttatttccattcatatcattttaggcaaatcacttagccccctgggcctgcctttcctcatcagtaaaagtggtataacattagtgcctgcattgtggggtggttgtgaggaaagcagcactcaaaacagtacctgacacacagtgggtgccaaataagagtctgatgtattagtgttataggtatcggcctcctccctccccagtgcaatagtgtgtgtgcgcctctgtgtacctctgttggtgctgacaagccctttttaaaatttagaggtgaggtctcactctgtcccctaggctggagcacagtggtgcaatcatggctcactgcagcctcaaccgcctgggctcaagcaatcctcccagcttagcctcctgagtagttgggactatcggtgtgcaccaccacacctggcccttagacagcccctttatttcaaagcgaaatggcagccacaagatttagtgcaagctctccaagctttaggaccagctgcaactcctctaactgaccaaacaggatcccccatgtccccaacccccaaaacctgatgaaaagcaaacagaccattttccacattcatgacggaaaggcccttttcttggctcctgcccttgctcatgtcaggatttcactccatccctgataaagaggaagcaccatgtcccaggaggacatggaaactctctgctttgtggtgaatagttacagtaacagtagctcctctctgtggggagcttatgagcccctaagctttatagaactgccctggcagtttatgagaacttcatcccagcccccagagctcatggcacttatttttgcccccagtttgcagatgtgcacactgagactcagagagctaacactgcttgccaaggtcacacatctagcaaatggagaaactttatgagacaggtgaaggcacagcaaggataaaaacccagagggaaaaatactcaagttttctccgggaaaccatttgcattccagagaggttggtgtgcgagtgggcaagagatgtcgcgggacgatggttaagggacagagtctgagctcaactaggactaggtttcttcctttccttccttccttcctttcttccttccttcttcctttcctttgtctttctctccctcccttccttcttcctttccttcctttcctttctctttccctccctccctcccttccttcttccttccttactcctttccttccttcctcctttccttcctttcctttctctttccctccttccctccctcccttcttccttcctttctttccttccttcctttttcctttctctttcctttctttcctttccttccttcctctcttcttccttcttttctttctttcttttctctttctttctttctttctttctttctttctttctttctttcctttctttctctctctctctctttctttccttctttctccttccttccttccttcttttcttttcttttcctttcttttcttttgttttttgagatggagtctcgctctgttgcccaggctggagtgcaatggcacaatctcagctcactgcaacctctgcctcccggttcaagcaattttcctgccttggcctcccaagtggctgggactacaggcacgcgccaccacacccagctaatttttgcatttttagtagagatggagtttcaccatgttggccaagctggtctcgacctcttgacctcgtgatcctcctgcctcagcctcccaaagtgctggcattacaggcgtgagctaccacgcctgggctaggactaggtttctatcggtggtgtggcttttgggaagctacctaatcttaaccactctgtttcgtcatctataagataagcagtgtagcattttcttgcaggaatgttgcaaggattaagtggatggtgactgtaaaacatcatgcgtggcacatagtaaattctcagcaggtagtcattgctggtcatttacttttctctaatgaccagcaagctcttaatttcctccttggcatgggcactgggacgtagatggacaaaacacagagagaaataaacacacggacaaaaatccccgccctggtgtggctgatattctgggtggggagagagagggagtccaaggaccagataaacaggtaaaggatagtttgagtgtggtaagtactaaggctcaaaaataaagatctcccaggtgatcttagctgcatttggaggtgacaggagatacaactgagaaactgagataggaggaaacccaaggggagatgtgggcttgatttagggtgatctgaggagtaggagaagtcaggggctggtgtggggaggctctgatggttctctctggggagtgaagcagggattcgttggggagacccaaggggacaggtgaaggcccctgaacaggtggccagtgctgagaaaggaaaggtggaggacccaagtgagttcctaatttcttcattgctcccctaaggtgtttgtctcacccttggccatagtcttggatcacttacagatgcagaccaggctgggctcaatggcttgtgcctgtaatcccagcactttgagaggctgaacccaggagtttgagagcaggctgggcaacatggtgaaaccccgtctctacaaaaaaatacaaaaattggccgagggtgttggcacatgcctgtagtcccagctacttgggaggctgaggtaggaggatctcttgagcccgggagacctatgctgccaaataaggtaggcagtagccacacatggctattgcaattttagaaattaattacaggccacatgtggtggctcacacctgtaatcccaacactttgggaggccgaggcgggcagatcatgaggtcaggagatcgagatcatcctggccaacatggtgaaaccccatctctactaaaaatacaaaaattagctgggcatggtggtgcacacccgcagtcccagctactcgggagactgaggcaggagaattgcttgaacccaggaggcagaggctgcagtgagctgagattgcaccactgcactccagcctgggcaacagagagagactccgtctcaaaaaaaaaaaaaaaaaaaaaaaaaagaaaagaaaagaaattaattacaataaaaacagtccctgagtttcactggccacatttgaagtgcccgatgaccctgtgtggcttagtgaccactgtgctgaatagtgcagatctagagcatcctactggacatgttgccagggtccctgaaccaacagaattagcatctcctgggagcttgttggaaatgcagaatctcatcccctaccccagacctgctcaatcccaatctgctcttcagtgagattcctcaggtgatcttgactgcaccttctaatcacttggaagctttaaaaatgctgaggctgggcacggtggctcacgtgtgtaatcccagcactttaagaggccaaggcgggtggatcacctgaggtcagaagtttgagaccagcctggccaacatggtgaaactccatctctactaaaaattacaaaaattacccaggtgtggtggcacacacctgtagtcccagctacttgggaggctgaggcaggagaactgcttgaacctgggaggtggaggttgcagtaagctgagatggcactgctgcactccagcctgggtgacagagtgggactctgtctcaaaaaaaaaaaaaaaaaaaaaaaaaagaaaagaaaaaggaaaatgctgatgccccaagctccacccccacagatgctggagagatttgtccagggcttcccctggagtggggaatgtttgaaaactccccaagggtttctaaagttcagccagagttagcagaaagcccattaggtggctaagcaggtagactgaagttggagctgtgtgaccttgggcaagccacttaccctctctgaaccacaagctcccttctctctaaaactagagacctgctggcacctccctcccagggctgtgagaagtaaatgatgggatgattcaaagtgctgagtagggtcagatgcagtggctcacacctataatcctagcactttgggacgctgaaatgggaggattgcttgaagccaggagtttgagaccagcctgggcaacatttaaacattacccaggtgtagtggtgcatgcctgtagtcctagctgcttgggaggccgaggtggggggatcccttgagcccaggagttcaaggctgcagtgaacaatgatggtgccactgcactccagcctgggggacaagagtgagaccctatttctaaaaaagaaagaaacccaaaatgctgagcgagtgccttggattgatagtaagcagtgcctgtgtaataagcatgaattttaaaaaatgaggtcagcagccttagagctaatggttaatgggtttgggtgtgggatttttttttttttaatttttaaaacattgagataaaattcccataacataaaattgaccattaaccattttaaagtgtacagtttggtggcatttaatacactcagtgttgtgcaaccatcacctctctgtagttcaaagaccccaaaaaggagaccccgtactcactgagcgctcactccctgtctctccccgctcccccagcccctggcaactactaatcttctgtctgtatagattgacctattctgattttgggggtttttgaactcgccttccctggctgacaacctctcgccatccaggtgagactgtgtgaaagcccagctccctgcatttctgggtcttcctctccccactgggggctgcccccacctgtttccccctctgggcaccctggttctactcatcagcctggcttaatcccagcagcaggtccatgttctgctctcctgtggctgccacaaatgagaggtttcatctcagctgggtttctcctagttaaatatttaataaataagacctacaacttgtgatgctgggagtgtttgatagtgaaattaatgatggggagagagtggcaggcggcccacaggtccatgctggagctgggatgaggcgccctgggcaggcgtccgtgccactgatgcttgggaaccacggtgggccatgccatcccatttcccccagccagggcctcttttttagcactgtgtccagcacagggtagccacctgataaataagtgttaaaagaaagagaggctgcgtgtgtagggaagaaggaagagacagaggagacaaagaggagacacagagagagagagagagatgagagagaaagaaaagtggaaggtgagaaagagacagagatggaaggggagagaaggacctggatggaggaagtgcaaggaaggcaatggtgagggaaaagagagagagacaaagatggaagggatgaaggagagggagagatatggaggtagagaaagagagacagaaagaagagagagaatattgcttcttgtatcttccccttctcctgttatccttgaccatcttattatttttttcttttttctgtctctccagttctcatttccttaccctcgccgtcttgccaactcgtcatctcttttcatttcctgtgtctatgttatcttttaattttctgtctgggtattttccccttttctctttctcagcataaactgttggttggtgtatgtgtcttctttcttttttagtctttaactgacgtgtgtgtgtatgtgtgtgtgtgagagagagagagacagacagacagagagagagagagagagacagaacaaacctagagagcagtgtaggaacatagatgaacattttaaagaccaaaccatgaagcgtacacccattttacccaggtcaagagccacagggccaccatcagattctccctcatgctcatcctcaatcacagccactccttccctcctggaggaaccactattggagattgtatgggaaccattcgcttgctttcttgtgtggttgtaccacctaagtacgcatcctgaagcaatatagtcagatattatgtggttttgagttttatatgaataaaatcatgtgagaggagttgttttgtattttgcttcattggtttgcagttacctttgtgagatttcatcctcattgtggtcactgcagctccttcatgatcttgtttattcattgatgatgagcatgtgactttgttctcttttgggcactggcataagcagctttgttggttgtttatggattctgctgctcgcttgcaggggtctctctggagcacatcgctctgtgtgaaattgttggatactaagatttgtacattttcaccttgactaaacactgccaaacaattttccaaagtgcttgtgctaatttacactcctgccggtggtgggtgagcattcaagatgcttcacaaccttgccaacacttggtattgtcaggtttttaagttatagcctttctcatggtgatttctcattgtgattttagtttgcatcccccgattgcaaattagagtgaacatagtttaaaatatttattgactattcaagcttgcttttttgtgaagtgcctctacatgctctgtccatttttgattaggtcacttttaaaaaaaaaatattgatttgtgggtgatccttacatagcctggaaactgattcttcatcattatatgttgtgcaatattttctcttggcttggcttttgatcttttttataatgtcttttgatcaccaacagttcttaattttgatgtggttgattttagaaatcttttcctttatagtttgtgggctttgtatcttatttaagaaaatcatttctaccctgaggccatggatatattttatgttatttctgaaagttttacagttgtgttcactgtatgtctttaatcagcttgggattgatttttatatgtggtggtaggtaggggtccaatttcctttttattccataagaattgtcccagcatcatttattaaaaagcccattcttgccccaatgatctgcaagacaacctcttgactgtttaacttttaccttctttcatctggtctgtttttatactcaacctttgaagccacaaatatttattgagtgccaactgtgtgccaggcactgagttacagtgacggatatgacagatgcaatcatggctttcatggagtttacagtctggcaaggatgacatgtaaatagttattactacttataatttaaaatgttataggccttgcaaaaagggacaagtctggcttgctctaaaagaaacatgtgaaacaacatcttccagggaagtgctgataaactgagtctttagtgggcctctgctattgtaggggtgggaatggtggaaaagatgttttggccacagggaacagcatgtgcaaaggtcctgtggaaggtgcttaggagtttgatatttatcctaaaggcactgtcaggctactgaagcagtaatacaatgattttatgtctgtgaatagttccactggttgctgcatggagaatgtattggaatacagcaagaataaaaagccatgagaccaattaggaaatgatttcactcattcagggaagtgtgccttgggctggcatggtggctgtggagatggaaatcattgatcagattaaaagaaattttgagctggcatgatttttcccctctctcccctctctctatctctgtttcttttctggttgtgttttctgggtgagaaaagcagtttgtgatcctgccaagggtatgtgctctggaggatgtatttgccacagatggtctttggaattctggccaagagagtcactggacagcccctggcccccagggtttctggagccaattcaacaatgactgtttattaacaacagcaaggatgagttgctagcctttccttcagagcaccttttaactgttaccttactttgttacccaaaccgacactatggaattggtgggggagaagtggaagggtttttatctccattttttatagaacgggggaagttaattggcactcttgaaatcatacaaaagatgttggtttcaggattggtttctggactttcagcccaatcccaattactcaagctcacacacccaatccccaaacatactcttttgcaaataatttccctactgaggtgctcctggccaatttaaaaggtccccatttccttgcctataaaatgggaattaaagtaaaaatatctacctgttgacttgctgtgaggtcagtgggcctgacacatggtgtggactcattatatttacctatgtgaatcccttagttccctttacttggaagaggtggaaaactcaaaggggcttaaacaagaagtggggattgtattggctcatgagactgaagagtctcaggagtgtccagcttcaggcttgtttggatctagggatcagataacaccattaggcctctgtttctgtttcttggctctactttttgcagctggctccattatccatgacttagctgcacttccagccctccagtctgcccaagaccatattcagagagagattcttctctctttttcagctatcttcccggaattttcagcaaatgctttcttgcttttgattggctgttgctgaggtcgtgtgctcatgccagaaccaatcactgtggggaaatgggaggtggagaacggggtgctctgattggcttaggcttgggtcacatgactttatggagttggggtggagccaacttctccaagtggggaagagcagtcttcttaaaggtgtattaggatatgcttgctgctgtaacaagcaacccccaagtctgcagtagcttaaggcaatacgaatgtacttctcactcaccctaaatccaatcagataatcagcaagtggcattccatgtggtgatttcaggacccggctctttccatctgtggctccaccatcccctaagatcagaaagtccttcacttccggcctgtaggaaaagagtatgaaggctcacacaggaagttttgggaggccacatatagaagtagtgaaccttacttctgcctgcattctgtggactggaatttcatcccatggtgtatgagagagggtcccagtaggaaacggaagacacagaccaagaatcaaattaagagatagcttaagaatcaaattaagagatagcttacaaaggtgtgggcccttactgaaatagagaaggaggaagagaggaaggaggcagagacagagagagactgagactcacaaagacacacacacacacacacacacacacacacacacacacacacacacaagttgagagaaagaaggggggagagaaagagagagagggagcatttcctaacaggaagctggcagaataaatgtcccccattgtccaaagccagagggctgggagcccagtgagcccatccacacaggtcagccccccatgtgacagtcctagaagggtaaagaaggaaggagagtggatttggggtaatggaagacagccaatacccatggtccatctgactgcagggggaactgagaaattcagtccatggagaagaaggtttagtggacacgtcactttgtctttttcacaaagtgaaactaggttctcaggtggaaaaaagaaaaagaaggtttgccttgctgctattctttttttttttttgagacggagtctcactctgtcacccaagcgggagtgcagtggcacgatctcggctcactggaagctctgcctcctgggttcacgccattctcctgcctcagcctcccgagtagctgggactacaggcacccaccaccacgcccggctagtttttttgtattttagtagagacggggtttcactgctagccaggatggtctcgatctcctgacctcgtgatccgcccgcctcagcctcccaaaatgctgggattacagacgtgagccaccgcacccggcctccttactgctattcttattattggtggtagcagtggtggtgatggttattggttcttagttccctctacatgccagtatctgctctcttctttttttctcccttacttctttccttgttctgcaaattctttccctttaagtgaaaatctttccgtgttctccaagggagataaattctatgccaagcttgagtgtggggtcctctgcttggatagctgtcttctccaggagatgaggtagaactgagatagtgggggtctctgcaggcagtctgtgcccctggcaagcccctcaccttaacctgaggctgggtggggaaagatgccttgatggagtcagaacagaaagcaagtgatcgctgcctgaaccaagcagtcactttcctggaggtgaaacctagaaacggtccctcaggctgggtccagggaggtggacttgggtcccaggggcaggaagcaacctgcccctcacctgctcctacctctttgtagcctatcttggcaaccagaagtaggtatacaagtgacgttgaagctgggcatgttaacaatggtgtgagcccgcctgactccaatctggtccagctgtactggccgtgcatcctcatctccagcccccagggtcagcccagcggctgtaacaatggtctgtcccctccccgccccacccacttctttgaactcctccaaggatctgtgatgatagggctgtcactgtcttagcttccaccattcaagcttaaccggccttcttcccctccatggagaacggaagagcaacccctcattgcctctggcagctgaccagcaggtccctgccttctgcccactcccaggtctaggacaatgaggtgagaggtagacaggaccaagttccccagtgctgtcttctaggtccacctatcatgagagccgtgattcctagtttttatcaccctctccccaactttgccagctctccacttctggcagtggtggctgcccatgacttcaccttcccgtgcctcagtttcctcatctgtaaaataaggacagccatggtaatgagagttctggtcaatatgccaggcacctcgcttgcatcaatttagctcatcctttcagtgccctgaggggtgggtactgttatcatcccgtgtaacaaaaagagaaaaccgaaacagagagagagactcactatctgaggtcttgcacccctcaagcaacaaaagtgggatttcagcctaggctatctagattcggagtccacggtctcaatgaataataacaacaataataatattgtcctaatctgatgagtttttgatcagattcaatacaagagcataggcagaaaagcttagcccagtgcccagcacatggtaagaactcagcatgttatttataatagtaataaaccattttatgttatgtaattatatattcatagataaatatagttgactcttgaacaacataggggttggggcaatgacctcctgtgcagtcaaaaatgtgtgtgtaactttttttctctattttttagaaattttaaaattagagacaaggtctcgcttttgttgctcaggttgatctcgaactcctgggctcaagtgatcctcctgcctcagcctctcaaagtgctaggattacaggtgtgagcccccgcacccagcctgtgtataacttctgactcccccaaagcttaactactaacagtctattcttgaccagaagccttaccagtaacataaacagtcgatgaagacagattttatatgttatatgcattatatactgtattcttacaataaagtaagctagggaggagaaagtattattttaagaaaatcataaggaagagaaaatatatttactattcattaattggaaagggatcattataaaggtcttcatcctcattgtcttcacattaagtaggctgaagaagaggaggagttggtcttgttgtctcaggggtggcagaggtggaggtggaaggggaggccagaaagacaagcacgcttggtgtaactgttattggaaacaaatctacataagtggacccataaaattcaaacctgagttgttcaggggtcaactatatatgctacaaatacgtaatatgctaatatagttgtatgttattgttatagtacggggatcagaaaatgttttctgcaaaggattagctagaaaatgtctagtaaatactgtctctttgggaccactctactctgccattatagcaaaggcagctacaggcaatacgtaaatgaatgggcatggccatttgccaataaaactttgtttacacaaacaagccatgggccagagtttgtcaacggctggtatagtatatgttattatatattagctttactttttctgttgctttgtttatgttcttctttgcccttcctttcttaaaggccagcctttctttctctctgttggtctgtcttttaggacagcatggcaggccactgggacatgggctctcctgactccaggcttgtttgtctgataagacatgaagagtgaaggtggcaggactctgagctcaggcctgtcctcctcctcttccctctcttcgttttttctttcctctttcctcttttcttcccaagctccagaagttgccattttcctttcccattgctgattttctctgccttgggagaaagcccgagaagatcacttggaaaagcccacgagcatctctggcctcactcacccagctcctgccattgtctttactcttcctcagacacaccaggcacagtcctacctcagggcctttgcactggctgtttcctctgtctgcattgttcttctctcaggtgacctcatggcttctccctcctctccttcaggacttcactcaaaggccaccttctcagcatttgcctcccgcccttctgccttattttcccctttggaacttttcaccttcttacttactcatctgtctgctatctgtcaccctacatcactatgatctccacaagggaaggtgattttattcgttttttgttctgttttgttgaagatgaggttttgctcttgttacccaggctggagtgtggtggcacgatctgggctcactgcaacctccacctcccggattcaagtgagtctcctgcctcagcctcctgagtagctgggattacaggcacccaccaccatgcctggctaatttttgtatttttagtacagatggggtttcaccatgttggccaggctgatctcaaactcctgacctcaggtgatccacccacctcagccttccaaagtgctgggattactgtgagccaccacacctgatcttttggttttacccaccaatgtggactagaacagcctagatcagcaggtggcatgcagtaagcagttgataaatatgtgttggatgagtgagcactgtggcttctgtcattctgttgctcaatagcattcatctggaaataaccacagtttgtttatccatttacctgttgattggcatttctgttgattctcgtttgggccattatgaacaaagctgctgtgaaatacttatacctttgcccaattcttcacttggtgaacccttataaatcctttaggccaggtgtggtagctcacgcttgtaaccccagcactttgggaagccgaggtaggaggatcgctggaggccaggagttcaaaaccagcctgggtaacatagcaagacccgtctctacaaaaaaataaaaaattggctggacgtggcaatgcatgcctgtagttccagctacttaggaggctgaggtgggaagagtgcctgagcccaggagttcaagaccgcagtgagtgatcgcgtcctgcactccaggctgggcgatagagtgagaccctgtctgtaaaaatgacagcaacaacaacaataataaaacctttaggtttcctcttaaaaggaacatccttagagcttttcctgacccagcaactcaccccaagtctgaattagacttcaccccatttctttcataacatttatcacaatgacatgtttattttgtgggggcgggtggcattctggccagaactgtcgacttccagagtgaaaatacggaagaaccaaataaaacacaacacacacatttgcacagcagctcgagggaggtgcttagttctttgagtttccaagaacagagagacgaagatttgtctggggaggaaaaatcagggactgcttcttggaggaggtggactgttgctgccccatccacccacacatttgcagatgtggtgatgagaagatgactgtcacgaggtctctgagcccagggggcccatggttgagtgcaaagatagtggggttgacaaataatcgtcgtataacaaaagaaaagccaccacagttgcataatggaaaggcggcttctatagaacattcagatcatagttgaaggcatgtcacactgtgttactcagaggccactgtcagagccaaaagtgagagtggatgagagtttgggcaggaaacaactgaaccagatacagcatcacctccatgagggctcagctttatctattttgtcttctgttgcatccccagcccttagaacactgcctggtccatctttgctgtgtgaataataataaggaacgatcgctgtgttgagtttgggctgtgaattcagacagtttgctgctgcatacctgattatgagtctcagttttcctcctccataaaatgggcaaaacagtccttgcctcatggggctgtgcatttgtttagcaaacactgaaggagtatacatggtggccaaggcactcttcaagacacaggaagcagacaaaagtccctgccctctgggagcttacatgctcatggggagagatgtatgataagaaacaaaaatagtaggtaagttgcatagtactttagaagattataagggtaatgggaagagaacagcagagaaagggctggggaggcagttgctgtattagatagagctttatcgaggcgatggcattggagccaagacttgaggaagctgtgaggatgtctagagaaagaaggaacagctggtgcaaaggccctgaggtaggggtatatgtgacatgtgtgacagtgaggaggcagatgtggctgaagccagtgagcaagagagagggaaggtgcaaggataaggacagagaggtgacgggacaggttttggagggccttatgggctgcggggaggactttggcttttgctctgagggagctgggagccacggagggcttttgagcagaggagggacgtgacctgactcagatattcataggctcctctggctgctgtgaaaagaacagactttgaaggttgggggcaggcagggcagaagctggggaattaggaaggaggtgacagtgttggtcctggcaggtaatagtgggggtggaaccaggttgttgtctgtggagataataatgagtggctggattctggttataatttttaagtttttttattgtgataaaatgaatttttttattgtgataaaatgaaatttaccactttgaggtgtgcaattccacagcacttactacagtcaccctgttatgcaacagtcacctctatttaatctcagaacatttcatcccccctaaaggaaaccctgcacccattagtagttacttccagtttctcccttcccccagcttctggaaactactaattctggatataagttgaaagttgaccagtaggatttctaggcagacaggtggtgagggctcaatgcattcatgcacagaaagtactcaggtggcatatcataggtgctcaaaactgaaatggtgatgatgagttggcaatgatggtgagtccttccagaatccctgctctagtgctaaactgacctacctggctgtgtagaattctcacctgctggccgggagggtggcagaaccaggatcccttcttacttccagtctggcttgggttagggataggggaggaatgatcagaagaaccaagctagcaccatctgttctggaacatcatccaactcttgtccagatttcccagaactgagcaggaaaatgtccagggaggaacagtgcagctgatggaagtcctggtaagccctggccccagcttcctgagctgctgttgcaccaactagcatttgttggaccttcagtctgagccaagatggcagcttcagaggaagaacaagaagtgtacaagtttctttcatggttgtgtccccgcctccttatatagcctcatataaacccctgcactatcccgttactgtttgcctctccctgaaaagagtgtaaaactcccccactttttccctacttttcacaatgtgttttggtttctaaagatgaaactcctttaattatgttctggttgtaattttctggctccttttatttctcccttacttgatgtattattttcccttgttccttctgccccctgcctccattgatgtttctcttcactgctatctagatttaattctcaactcctgccaagttcagggtgatagtgcaaaaagacatggaccatttagtcttgaattcaggtcccacttctgacaccttcaaagctgctttactttgggcaagtcatatgatcttcctgagggggtatcctttaccttgttcagctaacatttcttgtttttctctgggcacagagtagagtgtcattttccccacctccctgaagttaggtatggctgtgtgatttggtttcatcaatgaaatgtgaggggaagtgacgtgagtccttccggacagaagccttaagggtgagcatgggattcaccatgtttcctttttcctgcctccactgtcatggatgcacaaagatggaccctctctcaaagtaagtgctggagagaggatgacatagatcagtccccatcccacttcatagcatgagtagaaaaatagacctggggtgtgttcaaccactgagatctggggattgtttgttactgcagcaggacatagactaggctgactgtatacctcattatctgcattttggggctgatatctaatcacagtgtctccaggaagattatgttgatgtatgttttagggatggatattcatattttcctataagggctcaataggtttggaaatgtcacatgcatgtaaacttctgattaacaaatatttcttgctttccaatttcttcctatagtgcttctaattttcctgtttttcaatcttgaataaaatgtgagaagtgtttgacttctccttcgaggagattaatggtttctaaagcctggggcattgatttagtcattctcaacctccttgtttctatgacctttttttctccttctctggtcacttagtgtctgctaaggggtgaaggaatgtctgttttaactcattgcattttttttttttttgagacggagtctccctctgttgcccaggctggagtgcagtggtgtgatgttggctcactgcaacctctgcctcctgggttcaagtgattctcctgcctcagcatcccaagtagctgggactacaggtgtctgccaccactcccggctaatttttgtatttttagtagagacggggtttcaccatattggccaggctggtctcgaactcctgaccttgtgatccgcccgccttggcctcccaaagtgctgggattacaggcgtaagccaccacacctggcaaactctttgcatttttaactcttgacatcttcatcttctttttcccacctcccctttgcctgttcctcccctgctcaccccaccagggagtttataatcaggttctagaacctgcaatgtttttctgttgttgtcttccatcttccttgagtcttatgggaatcggccatagtcgcaaattaacaaatagctctgaagcgcctcaagcttggaggcatttccttttgctcacctaagcaagatcctggagctgttgcaaatatcctgccccctactgtaaatctgtcttcatggttgtaagagattcagtcggggtcagtgaagacccgagcaggagatcttggccgaggctccttgatgttctgtctgcgctgggtgttgtcatattgattaagctcctgggactgctgccagcagcctctaggattaaatcaatagagtttgcaaaagtaaaagcttcttttggagacacagaatatgtgggtttattttttaatgataaagcttcaaggagaatcttcatggatggcagaaccagtgatggaaaaggcgaggcagacccaaatatttggggaagtgcagtggggagcaagtgagggaggtttcattgggaggccggggctttccagaaaatctgtttaactggagttgctaatgcaacagctcagagttagaagtgaaggtggaagatgcaagaaggactgccgctgagatgtaaagagaaatgaaggagaggtggatccatttgctcattcaataaacattttgggaggcaggggggtgggggggagcctgccatgtgcctggaactgggatgtacatggtggggacatgacagtgggcaggacagatgtggttcctcctggccctcctggaacttgtaacaggaaaagaaggcataaaataaggaataggcaaatacagacataattactaattgtggtaagtgtttgggagaaaaccagcagggtcctgtgtttgtttcctagggctgccaggacaaattgccatgaactatatggcttaaaacaacataaatatattgtcacccagttctgaaggctggaagaccaaaatcaaggcatcagcagtgctgagctcccttggacggctctagagaagaatgcttccttgattcttccagtttctggtagttgttagcatacattggcttgattggcttgtggctgcatcactgcagtctctgcctctgtcttcacatggccttctccttcatgtcagtgtcttctcttcctcttctctctctctcttttttttttttttgtcagggcctcactctgtcaccctgtacaagagtacagcagtgcaattatagctcactgcaactgctgcttcccagcatcaaacaatcctcccacctcagcctcctgagcagctgggacttacaggcgtgcaccaccatactcagctaatttttaaatttttgatagagatgggatctcactatattgcccagactggtcttgaacttctgggctcaagtgatcctccctcctcagcctcccgaagtgctgggattacaggtgtgagccactgcacctggcctcttctgtctcttataaggatctttgtcgatggattttgagcccgtcagataatccaggacaatctcatcttgagatctctaatttaattatacttgcagaggccgttttactaaataaggtcatggccagaggctccagaggctaaagcatgggtatgattgcaccactgcactttaggctgggtgacagagcaaggccccatctctgaaaaataaaataaaataagtaacctactacaggccctttgcgtagaggataattagaagtacaggggtaccacgtaagtgaagacctgaaggttgttaagcacagagcagagtgtgaacagaatgagacagagggaggaagagaatcccaggcagagggaacagcatgtgcaaaggccctggggaaggaacaagttcatcatgttaaaaatgagccagtgtagctagagtctgatgagcaaagggactcacaggtgggaagacacccaagaagttggcagagacaggtcacacaagaccttctaggtcaagttccggaggtgaactttattctacatgcaatgagaagtcctcagagaagcttaagtgggatgggacagaactgctttactttaaatatatatacatatatacaaacatataatattacatatataaagcatatatatgtatacatatatacatatctatctacctgtctatatattttttagctgggcatggtggctcacacctgtgatcctagcactttgggaggctgaggtgggaggatcacttgagcccaggagttcaagaccagcctgggcaacatagggagaccccatcactacaaataaaaataaaaattaaaaattagctgggtgtgatagtgtgcacctgtagtcccagctacccgggaggctgaggtaggaggattgctggagccccaaaggttgaggctccagtaagccgtgattgtgcccctgcactctagcttgagcaacagagtgagatcctgtctcaataaaataatttttgtattgaggtgaaattcatgcaacataagttaaccattttaaaatgagcaattcagtggcattcagcgcattcacaatattgtacaacctccacctctttctagtgctgaaatattttcatcaccacccctccagaaaaccctgtatccatgaggcagttgctcctcatcctcccctcccggtatccccccaacccccaccactcctggtaactacaaatttgttttctgtttctatggatttacctatactggctctttcatataaatgaattcaggcactgtgtgacctttcgtgtctggcttctttcacttagcataatgccctggcttctctctggagaatgaaatggatagaccactttggagtctactgagattatagatatttctgtgggaagggacagtggcttgaccttgggtggtgctgaagaggcaatgctgagcaggaggattcaaagtctaatttcggaagtagaattggtggggtctgatgatacatcagctgtagggggaggaagatgtaggaactgggaaggtctcttagggtaaccttacctgattgagctccttactaggcagctggtggtacaattcataacaaaggttaatagagaaagagacatgggattagggagggaatggaagagtttgggccttggacactgtagtggtttgaatcctgtccaccaaaaattcagatgcatttggaacttcagaacctgagacctcatttgaaagtaggatctttgcagatgtcattgagtcagggattgagatgaggtcatcctggattacagtggactcgagattccatggtaagtgcttttatatgagaaggtacaggggagaaagtcatgtggcaatagaagcagagaatggagtgctgcagccacaagccaaaagacatgtagaggcaccaaaagcgggaagaggcaaggaaggatcctcccctagagcctttgaagggaaaccccctaatttcagaaccttgcctccaggatgacgagagaataaatttctgttgttttaagccacccaatctgtggcaatttgtcatgactgccctaggagactaatatagacactcctatgagatgctctaagaagacacagagtggtatagctattgctaagaccacacactgtagcagggaggaaatcaaatggagaaatgccccaactccccctcctctctgatctcttgctggtgcctcccgttggccaagccaacccagaaggcagaagatgtggtggagggcagcgttgcagggcttggatgatgcagtcacagaagtcagccctgcctctaccaggatgccaaacagggcaatgagtggatattttagggagaaagggcaacaagagaatggcaaaatacatcgaaatgcatgcaagctctagaaagaggatagagatagataaagggtgattacctaggattaagccccagggaagaccaacatttagagattggatagaaaaagaggagcaaaaagggaagattgagaagtagagaccaggaggataggaggaaaactagaacaacattaagaagggcatggtcaagtaatctgggcacagaaaaatggccctgggatttggcagcctgggggtctttggtgatcctctttggaagagttttggttgagtgatgggggctagaaaccagcctggggagggtaggagaagaatgtgcagtgaggaagtggcaggaacacgtgaaggcaactcttcatgaaggggagtagagaaattggttggtggctgaaggaaaattttcagtcaagggtggaggttttaatgatggaagaatattgatttctgtaaattgggtcattcccatccattataccaatatgcacgggtgtcttctctgatataggatgctgggattctcaaatgcccatttgagtttagcatcatgaatttaatgtcaccagcccagatagttgatctcattcaggaatgctccactgcccaggtatggggaaggcaactagttgagttcatgcagggatggattttttccaggagagaaacaggaggcaagaaagtgcgatataatcaacctatgtaaggttgacaaggcaggagagggtcctgagaaatggcggggtcagtgggttgcagggctcgatgggatggacgttggtttgcatttaagggagttagtgagctgggaggtggttaaagaggaggtggttcagccgggcgcggtggcccacacctgtaatcgcagcactttggggagccgaggcgggcggatcacaaggtcaggcgatcgagaccatcctggctaacacggtgaaaccctgtctctactaaaaatacaaaaaaaaaaaaaaaaattagccaggcgtggtggcgggcgcctgtagtcccagctactcaggagcctgaggcaggagaatggcgtgaacccgggaggcggagctgctgtactccagcctgggcgacagggcgagactccgtctcaaaaaaaaaaaaaaaaaaaaaaaaaaaagaggtggttcaagacaaggatgctggaaacaggtgttttggaggtggctggtgtagcttctgagcatgcatagctggagtggcttggaggagacattggttattgatgaagaggtagggacatcctccagtgatcaaggaagcaggggaccagcatggacaatggtctctccacagggaaattggaggtcatcaaatgttaacaggttccgtcggagtcttagctcccagcttctgttttcctgtggatctcaggatcttggctgctggtgctacctctgactttggacttcccattgagcccagcagcactgggagggaccttcatggcattggctggtttaaggaagacttccttggctttgctgactttcttgggggccttcttggctacacctgcttttgagggagccctcctcacctcacctgacttcttgggggcaccttttccaccttatctgagttgggaaggtctttctttgattctcttgctttcttggggcccttctcactggtttttctgggggccatgatggtggacatattccagagctgagctttccttttgttcttaggaactaatttgaggctgccagtggccccaccttggtcttagagttgatggtctgcagggaatttccaggttaaaggttttttatttgtttgtttaattttgagacagagtcttgctctgtcacccaggttggagtgcagcggcacgatcttggctcactgcagcctccgcctcctgggttcaaacagttttcctgcctcagcctcctaagtagctgggattacaagcacgcaccaccatgcccagctaacttttgtatttttagtggagacagggtttcaccatgttgaccaagctggtctcaaactcctgatctgaagtgatccggccaccttggcctcccaaagtgctgggattacaggtgtgagccactgcgcctgacctccaggtttaagtttaaaccatgaagtagatggactgtgtagagagagaccagggaaatggaggattttactgaccactgaacagggatgtcactattgccagagaggaaaaggattcccccttggtagagtgaacatataagggaaagtggttgaaaattgaatcaggagacagagacctcacaccactcagaggtccctagagaactttactgacctagaaaaaaagataaacagggagaaggtcttcagttcttgtttggaatctgacactgaagcatcctcactcctcactctcttcccgaccccgagagtctgaaattgattaatactttttgtttaaaacttggcttgttgttttgttttttctttctgttttcatcaagggatctttattttacttttgtgtatttgtgtgttttccatgagtcatgttaattcttccatgtttaaactttttggcccagaggaatttatacatttaaattatggatttaatttcagaaggtacatacacacacacacacacacactcactcatctcactttttaaaaactgtaaaatatagccctgtaaatatccagaaaatatctaatgtgggccgggtatggtggctcatgcctgtaatctcagcactttgggaggccgaggtgggtggatcacctgaggtcaggagttcgagactagcctggccaacgtggtgaaaccctatcctcactaaaaataaaaaaattagctgggcatggtggcaggtgcctgtaatcccagctactcgggaggatgagacaggagaatcacttgaacccaggaggcagaggctgcagtgagccgagatcaccccactgcgccccagcctgggcgacagactgagactctgtctcacaaaaaaaaaaaaagaaaagaaaaagtcagtgtgcatcccctctgacatccagcaacttcacatcttggaatttatgctgcaggaaaattatcacaagtgcacaaggatgtatggtgagatagttattattatcattttaaaagatagggtctcactgtgtcacccaggctggagtgcagtgaagtgatcacagctcactgcagccttgaccttctgggctcgagtgatcctcgtgcctcagcctccccagtagctgggattacaggtgtgagccaccatgcctggcatccccctttttttaaaaaaaggttttaattatgaaaagaatatgggcttgttgttttgtgtggttttttaaaagcttaaaaaatgtgtagtgtgtcatttagaaggtgaaaagcccttaccccatcccacctcccagagataacctctgctagcaatttcgtgtttgtctttcaaattttttcccacacacattctttgtactggctgcttcccctcctgggttactcttctcccagacagaaacagggctcattcccttgcctcctccagcttttattaaaacattaacttccctgtagctggatgcagtggctcacgcctgtaatcccagtgttttgggaggtggggaggcaggaggatagcttgagcccaggagtttgagactagcctgggcaacatagcgagacccatctctacaaataaataaataaataaataaataaataaataaataatggaaatttaaaagagagagggaaggactcttgaaaaccgtccatatcatgcttctctaaatggttgagggctcagaggaaaaaaaatcagcaatttcacatcacggaatttattctgcagaaaaattctcacaagtgcacaaggatgcgtggtcagatgatgatgatgatgattattattattattattgaagaaagtagcagcagcagcagcagtattttaaaagacagagtctcggatgggcatggtggctcacgcctgtaatcccagcactttgggaggttgaggtgggcagatcacttgaggtcaggagttcgagaccagtctggccaacatggtgaaaccccaactctactaaaaatgcaaaaattagccaggtatggtggtgggtgcctgcagtcccagctaccagggaggctgaggcacgagaatagcttgaacccaggaaatggaggctgcagtgagccaagatcgtgccactgcactccatgcactccagcctgggtgctgacccaggttaggtgcaagactccgtcttaaaaaaaaagaaaaggaaaaaaaaaaaaaaaggacagagcctcactgtgtcgcccagggtaaagtgcaatgagtaaaggcccatgatgggaaccctgaggagagagtcaaggggaaagaaaaaaaaaaaagcaaaaccaaaatggaatttaaaaaaaatcaggtgcaatttgcataacagaaaattaaccattttaaagtgaacggctctgtggcatttactgcactccaactgttatgtaactaccacctctgtctagctccagaacattttcaccacccctaaaggagaccttgtacccattaagcagtctctctccttctcccctccccaccaccttcctccagcctctggcaaccacccatctgcattctgtctctatggatttacctattctaggtagtcaacaggatgagatatcccaaaagtccatccatggatgaacagataaaccaagtgtgatatgccttcctcagatattagtctgccttaaaaaggaatgaaatactaatctttgctacaacatagatgaacctcaaaaatatgatgtggctggacacagtggcttacacctgtaatcccagaactttgggaggctgaggtgggcggatcgcttgagcccaggtgttcaagaccaccctgggtaacatagcaaaactccatctctacaaaacaatttacaaaaaactagccaggtgtggtgacatgtgcctgtagtcccagctattcaggagactgaggcgagaggatcgattgagcccaggaggccgaggctgcagtgagccatgatcataccactgcactccagcctaggcaacagagtgagaccctatctcaaaaaacaaaacaaaacaaaacaaaaaagttgatgctgagtgaaagaagccagacacaaaaggcaacatcgtgtttaattccatttacatgaaatgtccaatgaagattttttttggcaacatttattttgagtataatattcagtgagtggaccacacatatgcatgcactgcagtatgttcttggaaacatttcagatttgagaggtctgttcagctatgatgacggtaggtattgtcccttccctccctccttgaagaaaaggaactaaggctggacgcggtggctcatgcctgtaatcccagtactttgggaggctgaggtgggcagatcacttgaggtcaggagttcaagactagcctggccaacatggtgaaaccatgtctctactaaaaaatacaaaaaattagccaggtatggtgctgcacgcctgtagtcccagctactcgggaggctgaggcaggagaattgctcgcacccaggaggtggaggctgcagtcaaccgagattgcaccattgcactccagcctgggtggcagagcaagactctgtctcaaaaagaaaagagaagagaagagaaaagaaaagaaaccaaaagaaaaggaaagaaaagaaaaggaaccaagacctagaagggcaaaaataggaaaagttggccgggcgcagtggctcacgcctgtaatcccagcactttgggaggccaaggtgggcagatcacaaggtcaggagatcgagaccaccctggctaacacggtgaaaccccgtctctactaaaaatactaaaaattagccgggcgcggtggcaggcgcctgtaatcccagctactcgggaggctgaggcaggagaatggcgtgaacctgggaggcggagcttgcagtgagccgagatagcaccactgcagtctggcctgggcgaaagagcaagactcggtctctaaaaaaaaaaaaaaaaaaaaaattggaaaagttatttactattagcagcaattgtcataaagtaatgaacatttattgcatgattacaatgagataaattgtatcctgtttttataagcatattaagttttcttttttaaaaaaatgtatgtatttatttattttaagagatagggtcttgctctgttgcccagactggagtgccatggtatgatcatagctcaatgcagcctcaaattcccaggttcaagcaatcttcttgcctcagtctctcgagtagctaggactacaggcatgtgccaacatgcctggctagttttcttatttttaaatgtatttttgtagagacaggatcttgctgtgtcgcccaggctgtcctcaaactcctggcctcaagcgatcctctgccttggcctcccaaagggctgagatgataggcatctacctctgcatttggcccacattaaattttctagtcatcatgggaaccaaaataaacaatataaaacactcacattccttgagcacttactatatgcagggccctgtaatagattattgtgtgtatcagctcattccattctcacacaacctatgaggttgatgctattttctaccttttatatatgaggaaactgaggctcagagaaggaaactgccttgcccaaggtcaaggccacgtctgatccccaaatcctttcaactcctctgcactactattttttagtgcagatattgccagttttctaagcagaagcatgatttagcagccctgagtagacttctcatttcagaaccaaagtgttggacattgttggataatatgaaaaacaaatgacacacaaacctatttgatactgtttttaattttctcttcatttgattttcctgatgacatgattaatcttttttgcctctaccctgtatgtgaaatgtaggtctttgcagatgtctcagagagtgttaatagttgctgctggttttgttttctctccccggggattcccatccctgggtgcaagtgaaattaaacttgtgcctctttgccgctggccgtggtgctgaaaacatcccgggcagcgctagggttgcccttgttagcatgccatccctgctaagagtcttaggctgatcagcgagtggagagatcttttccaggcttcattttggttagaactgtgtgttgaagattttaaagcccatgtctgggaactggagactgtttggattgtttgaagttgaaatagtcatgaataattcctacttgagatgggcttatgagggcgtggactagcatgcaatggttggcctttactaaactgtggccattggttgggacttgggtgaggtgtaacccatttggtctaatccatatggttagggccccaagtgcacctgcattctatttttttttttttttaaataaaggcaaacccatctatcttctaaccaggatagctcctgagtggtctttggggaccaccagcttaaaagcatagactgtgggctgggcacagtggctcatacctgtaatcccagcactttgaaaggccaaggtgagaggatcgcttgagcccaggagttcaagaccagcctaggcaacatggtgagaccctcatctctacaaaaatgttaaaagttagccaggtgtgttggcatgcacctatagtcccagctactcaggaggctgaagtgggtggatcgcttgagcctgggaggtcaaggctacagtgagctgtgatcgtgccactgtatttcaccctgggcaacagagcaagaccctaactcaaacaaacaaacaaaaaaaggcatagactgtggagttgggcagacctgggtgtgagccccagctctgccagtacctcctatgtgaccttgaaaatttgtttaatctctctgagcctggattttcttgtgtggaaaatgaggcttaccacagaacccaccttgtagaaatgttgcaaggaattaactgaaacaaagtgcttaccacggtatctgcccaaagaagcagttggaaacaaggcagctgtaattatggtcgctgtgcttgttaatggccccataatagttgatcatattgcagagtgaaattggggtatgtgtttaatggaccaaggaatatgtcttaaacccatatatctagggttctggtaccctctactctttttcctggtgattgtgatgagcatggaacttacatgaaaatgaggtctgtttggcttcttcacacaagctcaatgacctggctaactgctacaagtatctgtttccttagaacccacccatcagcagtccccatagtggagacaaggtcacaaagagttgacaaacctgatttgatttccgcaccaaccacaggaggcttgaaatgagatgagggtgaagggcaccacagagggatgcaaggattacttggacactgcaaggtcttgctaagggatgggaaccatcagccacgcccactttgagaattttccttcatgttctgaatctgaagagcaaggtcctgttctcagatgcaagccctccttcttccctacgcagagtcaaacttggtcttttccagggtcacatacagcctctctctggggcctctgcaggtcctgatcaatttcattgtgtatagagctctgtgtctcctcacctgcctgcagggctgtctgctatcctgacttccgagagccatttcggaagccagcttttcctcccatcagggatgcttctcttctttcagcccccgccccgctttggcctcctaggatggctgatttttctggatcccgctgacacaggtgctttctctccgagccaatcagggagcagaaaggctcagctcagctaacagaggcattgctcaccgcagctgtgagttagaactcaggctttctaaatcgggaggatcaggcatgacttgaggttgggctgagaaagcctcgcctgccccccagctcgactacccagtgaaacctttggcttctgcctcgggcgaggcatctcttaccatgccaagaactcagcagcccatctttctttcatctgggcaccaagtacatcattgcatatttcagggggtttcattgtgtccttaacatgctcatggagacttggcttgagatgaagtcggggtttctaggcagcaggacccatgtccccttccttcatttcctccaccggtgatttttgttttgttttgttttgttttgttttgttttgttttgtttttgagacggagtctcgttctgttgtccaggctggagtgcagtggcgttatctcggctcactgcaaactctgcttcccgggttcaggtgattctcctgcctcagcctcccaagtagctgagattacaggcgtctgccactatgcccagctaatttttgtatttttagtagagacggggtttcaccatgttggccaggctggtctcgaactcctgacctctggtgatccacccgcctcggcctcccaaagtgctgggattacaggtgtgagccaccgcaccaggcccttccactggtgttttttgagcatctactatatagagaatgctctcctgggcacagaggatgaagcagtgaacaaagtagacaaaaaatccccacgtgcatagagtgtgcagtctcgtgggagagacagggaacaagataaagaaggaaaaaaatagcagatgcttgactggggacggggactaaagaaagaaaaaaataagcaggctaagggggttgatggatgtgacctttgagtaaaggcctaaaggaagtgagggagggagtcatgtggatgtctggggaaagactattccaggagaatgaacagcaggtacaaaggcccctgggtacaaatgtgcctggggagtttggggaataaaagggaggccggcgttgctgtagctgagtgactaagggagagaatagaggagatgaggggagggaggtaatgggagcaggtcatgcaccttgctggtgctggaaggactttgtttttgcttttgagtgagatgggatccatgggaaggctttgaatacttccacatgcattaggctgaaattttcttttctgcttttgtcgcattccaacattgcttttatttcatcaaaatcttcggtttcttctcaggctctttacccaagtgggagcagaaggctggtacccagggctgttcagttctccccctggggtcagaacgtggaggagaaagcttggaggagaaacaggaacccccacctctttctggatgactcaaaaccgcaattacctgagctcctcctcctatccctgaaatagaggcacttagcacttcctaaacttcccggtgcacacaaatcccctggcgatctttttaaatgcaggttctgactcagcaggtggatgcaaggtctaaggctgcattcctaaccggtgctggttctgggaccacactttgagtagcaagggtctgaggtcattgttgcagatgtccatctggggcatgtctgtggacacttgcgggggtgcgggtgagcagagggaggggggatgatgttggaaaagcagtgtgagtatctgtgtttgataagaagtaagaaaatgaagcaaggtgggagagtagaacctctttatttttgcctacgtgctaaggttttattgccatacccagagagccctgggtctgaaatccaggcaacactggccagttgaaaccctgatattgcagcccataaaagtgctgcatgctgcatggtggacttctgggactcttcctggaaccttcagtgccagagccggtccaaaggaagtcacatccctgccattgaggggcaggagaccagggaaccggaggagtgggatggcagaagcgcgtgtaaggaggctgagttggcagggagagaaagcgaagtcagcttcaaatcatagcgagaggagaccagggaagggcttggcgttgctgctctgtgtacaaatattgtctcttattttccaggctgcagggtgaggcagagtggagtatttgtgcaacacagcccagctttgttctctgggctcctaatgcctgtcagctcagaggcagaaagccaatcagagatgatcgtcggcaaggccggcttttgttggctccccaaattgccctgagtctcggattttgcttttcagagtgtgctttcagctggaggcaaaggctgaagctggtgacaaaaggaagcctggttttcctggctttccgagacttttactgagggggtttctatttcagactccgttttcccacctggaaagcaggttccactctccctccggcctggaagggatggttttatggtgcttccaaaatgccaaacctaactccagggcagaagaggagactgaaaccaattaattttccaaaggttagagctacgaggaggggagaggtttagcatggtcaagttccccaagacatactaattgatctctctacagaatgcgggatttcagtgcccccaggggacactcagcaatgtttagagaccacttgaggttgtcatcactggacaggaggggctgctactggcatctagcacacacaggccagggatactgttgaacatgctgcagtgcccagacagccccaccaaggagaatgatccacccctaaacctagtgctgaggttgggaaatcctgctccggagtaaccaacaccctatggctttttcactcaagcagccgcttctccagcgcttacacctcctcagagattgccagatccatatgcagagcctgttggcgtgggacacttctgaggggtgtggcagggagacagcggacattcccatttaccagctgatcagcaggttaggagctaatatgaaatgaacaagatagaccctccccacctgccctgcagatcctctggtgggacactagggagggaggcctcctaaacccaaatgacagttcccaggatgcagggaggagtttacctatgcaaactggagagaatgcaaatggggcatctagagatacttactggacgacccctcccctgcctcgggtcttggaagaacagattctcagaggtctgccctgatcactgtaattttttttttattgaggtaaaattaatataacacaattaaccattttaaagtgacatttagggctgggcacagtggctcatgcctgtaatccccgcactttgggaggctgaggaagaaaggtcgcccaggagttcaagaccaccctgggcaacaaagtaagactctgtctcttacaaaaaaaaaattaggcacacatggtgttgtgcacctgtagtcccagctactcaggaggctgaggcaggaggatcgtttgagcctaggaattcaaggctgcggtgagctatgatcatgccactgcactccagcctgggtgacagagcaaaattgtgtttctttaaaaaaataaaagtaaaaataaataagaaaagaaaggagaggggaggggagaggcgtttagtacactcacaatgttgtgtaactgtcaccttcatctagttctaaaacattaagcagccactcccatttcccttgccattccccaggaacaacaaatctgctgtctgtctctggatttgcctgttcgggatatttcatatacatggaatcatacaatatggggtattttatgtctgcttctttcgcttggcataatgttttcaaggttcattcctgttctatcatgtatcagtacttcattccttttttttttttttttttgaaacggagttttgcttttgttgcccaggctggagtgcaatggcacaatcttggctcactgcaacctccgcctcccgggttcaagcaatcctcctgcctcagcctcctgagtagctgggattacaggcatgcgccaccacacccagctaattttgtactttttttagtagagatggggtttctccatgttggtcatgctggtcttgaactcccaacctcaggtgatctgcctgcctcggccttccaaagtgctgggattacaggcgtgagccactgcacccggcctacttcattcctttttatggctgaatactattccattctatgagtagaccacattttgtttatccattcacccactggtgaaatttaggttgtttccatcttttggctgttgtgaatagtgctgctgtgaatatttgtgtatgagtgttcgttggaatacctgtcttacgatccttttgtgtttataccttggagtggagttactgtgtgtcacatggtaactctgtgattaactttttgaggaaccaaggaatggttttctatggcagttgcactggtgtttttttgttgttgttgtttttgttgttgttgttttgagacagggtctcactcccattgcccaggctggagtgcagtggtgcagtcatggttcactgcagcctcaacctcctggggctcaagcaatcctctctcctcagcctcccaagtagctggcactacaggcctgcgccactatgcccggctaatttttcatattttttgtagagatagagtctcagtttgttgcctaggctggtctcggactcctgtgctcaagtaatcctcctacctcggcctcccaaagtgctgggattacaggcatgagccaccgcatctggccagctacaccattttatattcccaccagcatgagggtttcaatttcttcacatcttcaccaacacttgttttctgtttgtttgtttgtttttaatagctatcctagtggatgtgaagcagtatcccgttggggtttgatttgcacttccctgatcactaataccctcatgtacatattggccatttgactgtcttctttggagaaatgtctattccagcctcctgtccatttttcaattggattatctttttgttgttgtgttgtaaatgttctctctttattttttatttttttgagacagagtctcgctctgtcgcccaggctggagtgcagtggcacgatcttggctcactgcaagctccgcctcccaggttcacgccattctcctgcctcagcctcccgagtagctgggactacagatgcccgctaccacgcccggctaattttttgtatttttttagtagagatagggtttcaccgtgttagccaggatggtctcgatctcctgacctcatgatccacccgccttggcctcccaaagttctgggattacaggcgtgagccaccacacctggccgtaaatgttctttatatagtactagacccttatcagatacatgatttgcaaatagcttctcctattctgttacttgccttttaactttcttgataacgtcctttgatgcacaaaaggtttaaattttgataaagcccagcatatctgttttttcttctgtggatcatgcattaggtgtcaaatctgatcataatgttttatttatttatttacttatttatttattattttatttatttttgagatggagtcttgctctgttgcccaggctagagtgcagtggcatgatctcggctcactgcaacctccacctcccaggttcaagcgattctcctgccccggcctcccaagtagctgggactacaggtgtgtaccaccacgcctggctaatttttgtatttttagtagagacagggtttcaccatgttggccaggctggtctcaaagtcctgaccgcaagtgatccacccaccgcagcctctatctatttttaatttatctctttttttttttttttttttgagacagggcctccttctgtcacccaggctggagtgcagtggtatagtcattgtacactgcagcctctacctcctcggctcaagcaattctctcgcctcagcctcccaagtacctgggaccacaggtgcctgccatcatgctggccctgccaccatatttgaaattgcagccctgaccccttccactgtctatagtcttcaccatcttactacataacatagcatatatgatgtactgtataacatggtatatgcagtgtactgtatagcatagtatacatgatgtagtcatctcatttatttgcttctcctctgggaagcaggaggaagcttctcctcttgtctgctttgctctcaactgtgtccctagcccagaacagagtctggcacacagcaggtactgaatgaatatgtgttcagtgaatattgtgggtgagatagaaggtgaatatccacatttccctttagaagtcacctgatctgggtttgagatctgcagggatctactccagacaggagaacgaataattccacctgtgctgatgagttggaaggatctagagggcttgagatctttccactggggtcagtgggggtgggtgcacctccaacacccttcttttctttgaacaagatttttccttaattccccaatactccctttgaatatatgattttagccaccatcatagcgaattgcatcgtcctcgcactggagcagcatctgcctgatgatgacaagaccccgatgtctgaacggctggtgagtgatgtcttttctcagggtcttctccttggctttagcaggacattaatttttgggggagtggagcagggcacagaggaggctctcagtcctggagcccagagccagatcatgggaagcctaaatttccttttcattttttcttgaaccagagtctcgctctgtcacccaggctggagtgcagtggttcagtcatagctcactgcagcctccacctcctgggctcaagccatcctcccactgcagcctcctgagtagcagggactacaggtgccaccatgcccagttaattttcttatttttatctttttttgtagagatggggatctcactaggttgcttaggctggtctcaaactgcccactttggcatctgacataatttcaggcagtatactcaaatgaacattgttaatgttaataattatgtcttggccagacactgtagctcatgcctgtaatcccagcagtttgggaggccaaggcaggtagatcacttgaggtcaagagttcgagaccatcctgaccaacatggtgaaagcccgtctctactaaaaaaatacaaaattagctggatatggtggtgcacacctgtaatcccagctacttgggaggctgaggcaggagaatcgcttgaacccgggaggcagaggttgcagtaagccaagatcgcaccattgcactccagtctgggcaacaggagtgaaactccatcttggtgggggggaggcgaaaaaaaagaaacaagaatattacaaaggatacagatgaagagatgcaaagggtgagatataggagaagggtgtggctggcagcttctaggtagcttcaggagggggactggtcaccagaaagaccaaggcatgattcgagggttgcgactttcagccccaccccccaacctctgggagggcagaggggctgaaaatcaagttgatcaccaacggtcaatgatttaaatccaaacctctaatcatgccttggttttcccggtgaccaacccccatcctgaagctacctagaagctgccagccatcagtcaatccttagcctgcaaaaagacatccctttggagatcccaagggttttaggagctgtacaccaggaaacagtgtcaaagaccaaacatacatttcacaatgtcacagtcttctaaaaactataactagcctagcaaacctatgatttctagatctttgcattttcacttaaaataaagctaaataaaaagcgtccattgaaagactggtaagcaagtagaagtaccagtggcaagctaatgtggaaaaaaaaaatcattcaggcagagtgaaaatgattgtagctcgagaaacgttgctgtaacagatgggaaaacattcacattggggctctgatggagaagagcttgtagcttaatttcaaatatgatagattagcagctggaagccagaaccagccggaggttctgcagaggaactggaggtgaggatactggccacttatcagccagtacagaagtcctattccaaacctttaacaatctacatgccagctgagaaccatcctaaggggtcagatttaggagtgaggtcaatgcacaagctctagcctcaaataccttgaacgctgcatgtgacaagtaaattctctaaaccaatgctttccattagaactttctgcagtcacagaaatgatctccatctgccctgtccaataggattgtcacttgaaatgtagccagtgtgactgcagaactgtgttttttattttattgcatttaaattaattttaattgaaatagccacatgtggcctgtgactgtcgtattgaataagacaggtgcaaacaaataattctgtttagctgagtgatatgtgaggttggcccaaaaggaatgaaggaggaaggtgccttctctaggcattggctttgctcgcaaaaggctttggacaagagaactctgcaagaggcagtgaggggtggtgagtgcaggagggtcaggggaagtgagagggtgataggtactgatttctaggtgggctggttccctgatcttgtcaacatctgcccagcccaagacgctgaccttgccttctctcccttccaggatgacacagaaccatacttcattggaattttttgtttcgaggctggaattaaaatcattgcccttgggtttgccttccacaaaggctcctacttgaggaatggctggaatgtcatggactttgtggtggtgctaacggggtaagtggcgcgtgctatacgctttggatttaactagctgaaggattacgaggcttttggttggtgtggtccgggccaggctcaggaaggctgagcccttgtgttctccctccccttgttatgcgcctgcctcctttctgccaacaccccacctccatgtctcagctgtatattacagcagatgctttctgttacaattaaaataatagctcattattgttggctgcttccagagtgctttatgcccattctctaatttaatccttgcaacaacccactgaattaggaaatattaatattcccatctgaccactgaggaatcagaaactcagagtgtaacttgcttaaggccacccagcaagtaagtgatggaactgggagatgaacagaagattatgcattccagaactcaaggttttaagtgttgtacgtgcatgggtctcttgatttgcttgaggatatcttgcttttatttcaacttggtgaatgttttttgagaatgtctgggtgcaagggattgtgattatgacaaaggagaaaagcaagctaaataaggtacagttactgtcttcaaggagttttcagatccatatatgatgaactgtggttgaaatgtgtatatgctttcctctaagcaccctgtatgaggtagcacttgctggtataacaaaagatccaaagctaggaaatgacttaaacacggcagaagtttatttgtcactcatagaaaattcaaaattgagctgggtgtggtggtgcatgcctgtaatctcagcactttgggaggctgaggtgggaggatcacttgagctcaggagttcaagaccagcttgggcaacacagtgagaccacccccccatctgtaaaacataaaataaaataaaaattaaccaggcatggtggtacatgcctgggagaattgcttgagctcaggagttggagggcacagtgagctatgatcatccaaccgtgctccagcctgggcaacagagcaagaccccatctcgaaaaaaaaaagtccaaaataattgttcctagttgacaggctcatctcctccaatgactgacggaccctgacccttgccatattgtggctcttcattgtcagcccacatcatccaataactccatgcttgtctgtatcaaaccaggaaggagaagtgagcatagaaggtgatacttggaaaggtttatgagtttggaaggggtgtgacccatacctgttccattcatatcctattggctagaactcggtcacatgaccacacatcactgcaagggaagctgggaagtatcagattgtgcttagaagaaaagggaaatggatttggagaatgacctactagtctgtcagggaccttaaaaacttttattagattccagtagggacattagtatctggtaccaatggctggttcctcctcttcccactctctactctcctctcagctaagtctgggctcttctattctaagacccttcttcactggacacctttttcatagtaatcatttacaggatcatagctttccatgttttgttgctgctccaggttctgtctctcttggcggatgtgatgggttgcagcacccacactgtgctggccgggctctcacaatgcagatttgtttcagagcaatgttgcctctcacagaaggagctgtggcctattgggctgtttctgtagaggccttcagatgtcagcagtctgttgtaaggactctgggctagctctcatgggcttgggtgttcacagagggatctttgttggctgtgctcacagttcggtggcttgggaccttggtgggttccaagggcatattatggtactgggcacttttctcttagtctactaggaaactcatctagaaacagcctagtggctaacttttttattgtttaaaaaatgtaaagctgggcagggtggctcatgcctgtatcccagcacattgggaggccaaggtgggaggattgcttgggcccaggagtttgagacgagcctgagcaacatagcaagaccacatctccacaaaataaaaattaaaagtgtataaagctgggtacagtggcacatgcctgtaaccccaattactcaggaggctggagagagaggattgcttgagcctaactagtttgagaccagcttgggtaacctagcaagatcccatgcaaaactaagtagagaataatagagcaaacacctgtgtatacattcatttattcaatgactatttattgaacacttctgtgtgccaggtcctgttctaggctctgggacacagcagtaaacaaaatagaaaaatcccctgtcctcatggagctgagagtctactgatggagatggacacaattgatgaatgaatctagtgtgtcagatggcggtgaggggtacagaggaaaaataaagcaggggagggatgggatgtgtggcaggcaggggtgaggggtgctggaagccagggaagacttcactgggcatgtgacatctgaatgaaaacctaagggaggtgagtgagtgagccatgaggagagctggaacagagtgtcaggcaaagggaacagccagtgcaaaggctctgaggctggactgtatctgacatgtttgatcaacagtaagaagacccacatggctagagaaggtgaccagaagaatggggagaattggggatagagaagtaatggagtaacctgctatcaaaacacaacctttctctttttttttttttttttttttttgacaagagtctccctctgtcacccaggctggagtgcagtggtacaatctcagctcactgcagcctctgcctcccagtttcaagtgattctcctgcctcagcctcccaagtagcttggattacaggcgtgtaccacaacatctagctaatttttgtatttttagtagagacgggtttacgccatgttggccaggctggtcttgaactcctgacctcaagtgatccacctggcatggcctcccaaagtgctgggattacaggcgtaagccactgtgcccagcaaaacaaaacctttctaacctttctaatccctgttttctccctccctagacccattcctttctctcccccatccaggggcactttcctgaattttatgtttattatttgcatttatgtattcacactttggctgcctaagtatataagaaatatatgctacctatttttacacttcaaaatattttttaaatagcatcagagtgagaatagtttacactttgactacatgcatagataagaaatatgtgggctgggaatggtggctcacacctgtaatcctagcaattttggaggcaaagatggaaggattactttaggccagaagtttgagaccagcctggccaatgtagtgaaaccctgtctctacaaaatgaaataaaatgtaataaaatattcagctgggcatggtggtgtgctcctgtggtcccagctactcaggaggccaaggcgggaggatcacttaagcccataaggtcgacgctgtagtgagctatgactgcactccagcttgggcaacagagcaagaccctgtccctaaaaaatgttttttgttgttgttgttgttttttgtttttttgtttttttaataaaggccaggtgtgatggctcacacttgtaagcctagcactttgagaggccagggcaggaagactgcttgagtccaggagtttaagaccagcctgggcaacatggtgaaaccccatctataaaaaaaatgcaaaaaattagccaggcatgatgacgcacgcctgtagtcccagctactcaggaggctgaggtgggaggatcacgtgagcccaggaggtcgaggctgcagtgatccgtgattgcaccactgcactccaggctgggcaacaaagtaagaccttgtctcaaaaaaataaaataaaataaaaaataaaaaaaagaaaagagaaagaaaaaaagagatatgtggtactgtttttcaaacttcacatttctctaacctgacttttgtgttcaacatgagataaatctgattaataaaaatagtttccatgcatccattttcatgactgcatagtattctgtggtaggagtatgctgccgtgtatttatctatttggattgtttccagctttgggctattttgacccaaagtgtccctgctttctcccaagtgagtttctctagggcacgtacccaggagtggaactgctgagttgtatactgtgtgcatcctcagccccactaggtattgccaaattgctctgcaaagtggttgtgccaattcatgctccctgggggctggcttctgctggctgaggctggcttgaccttgctggcaggaaggagccttaaaaatccctgtgtggttttttttgttttacttttattttaagtttaggggtacaagtgcagatctattacatgggtaaacttgtgtcttgggggtttgttgtacaggttatttcatcacccacgtattaagcctagtacccattagttatttttcttgatcatcttcctcctcccgccctccaccctccaaaaggccccagtgcgtgttgttcacctctgtatgtccatgtgttatcatcatttagcccccacttagaacacgcagtatttggttttctgtttctgcattagtttgctaaggataatggcctccagctccgtccgtgttcctgcaaaggacatgatcttgttctttttcttggctgcatagtattccatggtgtatatgtaccacattttctttatccagtctatcattgatgggcttttgcagccctgtttttttttttttttcataataacacggttatgggaacacttagggaagctcatatattattgagcagtgtgatggttaatattgagcatcaacttgatcagcttgaaggatgcaaagtcttgttcctgggtgtgtctgtgagggtgttgccaaaggagattaacatttgagccggtgaactaggagaggcagactcacccccaatctgtgtgggcaccatctaatcagctgccagtgtggccagaataaaagcaggcagaagaagttggaaagagtagacttgctgagtcttctggccttcatctttgtcctgtgctgaatgcttcctgccctctaaaatcagattccaagttcttcagcttttggactcatggacttacaccaatggttagccaggagctctcaggcctttggccacagactgaaggctgcactgtcagcttccctacttttgaggtttgaggactctgacggatccaccactggcttccttgctcttcatccttcagatgggctatcgtgggactttaccttgtgattgtgtgagtcaattctccttataaactccctttcatatatacatctatcctgttagttttgtccctctgaagaaccttgactaatacagacacctagtgggtcccaataagtgatcattaaactgaaggcagtcattcagtaggtcagtttgtcacttgtgtttgtatctccctgcttacaacaaggtggcctttcttctagtttcctgtcatctgatggaagagattctagactcattcctctagaggagaaatacttcatctagaacagataggtcctaagggtgagagctcatcgttgggatgaatgaacccactgaaattttatgcaagaagaaaattgtgtatatgtatatttttttttctggtctgtagtttttattagattctcagggaatcctgatcctatcatgaagaccttctattctagattgggttcctttcacatccccttctcctttcttgttgaattctccatgcatttctttcacttgcttttcttgctcttatttctctggtagtcagttatcctttttgtctggtggttctatctccttcaaatgaggcacattgctcaaattttattactccaaattccaaggtgctgtttagtgtcctgttgggttgtaagctaggaacagggaggggaaagtaaaacattctgcatgagctgggtgcagcgggcaagcacctggaattccagctactggaagctgaggtgggaggattccctgagcccaagggtttaaggccagcctgggcaacaaagtgagattttgtcttaaaaaaaaaaaaaatcccagctgggctctgtggctcatacctgtaatcccagcactttgggaggcagaggcgggcagatcgcttgaagtcaggagttccagaccagcctggccaacgtggtgaaaccccatctgtactaaaaatacaaaaaaaaaaaaaaaaaagcctggcatggtggtgtggtgtgcactggtaatcccagttatttgggaggctgaggcagcagaatcacttgaatccaggaggcagaggttgcagtgagctgagattgtgccactgcactccatcctggatgacagagtgagactctgtctcaaaaaaaaaaaaaaaaagaaagaaaaaacacgcgcgcacacacacacacatcatgcagacctagccttctgccaatgtcaatggtagagaaacacagtagacacttaattctatgtttcagagaggaggggactcaaatatattaatttgacattgagacagtgatgactttaatgagtactttctttcctttttttttttttttttttcgggacagagtgcagtggtgggattttggctcactgtagcctccacctcctgggttccagcagttctcctgcctcagcctcctgagtagctgggactacaggcatgcactgctgtgcctggctaatttttgtatttttagtagagacggggtttcacactatcagccagactggtctcgaactccggacctcaggtgatctgcccacctcggcctcccaaagtgctgggattacaggcatgagccaccgtgcccggcctaatgagtactttctgattaacctgttgccctctcagattcctgaagcaaaccacagcgttaaaacgtgattcattttgtgtggaccaccacggtgtttaccttcttcttgggtgaagtttggtggaaaagatcttaccccggacatctgtttgttctttgtaactcagagcctcagagaaatcctaactttataatgttgtcaaacccttgtaaggcatgtttttattgtatttgtgttctgatcatgaaactgaaaatgtgtaagaggaagatttcagaagcttggctgtatgtctgagatgacagttcttttactgtcattctcaaatatatataaatattgaagagatcaaataacacaaatcgtgcatgttaagaaaagagactgtgaacctcaccagagaggggtgagcacaattttttttcttttttattcacagggttagcactgtccctttcacataataaatgctcagtaaaataaatggttgttaagccggaaaagggtaacacttctgataatgagtgtcctgggaaatttactaagctgtttagaagatgggaccaacacactgatagaaatagtcagatagtccagaagtctatggcagatgccctgaacatcagatgagatataagacagagaagctctgggtctttgccagctctgacattttatgactctatgaaacggaaggttcctttttagaagggtctataaactgtctcaggctttgggccattttgttgaagatcagaggcaaggaaaagacacaactacacaggaaccatcagggaaagatgttgttttttggtcttgaagcatcattgaatttttttttttttttttgagacggagtttttctcttgttgcccaggctagagtgcaatggcatgatctcggctcactgcaacctccgcctcccaggttcaagtgattctcctgcctcagccttctgagtagctgggattacaggcatgtaccaccaagcccgggtaatttttttgtatgtttagtagagacgaggtttctccatgttggtcaggctagtctccaagtcctgccctcaggtggtccgcccacctctgtctcccaaagtgctgagattacaagcgtgagccaccgcaccgggccgcatcattggattttaaggctccatggattctggcaggtccagcccttctgttttactcacaaacaagtggtttgtccaaagtcacacagagatggtggcaagagatctagaataagaaggtgtcttcaagtcatggagccaggaaccctggctttttgggcaatggaagtggtataaatgtttaatatcacccctcaggttctgccactagagcccagctctctcttccttcctcttgccccctgactagcctatggcctctttccagagaataagaaagggatcctcagagaataatcccagttcctcgctttttattatatagttgaggaaaccaagtctcagaggggtcagtgtcttgaccatacacctctcatgtcctctctcctttttgattaattgaataaatacatgtagttgcttcttacctcctttctttcttcacccctgccccatgcacctgctcttagttgccttcacatgtaaacagcattccaacaacaacaacaaaacacaaccagcattctaactcatgagaccagcaacagttcctataaataccagcagcattttattttaatgtctctctgcagtagtttctcccctccatggatcagtcatccttggtaccaaaaggattccccactgtgacacaaatgctttttgtcattctcagtgagttataccattgagagagcatcgatctttttattgttcaaagcttttggttgtcatgatatttgctggaccatgtttcaccaggaaccacatcacttcctagcagcaggagctattttcttccatcttctaacaacaccagcagtgacagtgataataatgatgttagctgccatggtcgttattcttatcatttattgagtacttactatgtgccagggactacattaagagttttatgtgtattatcacattgagcctcgctagcctttgtacagatgaatctgaggctcagagaggttaagctgctcacaagggagtcacacagctggtaaggggtggatcaggatctcagcctctctgctaggacacttctctaaacctagaataatactgggcctgtgttaagttcagcaaagagctgtattcaacccagtgtccttaggaatgtaatgcctgttattaacaacagtggcaacattgataagctgaaacttatgaggtgcttacaatatgatatactatatattatatacatacataggcacccacctataatctcagcactttaggaggccaagtcaggaggatcacttgagcccaggagttcgagaccagcctgagcagcatagcaagatcctgtctctgtaaaaagtttattttttcagttggccaggtatgttggtacatgcctatagtcccagctaatgaggaggctgaggcaggaggattgcttgagcccaggaatttgaggctgcagtgaactatgatcacaccactgcactccagcctgggtgacagagcaagactgtctctaaaaataaaaataaaaataaaattatttcaactctcaaggttaaataaatactattattattcccatttacagatggagcaactgaggctcaaagacattaaatgcttactgtcttagtctgttttctgttgcttatagcagaacacctgaaactgagtaatttataaagaaaaagcaatttatttcttacagttatggagactggaaagtttaagatcaaggctgcatgagctataatgcacacacactattgcactccaggctgggtgacagggtgagaccccgtgtcaataaataataatataaaataaataaaacaaatttcaacatgagttttggaaggtttgaaatattcaagccagagcatctgtctcataagtggtggacccaggatttgaactaaggcagatctggatctagaacccattttcttgaatcctacgctatttctctaaggtcaagtttgccaaggaaaataaacttgagaatttgaatagagctctctgacatgggaagtcagggtgatccttccttcccctccctgatcttgggttccactatggctgggggaaaacaggagcagaagagatttcaagaaatgagagattggcctagcgccatggttaagacctggacttcagagtcagaggaagctcctccctctatgacagtgagaatgtgggttgaactcactgaacctcagttttctcacctggaaaaagggagtaaaactagtgcctagctcctagggtttgcatcacacacgaaagttggtgaactgaaggaaaaaaacttaaattcttgtgggggagcatgtgatagatgctacaaattctccatgccttatttacctagcttacgtctaagttcacctgcagcttcctcttggtacactcccatctctctacatctctgttggagggcagtctctggcatcacagagtttgctgagccagatgcttaacaacctcggtagcatccctcaaccagtgagctagggagtcagtgtataaataccctggcttccccattgctcagtgggaaaacactgaaatatgttatacagcatcatagaggtgcctcagtaaaattgaatcctagttgttcacataaaacccattcactagtgtaccctttaccaatctctctcttcctcattcctcacttgtaattccttgcattacctcccaaattaaccattggaccctagtttttgccttggggtctactcggcgctaactcaaggagcggaagttggaagcttagcgggttacaggtttcagcaccctggacagctcccagcacaccgtattgtgctaaaatgttctcttccctccctctgcctccagctggggtggagagggactgagtaaaggccagatggccaggtgaccttgttccatactgagcttcttggccattttccctgtggggctggagaagaccttgccatccatctctccgcaggtttgggggccgactgaggtcttgttttctcgaattgctatgacaaatgccagcctgcctccaaggggcatctgtcccactgcctctacagtttgcatgcctaatgactcctctcctctcaccagggcagggaggtggctgcctggtgggccgcttgaagccgggagaccaagatcatgccactggactcgcaacaaaccgagactcttttttttttttttttttcctcgagacagggtcttgctctgttgcccaggctggagtgcagtggcgcgatcttggctcactgcagcctccgcctcccaggttcaagcactcccacctcagcctcccaagtagctgggattacaggcgcacaccaccatgcctggctaatttttgcatttttagtagagagggggtttcaccatgttggccaggctgatctcgaacttctcccctcaggtgatccactcgccttggcctctcaaagtgctgggattgcagctgtgagccaccatgcctggccaacagaataggactctgtctcaaaaaataattttttttaaacattgctttgcaacccagctgcttcttgtgcaggcatctctaaatgaggacagccagtctacatagacacgtaaggaagcatagtggttaagacctggtctttggggttagagtggattcccaacctgactccactgtttccaagctgtgtgaccttgggcaagttactgtacctccctgaatcttccatttcttcatctggaaaatgagagtagtagcatcccctgacttggtggggcatggtggctgatgcttgtaatccaaacactttgggaagccaaggtgggtgaatcgcttaaacttgggagttcaaggccattctgggcaacatggtgaaactccatctctacaaaaacaaaacaaagcaaaaattatctgggtgtgatagtgtgtgcctgtaattccagctactcaggaggctgaggtgggagaatcacttgagcccaggaggtcaagtctgcagtgagccgtgcttgcaccactgcagtccaacagagcgagaccttgtctcaaacaaacaaaacaaaacacaaaacaacaacaaaatactaccaccttatggagttgttttcaaggttcaatgagttaatgtctgacccatgctgggctgggtttatggatgttacttgcccagggacagtctgaagaaagagaaagtgatatagtccattgggcctcagcttcctcatctgtggaatgggaataataattgcacctacctcaaaaggtaaaagtcagtgagatacatataaggcattcagaacaaaaactggcacagaataagtgctcaattatattagctattgtaagactaataactatcattataatgatgataataattattactacttccccaggcccagttccatagaccagttagttaactgtagggaacgtttgctattattagttgggttcccaatatctgacctccctttccaatttagggagaatcctcccctttctataaagtactgctggtctatgggatcccaccctcactaataagttgaaggtgaaagggattcattgtcaccccatcacctggtagtcagggcatgtgatttaaacaaccagggccaggcgcagtggctcacgcctgtaatcccagcactttgggacgccaaggcaggaggatagcttgagccaagcccaggagtttgagaccagactgggcaacatagtgagacccctatctcttaaaaattttttaattagctgggggtggtagcacaggcttgtagtccccgctactcaggaggctgaggcaggaggattgcttgagcccaggaggtcaaggctgcagtgagccgtgatagtgccactacactccagcccagcctgggcaacagggcaagatcctgtctcaaaaaacaaactaataaaaaactcaaccagtcacgttttcctacccaggaatttgaaaatggaccaagtgatccaaacatgatggtttggactctttcatggcctcctgctacaggagaaggtcaggctggctacattgttcctgctgatttcccaaatcccctcttctggccccctgttgattatctgagtttcctaaaaatcccttttatgcctaagatagccggtcagtgtttggttttgcaatcaagaacccagactgggccaggcacggtggcccacgcctgtaatcccagcactttgggaggccgaggcgggcagatcatgagatcaggagatcgagaccatcctggctaacgtggtgaaaccccgtctctactaaaaatacaaaacaaaaaaaaaaaaattagccaggcatgatggcggtcacctgtagtcccagctactggggaggctgaggcaggagaatggcgtgaacccgggaggcggagcttgcagtgagctgagatggcaccactgcactccagcctgggcgacagaacgagactccgtcaaaaaaaaaaaaagaaaaaagaagaacccagaacccagactgatcctgagacaaagatttgagggcaacgaatcacgaggtcaggaaatcgagaccatcctggctaacatggtgaaaccccgtctttattaaaaatacaacaaattagctgagcgtggtggtgggcgcctgtagtcccagctactcgggaggctgaggaaggagaatggcgtgaacctgggaggcggagcttgcaataagccaagatcgcaccactgcactccagcctgggtgacagagcaagactccatctcaaaaaaaaaaaaaaaaaatttgaggacaagtggtttgtttggcaataccaggaaacaggggaacaggatagtcagaaaagaaagagaaagctgggcatggtggctcactcctgtaatctcagcactttgggaggccaaggcaggtggatcacctgaggtcaggagtttgagaccagcctggccaacatggtgaaatcccgtctctgctaaaaatataaaaattagtcgggtgtggtggcgtgcacctataatcaaaataaaataaaatcaggatattttattttaaaactctgtcttagtgtaactcatatttacctcttctgtatgctcctttgcatcagttatatattgccataatacggctgtgtaacaaacaatccccaagacccagtggcttataatgacaagcatttatttagctcatgattctgaagggtggcagtttaggctgggcccagttgggtgctttatctggtctcagttgagctcattcatgcatctttggtcagctgcgggtcagctgggtggctcttctgtttggctgttagctggctgcagactggtccaggatgacctcggctggaatgactgtgctccactccctatggtctttcaccctccagcaggctagcctgagctagttcacatggcagcttttcatcctccagcaggctagcctgagctagttcacgtggcagcaatgggattctaagagaaagaggaagtgttcagccttcttaagggctagtcccaggaatggcacaacatcgtgttggccactgttgtccaaagcaagcaatgaagctggtccagattcaaggaatggggcaacagagcccatctggtatttacctggggccactggggccccattcctgttccctggggccttttgccctgacttctgtgggccctcagagcatattttcagattcctttccatccctgaccctcagcaatcaatgtagatgacgtgtcattactgtgtcacttgcacagagaaaaggaggaaaaaatgtcagcaaaaactctgctgagagcagagggcccatcatacagcaagctggaaagaaaagtgggaatgattacacagcctcctcagatgcttccagcttttatcaaatctcactgtgatatctgagttctgaaccctcacaggtggttggcgtgcaagggaagagatttcttgtctgccatgctgacatgcacagacacgcaacctggctccctctgtccactggggctttggattttgtttgttgaaatgttacccactcctgatcagagctggatggaaacctggctctgattccattggctcaggggctcaggtgggggcagaggccaggctggttgggtgtctatgtggagaccttaactcttctccctcccgccccaactctttttgtttctttttttttttttttttttttttgagatggggtttcactcttgttgcccaggctggagtgcagtggcgtgatcttggctcactgcaacttctgcctcctgggttcaagcaattctcccacctcagcctcctgagtagctgggattacaggagcacgccaccatacctggctaatttttgtatttttagtagagacagggtttcgccatgttggccaggctggtcttgaactcctgacctcaggtgatccaccctcctcagcctcccaaaatgctgggattagaggcgtgagccaccacacctggcccttttcttttcttagctgcctccacctctcttcccttctgcagtgttaggtttatggaaaccgaggccggcgtagagatcaacttcagagagcatgaactgagcatctgctgggtcttagatcctttacatagcttatcatcttcaaaccttctcacagttctgtgtggctagagccaggatttggacacagctctgccccactgtagaaccaggcttccttctgtccactgtcaaattttagagggagaaaatagggaaagggacaccagccttctccacgagcagcttctgcccactcaccccagggactttgcacatgctgtgtgcctgtgtctgagatatgctccctcctctgtatctgcttaattcttacccagacatgatacataaagtatttaacatccaggtggcagggacaccagctaacctgaaaagaggttcccctgttgtgccacatgtgtactcattgtttgctgcattgtgggggcagtccaggggccttgaagaggggccaaggtgccaaaggggcactctcaggcctcaaggaagtacatgtttactgatatgatactgtctcttcctccaggaaggaagccttccctgatctccccactgcatgcccactatgataccagtttaggtcccctctttatggccatctgtggcatcagtgtgaatcctcttaatgttgtctatttggttaatcatctgtctccttcctctggggggtaaagacagaaccacagagcctcgtgtagaacttgagaatggggttcagtaaaaatctgttgaatgcataaatgggtgattgagtgaatgaatgaatgagtgaatgaatgagtgagtggatgaatgaatgagtgaatgaatgagtgagtgaatgaatgaatgagtgaattaatgaatgaattcatagctgataatacaggcttcatggcttttgttaggcttgcccagacattgctaggggatggacagaaggaagaagagctatacttaattccagtcctgttgttctgtagcaggaggagaaaaacagggactgcccagcctgctctgggtggattcaggagcagctgaggttcctctcttatttgcaaacagggaattcaaaaagccccaacctcagaatcacactcgcctcagcagctgtaccagccaaggggacaatgtgggaagccttgggcaccaggaatgctgagtgcttcgaaaaagcgaaggctcagggaacaatccctgatttttcattcccttgtcctttctgaagaaacaggcaaaggcaggccaggcacggtggctcacacctgtaatcccaacactttaggaggccgaggctggtgaatcacttgaggtcaggagttcaagaccagcgtagccaacatcatgaaatcccatctctactaaaaatacaaaaattagctgggtttggtggtgcatccctgtaatctcagctactcgggaggctgaggcatgagaatcacctgaactggggaggtggaggttgcagtgagctgagtctgcgccactgcactccagcctggatgacagagtgagactccatcttaaaacaaaacaaaacaaaaacaagtaaagccttgtgtgtttttaaattgtaggttcagcagcaaagctctgtaataaggagctggaccctgcagtcagacagtcatgggcttctccagtgcccagccgagtgacccgagggagttatgataaacaccaacattcatccacaatttgtacctagtgctattctcaatatcttgagtaaattatctcatttaatcctccaggcacatctttcttggtaggtgccgtcattgtccccagtgtacatctgggaaaatgaggacaggctggcagagcacccttcctgctcacctctgctgctctgctgacctctggcaagactgttgtctctctgagcctcagtttccccatctgaaaattggggcctgtattagcccgttctcacattgctataacgagatgcttggctggggctgggcgtgatggcttatgcttgtaatcccagcactttgggaggctgagttgggcagattgggagtgtgagaccagcttgggcaatatagcaagaccccatctcttctaaaaaaaaaaaaaaattagccaggcatggtgatatgcacctgtaattccagctacccaggaggctgaggcaggagaattgcttgaacccaggaggcagaggttgcagtgagccaagattgcgccactgcactccagcctgggagacagagtgagactccatctcaaaaaacaaattatttttaaaaaattaaaaaaaaaaatgcctggctgggcacagtggctcacacccataatcccagtactttgggaggccaaggtgggaagattgcttgagcccaggagttccagaccagcctgggcaacacagtgaaatcctgtctctactaaaagtacaaaaattagccaggtgtggtggcacgcgcctgtggtcccagctactcaggagggtgaggtgggaggattgcttaagcctgggaggtcaaggctgcagtgagcaatgattatgccactgcactccagcctgggcgacagagtgagaccttgtaaaaataataataataataataaataaataaaaaccctgagactggggtaatttataaagaaaagaggtttaattgactcacgattctgcaggctctacagaaagcatggcagcatctgctcagcttctgggaaggcctcaggaaacttacaatcatggcagaaggtaaagctggagcaggtgtcctcacatggccagaacaggaggaagagagagagtggggagatgctacacacctttaaatgtccaatctcacaagaactcactcacgatctcgagaatagcaccaaggcggaaatctgcccccatgatccaattaccttccaccaggccccacctccaacattggggattacaattcgccataagatttggttgcggacagacacagatccaaagtacattaaaagtaatggcaaaaaccacaattacttttgcaccaacctaatatctcaggggctcattgtacctatttcacaggacaaatgaaggtatcagtaataacagtagcctgtagtcccagctattcaggaggccgagacaggaggatcacttgaacccaggaggtcgaggctgcagtgagctatgatcacgccactgcactgcaccctgggtgacagggcgaaaacttatctctaaaaataataataacaacaacaatagtgaacacagatataacatgtgtgtggccaggctgtgcccttagggctttgcagggattatttcattcactctcaatctccccattttacagatgagaaaactgacgttcagaaaagctagaggacttgccccaagccacacggctaggaagtggtggaattggggtttaaatgaggaagcttgacttcagtgtcgaagctcttaactgccacactcaatacatggagtagaggttgctgattctgtgattatctgattctggaaagtaaagaccctgtttccagacgtttgctgcttgacttagttcccaggggatggccactggatgatgcagtgttgcccaggagaggttagctagacacactgcaaccattccattgctaatacttatacttgctcttgttctgctgggtgctatgcagggaagggctgtctgagccctttgcaagaattctcccattggtgcctcccagagattctgaggttggggctttttgcatcccttattagcagatgagacaccaaagcccaggtcaataatctgacctgcatcccccgcctaccagccagaccaaggtcacttccccacaatgcaggccctgatccaaggctctgggtgcaaaccagtttccatgtccctgggggtccatcttcttcagctgactttttttttttttttttttttttgagacagcgtcttgctttgttgccgaggctggagtgcagtggtgtgatcatggcttattgcagccttgacctcccaggctcaagcaatcctcccacgtcagcctcctgagtagctaggactatgggcacacgccatgatgcctgggtaatttttttttttttttttttgagacagagtctcgcactgtagcccaggctggagtgcagtggcgcaatctcggctcactgcaagccccatctcccaggttcatgccattctcctgcctcagcctctcgagtagctgggattacaggtgcctgctacctcgcctggctaattttttgtatttttagtagagacggggtttcaccgtgttagccaggatggtctccatctcctgacttcgtgatccgcccacctcagcctcccaaagcgctgggattacaggcatgagccagatgcctggctaatttttaagtttttttataaaggcggggtcttgctatgttgcccaagctggtctcaaactcctggcctcaaaaagtcttcctgcctcagcctcccaaagtgctaggattacagacatgagccactgcacccagcctgactttttttctaactgaaaaattaattatatatattcatggagtacaatgggatgttctgatatatgtttacatttttgaatgattaaatcaagccaattaacatatccactacatcgcatacttattttttgtggtgagaacgcttaaaatctactcttttagcaattttgaaatatacaataccttatgttgtatattacattatgttgtatagtacgttgaaacatacactacaatacgttatcattaattgtggtcaccatgctgtgcaaaagatctctaaaacgtattcctcctgtctgactgaaactttgtatcctttgcctaatatctccccaatccctccaccaccagcccctggtaaccaccattctctctgcttccatgggttcaaattttttattttttgaaatttttaatttttatttatttatttatttatttatttatttatttttgagatggagtctcgctctgtcacccagtctggagtgcaatggtgccatcttggctcactgcaacctccgcctcctgggttcaagcgattctccagcctcagcctcccgagtagctggggttacaggtgcttgccaccaggcccggctaatttttgtatttttagtagagacggggtttcaccatgttggctaggctggtctggaactcctgacctccagtgatccacccacctcggcctcccaaagtgctgagattacaagcgttgagccactgcacctggcctaaaatttttttttttttttttttttttgagacggagtctcactctcttgctaggctggagtgcagtggcatgatctcagcccactgcaacctcagcctcccgggttcaagcgattctcctgcctcagcctcctgagtagctgggactagaggtgtgcaccaccacgcccagctaatttttgtatttttagtagggacagggtttcaccatgttggccaggatggtgtcaatctcttgatctcgtgatctgcctgcctcgggcttccaaagtgatgggattatgggccaccacgcccggcctcaaattttttagagctcacatataagcgagattgtgtactatttgcgtttctgtgtctggcttgtttcatcttagtataatgtcctccaggttcatgcacgttgtcgcaaaagatggaatttgctcctttttaaagactgaatagtacttcattgtgtacatatacacgccatattttcttcatccattcctttactgatggacatttgggttgtacctgcatcttggctattgtgaagagtgctgtcatgaacatgggtgtgcagctgactctgaggtgttagagggattacagctcctccaaaagaccaccgtcacccaaacctgctcctcctgccctattttctgtttaggtaaaggcggctttaaccccctgcagtgctctggcctcagacctccagatcttcctctatgcctctatgcctctttttctccaccccctgcatccaatctgttagcacatcttattggctctaccttcagaatctacccagaatccaccacccacctctcaccaccttcacagccccaccccggtccagcccccatctttgctggcctggactaaaccagttgcccctccaccccaatctggtctcttaacttcagtccttgccccacccccaggactgttccccacacagcagccagagggcacctgtgagccactgagtcaggacctggctcctctttgctcacaacctcacttggagaaaaagcccaaattctcctcacagggacccacaaactctgcccctgtgatcccccatccccctctattcccactctcctctccactcactcggcttcagctacacaagttccctgctgtcccttacacaccaagcactccccagcctcagggcctttgcacaggctgttccctctgcctggaacactcttcccccagatatctgcttggctcccccctcacttcctttgggtctttgctcaagtgtccttctaacatgtaactgcctcacctgcactgtgccaccccactccccgcctctaggcttaatttccctctacacccctgaagagcatctgccaagctatatttacttgtttattggttattgccaatcccctgcccccactagaatgccagctccatgagggcagggacttctgtctgttttgttcactgctattcccccagagcctagaacacagcctggcacatagtaagtattcactaaataatttgtaatatgaattgtgccagtaaaatcttccaggggcatcaagcccctgccatgactaggtggtaacatcctcaccccctgtccatgtgctatctcctcctgacctgcttgtctcattgttctaatggtggctcacgcctgtaatcccagcacttggggaggccgaggcgggcagatacctgagttcaggagtttgagaccagcctggccaacatgatgaaaccctgtctctactaaaaatacaaaaattagctgggcgtggcattgcacgcctgtagtcctagctactcgagaggctgaggcaggagaatcgcttgaacccgggaggtggaggttgcagtgagctgagatcatgccattgcaatccagcctgggccacaagagcgaaactctgtctcaaaaaatatatatatatatttcattgtggtaacatatgcataacataaaatgtaccattttttaagtgtttagttgagcggcgttaagtacattcatattgttgtgcaaccaggaccgccatccatctccagaacttttgcatcttgcaaaactgaagctctgcccccaggaaactctcactccccgctcccccttcccctctccccgactcccccttcccccctccccactccccccaccctactccacactccccactcccccagcccctggcacccgccgttctagtttctatctctgtgaatttggctactttgggtcccccctgtgagtagaatcatacagtatttgtctttttgtgactggtttgtttcgtggagcataatgtcctccagtctcatccatattgtagcatgagtcagaatttccttcttttccaggccgaatcgtattccattgtgtggatggaccacactttgcttatctgttcatccagatgggcacttggcttccaccttttggctattgtaaataatgctgctgtaaacctgtgtgtacaaatagctgagtccctgctttcaattcttttggatatagacccagaagtggaattttttttaaatcaagatttgacccactggggcccttagaggtctcattggctctgaagcttttttttttttttttttttggacgctttgaaactaaaaataggagtgaggggcacagtgaggggggcacacatctctcgtgtcagcgttttttaaaaacaccccgggaggaagatgtgtgaaatccctcccttccccccgctcccaccccctccaagatctcaaaatacctcttgttttaggaagcggctgtgacatcaggcaggcagcgtgtggcatctgagacacaatatcgcaagtggctgggagcccagagaaaccaggacaggcgtgctggggatgtggactagagatggagctaattttagtggctgaagaggctgcaagaagagagagaaagaggggtgtgtgtgtgtgtgtgtgtgtgtgtgtgtgtgtgtgtgtacgcacagtgatagaggctggagggggagaaatgacagataaatcagcttgggcaaagaaagctaatgggcagaggagcgagacccagctcagaaggtggtcagcaaatctaaagatgtgtgcccgagggtcaaggtggtggggggattcataggcaagtggtagagaggctattccatttgcagaggctctctctgtttgaggcgtgattcacctgtgccgtcctcaaggccattctgagaacaccactgttgttttcctccttttatgagtagggaaactgaggcattgaactgcttctattcttcagtaagaagcagggggaacatatggtagaagcaaagaaatacaaacatgagggctctcggggtctacgtgattggctgtgacatccatgagagcggatcgcaggttgaaggaaacactggtggcagaaagtagctgaacatttggatttgggaatcccagtggacgtggcgaaaattctggcttttcccttcacaggctgcggggccactctgacctgcggtttccttatctgtgaaatggaacgatgccacctgtctcagcgttgttttgaggatgcgaggagatgatccgtgtaatatgcccactagggggcctgctccagggtagattctcagcaaatggtagtcatggtttttgttacatttggggatattggcaggtaaaaaggaaatacttcattcattccaaaattgctcactgaggttctactatgtgctaggccctgatgacacatcggtcaacaagacaggcctgctttctgcccttgtaaaacttcagttcaactgcattgcactcatcagcctaataatccaggtaaattgtgatgagaataacaactagcatttactatgagccctttacaaatattaacccatttaatcttctaaagagcctataagataagagctcttgccctgcgcagtggctcacgcctataatcccagcacgtcgtgaggccaaggcaggtggatcacctgaggtcaggagttcaagaatagcctgaccaacagggtgaaaccctgtctctgctaataatacaaaaattagccaggcatggtggcaggtgcctgtaatcccagctacttggctgaggtaggagaatcgcttgaacccaggaggcggaggttgcagtgagtcgagatcactccactgcactccaagagtgaaactctgtcacacacacaaaaaaaaacaacctgttattatccacattttacctatgaggaaaccgatgcccagagaggttaagtaactgtccaaaggtcacacagctacggagtggtagagctgggattcagacccaggagtgtgatcccagagtgtgtgtgtatgtttgtttgtttgtttgtttgtttgtttgtttttaccactgtgttttcctgcttctgcaatagaagtaatcaccagtaacactgagcagttgttatgtgccatgcccttaacacacatctccttggatctttggaaagaatcctaaaagggttgtttttcatgatccacattttatggagagagagagatcaaagcatagagagaggaagtaacttgcccaagatcctgcagctgaagactctagggttgcaaatttgggacggccctggaccctgcattccagcttctagcagctcatagggggaactctttatttatttatttatttatttatttatttatttatttattttgagatggagtttcgctcttcttgcccagcctggaatgcaatggcatgatctcggctcactgcaacctccgcctcctgggttcaagtgattctcctgcctcagcctcctgagtagctgagattacaggcatatgccaccacgcctggctaatttaattttttttagtagagacggggtttctccatgttggtcaggctggtctcgaactcctgacctcaggtgatccgcccatctcggccccccaaagtgctaggaatacaggcctgagccaccacgcatgccctgggggggaccacttttatcggtgcatttcttccattttccctgtgtctgtgtaaagataaacacccccaagccccttgactatgaactgtgggccataattagttaatggaaggtaaatgttttagagacggaaattgctgtgccatttttccccgctaggcattgttgcctgcatgctaatgcaacacaatgtgcctttcttctgtcaggcatttttagacaaattctattttccctaaaatattttgccaaagaaaatagcaaatggggaagacattcagaggctcaggcagagagaggacaccattcccttgggtttaaacagaatggcagagtggataacagcacagatcttgagttaggtggatgccaatttgtgatttatttcccagcaaaccaagatgctggctctctgtgtgcctcagtttacttatttgtcaaatgaggagaataatggtacctgtctctcaccagcttaccagttgcctctttagctatgtctaatctgctattaaccacgcccactatgtctttaattccaagtattagaattgttttcttcctacaagctgtctgatcttttttaatcctgcttcatcttttgcagtattgttttcctacagcaggatttctcaaccttggcacaattgacattttgggctaggtaattcttggccgtgagctaccaccctgtgctaagatacttagagcatccctggcctctcaccctactaaatgccagtagcagcccctccccagttgtggcagccaaaaatggctcagacattgccaaacgaaatgtcccatggagggtagaaacgcccccacttgagaattgttctataggtattttcaagcatgtcttacatttctttaagtataatatgcaaaagaaaaggctaaatctaaaaaaagcccataatatgcgaagaatttttataatcagtgtccaataacttaagtatctaaaattgttatggctttttttctgctgtctcttgtttcctgtgattcctcattctggtgccttgttttcttgaatgtcttgttatctttggttgtgtgaagctcattttccatgggacactattttttgttttgttttgttttgagacagagtctcgcttggttgcccaggctggagtgcagtggtgcaatatcagttcactacaacctcagcctcccaggcccaaatgattctcctgcctcagcctcctgagtagctgggattacaggcgtgtgccaccacacccagctaatttttttgtatttttagtagaggcagggtttcaccacgttggccaggctggttttgaactcctgacctcaagtgatcaacccgcctcggccccccaaagtgctgggattacaggtgtgagccaccgtgcccggcatccatgggacactgttgaagggagttcattgaggcctgcgatgaaggcgaaccctccatggacaatttgcatttactttttccaggtgtctgggaaactcccagtctaggaccatcttagacttttagaccaacaatgtgttgagaatttaggtcaccagtgtctgcaaaagccagcttgtggttataatttctcaaaaacttttgtttttctccttttctgcaaagtgccaaagtaacttcctcaaaaatctctgggaatggaaagacgggagtaaattaacttcaggtttcttacctgaaagtgatagcctattggggccccatcctacttggggagtggtgtgtctcctttgagactttctaacacgtgtgtaccctggactttgccccacccctgctccctaggaggccataaaacttgaagcagcagttccatgggttagacagatgcccttggggcaaaagtggttttaatgctctggtagatgctcaggttacctctgggaaattcttgacttcacttatttatttggggctgataactactaattgtcaggcctttcttgtttcaacaacatggacttcagattttatgcaggatttgtcatcgttttcagcaagagagtcagtcttattacccagcttactgcattagaaatagatgtctgggccaggcgcagtggctcacacctgtaatcccagctgtttgggaggctaaggtgggcggatcatgaggtcaggagttcgagaccagcctggccaacatggtaaaaccccatctatactaaagatagaaaaaattagctgggtgtggtggtgcgtgcctgtaatcccagctacttgggaggctgaggcaggagaattgcttgaacccgggaggcagaggttgcagtgagccaagatcgcaccactgcactccagcctgggtgacaggacgagactctgtctcaaaaaaagaaatagatgtctgttgtgtggattatttaaaagagtagatggccaagaactatgacttatgcctgtcatctcagcactttgagaggctaaggtggagggatcacttgaggccatgagttagagaccagcctgggaaacatagcaagacccccatctctgcaaaagtaaaataaaataagttagtgtgcatgatggtgcaggcatacctctagtcctagctactcaggaggctgaggcaggaggatcacttgagcctaggagtttgaggctacagtgatctatgatcatgccactgcactccagcctgggtgacagatcaagaccctgcctctaaaacataaaaataaatacaaattaagttaaaaaataaaataaataagtaatagaacatccagcacagttcttggcatgcattgactgttgttgtttgtttgtttgtttgtttgtgacggagtctcactcttgttgcccaggctggagtgcaatggcatgatcttggctcatcataacttccacctcccaggttcaggtgattctcctacttcagcctcctgagtagctgggattacaggcacgtgccaccactcctagctgttttgttttgtttgtttgtttgttttgtatttttagtagagatggggtttctccaagttggtcaggctggtctcaaactcctgacctcaggcgatctgccagcctcggcctcccaaagtgctgagattacagacgtaagccaccacgcctggccagctgttttgattgttaaatgaaggtggtatgaaagggaaggaagaacagtgacatttgcaagggacactccctggagggcagggcaagggggctgtggaggggagaagtcagagagtatgatacaggttgccttgggtgatgttttagattttagccaacattggcaaagagcctcatttatctctcagagtagctctggctactggaaatgctgcacaacttcaggcggactttctagaagaaaactcttggccaggtgcagtgactcacacctgtaatcccaacactttgggaggctgaggcaggtggatcacttgagctcaagagtttgagaccagactgggcaacgtggcaaaacctcatctctacaaaaaaaaatacaaaaattaaccaggcgtggtggtgcatgcctgtatcccagctacttgggaggctgaggtgggaggattgcttgagcctggggaggtggaggtggtagtgagccaagattgcaccactgcactcccatttgagtgacagagcaagaccttgtctcaaaaaagaaaaaaagaaaagaaaagaaaagaaaattctctctgggattcaatcctggcccacacagcattggcttcacttcacctccttctcccctgagatacacagcaccattcccccaagcttcatcaacttaatctctgatctgggtgctgtgacttgtccccattcctggccagaatttaaggtagggatgaacccactagccctccatcacgcactctgccataaaagcacaccacgtgctgattgctgtctttggtctcctttctgccttgccctctagactctgagctgcttggagacagaggccagttttgtccatctccaaatcccctaaagtcctgtggccagcaagcaggtaggacatctgaaagttcgtcagagagggaattgcttttctcttgagatgcaactagaacaagaatcttattgacctggagtagcttcaaggttgtaagagtatgtgtcagggttctccaagaccactctcaggtttgaaggtttgctaaaagggctcacgggacccagaaaagctgtgaaattcagttatggtttattacagtggaagaatacagataatacagattaaaatctgcaaagcaaaagatgcacaaggcaatgtccaggggagatcaggcatgagcttccagctgttcactcccagtggagttatgcaaacagtgctcaattctcccagcaatggtgtgtgacaatgtacagtgtaccgccaaccagagaagctcacctgagccttggtgtccagggtttttattggggctcagttacattgacatggagcacccatgtgactgactttaactgctgggtctccagcacactccaagatcaaactgataccgtgtgtcccagggccccagctgaacacaaacaggcagtcaccatagatcccattgtgagcataagctaccaggcatggcccaaagccctagatatacagatattctttccaggagccagccaagggccagtccttcctttggaatatgcagagtttgaactccccaaccccaaggagttaactctttactacacagaatataaatctcaccaagtctttcttcttgtcaagtcctctcaaggtgacccattgcttttagcagtgtctttgagaccctgcgtcatctggccttgacccatatcacctgtgttatctctccactctagctacattgaacttttcttttttgagatgtggtctcactccatcacccaggctgaagtgcagtggtacagtcacagctcactgcagcctcaaactcctgggctcaagtgatcctcccacctcagcctcctgagtagctgagcccacaggtgcatgccattacacccagctaatatttttatttttagtaaagatgggttctcactatgtttcccaggttggtctcaaactcctgggctcaagcagtcctcccatcttggcctcccaaagtattggcattacaggggttagccaccacatccagcccattgaactttttaaggatcccctagcatcctatactttctgtcactggatagccttggaattatttttccttctttttgaaatactcttcttctttccaccctttgctgtcaagtctcagaataggcattatttcctccaaaaaccctctcctgaccctccaaatctggatgaggacacttcctttgcccagagagcacctgttttaatcctctcaggtggctataataaaataccttaaactgggtggcttatacacctcagaaatttattttccacagttctggaggctgggaagatcaaggcactgacagatttggtgtctgatgaggggccatttcttgtttcgtagaaggggtcttcctactgcatctttccatggtgaaaagagttgaggcagctctctgaaacctctttcatgagagcatgaatccctctgtcttcatgatctaatcacctcccaaaggccccacttcctaatatcttcacattggtgactaggtttcaacatatgaatttgagaaagacacagacattcagaccatagcagtgctcttccaccaggttttttatccccctgtattataattgaggtttaaattatctgctttccttcccttagattgtaagctccatgagagcagggccctacccatccagtcattgtcctatcccccatgactacaacttcctgggtacataattaatatttattatattatgtagcaaaggtatgctgccatactaagagacccaaaaggccaccggattaaaaccttaaagaaaaaaaaataatttctctcctataatagctgcaaggttagccatgcaggttggcagggaagctcacttccacaaagtcactcagggattcaggctcctgttgccctcttcttttctaccaccaaatgatcttcagcaccatttgcacaatcaaaacttaactggtcttgaataggcagaccttgaatttctgaagtctcagacccaaaagtggcagctgtcacttccactgacatatcactgatggaaacttaatcatgtgatcataccaaactgctagggatgctgggaaatgtagttttgttgggaactccatgacttggctaaaattccattactgtagaagatggtgggggatgggggagtggtggacatccagtggttgctaccatatttattgaatcaaattgtcaaacaggacctatctgataaggggttcttttccagaattaactgaagtattaaatcaggggcaaaggcatgtcacctcatctttctctccctatattggctttctagggctgttataacagagtaacatgaacttggcggcttaaaacaacagaaatttattttctcttagttctggaggctagaagcctaaaatcaaggtgtcagcagagccaccttgacaactgctctaggaaagaattcttccttgcctcttctggtggctcctggcaacccttggtattctttgtctggcatccacttcaatctctgcctccatcttcatttgccttttttctctgtgtgtctatgtcctttcctcttcttagaaggataccagtcattgaatttagggcttactctaaatccaggatgatctcacctcaagatccttaattagttacatctgcaaagagcttatttcaaaacaagattgcattctgaggtttcggtaaacacgaatttgggggaaatagtattcaactcaattcactgctttacttaagaaaagagaccatgaagtgagcctccttctgcttgagagagagagcgagcctttctgtgcaataggtcaatgaatggatgcagctgaattccacataactttataaaaatagatggccagcccatggggtttgctgacccctgcccaaaaattccaaagtcaacagcagtctcttttttaatcatttctctattttttaatttatttttatttttatgttgagatagagtcccgctctgtcgcccaggctggagtgtagtagtctcggctcactgcaacctctaccttccagatacaagtgattctcctgcctcagtctcctgagtggctaggagtacaggtgtccgccaccatacccagctaatttttgtatttttaatagaaacagggtttcaccatgttggccaggctggtctcgaactcctgacctcaagtggtccacccacctcggcctcccaaagtgctgggattacaggcatgagccaccatgcccggccaggattttcttcattttaacagcattcttacttgtcccacatccattctatcctgggtctaattagataacaaaatctacagatcttgtttaactgacattgtcctgggggatactttttatcttttgagacaaggtctcactctgttacccaggctggagtgcagtggcctgataacagctcactgcagcctcgaccacctgggttcaagcgatcctcccacctcagcctccagagtagctggaaccacagatgcatgccaccacacctggctaatttttaaatttcttgtagaggtggggtctccctatgttaccaaaggctggtctcaaactcctgggctcaaaagagcctcccaccttaacctcccaaagtgctgggattacagatatgagccactgtttccagccttggaaatatagtctaagaactgagtcaataggcgattttgtcattgtgtggacatcatgtagagaacttaacacaaacctagatggtataaactactgcacacctcagttatggggcataccctattgcacctaggctgcaaacctgcacagcaggttactgtcttgaatactgtaggcagttgtaacacaatggtaagtatttgtgtatctaaacatatctaggccgggcacggtggctcacgcctgtaattccagatcacctgaggtcaggagttcgagcccagcctggccaacatggcgaaactccttctttactgaaaaatgcaaaaattagccaggtgtggtggcaggcacctgtaatcccagctattcgggaggctgaggcaggagaatcgcttgaacctgggaggtggaggttgcagtgagctgagatcatgccactgcactccagcctgggtgacagagcaaaactccatctcaaaaaaataaaaaataaaaaacatatctaaacagaaaaggtacagtaaaaatacagttataaccatatgggaccaccattgtataggcagtccgctgttgatcaaaacatatcaaaacatcgttatgtagcacatgactgtaccataaaccacacggcttcaaacaagggaaatgtattctctcactgttttggaggccataggtctgaaatcgaggtgtcaccagggtccctccaaaggatccgggggaggatccttccattggatttggagttgcttcactccagtctctgcctcagtggtgacagggcgttctcctcttccctctcaaagttccctcttctgctgtgtcataaggatacatatgactgcatttaggccccactcagaaaatccaggaataaactcttgccctcatattcttaactaaatcgtacctgcataccttattttttctaaataaggtagcattccagggattaggacatcaacataacttctggagggttcactgttcaacccactacagccagaatgcgctttgaattcaggttctgacatctgggactgcctcccacgtacacacaccactaccttgtactgaatgcctgaagggttctgcccccacctccactcccccaaatatttgctgtggacctgagaaagctgacttcatggaagcttcattccattgttctaaggacttttcatacattaacaaatgtcttctctctatggggaaaaccacagagaaatcaagacagagtggggttaagtaactcacctgaggaggaacagtaagtggcagagccaggattcaaaccaacatggttttgcacagttttgacatcatttgcaacacaaatattgtcacagatacctttttgagcatctactgtgctaaccgccaggaaggaaaagaacatggggccgggagagctcttgacaggggacagggctggccatggaggtctgtgtcttggtggaagatgctatggttctctttttttttttttttttttgagatggagtcttgctctgtcacccaggctggagtgcagtagtgcaatcttagctcacagcaacctccacctcccgggttcaagcgattctcctgcctcagcctcccaaatatctgggattataggcacacaccaccacgcccagctaatttttgtatttttagtagagatggggtttcaccatgtgggccaggctggtctcgatctcctgaccttgttgtgatccacccgcctcggtctcccaaagtgctgggattacaggcatgagccaccacactgggcaactatggttctcttttaactccttgtgctgaaattattgcagaagcccaggccagttcatccccagaaagtgaggcataaacaggcagagctctacagaaacagagaatccacgactggtttgatggaggctgcctcactacctacagaatgggctctgggtggattgttctatctggggagccagcccacccaccagtctcagcccttggcgactctttcctgctgtcacagcagctggacattcagaaaccgaaacatgacagccttccctccctgttcctgcccagtggagtggaaacccctcgggacccacataccgagcgtgcacagcagcacagagttgcacagttaacacagcgcttcttctccagccctccggatgcaagctgacagattggcagctggctgacttccaaggtccagtgagttcttggcagtcgctttctgacctggacgagtggctgccacctcctggaacatcaggctgcccccttggggagagggtgacggtctctctggaaagactgtgagctttgaggtggtcatcaaaagccattcttggaaacattctttgagctgtaccgtgcaattcggtcaccaattgcacgtatttggatattaatatccgtatgtggatattaaattggttttgggttttgttttgttttgattgtggcaaaatatacacaacaatcctcctgcctcagcctcccaagtagctacaggcatgcaccaccatacccagctaatttttggattttttaaatttgtttgtttgtttttgttttttgagatggagtgtagcactgttgcctgggctggagtgcagtggcgcgatctcagctcactgccacctccgcctcctggattcaagtgattctcttgcctcagcctcctgagtagctgggattacaggcgcccgccaacacgcccagctaattttttgtatttttagtagagatgaggttttaccatgtcggccaggcttgtctcgaactcctgaccttgtgatccacccgcctcagcctcccaaagtgctgggattacaggtgtgagccaccgcgcccggccgatttttgtagttttagtagagacagggtttcaccatgttggctaggctggtcccgaattcctgatctcaggtgatccaccgcctcggcctcccgaagtgctaggattacaggcatgagccaccgcacacagcctaaatgctgtgcctcacgcctgtaatcccaacactttggtaagctgaggccagaggattgcttgagcccaggagtttgagaccagcctgggcaacataggaagaccccatctctataaaaaataaaaataaattagccaggcgtggtggtgcaggcctgtggtcccagctactcgggaggatgaggcaggaggatcgcttgagcccaagaggtcaaggctgcagtgagctgtgattgtgccactgcactccagcatgggtgaaagagcaagaccttgtctcaaaaaaaattaagcgaaatttaaaattctgtttctcactcacacaggctgcacttcaagtgcttaatcatcccttgtgggtggtggctatcatattggacagcatggatagagaatatttttatcagcgtaggaagcttcatcagagaggaccgctcagaggcctgtggggaccagcacagtgcagtagaagacacaggccagctggtgagagactggtcttctgatcccagatctgtccctcacttgctaggtgaccttggacagctccctcagtccctctggagttttctcttcattgttaaatcaggaaattggcctcagtgaattctgaggccccatctacttttttttttttttttttttttttttttttaattgagacagagtctcgctctgttgaccaggctggagtgcagtggcatgatcttggctcactgtaacctccgcctcccaggttcaagcaattctctgcctcatcctccccagtagctgggactacaggcgtgcaccaccatgcctgggtaatttttgtgttttcagtagagaccgggttttgccatgttggccaggctggtctcaaactcccaaccttgagtgatcctcccgcctcggcctcccaaagtgctgggattacaggtgtgagccaccacgcctggcctcatctagttctaaatgttatgacccactcagctctgaagacaagggaggaacatcctctcagtctagctctgacatgcagaagcctctcaccctgtcccccaggtcataaaggcaggcgtgttgtgaagagcacagaatgggctgagaaaaatatgcagggattgcgtctatctcccttccttccgcacgtttccttgtcggcaccacctgcctctattccgcgccgcacacacacccgccttctctctgtctcggaggaagacaggatcttccatcccccaaatcctgccctgattcctactctgaagcctctgccctgactcctttaagctccctgggaatacagcccatctcctatgccctcctcatcccagtagttcctaccttccccaaaatcgctttgggaaagtcccccaatgagtaaccagctgtcctacatgggcatctcagaacttctcttctgttgttgttgttgtttgttttgcttttgttttgagacaggatctctctttttcacccaggctcgagtgcagaggtgtgatctcagctcactgtagccttgacctcccaggctcaggcgatcctcccccctcagcctctggaatagctgggactacaggcacacgccaccacacccgggcaaattttttttaggacttttggtagaaatggagtttcgccgtgttgcccaggctggtctctaactcctgggctcaagcgatccgcccactttggtctctcaaagtgctgggactacagacatgagccaccacacccggcagagcttctatttcttgagtgtgttctcagccatgctaagacattttctcttctcagcctgatgatgcttttggcttgtgtttctttgtttttaattaccccttcccagtcgctgtcatgggatcatgagggtcttctgtccatctagatgacacctttcttgtgccacgtgtctccaacattccctggtttttaaacccttattgctttcaagatactatccaagctccttaatgtggcacattgtccttcgctgctatctgcctgctttttttttgagacagagcctcgctctattgcctaggctggagtgcagtggcgcaatcacagcttactctgcagcctcgacttcttgggctcaagcaatcctcctgcctcagccttctgagtagctgggaccacaggcatgcaccatcatgcttggctaatttatttttatttatttttatagagaaggagtctccctatgttgcccaggctggtctcaaactcccggactcaaagttcattgcagtttcaattttttccttggctcaaggatcctcccacttcagcctcctgagtagctgggactacagacgggcaccaacacacctggctaatttttgtattttttgtagagatggggtcccactatgttgcccaggcttctatctgcttttatctcaccttccactcttccatccttcctttcttttcttttatttcctttcccttcccttgccttccttttctttctttctttctttctttctttctttctttctttctttctttctttttctttctttctttcttgacagagtctggctctgtcacccagactgaagtgcaatggcaagatcttagctcactgcaacctccacctcctgggttcaagcaattctcctgtctcagcctcccgagtagctgagattacaggtacctggcaccacacccggcaattttttttttttttttagtagagacggggtttcgctatgttggccgggctggtcttgaactcctgacctcaggtgatcctcccacctcagcctcccaaagtgttgggattaacaggtgtgagccactgtgcctggccttttttttttttttttttttttttaagacaggaccttgctctgtcactcaggccagagtgcagtggcactataatcactttctgcagccgtgacctcctgggctcaagggatcctcttgccttggcctccctagtagctgggactacaggcatgtgccaccacactggctaatttttaaaactttttgtaggccgggcacggtggctcacacctgtaatcccagcactttgggaggccaaggcgggcggatcacgaggtcaggagattgagaccatcctggctaacacagtgaaaccccatctctactgaaaatacaaaaaattagccaggtatggtggcgggcgcctgtagtcccagctactcgggaggctgaggcaggagaatggtgtgaacctgggaggcggagcttgcagtgagctgagatcacgccactgcactccagcctgggcgacagagcgcgagacaccatctaaaaaaaaaacaaaaaaaaaaaacaaaaaactttttgtagagatggattcttgctaggttgcccaggctggtctcaagcttctaggctcaagcagtcctcttgcctgtgcctcccaaagccttgggattacaggcgtgagcccccacacctggtcctaacccactttctgaacttccaaccacaccattttgtcctaatatttaagtcacaccataacatgtcccacttcagaaatgcctaccaaagtagtcttcaaatctttttaaatcagtggaccctttctaccaaacaaatgttattttttaaatatttattttagagtaatttagacttttagaaaggttgtagctgggcgcagtggctaacgcctgtaatcccagcactttgggaggccgagacaggtagatcacctgaggttgggcgtttgagaccagcctgggcaacatggtgaaaccccgtctctactgaaaatacgaaattagtcaggtatggtggcacgcgcctgtagtctcagctactcgggaggctgaggcaggagaattgcttgaacccaggaggcggaggttgcagtgagctgagatcgcgccactgcactccagcctgggtgacagagtgagactccatctcaaaaaaaaaaaagaaaagaaaaaaaagaaaggttataaatatattataaagagttcccacatacccttcacccagtttctcctgttgtttgtatcttatattatcaccatatgcttgtcaatgctaaggaattgctgggtgcagagtggcacatggctgcagtcccagatactcaggaggccaaggcaggaggatatcgcttgagcccaggagttcaagtctagcctgggcaacacagtgagacctcttttctgcaaaagaaaacaaataaaacatctaaaaaagaatacactggaggcggcgtggaaacaaggatctcatttgggagttgtctgcaatgttctgagcaagcagtaacggaggcctcaagtcagggctgtggtcatggaggtggggaggggtggttggtttcactatctgtgttgacttaattttagatttgcagactcaactgagtatgaactttaagagaaagagagaggccaggcacggtgggtcacacctgtaatcccagcactttaggaggccaagtggggaaggccgcttgagcccaggagtttgacaccagcctgggcaacatagtgagacccctgtctctacaaaaaaaaatttttaaattagccaggcagggtgatgtgtccctgtaatcccagctactcaggacagtgaagcaggaggatcatttgagcccagaaagttgaggctgtagtgagctgtagttgcaccattgtgcttcagcctgggagacaaagtgagaccctgtctcaaaaaggagaatggggagagagagagagagagagaaggagaaagagagagaaagagagagagggaagtcaaggagaaccccacattttttgacatggtgtattagtctcttctcacactgctaataaagacatacctgagactgggtaatttataaaggaaagaggtttaatgcactcacagttccacatggctggggaggcctcacaaccatggcagaaggcaaaggagaagtaaaggcatgtcttacatggcagcaggcaagagagcttgtgccatttataaaaccatcagatctcatgagacttattcactaccacaagaacagtatgggggaaactgcccccatgattcagttatctccacctggcgccgcccttgacacgtggggattattacaattcaagttgagatttgggtgggaacacagccaaaccctatcacatgggcaagtgaaaggatgggtttgccatcaaataaaatggggaaggagactgactaggtgggcagattaggaactcagctttctatgaagtgcctactgatggatagagatattgtgttggccatctattaggttggtgcaaaagtaattgcggttttgccattaaaagtaatggcaaaggaaataacctttgcaccagcctaataggaattggagtctaaaattcaaaaaaggtaagtcagagctggagatccaaaggcaggagtcagcctcctgtggaggctatttaaggaactgaataagggcatagatgcaggagagcacccaggactgagcccagggcttactctccatcattaaagaggttggggaagatgaggaggagccagcagagaagactgaattggagcaaatcagaagaatgtgggtgctggctgtcatgcaaggaaagtgctaagccatttcaagtatgagggaatgatcaatgatgtccactgatgctgatgtgttgactcaaatgaaaaatgagaatcaaccattggatgtagtggcatggagatctttcgtgacctgagccagagctgcttaggtgaagaggtgaaggcaagaggctactggaaggattactactagctcttttaaagagttctgctgtgaagggtagaggaagagagatggggcatgtgttagctggtgggggaagtggatttcagaggtttgtttcccttaaaaaaaaaaaaaaaaagaaaaaagaataaagaaaaaaaaaaggccaggcacaatgactcacacctgtaatcccagcattttgggaggctgagacctcgggaatttgagactagcctggacaacatagtgagaccccatctctacaaaaaaaatttttttttaattagctgggcatggtggtgcatgcctgtggtcctagctacttgggaggctgaggtgagaggatctcttgagcctgggaggtcgaggctgcagtgagctatgatcacaccactgcactccaggctggacaacagagcaagaccctgtctcaaaaaaaaaagatgggagacctaacagcagattttatgctgataggaataacctattaggggagaaaaacatgaggatgctggaggaagaagagtgtcaggaggacatctcttggtggacgagaggggatggcatttggtgtacaggtggaaggtttcactttagatgacagcacacacagttatctatagaaacaggagaaaatgcactatatgggcatacatgctgggaggtagagagtaaataatagtggtggttgcttgtggaaattctcttctaatgtttttatatttttatggtttatcaaggacaatttatatttttacagtttactgcaaacaacaagttctaatttattcaataattatttgtgggtagaccgagtgcagtggtgcatgcctgtaatcctagcactttgggaagccaaggtgggaggattgcttgaactcctgattcacttctgagcttgaatcaggagttcgagatcagcctaagcaacatggcaaaacactgtctctacacaaaatacaaaaactagccaggtatagtggcatgcacgtagtcccagctattcgggaggctaaaacgggaggatcatttgagccctgaaggtggaggttgcagtgagccaagagcgagccactgcactccagcctgggtgatagaataagaccctgcctcaaaaagaaattcttattcttcttcttcttattattatttgaggagacatttactttgtaccaggcgctgtgctagatgctggagatacagacatcaacaatgacaaggctaagtgcctggcgtatttgtactttgagtctaataaaagacatcacacagacacacaacacacacacacacacacacaggattgtcaaaggatcaaccatttcacatgtcaagatcaggaatgatattggtctactactgccttaccatatctcctaccatgacctcatcttcctcttgccagattttaagtctttatacctcaactcccagaactctcttcgcctcacaccctatcacaatgtcatccgtaccccacggccaatactccatcattcgggaaagcaaagttccaaagcgtcaagattgtatcaatggacctgtctctatggcaacagtcctgaatgagccaagcaaggtaaccctggagatggcgtgaatgagaaagtggcctgttgccacggagacgtgctgaatgggaaggcccccacgagccaggctatgtcacgaagccgaaacagtcagcatgaagtcggtatgtctattttcaactcggaattacaaaaatacattttaatagagctcatgacccatctccttcctcgtccctgcctcccaccccactcttcagccttcatcctacaacacaatcgagcctcaccaggaacccttcaaacccctcaaggacaccttactgttccttcagtacacagtccccttcctgggctgaggtggtattcctttgaccaactactgtctcccctttgggaccaacagtattctcaaaagccatgagcttatgggaagaacattaactacattctttggggcaagaacagttgctcacctgtgaaccagctcagcttgcatctgtgagaatgattgcaatgggtagaccagttctccatcaaagaatggccctagcaccccacacacagtggtataatctgatcatgctggtgtattgaacatataatgttagtgccacatgaaaggaatttgtaaaaggacttagtgcctagaaaggtacctttgaagatcttggaatctctgaaacttacccaggttccttataccctgctcaaagtattcctccatttatttcttcattcattagttcttttgtttcaccacatatatatttttgaaacggggtctcactctgttgcccaggctagagtgcagtggcaagatcgtggctcactgcagcctcaacctccccatctcaagcagtcctcccacctcagcttcctgagtagctgggacaccacaggtacaagccaccacgccaggctaattcttgtaatttttgtagagacggggttttgccatgttgcccagtgtattcgtttgttctcacattgctataaagaactacctgagactgagtagtttataaagaaaagaggtttaattgactcacggctccacaggctgtgcggaaggcatggctgaggaggccacaggaaacttgcaatcatggcggaaaatgaaggggaaacaagcacatcttcacatggtggcaggagagagagagtgagggggggagtgctacaaaaccaggtctcacgagaactcactcactgtcatgagaaaagcaagggggaaatctgctcccaggatccaatcacctcctaccaggtccctcccccaacattggggattacaattcaacatgagatctgggtggggacacagagccaaaccatatcacccaggctggtctctaactcctgagctcaagcaatctgcctgccttggcctcccaaagtgctaggattacagacgtgaaccatatttattaagcattgttacagcaaagagaagcattgttgcagcataacaattggaagactccattgatggacgtctccatcaacaagaactgtcggataaactatggtacacccatcccttagcgtgttatgaagtcattacaaaaagaagaagcagatctctgagtgtcaataagagctagtacttatagggtgtctactgtatacaagtgctgttagaaagtgagtattaactcatttaattcttgtaacaagcctgtgaggtggattctttcatatccccattttacagagaaggaaataggaatctctatatccaagatatgttatcaggtgacaaaagcagtttttgaatggtgccgccattttctcgtaagagcaaatctggaagattccatgagaaattaataattgtgtttgcctctgtagcggcaccctgaaagatttggaagtaggtgtggaaaggaaacttactttcttgtgtctttctgaattttgtactgtctacgcgttttgtctttcacaaaaccaaacagaaaatgaccatttggtgcattttgtgtgtcaggcattcttctagtctagagaagcacaggagagcaaaatattttactgacgagaaaaatgaggcatggagaagttaagtgacttgcccaggtagcagagctgggattccacatcatagggtttatacaggaaacaggtaaacagagctgtgcttgtgtgtgggtatgtgtgtacacatgcatacatgtgtgcatgtgtgtgtgtgtttgtgtgtgtgtgaatgtgcttgtgtgttgggagagggaaatggcaagagaagaacctacagaaggtcagcaggaaccaacccatgttttgaggagtttggactttatcctgaaggcacaagggagccatggaaggatttagacaaggggtggttgtgcttagctttttatttagaaggatgactctggctgaagggtgatggcccagaatacaggtatatgtgaaggactcctcctgccctagtaggaggatgcccacccaccctctctgcccagtgcagtatcaaagggcaaattgggtacagagaattctcaccaagctgggtagaatccactctgatgctggggagtggacactgaatgcaccagcctctcctcctgctcaatccctgaattgaagctgttccactaatgttagggatcagattcccttcatatatatatatatatatatatatatatatatatatatatatatataattttttttttgagacagagtctccctctgtcacccaggctgaagcccattgtcgcgatcttggctcactgcaacctccacctcccaggttcaagcaactcttgttcctcagactcccaagtagctgcgattacaggcacccgccaccacacctggctaattctatatttttagtagagacagggattcacctatgttggccaggctggtcttgagctcctgggctcaagtgatcagtctgcctcagcctcccaaagtgctagtattacaggcatgagccaccatgcccgtcctttttatattacctttttttatagagatgtggtttcactatgttgaccaggcaggtcttaaactcctggcctcaagcgatcctccctcctcagcctcccaaaatgctaggattacaggtgtgagccactgcatctgtccagactctgttctccataaagctggcatatggaaagagggaagaccatccaggcaatatcgaagtcccattggtgctgatgtggctgctgagaccacatgaatggatgcattctgactctgccacctctcagctatgtgaccctgggccagtcagcaagtccctctataactcagttttctcatctgtaaaatggcgtcaacagtagccaaccccagcaaatactgtgaaatatacagaacatcattataatggtgaggatgatagagatgctatgttatcagaatacctgggcttgaaccagctccccttcttgcaagctgtgtgacttggagctgatgcccaaacctctgtgggcctcatttgtttcatctgttcaatggggataataacactcttacttcatacagttatggaggatttattgaaataattgacatacagctcttagaacagtatccggctccttgtaagcgctcaagaaatattacagactgttgataataatgcaatactactaccaataatatggccaggagcaatggctcacacctgtaatcccagcactttaggaggcagaagcaggctgattgcttgagcacgggagttcgaggccagcctgggtaacatagggagactctgtctttacaaaaaataaaaataaaaatacaaataattagccaggtatggtggtgcatacctgtagttccagctacttgggaggctgaggtgggaggattgcttgagcccaggaagttgaggctacagtgagctgtgatcacaccactgcactccagccagggcaacagagtgagaccctatctcaaaaataataataatggccgggcgcgctggctcatacctgtaatcccagcactttgggaggccaaggcgggcagatcacttgaggtcaggagtttgagaccagcctggccaacatggtgaaaccccatctactaaaaacacaaaaattagccgggtgtggtggcggggtgcctgtaatcccagccactcaggaggctgaggcaggagaatcgcttgaacccgggaggtggaagttgcagtgagccgagatcacaccactgcactccagcctaggtgacacagtgagactccatctcaaataataatatgagtaataataataatatcatttttatcatcattcttactaacagtctctcactccttgccctgcagttttgcctgttttcttggaataacactcttccacacctttcccctcagggatggttcacgtttagcatcatgacccacccctggggattagttagctcatttctggaaagcactttggagctgtaggtgctttgcaggctggaaacatcacgggacttgtaccatatttaagcaatgccagattattctgcctggcagggggaggacacagaggatacggccctggtatcttttctccctgcctacctcagctttgctctgaaccattttctgtcctgttcagggcagcctgggccacttgccacttccagctttctcgggagaggatgccttcctgatggcacgcctcttaacacacacctggtgctgttgttgaaaaagcaacaattgactccagcgccagcactgagaggcttgtccttaaaattagcaggagctgttggaaggtcgctgttagctcttttgactggaacacactgttccccaggtggcatgaggctgaatacagtgcagggattggctctgctctcaggtggcctgctccacgctcctgagctccgggtggaagctgtgaccattatttccttaacagaaacatatatagcagcattaactatgaaccttattactgtgtgtgtgtgtgtgtatatgtgtatatatatatatgcacatatgtgcatatgtgtgcctatgaacctgttctgagcactttacaaatgtcaatgtattttatcctcccaacaacccattttataaataagacttgaggcacagagaggttacgttactgccccaagatcacacagctggagagtggtgaggccaagatttgaacatatgtaccattgtaccatatgtaccaactttttttttctttttgggatgcattcttgctctgtcacccaggctggagagcagtggcatgaccacggctcattacaacctcaacctccaggttcaagctatcctcccacctcagcctctcaagtagctaggaccacaggtgcataccaccatgcccagctaatttaaagtttttttttgtttgtttgtttgtttgtttgcagagatggggtctccttatattacccaggctggtctagaactcctaggttcaagcaatccccccacctcggccttccaacatgctgggattacaggcatgagccactgcacccaggtcctccctccttataaaggtcgccaagcacaatcttgtgagcctggccctatccacacccatacgcaacatggtgtgtatttttcaaacaaaaactgaatgaacacctctggtttgggttcccctcacacttgtcccgggtttgttgactctgtgttgtgggcctagacaaagcagtgtctggagctcctagacccagggaccagacagtctgggttcaaatcctggctcttccacttctgcctgagtgctctctctgaacctgtctttctttatctataaaatggagataatttttttaaactcatcacttggtcaaactgctttgagcatgcaaatgagttcatatgtataaacctcttagaatgtcccaggcaaagaacaacacttcactcagatcaacatttatttagcatctactgtgtacccatgactattctaggtgatgaggagaccctctggttcttatgaggtagtgaggtgggggagggtgagaaccctaaacattaacgatggtgtgttcgcaggtgggaaaatcagtaaagtcgggtaaagggaatttgggagtgctgtgctcaagtcctggccctgccactttctggggtgcaagatacagcattgaatagggtggtcagggtaggccttattgggaaagtgatatttgagcagacgatctagatgtcggcacatattgctactgtttgatggtactaatatgagtttgagtttcacttgcaagtatatatatatatatatatatatatatatatatatatatatatgtgtgtgtgtgtgtgtatatatatatgtgtatatatatgtatatatatgtgtgtatatatgtatatatatatgtgtgtatatatgtatatatatgtatatatatgtatatatatgtgtgtatatatatgtgtatatatatgtatatatatatatgaaatttggtccatttatttatgctgatcaattaattgatgttgaaattataattgaatgttttattaataaacagatacccacatactattttttcagaaattgttaggttttggggttttctttagattttgattatttttatttgcttaattttcttttttcttttttttaattttatttttccataagttattggggtacaggtggtatttggttgcatgagtaagttcttcagtggagatttgtgagaacctggtgcacccatcacccgggcagtatacactgcaccatatttgttgtctgttatccagtgctcacctcctactcttccccccaagtctctaaagtccattgtaccattattttactcacccacattctttggcctgagatgctgagtggtcatgactcccagatcccttcttgtttctgtatcaaagatctttactaagatcctggcctagggaacctattccctttcctcatccccaatgggagaaggggcttcttccccagcttatttgccaactcataggaaaggtatgaaggagaggactgtagttgtcttgaagctggtcagatgttgaagagatgataatatttgctgatcaagagagacaaagcaatgctggaagaagaggctgtgttagttaacaccagctgcaataaccaataaaaccaaaaatctctggcttaagagtatgcatgagtgagaaatcaacttctaaagtacaactggtggccggatgtggtggcttatgcctgtaattctagcactttgggaggctgtggtgggagggtcgcttgaccccagtagtttaacgccaacctgggcaacacagtgagacaccatctctactaaaaataaaaaataataaagtgaaactggtgaggggtgcaatgaggtggagtggtgggtgactcaaatatggctcgactccatgcagtcactcagggatccaggctgttggaggctctccctgcttaaacatgtggcttccaaggttgttctaagagcctacattgagacagcagctggggaaaagggaaagtggagtgggaggtacttatgagggttcctggaagtggtgaacaacacttctgcctgcattctattgggtggaatttagtcatgtggcccaggctagctgcatgggaggctgggaaatgtagtctctgattaggctgccatttcccagtcccacttgtgaatctttagtgggaagctcaccatgtttgcaccagggattcagtctacctcccactcatgcctcaactatgtatcaggcactgtcgtaagtactttacatatcagcctacctaatgcaaacaactactcagtgggtgctttattggtcacatgtattagtgagaacatggaaacccagagccgttaaatatcttgcccaaggtcacacagctaggaagtggcagagttggaatttgaatccaggaaatctggctgcagagccccacgcttagtataaattcattgtagtttagaaagaggcagaaggaccctaaaattggcataatccattttttggtccctaaggaactgactgaattgactacttgtaaaagtgagtcctggacaggcaacagtggctcaggtctgtaattccaggactttgggaggctgaggcgggcagatcacctgaggtcaggatttcaagaccagcctggccaacatggcaaaaccctgtctctaaaaaaatagaaaaattagctgggtgtggcggtgggtgcctgtaattccagctactcaggaggctgaggcaggagaatcgtttgaacctgggaggtggaggttgcagtgagcaaagatcacgccactttactccaacttgaatgacagagcaagactctgcctcaggaccgccatggccccctgggttctaggtcagagtttctccgccacagcactgatgactttgggggctgcattattagctccaaaatgggagctatcctgtgcactgcctcaacttacttgatgccagtagcgcccgcgccccagttgtgagaaccaaaaatgtctccacacattgccaaatgtcccctgggaggtgaaatcacccctggttgagagtcactgttctagattgttaaatattatcttacactctagcacaagtccaaggcaaactgacttagaaattaccaaccttgcaaaaaatagaagatttcttaaagtcagtgagcatgatggtggcaagctgctgaaatcacacccccagacattagcagatgggatctggacagtattcatctagttaaaaattgacaaggactgggacactgcaggctcttcaaaagagaatcatttgaataacaaggggtcaagacaggggtaattggtgaaagcccctgctcataatttgaaaatataaataggcatcatgaaaattcatcctgcaaaagtcaaaagtcgaatgtgcagtgttatacatgatcagttgatttgggaggggaaattgcatgcacacacatgagagcttgcacacccacacacacacacctgttcaagtgtgtgtgccagtgctcagtgaggaccatctccccaacctgtctgatcatcttgctttggggtgaccctatgggtgaggcagaaattcttggatcatagttttctaatgaatattataattgttaacttctgatgggtgctgactttttcatctttgcaacactgcgtaggtatttttactctccccattttacagatgagacaactgaggctcagaaagattgattagctctacacgaagccaggatccaggcttagcctggctccaggaatcatgttttgagttacgtagcttccctgattctgagggacctccccacttctgaaatcttctactgttactccccatggccctttcctattgaccggaggcaccccagctcctcactcgtcccttatcttatgaaacatgaccatgatgtctgaattcaaaggagagcctgggctttgtggggaaaacgaagcagaaaaagaaaggtggaggttggtggttgtttttggcatggtgaggagcctgtcgttgcttgaggaaagcaagaaaggagattgctggggcttggatccatctctgggtgcctgtgggtctgtctgtaaaaatgagaactggtcgtgctcattagaggatttgaccgttaggccttgggatagcgatttgggaacttttttctgctaagacaaagaataatatggttcaggttcattttgctcctgctttcccaagccctacatctcttctgggcttttttttttttccttttctctccttcttcttcttcttcttcttcttcttctcatttttggatctggacttctgctgactcatctctctgagcaaggaaggagggaggaagtcagaattgctcattaaccgttttctttagtgactcagctgtgattcacattttaattaatggaggagaaaaacctgatcagtcctaaggcatctgcccaatcacgcataactccaggctggtgataataataatacttgaaaaaagtggggtgtcctgaattaaactatggctcattccccacattagtcttgaggactccaccaggccctctaagttccaggtctcaatggggctccctgaaccagagcagctagtccaagccccgagcagcatttctgcagagttagtctgaggtcaggacaagaaacagaggctcaagccctcctgggatcgcaggaggatcatgggaatgtaatattgtttcctgagctggtctttggctataatcccaggctcaagcctggcctccctcccctcggggcctgaaatttgtcagagcctattgcaggggcagcttctgtgctttttgtttgcccagagaatgagaaaagtccagataatcatgaccgctacttcctgagcacttactatgcatcaggtggtgtgctcagcacttctcatgaatgatcacgttgaatcctcactctgtccacaaaaagaaagagcttttatataattctccaacctccctatgaggaaactgaggcttggcaattgcccaatgtagacaattagtaaataatcaggcaggatataaacccaaccctttcccacctgggagccagagcttgcatctactatacttctctgctttccagtcagctgcaaagaaaaattggaagctgatagctcattcaacaaacacttattgaacccttccacctgctcagccctgttctagacaccagagatccatcagtgaaccaaagaggcaaatccatggtctcatgaaactgacaatttacctgcccaagtgtattagttactgtttataagttcctattaagtgtattagatatgcttgcagctgtaacaaagaatcccaacatgcataagggctcaaaacaataaaaatttcgttcttgcacagataaagttcaaaaggtgtattctttttttttttttcttttgcgacggagttttgctcttatcctccaggcatgagtgcaatggcccagtctcggctcactgcaacctccacctcctgggttcaagcattctcctgactcagcctccccagtagctggaattacaggtgcccgccaccacacctggctaattttttgtatttttagtataggtggggtttcaccatgttggtcaggctggtcttaaactcctgacctcaggtgacccacctgcctcggcctcccaaagtgctgggattacagccgtgagccaccgtgcctggccaaaaaaaaaatgtattcttaaacagcaggcacctctcctctaagcagtaagtcaggggcccaggcttgttccatattgtagctcctcatcttcaacccatggcttccaaagtctccatgcttcttgatatcaagccacagaagggaaaagagcatgagaagggcacaggagaaatgtttctgggacagacccagaagtagtccatatgacttccatctacctcccactggctagagcttacatggcggcacccacttgcagagctgggaaatggagtctaactgagcatccaggaaggagagacagacatgagtctttgcgtgggtcctcactgagaatcaagctccacattttgatcgatgtcaccagagcgtacatggcggcgcccacttgcagagctgggaaacggagtctaactgagcatccaggaaggagagacagacatcagtctctgcgtgggtcctcactgagaatcaagcttcacattttgatctgtgtcacctccttgcaagccctaccttaggacaattttaagggacattcctatcttcttccacccttaggacagttttaagggacactcctgagttcttccacccacctcctctgtttcttgggcttccagctctcaggatttgcctttgccttacaatggggtgaagcaagaatctggaagaatgtctctccccacaatttgaagtcttatttgaaaaaaagcagtagagcatccctccctcttgaggtagggaaatctagaatcaaatcctgcttctccagactttgacctcagaaactggggggacttcaaggtcttcaggtgggcagctttcatgaaccattcattcctcccacctcataccaatcagggtcctaacaggaaaaagaattaacttctagatggttcaaaagaagaccatgccatgaagagactccttaaagagataggaacaggtgagagaaatagataacggctgtttgaggtcctcagagagaagccatcgcgagccctacatttcctggaacccagtggaggcagagctgtgcagaagggactactgtcagaaccagggagggagcagggaagcaatattccaatctctttccctcccctcatcttctgccagcgcttcccctcagccaaaccaaaccggaaacggagcaaagcattctgggagttgtagtcttcaagggtccgcctcgagggcacagagcccgctggagcattgacctagagggcacacagggaatgactagtttgcaccatcatgtgacggactgcacgccctcgattatgtaatccactctataattcaactgcagagctgcatggtacagcaggatagccactagccacacgaggctatttaaatataaatgtacattcattaaaatttaaccaaatgaaaattttagccactgagccccatttcaaatgctcattagccacacgtggctcttggctaccatattggacagatcagaatagaacatttccatcatcccagaaagttctaggggccggcgcagctgtggtgtaacctgagcccatgcatgttatggaatggagaagagagaaaacagcacaagaggcagttttgaagggagacagagagctgtggatcagtagggaggagactctctaggcaaaggagcagttgagaagcaagaaagttgagtgagctgctttgctgcgatggaggcttccctcacggggaagagtagagtcagaaagctttagttcaagttcagctctgaaatgaaccaatgagtgttctgacaagacacctggccttccggaaccttggttttgtagtggccaagggcttgaccctctgaaggttcactgaaaaaaatcaactcacaaggcatattaattggagaaaaggcaggcagatttatttaatgtgtttgcacgagagccttcagaatgaagacccaaagctgcaggggaaattgtccgttttttaagcttaggttcaacaaagtatggacagcggtgtagaaatatgattgaacaaaaagtgtacaatgtaaatgctaatagactgagtggggaaacccaaaaagggctgtcttgattctccttggtctctctgagcatgcatttcttccgggtatgggacaagaccctctctggaatggagggggggctctcttggttctccttggtctctctcagcatgcattccttccgggtatggggcaggaccctctctggaataagggggctgtcttgattcttcttggtctctcagagcatgcattccttctgggtatggggcaggaccctctctggaatgggatccttataacctacggtcaaataacgtaagttagataatttcttttttttttttttcttttttttgagacagagtctgattctgttgcccaggctagagtacagtggcacaatctcggctcactgcagcctctgccttctgggttcaaatgattctcctgcctcagcctcccaagtagctgggactacaggtaagcaccaccatgcccagctaatttttgtattttttagtagagacagggtttcaccatgttggccaggctggtctcaaactgctgacctcaagtgatccaccacctgggcctcccaaagtcctgggatttgtaatcccagcatgagccactgtgcccagccagatcatttctttttctttttctttttcttttctttttttttttttttttgagatggagtctcactctgttgcccaggctggagtgctgtggtgcaaactcagctcactgcagcctctgcctcctgggttcaagcaattctcctgcctcagccttccaagtagctgggactagaggtgcgcgccaccatgcccagctaatttttgtatttttagtagagacagtgttttgccatgttggccaggctggtcttaaactcctgacctcaagtgatccacccacgtcggcctcccaaagtcccgggatttgtaatcccagcatgagctaccacagctggccagataatttttttataactagtttttacaaagaaaggtggagggaaagttagagtaacatttttaggtgttagggctgactttggggaaaagaggtctggtttctacgacccgccttagggaagagggattctagtttttgtggctagccccaggggagaatgggactaagagatagaagggcaggagaaggtcagagaaaaacttttgcttctgtggctgcttcggagaacttcattttggggtattgttttctgagccccaacagtttgcttatcagtgaagtgggtataggcgcccacctcccacagtgacgatgctgtgaacagggctttggaagagtagaactatgaaatatttgttgttgccttgtggggaaatggtcgttaaagccaaaattgttcaagagaagaagcaggaagagttcctttctttcctgcaggtatcctcttaagctgagtcttcagaatcccctgacaacgtttaatcaacactttattaaattcaccccaaccctgcttcaaaccttcacctggtcctcgagatcttccaactgtttcttgatgaagttagcaggcaattgtatggcgggatcatcatctcatgttttgttttgtttttttcctttttaccctctgactttgagaaatccttgtccttttacttttccaaacctgagagcattgcagagaagttagaattgagcaggacatgggcttaagacccagcccagccatgtgctagctgtgtgaactcgaagcagtgaccccacctctctgacctggaaagtagagggaatgataggacccaccaccgccacacttgtagggtcatcatggggattgaataaaataatgcataagacttggcccacagcaagcactcaagaaatgttagctacttcctaaatatatttttaaccttttattgaatataacatacatacagaaaagcacatgtatcatacaagtagagcttgagtgattttcaaaaactgagcccagtcatgtaaccagcgcctagttcaagaaacagaacatagccgagtgaggctgaggcaggagaatcacttgaatctgggaggcagaggttgcagtgagcagagatcatgctatcgctccccagcgtgggcaatgggggcggaggggaagagagagagagagagagagagagagaggaaggagggagggaaggaaggaaggaaggagggagggagggagggaagggaaggaaggggagagagagaaaaggaaagaaaagaggaagacagaaagagagagagaaaggtaaagaaagaaaaggaaagaaagagaaagaaagaaaagaggaagacagagaaagaaagagaaagctaaagaaagaaaaaaaggaaggaaggaaaatagggagggaagaggaggaggaagaagaagaagaagggggggagggagggaacagctgcagcttcgaggaaggaaggagggagggaaggaaggaaggaaaggaaggaaggaaaaaaaaacagcaccaacgtttagaaacccccttgtgcctctgaggtcaccagtaactccatcctgacttcaaacagtctagattagttttgcttgtttttgaactttaagcacatggggtcatacagcatgcatgcattgacttctttcccttgacgttgtatgtgtgagattcatctgtgctgttgctgttcatttgttctcatcgctgtgtgtgctgaaccacctgttcatttactctactaatggtgggcagtttggtgctttctactttggggctattccagagaaagctactttgaacacactcagatatgtctgtgggtgaccactcttcatatttctatgggagatattcctaggaccggaacatctgagtcagagggaggaattggtttagctttggtaggaactgcctaacaattggccgggcacagtggctcatgcctgtaatcccagcactttgggaggctgaggggggcaaatcacttgagctcaggagttcgagaccagcctggccaatgtggcaaaacccctggccaacatggcaaaaccccgtctccgcaaaaaaatacaaagattagccgagcatggtggcgtgtgcctgtaatctcagctactcaggaaactgaggcaggagaattgcttgaacctgggaggcagaggttgcagtgagcagagattgcactactgtactccagcctgggtggcagaatacatgaaactccatctcaaaaagaagaaaggaaggaaggaagggaaggaaggaaaggaaactgcccaacagttttcccaagtgtttgggatggaaggaaggaaggaaggaaggaaaagaaactgcctaacagttttcccaagtggttggaccagttaaaactcccaccacctgtgaatgagagtttgtttttattttgctcctggagtgcctctcctgtagcaggttcccactgaatgtctgggaattcaaatgtaatgcacttgttcatttcctcaagagcttcactccatcaattggattcatccattggctctcccatctccactgacactatgttctcacctctatttggaagacatcctgcctccacctgcccaagtcacattatcttctcattccagcctctcaaggagagttttctctttcaccacctcctctagccctggtgattggcaaggtctcgcaacagtacccttcaaaacactcatgactgtgaatgcactggccttcactaagtttcccattcttctctttctttcttttttcttttcttttctttttttttgaacagagtttcactcttgttgaccaggctcgagtgcagtggcacaaacacagctcactgtagcctcaacctcctgagctcaaggtatcgtcctgcctcagcctccttagtagctgggaccacagacatgcaacgttgtgcccagctgattttcttttttttctttttttttttttttttgagacatggtctcaccctgtcaaccaagtgcagtagcatgatcacagctcactgcagccttgacctcccgggctcatgcgattctcccacctcagcctcccgagtagctggggctacaggcacaagccaccatgcctggctaatttttgtacttcttgtagagaccaggtttcaccatgttgcccaggctggtcttgaactcttgggctcaagcagtcctcctgcctcagcctcccaaaatgctgggattacaggtgtgagccagcacgcccggccatggctaatttcttcatttttggtaaagacaggtctcactttgttgcctaggctggtcttgaactcctggactcaagcaatcctcctgtctcagcctcccaaagtgctaggactaccgatgtgagccaccgcacccggcaatttccccttcttgacttctccagagctctcatccctctcgagctcctgtctcttctagaatcacttacctcaccaccttatggggtttttgcctctgttcctactcctctttatttaagaaaacactgtactttaagagggcttcagaaaccacccgaaatagaaacatgtccttttgttcaatcctttactttaaaagacaaataaaatgaagaattgctctccatgtagaaggttaaggagcttgggaggaccttctgtgagtggggagaactttacattaaaggaaaaaaaatgctggagaatagctgtgaacccaggaagggagaaggacttcctccactgaacttgtaaagcacaaactctaaggcaaaaaaagacatgattacatgaaaactaagatatttgttcaaataaagatgcaattggggccaggtgcggtggctcacgcctgtaatcccagcactttgggaggccgaggcaggcgaatcacgaggtcaggagatcgagaccatcttggtcaacatggtgaaaccccatctctactaaaatacaaaaaattagccaggaatggtgtcacgtgcctgtaatcccagctacttgggaggcttaggcaggggaattgcttgaaccagggaggtggaggttgcagtgagctgaaatcacgccactgcactccagtctagcgacaaagcaagactccgtccaaaaaaaaaagatgcaatagcaggtggttcgggaaccaaaccttacatccagatgctggttgtcccatttcctgtgaatccttgggtgagttatcaacctctctgagcctcagtttcctcgtcaataaaatggagaaaatagtatctacctatggaattgttgtgagttttgaatgagttaatatttataaatcatttagaataggaattagcacatggtaaatagtggatagaatcataaaaaaaaaattgatcaggggttaacttctaactgctgtttgttatagaggtccctagcactgtgtggtcattttaaatttagatgatttagaattaaatgaaatttaaaactcagttcttcattcacactagccacattttaagtgctcaaaacccacaggtgactagtggctaccatatttggcagcacagattgagaacagatttatcatccagaaagttctgtcagacagtgttgatcaaggctacatgagggtctgggtgcagtggctcacacctgtaatcccagtgctttggaaggccaaggtgggaggatcactggaggccaggggtttgagaccagcctgggaaacagagagacctcatctctaccaacattttaagaattagccaggcaaagtgttgcatgcctgtagtcccagctactcaggaggctgagacaggattgcttgagcccaggaatttgaggctgcagtgaactatgagcgcaccgctgcactccagtctgggtgacagagtgagacctgtctctaaacataaaaaataaaaatgtaggtggggcatagtggctcccgcctgtaatcccagcactttgggaagccgagatgggcagattgtgaggtcaggagatcgagaccaccctggctaacatggtaaaaccgcgtccgtactaaaaataaaaaaaaattagccaggcatggtggcgcatgcctgtagtcccagctactcgagaggctgaggcaggagaattgcttgaacctgggaagcagaggttgcagtgagctgagattgcgccactgcactccggcctgggcgacagagcgagactctgtctcaaaataaataaataaataaataataataaagtaaaaataaaaatgcaaagactacctgagggaatgtctgcaagtcaaccagaataacacagcaaccccaataggaaaacaggccgaaaatgtgaacaggcggatcagggaagtgaagtctgaaaagctaatcagcctatgacatggtactcaaagtcatttgtaaccagaaagatggaaatgaaagcagtatctctgtacacctttaatattggggaaaaaatatgtgaataagccaagggtttccagcgatgcgggcacagaggaaagtcttgcaccactcaaaggggtgtggcccagggaggccactctggagacatatcggtagtactcagtccagtgaggtccagcaccatcagcgcttatgtccccaggcatccatcccagggacattcttaccaggtctgttaggggcaggtacgagaatgcttactccagcaccatctatataaggggagctgaaggccacctggtgtccctcctggagaccaggaggcggcatgtgacagcggcacccatggagcaccagaatgagtgagagctccagaccgcatatccgacagatactacgggatggggcttttagaaatatggttgttgccgggcacggtggctcatgcgtgtcatcccagcactctggcaggccaaggcgggtggatcacctgaggtcaggagttcgagaccagcctggccaacatggtgaaaccctgtctctattaaagatacaaaaattagctggacgtggtggcgggtgcctgtaatcccaactactcgggaggctgaggcaagagaatcgcttgaacccaggaggcagaggttgcagtgagccgacatcgtgccactgcactccagcctgggtgacaagagcaaaactctgtctcaaaaaatttaaaaaacaaaaaataaaaatatggttctgggtgaaaacaggaaacaacagaatgtgtctaacttcatcctgcttatgtcagttaaaaatagacacactcaaaatatcgcacgtgtttttgcgagaatgcactcctataaggccaaattaaacattctctcagttgtctctgggagggagaagaatgaaagtagggtatagagagatataggggaattaatgcatgaatgaatgaaggtataaacaagagacaggcgtcatacagaccaaaggtaaagatatcccgtaacctgaggagagcaaagaacttgactctgcatttgaagattcagaaaatgaatttcagaaatagttttctcgccagggggtggctcacgcctgtaaccccaccactttgcgagggcgaggcaggtggatcacttaaggtcaggagttcgagaccagcctggccaacatgatgaaaccctgtctctactaaaaatacaaaaattagccaggcatggtggcatgtgcctgtaatcccagctactcaggaggctgaggcaggaaaatcacttgaacccgggaggcagaggttgcattgagctgagatcacaccattgcactccagcctgggtgacagagcaagactttgtctcaaaaaaaaaaaaaaaaaaaaaaaaaaaagaagaggaagaaatcgttttttcaagaaggggaaagctgggtgatttaagaatgaacttgaagaggatcactcagtcctcaacctaggagtggcaagaatatagactgtatgggaagtggttctgctccttggtacccatcttagaaatatttggcctgagtctgtaagaggcaggtactttatctaacctgaggttagggggccactacatccccatcccctcccctgctttctaaccatgctaacatcttctcactctcctgtctcctctccttctcactcccctaatctgcctattcacattttgggcctgttttcctattggggttgctgtgttattctcactgatttgcagacattcctctgtgtcatctttttaattttgttttaatttttagaggcaggatgtcattctgttgcactggctgtagtgacgtagctcactgcagcctcaaactcttgggctcaaactcctgtcctctgcctccacttctcaactggtaacctcacttctcttcatgaggtctctccagccccagggcctttgcacatgttcccctctcttctgagtggcatatggtagttgctcctctgtaaatatttattgacatcctgacttccaaccagcagagaattgacctccttcccatgctcaggctagtgaaggcatgagtttggctgaggtcccagtggggaaggtgagtggggtggcagagttaaccaggagcagcatggtagaatgggtaaaaccagacgtagcacgcaggcaccacatgttagctggacaagtagtttaaccccatgggtctcaatttccccatcaatgaaagggagaatagaacaagtccctggtaagcagcataaaatgagctctcagaatgtaaagtaacaagcacacaacctggaagagaatacatttagtgaatattggctcctttaatcagcaggttctgatatgacttagctacaattaagaaaataaaaatggaggccgggcgcagtggctcatgcctgtaatcccagcactttgggaggccaagacgggtggggtggatcacctgaggtcaggagtttgagaacaggctggccaacatggtgaaccccatctctactaaaaatacaaaaattagccaggcgtggtggcgcacgcctgtagtcccagctactcgggaggctgaggcaggagaaacatttgaacccaggaggtggaagttgcagtgagcccagattgcaccactgaactccagcctgggcgacagagtgagatttgtctcaaaaacaaaagaagtctggaggccaggaggttggttgcagggttggttccttggctcaacaatgtctccaaagagtccttccatctttccactctaacatcgtcactgtaaggactttttttaacatttaccactcacagccccaagacgactgcgtcagttctttctttttttccttcagacagagtcccgctctgtcgcccaggctggagtgcagtggcatgatctcggctcactgcaacctctgcctcctgggttcaagcgattctcctgtctcagcctcccgagtagctgggattacaggtgcctgccactgcatccggctaattttttgtattttttttagtagagatagggtttcaccatattggtcaggctggtctcaaactcctgacctcaggtgatgcacctgcctcggcctcccaaagggctgggattacaggcgtgagccactgtgcccggccgatgactgcctcagttctaaggtacttacccagccatccacgtagacagacacaaaagcatccggccaaagaagagggagaggaagggctgtctcttaccatgtgactcatctcacggggaaaaaatccttttccagaagcacccagcagatttttcacccagatcctgttaggcctacgaatgggtcatgtgacaagtgctcttattgcaaggaatcttgggaaaaagagactattaggcattttctgcctctttgatgggaggtgggctctgccagtaaggcgggtagtggtggtggctcttggatggacaactgtgtcttccattcttcttcttcttttttttttttttttaagagacaaggtctcactctgttgcccaggcagaaatgcagtggcacaatcacagctcactgctgcctcgacctgccaggctcaggtgatccgcccaccttagcctcacgagcagctggaggagtgtaccaccatggccggctaatttttatattttttgtagagatggggtctctttatgttgcccaggctggtcttgaactcctgagctcaaacaatcctcctgcctcagcctcccaaagtgctgggattacaggcataagccaccacgcctggactctcttctttaaatactgagccttccacctcttctagaatatactctgttaattatcaaccacacttttctacatttttgcttcattattcattcagtaaacatttattgagtgcctactgtatgccaggcacagctttaggtgctggagatgctatgaacaaaacagatgaaaatttctaaaaaataaaataaaaaataaaaataaattttgcaaagccaggcacagtggcttaggcctatagttccacctactcaggagtccaaggcagtaggatctcatgagactgggagtttgagtccagcctgggcagcatactaggactctgtctctaaaaaagaaaagaaggccgggcgcagtggctcacgcctgtaatcccagcactttgggaggccgaggcaggtgaatcgcaaggtcaggagtttgagatcagcctgaccaacatggtgaaaccccgtctctactaaaaatgtaaaaattagccaggcatggtggcaagtgcctgtaatcccagctacttgggaggctgaggcaggagaatcgcttgaacctgggaagcggaggatgcaataagccgagatcgtgccactgcactccagcctgggcaacagaatgagaccctgtctcaaaaaaaaaaaaaaaaagaaagaaagaatagaaaatatctgccctacggggatggacatgctagaacatcaaagtccaatggaactttctgcactgatgaagtatgtatgtatgcaccagccacatgtggcttgggagcacttaaaacgtgactggtacaagcgaatttttcatttaatttaaatgaatttaaatctgtatttaaatagccatgtgtggctagtggttactttattgggcggtgcagctctctaaaggccaagagatacatcatcaacttctctcccttgacccatattcagttctctcccaccctgaaaatctcctctcctacccaggctcacatttccagttcttctcctcttgttctccctcaaccatcagcccccgcaagactgacgtgaccctgatgccgtatgaaatgcattcttcatcctttactcttactcacctctgtgcggccctggagaccagtgacctctcctttctcaaaatactttatttctgtgtgtttttgttgttgctattgtttttggggggttttcttgagatggagtttcactctcatcacctaggctggagtgcagtggtgcgatctcagcttactgcaacctctgcctcccaggttcaagcgattctcctgcctcagcctcccaagtagctgggattacaggctcccgccaccacggctggctaattttcttgtatttttggtagagacggagttttgccatgttggccaggctgatctcgaactcctaacctcaggggatccacctgcctcggcctttcaaagtgctgagattacaggcatgagccaccgcacccagcctcaaaatgcttttgaacttgactgtcaggtatgccattctccacaccagtctcctcccatgtctgtgtcttctccctctccactggggacccttggctttttccacttcactcatctaccctgggttatctggtcttccataaccctgtcctctgccacacctcacttattcacccaccacaatatttattgagtactcactaggccatgaaagatgctatacaaaaaaagcccctgtcctcgtggagctgacattctagaagaaagcatgaataataaatacgacttaataaacagtacggccaggcatggtggctcacgcctatcatccaaacactaagagaccaagatgagaggatcacttgaatccaggagtttgagaccaccttgggaaacgtactgggaccctgtctctacaaaaaaaatattaaaaattagctggatagggtaatgcatgcctgtagttccagctacttgggaggacaaggtggaaggattgcttgagcctgagaggtcaagtccgcagtgagctgtgactgtgcactgcacgccagcctgggtgacagagtgagatcctgtcttaaaaataaataaataaacaaacaaacaaacaatataattccagagagtgaagaggcaggatctctttagctaggaagttgagggatgttctctctgagaaggcagaatctgagtttcaacctgaagaattcgaagaggccagctaggcaaaagatgagagttgaaggaatggggacggcagaggagacagccaatatagtaattctcaataaagcagaaagtgagcttttcctgctggcagaacagaaaggaagtcggagtggccagggtgttgtgggacaaggtggtcagcaggagtcacatcacgcaaggtcatgtggtcatggtagactttaaattttactccaagcctgatggaagccattggaagattttaactaaggagtgacggaaaactggcatctcaaactcaacatgtctacaacccagttcttgatctttgaaaccttcttcctccatcttccccatctccattgacagcaacttcatccttcagttagctcaggccaaaaccctggagtcacccttgatacctctctcctgctccacactcagtctttccattggaagccctaggggctgccatattgttctccatagcacttcacaccgtctgacatactatatcttttcccactattgctttgtccttggtagcatctttaggcactctctgaatatctggcacatagtacgtgctcactaaatccttgttgaataaatgaatgaacatcactccgtggtcctttcagaaccagagccattcttctctttcttcaccaccgttgcccctcaccccgcccaactagtcacaggagttgaaggatgacacagtagagaactgggattctggagtcctgtggctggtctggggttcgagttcttactcagtggtaggaacctccatgtgggattaacttatctggtctttagtttcctcctctgtaaaatgggcctcaaactgccaaccgctgggatgcagggaggatttgatgagcccaggcaggctccctggagcacagcaatcaatggcagctatatataaaccggggcctcttttgtactcccactgcctttgtcctagttccagccctcattacaccagcctgctcttgcggctccctcctaacttctgctccatcaccaccaatctgtcctttcagctgtcaggcttgtcttctgaacgccaaccctaatcacatcccttcctgctccaaaaccttacatgactctcactgtccacaggacaagacccagcctctagttgacagcctccactgtccagcttacccaacctctcccctaccacataccctgagtggagccttctgcctccatagggctttcttagccagagaagcctcccttatcttcctgttctcctcctaattccttcttatccttccagggaggaggctgtgaggtaatgcatcttgggagccagctgggattgcacagggtggtgagattatctgcatttccgaggcttgaacaagttaaggcaatgggaaaggtcacacaatgagaaaatgcagggccaggatttaacccgtctgagatgttctgactgtgctatgctgcctccccggacatgagctctgcgataatgctgtccccaggctgtaatcattccctctttcatccctgcctcctctatccctggggtcagagggacttgtagttgaatctctcactcactcattggtgtggtctctccctaaagcagggtggagtttgtcttagcgttatcactgcatccagcacaacctccctggtccaggcttatcagcgttcaactgcgtcaatgcagttgcctcctcctcaatctcccagcttccggccttgccccctagagagatcatattttaatacaagtcagattacatccctcctcccctcagaaccctccatggctcacaccttactcagagaaaaagccaaagtcctctccacaacccacaaagccctgcaccatccatcacctcactgccttcgtcccctcacaccctcccccttgctcgctctgcttcagccacaccaactcatctctgtttctcaaatacaccaggcatggcctagctattaaatgcacggtccagcctggtgcatttgaagaacacggatgaattggtgtggctggaacagagtgagtgagggggagagcgggaggaggacctttgcaccagctggacctttgcaccggctgttccatttgcctagagttttccctgacatattcatatggctcactctcttgcttcccttgctttctcccagtctttattcaaatgtctatttctctgcacttgtgctgtttgatacagtcaccgctggccacatgtggcctttgagcacttcagttgaaacacatgaaagtgtagaatattgaccagattccaaggaaaaccatgtgcaaaatatcttttatctcttaagatacagggtctcgctctgtcttccagcctggaatgcagtggcacgatcacagctcactgcagcctcaaaatcccaaactcaagtggtcctcccaccaacagcctcccgagtagctgggattacaggcacacaccacaatgccccgcccatttttttaattgttattattttttttaatagcgacaaggtcttgccatgttgctcaggctggtctggaactcctggcctcaagcgatcctcctgcctcagcctcccgagtagctgagattacaggcaggagcttttgtgcccagcaggtctacgatcttcttagaatgcttcaggctgggcatagtggctcatgcctcaaataccagcactttgggaggccaaagcaggcagattgcttgagctcaggagttcgagaccagcctgggcaatatggtaaaaccctgtctctccaaaaaaaatacaaaaattagctgggcttggtggctcccacctgtagtcccagctacttaggaggctgaggaaggaagatcacctgagcccaggaggcggaggttgcagtgagccaagattgagccactgcactccagcctagacaacagggagaccctgtctcaaaataaataaataaataaataaataaataaataaataaataaacaaacaaacaaacaaaccaataaatgaattttacctgtttctttttacttttttaatgtggctactagcaaattttaattttttttttttttttttttttttttgagacagagtcacgctctgtcacccaggctggagtgcagtggtgtgatcttggctcactgcaacctccacctcatgggttcaagcagttcgcctgcctctgcctctgagtagctgggattacagatgcccaccgccacgcccagctaattttttgcatttttagtagagatggagtttcgccatgttggccaggctggtctcgaactcctggcctcaagtgatctgcctgcgtcggcctcccaaagtgctgggattacaggcatgagccaccgcgcctggctataaaatttcataagtagctcttaatagatttctcctgggcagtgctggtctaaacactttttttttttttttttttttttgagacggcatcttgctctgtcaccaggctggagtgcagtggcgcgatctctgctcactgcatcctctgtcacccgggttcaagctattctcctgccttagcctcccaagtagctgggactacagacacccgccaccacgcccagctaatttttgtatttttagtagagacgggttttcaccatattggccaggctggtctcgaactcctgaccttgtgatccgccagccttggcctcccaaagtgctgggattacaggcatgagccaccgcacctggctataaaatttcataagtagctcttaatagatttctcctgggcagtgctggtctaaacactttttttttttttttttttttttgagacggcatcttgctctgtcaccaggctggagtgcagtggcgcgatctctgctcactgcatcctctgtcacccgggttcaagctattctcctgccttagcctcccaagtagctgggactacagacacccgccaccacgcccagctaatttttgtatttttagtagagacgggttttcaccatattggccaggctggtctcgaactcctgaccttgtgatccgccagccttggcctcccaaagtgttgggattacaggtgtgagccaccgcgcccggccctgtaacacttttaacactgaactgtttgccttccaggtggtaaagagcaggtgcctttactgatagaaatgtcaccactcccttcatcccgccagccccatgtcactgacgcgtcctttccccttgctctgtggtaactttctcctaagcactcatcgccctaacatctgtcatacaggtatacctcagagacactgctggtttggttccaggtcgccataacaaagcgaatattgcaataaagggagtcgtgccttttttggtttcccagtgcacataaaagttatgcttacactatagtctgttaagtgcatgatagcattatgtctaaaaaaaaatgtacataccttaattttaaaatccatcaaggctgagcacagtggcttgtaatcccaacactttgggaggccaaggcaggaggattgcttgagcccagggatttgaaaccaggcaacaaagtgagaccccgtttctacaaaaaaattctttttaaaaatagctgggtatggtgacgcatgcctgtggtcccagctacatgagaggctgaggtgggaggctcacttgagcctgagagattgagactgcagtgagctgtgatcacaccactgcactctagcctgggggacagagtgagaccgtatctctcaacaaaaattaaaaaaaaaaaaaaaaaaggctgggcacagtggctcatgcctgtaatcccaacagtttgtgaggccaaggtgggtggatcacttgaggtcaggagttcaaaaccagcccagccaacatggtgaaaccccgtctctatgaaaaatacaaaaaaatagccgggtgtggtggtgcacacctataagcccagctactcgggaggctgaggcacgagaattgcttgaacctgggaggcgggggggagattgcagtgagccgagattgcactgctgcactccagcctgggtgacagactgagactctgtctcaaaaaataaataaataaataaataaataaataaatgttttattactaaaaaagttaacaatcatctgagccttcagtgagtcctcatcttgctggtgaagggtcactggctcagtgttgatgggtgctgactgatcgtgggggtggttgctgaagattggggtgcctgtgacattttcttaaaataagacaagaaagttttccgcatccatcgactcttcctttcacgaaagatttctctagcatgagatgcttgttgacagcaattttacccacagtagaacttttttcaaaattggagtcagttctttcaaaccctgccactgctttgtcaactaagtttatgtcatattctaaatctcatgttgtcattttaacagtgttcacagaattttcaccaggagtagaatccatctcaagaaatcactttctttgctcttccataacaagtaacgcctcatgcattgaagtttgatcatgaggctgcagcaattcagtcacatcttcaggctccacttctaactctagttctcttgctagttccatcacttctgcagtgtcttcctccagtgaagtcttgaactcctcaaagtcatccatgaggatcggaattgacttcctcaaaattcctattaatgttgatattttgacctgttcccacgaatcacaaatgttctttttgttgtttgtttgttgtggattgtttttttatttttaattgagttgaggtctcactatgttgcccagactggtcttgaactcttggcctcaagtgatcctcctgccttgatctccctaagtgctgggattacaggcatgagccactggaacagccacaaatgttcctaatggtatctagaatggtgaatgcttttcagaaagttttcaatttcctttgcccagatgcatcaaaggaatttatctatggcagctatagccttatgaaatgtatcccttaaatcataagacttgaaatagagaattacttcttgatccatgggctacagaatgaatgttgtggctgggcatggtggctcacacctgtaatcccagcactttgggaggctgaggcaggtgggtaacttgaggtcaggagttcaagaccagcctggtcaatatggtgaaaccccatcactactaaaaatacaaaaattagctgggcatggtggcgtatgactgtaatcccagccacttgggaggctgaggcaggagaattgcttgaaccctcttgaagacagaggttgcagtgagccaagatcacaccactgcagcgacagagtgagactctgtctcaaaaaaaaaaaaaaatgttgtgttagaagtcataaaaacaacattcatcttcttgtacatgcccattagaggtcctggataaccagtgcattgtcagcagtaatattttgaaagaaatcttttttctggctgggtacagtggctcgcacctgtaatcccaccactttgggaggccgaggcgtgtggatcacctgaggtcgggagttcaagaccagcctggccaacatggtgaaaccccaactctactaaaaatacaaaaaaattagccaggcatggtagcaggtgcctgtaatcccagctaccctggaggctgaggcaggagaatcgcttgaacctgggagtcagaggttgcagtgagctgaggtcgtgccattgcactccagcctgggcaacaagagtgcgacttcatctaaaatacatatatatatataacatgttatatgtaatataaattatatatataacatatatgtaatataaattatatatcacatataacatatatcatgtgttatatatatcacatataacatatgtgttatatatcacatataacatgtgttatatatcacacataacatatattatgtgtatatatgtcacatatattatgtgttatatatgtcacatataacatattgtgttatatatatcatatataacatatattatgtgtagtgtatcatatgtaacatatattatgtgtagtgtatcatatataacatatattatgtgtagtgtatcatatataacatatgtgtagtgtgttatatataacatatattatgtgttatatatctcatatgttatatataacatatattatgtgttatatattatatatatatttttttctgagtagatctcaacagtgggcttaaaatatcagttatccatgctataaacagacgggctgtcattcagtcttcattgttccatttatagagcacaggcagagtagattcagcataattcttaagaccttaggactttaggaatggtaagtgagcattggtttcaacttaaagtcaccaggagcactagctcctaacaagagagtcagcctgtcctttgaagctttgaagccaggcattgacttctcctctctagctatgaaagtcctagatggcaacttcttccaatagggcatttcatctacattaaaaatctattattcagtgttgccagcttcattaataatctcagctagatcttctggataacttactgcagcttctccatcagcacttatcacttcaccttgcacttttatattatggggacaccttctttccttaaacctcatgaaccaagatcttctagcttcagatttttcttctgcacttccccacctctctcagtcttgctgtgggcttgctgtggattaggctttggcttaagggaatgttgtggctggtttgatcttctatccagaccactaaaactttctccatgtcagcaagaagcctgtcttactttcttatcattcatgtgtttactagagtagcccttttaatttccttcagtaatttttcctttgcattcacaacttggctaacctctagcttatggccttttgtttgtttgtttgttttgtttttgagacagggtctcactccgttgcccaggctggagtgcagtggtgcaatcaccgctcactgcagccttgacttcctgggaccaagtgatcctcccacctcagcctcctaagtagctgagaccacaggtgtgcaccaccacacccagctaatttttttattttctgtagagatagggtctccctattttgcccaagctagtctcaaactcctaggctcaagccatcctctcacctcagcctcccaaaatgctcggattacaggcatgagccaccatccctggccctatctcagcttttgacacgccttcctcactgtgtttaatcatttctagcttttaatttaaagtgagagacgtgcaactcttcttttcacttgagcacttaaaggccattgtacagttatacactgacctaatttcaatattgttatgtctcggggaataggaaggcccaaggaaagcgggagagatggggaaatggccagttggtagagcagtcagaacacacacaatatttatcgatcaagtttgccatcttctatggatgtggttcgtggcacccccaaacaatgactatagtcacatcaaagatcactgatcacagaccaccataacagatgtaataattatgtaaaagtttgaaataccgtaagaattaccagagtgtgacacagagacgcaaagtgagcacacgctgttggaaaaaaaatggccctgatagacctccttgacacagggttgccacaaatcttcaatttgtaagaaacacaatatctacaaattgcaataaagcaaagcacaatgaaatgaagtcttcctcggccggtgtggtggctcacgtccataatcccagcactttgggaggccaaggcaagaggatcccttgagcccaggagttggaggccagcctgggcaacacagggagactccatctctagaacaaaacaaaacaaagcctgcttatatttattgggtttactctcagtctcccccacacagagatagggcctggcttgttattagtgctcagttgatgtttgtgaagtgaaatactaaggacttaaccactgcctgttctttgctgttcatgccctgacagcttttatgtgccagcacagaagaaaacaaggtgcaagaagagaatagtgatctctaagtcagaatttgaggaacccaaattagtaccagaaagctgggaggagaagagaaaaataaagtaaatcaaattaaaagttgaatgggccaagtgcagtagctcatacctataatcccagcactttgggaggctgaggtgagaggatcacttgaggccaggagttctagaccagcctgggcaatatagcaagaccccatctctacaaaaaaaattttttaattttctgaatatgttgttgtacacctgtagtcccagctgcttaggaggcagaggtgggaggatcgcttgagcccaggaggttgaggctgcagtgagctgttgttgcaccactatactcaagcctgggtgacagaataagtccctgtctccaaaaataaaaataaataaattcattttttgtaaagttgtatgtcatggcccctgcctactctggcttcatgacttgctgcttgaacctcaccatccaaatcccagtggtgacaccatgtcatttcttgaatttgccaagccctctttcagtcccaagctctctgtcatggccactctcagcctggaaagttctttccccactggccagatttctccccctcatctatgggaacttgacttgaagtagggggtatcccaggccctggactagttaacacgacctgctgtgtgcccctcaaagccattgtcttcctagctgagaaggcatcacacctgcaacagattcactcattgtgtgcatgtttttcttaaccacttctcttctgcatcagctccatggggcagggatagtctcatatgtcactctacccagcacataggatacgctcagacgcccacttgtggatggtggaaaaggtcagcccaacctaatatgcccatctctcctctaggggtaatcttgagaaaaaaagttgggaacttgctttgtgttagtttaggatgacccagaatagatcctgaaacaagaatttagggcaatccttgtgcaagtagttcatctgagaggtgaccccagaagggttggagaaggagaggggaggtggggcaaggaagggtgagttgtcctgtaggcaactgagctccgtcctactgggagcccacgtggaactcacctcttaagtgatccagaatgaagggtgagggagctgcggtattgatccaccaactcccagcaatctttggttgagggctgctcccttaaagttcattccctgggcctgccccagatttggagacagccctaaggcaagaggtacagataccagttggccacagactgaagtgttaagacccaagcccctggataaaactgaaaaatcaagccagatgtggtggttcccacctgtaatcccagctactcagtaggctaaggcaggaggattgcttgagcccaggagttcaatgctgtagcgagctatgattgcaccactgcattccagcctgggcatcagagcaagaccccatgtctaaaataaaaataaactgaaaaatccccaagttatttgctgtgaccaaccttccattaaccacagaccctctggtattcagcatttcttgtccattatatgaagttctgatgacagtctcttttattgtattgtgccttgaccacgcactgtacatcacttagctctgaaatggacatgttcaggaaacagggccaggtgggaccctgtgtttcaacagcaatacttttacaaatgaggtctcatgacagggtcttgctcggagggtttctatggaagcctcatcccacctactgctatcatccttactaacttgcatttacaaaagggactctttttgaccagaggcttggggtctgtagctgccttctagccagctgatgctggctggtccacacaagcaggatcacacccatttttttgttttcttatttatttctgaataggttagcataccggtaacctgtgtgcctggcattgtgctgaccactttttgtcaacttactgaatcctcacaacccttggaggtattgatactattgttatccaggttatacaaaagggggaaactgaggcacagagcagggatgtcccttgcccaaggttacccaactggaaagtggcagatctgggatctgaacccatgcaggctgggctcttaacactgaactactttcctgccatttgttaaagagccacaaaccaggccaggcaccatggctcacgcctgtaatcccagcactttgggaggccgaggcgggtggatcacctgaggtcaggagttcaagaccagcctggccaacatggtgaaaccctgtctctacaaaaatacaaaaaaaagtacccgggcatgatggcgggtgcgtagtaatcccagctactcgggaggctgaggcaggagaatcccttgaacccgggaggcagaggttgcagtgagctgagatcacaccattggagatcgcactccagcctgggcaacagagtgagactctgtctcaaaaaaataaaataaaataaaataaagagccacaaaccccgaaaggtctgccattcccccagggccccaggccaccccacaatctattgtcattgtaggttgtgaaatatactgaatgtcaccccaaccttgagccatggggaagattccatttctctcattgcaacatttgtgcaacatgaaccatctgttgggggtcttcgtaaatcaccttttatcccgtgaggcaggtactgttaagaccattttacaggtgacaaaactgaggccagtggtgtcgagtcacctgcctgtggtcacccaaccaatacaggacagcttggaatcccaagcacccccgccctgctgtctgacccccaaaacccaccctctgttctccattctggcttctttctttcagcatcttggcgacagttgggacggagtttgacctacggacgctgagggcagttcgagtgctgcggccgctcaagctggtgtctggaatcccaagtgcgtgagtttccgaccctgacaaggggtttgctcacgggccccaggagccctcagtttcccctatgcagagcatctcaggaggccacatcctgccaccagcctgtgtgagggcagtctcttctttgggactccctatagggaaccccctaggaatatgactgtagctccccatgagctcctgaaagcaaactaggagccacacccatttattgagcacctactgtctatcgggagccatgctaagcaccacgtgtgatctcattcagtactcacagccctatgaagttgataggactgatgtctctattttatggagggggaaactgaggctcagagtggctgaaacattggagcagggttttgtggctgagaagtggcagaactaggagtgagcaagtgtgactccaagcctgggccgtaccactggtggcaatgaccattcccatttaatgagtgcctgctgcgtgcagggcactacagaaggactttacatgaattaccttatttcatcctcacagtcacccagcgaacacccattttacagatgagacggttgaggcttaaggaggttaaattactcacctgaattcttagagtggacagtaatgagctctaaaattcatactcattccttgctgctttctcattctccacagatacatctagtccccgtttaagggtggctgccatatgcagggtcaagattaagtgtaggttgagccaaaaaaaaatgtaaaaagcaaaaataaaacagggctgtcctttttctatcttcttgtcttggttaataataataatttagccaggcatggtggctcatgcctgtaattccagcactttgggaggatcacttgaggccacaagttcgagaccagcctgggcaacattgtgaggaacaccacccccacccccccgccaatatctacaaattttttttttttttttagaaattagccaggttgactgggcacagtggctcacacctggaatcccagcactttgggagaccgaagcgggcagatagagcgagctcaggagttttaagaccagcctgggcaacatggcgaaaccctgtctcaaaaaaaaaaaaaaattagcaggcatgatggtgcacacctgtagtcccagctacttaaaaggctgaggcaggaggatctgagcccaggaggtcaaggctgcagtgagctgtgatagcaccactgcactccagcctggacaacagagtgagaccttgtctcaaaaaaacagacaacaaaaagtttaaaaacaaacaatttataggctgggtgcagtggctcatgcctataatcctagcactttgggaggccaaggtggatgggtggatcacctgaggtcaggagttcgagacctgcctggccaaaatggggaaaccccgtctctactaaaaatacaaaacttagccgggcgtggtggcgggcatctataatcccagctactcgggaggctgaggcaggagaatcacttgaacccggggggcggaggttgcagtgagctgaaatcacgccactgcactccagcctggatgaaagagtgaaactccgtctcaaaaaaagaaaaaaaaaaattaaaaagcacttactatgtgccagacattattctaagtatttccatttttttaaagtcctttatcctcccaacaagcctgtgaagtagtctcttttattatcaccattttacattttattggcttcgttcttccggttcattgctacccaggtttaaagagtaagatttcccagaggatcaccagcaggatctttttgtagaaagaagacacttctatccaaggtctctgcaagatcccagcagatgcctgcatcatattaaattaagggccatcccaaatctaatagtcaaaagagccaggtgcagtggctcacacctgtaatcccagcactttgggaggccaaggcaggacgattgcctgaggctaggagttcaacaccagcctgggcaacaaagtgtgaccctgtctcaaaaaatatatgtatattataatagcagtagtaacaagagtctctgtttaatgaccacctatgacttaccaggtacttcactgtgtgtgaactctctcatctaatcgtatgagggaggtactattgcagtccccatttacagatggagaagctgaggtttggaattcactagtaagtggatgactaggtcaggttcccttgaagcggatacttaggtgggtgttcagatgcacctgctttattgggggacggctcttgggagagacagcaggagatcagcagggtggggctggggaatggatagagcagggacgcaatttcagctggagtgtgtgtgacaccagagttgtcctccaatgcatggcaaggatgccggccttttgtacttctatagtcagtcactgtggatgggaggtagagacgcagtagctcccaggtgagatagcttttgatcaccaagggcaattctactaagaagagaggcagctgggaggcattagcaaccaacatccatagcagctggagggcgggtacaccagaaagaaaatgggatcttggccagacaccaagagtatccagcaccttaaccactgcaccacactgcatctgttagcacccacattacattttttttttttttttttttttttgagacggagtctcgctctgtcgcccaggctggagtgcagtggcgagatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagcacccacattacatttttaagcccttggagtggcatggcccctcgagctatcctgacagcttccctctcttactgtggtctccacccatcaagagccatgggaagttcctgcaatcaagaagcaaagcctcaggctatatgtttgaaccttcattttgatcatagactttcctagtagataccatagtggttacaaacataggatgttgtcatcgttcagacctgagttaatagcctcaagaaaaaaatggtagtggaaccaggtatggtgaagtgtgcctgtagtcccacctactcgggaggctgaggcaggaggctcgcttgtgcccaggaggtcaaggctgcagtgagccgtgatcatgccactgtattccagcctgggtgacagagcaagcccatctcaaaaaaaaaaaaaagccaatgataggcagagaaatactaactaaggctcttgctctgtcgccaggctggagtgcagtggtgcaatcacagctcagtacagcctcaacctccccagactcaagcaatcctaccatctcagcctcccaaatagctgggactccaggcacacagcaccatgcccagttaatttttttgtattttgtagagacagggtttcaccacgctgctcaggctggtctcaaactcctgagttcaagtgatccacccgcctcagcctcccaaagtgctgggattacaggtgtgagccaccacgcttggccagctattattattattaacattcttcgagtcttacaacagtggaacttttagtgcaggatgcgaatttcagtattaaccccttcctctcccaaaaggatttgaagcccagagtaattcagccgccatgaatgaaccatttgttagatgagaggctactggaggctgagcttggtaggataagagcttgcatggggtccctgattgatgacaatacccccagatttaggtcttcagatgcccagttgggtgtgtcttctgttccactgtgtcccttcggggactgttccctgccttctttctttttgagatggaatctcgcactttcacccaggctggagtgcaatggcgtgatctcagctcactgcaagctccacctcccgggttcacaccattctcctgcctcagcctcccgagtagccaggactacaggtgcccgccaccacgcccagctaatttttttgtatttttagtagagacggggtttcaccatattagccaggatggtctcgatctcctgacctcgtgatctgcccgcctcggcctcccaaagtgctgggattacaggcgtgagccaccacacctggccccctgccttcttattcaccaccatctttctgaattgggttgctcagaacagagaaagcaacatcagcacatgggcaaacatggggcttcatttcagatggacctgggttcaaatcctagttctgcctttttttttttttttttttttttttgagacagagtcttgctctgtcacccagactggagtacagtggcgtcatcttggctcactgcaacctctgcctcccaagttcaagcaattctccttcctcagcctcccaagtagctgggattacaggcgctggccaccatgcccagataattttttgtatttttagtagagatggggtttcaccatgttggccagacttgtcttgaactcctgacctcgttaatccgctggcctcggcttcccaaagtgctgggattagaggcgtgaaccgccgccgcgccctgcctagttctgccatttctcatgcattctctgggtgaatcacagcatctctgttagccttgcttcccacttctgtaaaatgagagtgactttacatgtatggccacctcaggggcttgtcactagaagccagtgaaataatgttgagtctggttccttggggttgaaattgggaccgccaaccgctttcctacccagagcagcaactagcctatatggcggccttttatgaatgaggaaaagacaccgcctcttggcagaaaaaaaaaattaagaaaatggctccctcttctgggtgcaagttgcccaacacccaggaatatggctccaaaagcaatggactcccacccctttcttgcccaaaagatcatcaaatggaacagcatgtcaaatacctttattaagtactttaaagttggctgggctctgtggctcatgcctgtaatcccagaactttgggaggcagaggctggaagatcgcttgaggtcaggagttcgagaccagcctggataacatagtgagaccctgtctctataaaatatatatatagatttatttgagacagcgtcttgctctgccactcaggctggggcgcagtggcacaatcatagctcactgcagccttaacgatcctcctgcctcagtccctagagtagctaggactacaggcatgcaccatcatgcctggctaattaaaataaataaataaataaatactttaaagttaaaagtgctttttaaaaaataataaggccaggcgtggagactcacgtctgtaatcccagaactttggaagaccgaggcgggtggatcacgaggtcaggagatcgagaccatcctggctaacacggtgaaaccctgtctccactaaaaatatgaaaaattagctgggcctactcgggaggctgaggcaggagaatggcgtaaacctgggaggcggagcttgcagtgagccgagatggcaccactgcactccagcctgggcgatataacaagactctgtctcaaaaaaaataaataaaataaataataataataataggggccaggtatggtggctcacacctataatcctagcactttaggaggctgaggagtttgagtccttggagaccaggggtttcaggccagcctgggcaacatagcaagaccccatctctacaaacaagttttaaaacttagccaggcatggtggtgcatgcctgtagtcctagctattgcagggactgaggcaggaggatcacctgagcccaggaggttgaggctgcagtgagctgtgattgtgccactgcactccagcctgggcagcagtgcaaaaccctgtctcaaaggaaaaaaaaaacctaggaagtgttgttcccatgataaggatcagcctccgtgtggtgcttccttcaccattgcccaatccccaggctcctgggtgcttaatattccctcaggaacacacctgctttgtctgggagagacctgggcgtcttggtggcggggtttgggggtacttgctcatgggcttatggggcctctctctgtgtccccccaggtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacaggtaggtccacggagcatgatgcatctttccagttttctccttcagggacaagctcttgggaggattaggcaggggtgtgcttctttctcctggcagctgggaggaccgtctccttcagagagcactacaggagaggcagtgagtgaaatagcctctgagatcttagctgttgaaaggggtggggttccacagaaggtgacccagcagagaaagagtttatttgggaatgatcccaggaagcaccatcgggggaatgaggaagtgagcagagaaagaagggatcttttaaagagtgtgctatcaagcgggttaccacttaaaactgggactggatccccctgggcacctctgggagacagcaaagaacacacaactcagctggtcacggtggctcacgcctgtaatcccagcactttggggggccaaggcgggtggatcacctgagatcaggagtcagagaccatcctggccaacatggtgaaaccccatctgtactaaaaaatacaaaaattagctgggtgtggtggcaggcacctgtagtcccaattactcaggaggctgaggcaggagaatcacttgaacccgggaggcagaagttgcagtgagccaagatcacaccactgcactccagcctggcgaaagagtgagactccatctcaaataaataaataaataaaaatataaataaaaaaagaacacacacctcagagccgtcccagccaaggggcaagggagctggggtatttatacactggcttctttttgacattggtgaggactgctcctagagtgggaattaatgcctggcacatctggctgagtggaacaggtattctgggtgctttcagacctcgaccagtcctgacttctaaagcaagcaagaagtggggagagttgggccagaaaagggttattgcctcaatgcattgtgagtggtaccttgtggaaggtgagagacagagaagattccaggcacaggtgccatgctaaacgatagttctcatttattataggaacccatggatttattttgttctctgccctgagtgctgggtgagagtactggatgagtcctcctggtctcccccaacccccaggatgtaccagagataccccaattgggagtcctggcaccaaccaatcagaacctagcactcagcagcattctgcccctccctgactatgcccacattaacccttcagtggctgggtctgggggtagggtgagccccggaaaagccaggcagcgcagagacactctcccagggctcagctctgaaccagcagtgtggaagcagtgtgtccaccacgatccacactcaggaaccaaatagcccttggatacgttttcagttaaatctttgccatccaaactctagctgcttgctctctaaagctccagaatgaaatggaatcaagtaggaagggatgccttcagtatttcagtatttggaccactggccatctgggtgcagacagactgaatagcagttctggttctgatgatttgggtcaagggagctgtgaattgaaggagtggatagaaggaatcaagaagcccaaaggggaacccaggtgggcagagaaagaggtttcaggccccttatttgggaaaggcagccacagaagaagattctgtctgggagtggatttccacccaccctctccacccagtgacccccaagtggatccgcagaggcagcccctgagccctccctccccactcctccccacggggagggaaaacccactggggaaggtttatttgcaatggttggaggtttgggtttttttgtgggttttggtttgttggttttttttttcctctttttctcttgctcctcctgtctctttctctcctgggcttgtgaagtttgctcaatatggaatgtcctaattatttctttccccgatgaagaaggtgttaattgaggcagagctatttctgctcctggcctcgtcacccaggcggaaatgcgagagagagagagagagagagagagaatgaatatggggcagggcctcttggaaaaatcagccgtgagcagagaaaccaggactcctggatcctaggtttctgtgaagttttattttatgtttttctaccctagactagctaaaggagaagaggccatggggttggcttgggtccgagtggggttttgaggggacagatgtgggtggtgccaccagaggggaggaagcctcgatttaggagaaagactgaaaagctagctcacgattaaaaatataagacgtgtgagtaagagacagatatatacagacacccaggcagtgggttaattttaaaatgtatttataaccgaattcctcagacactctggacgcttgtttttctagaagcaacgctcagagtgtttcgtgtcggtggttggggggttgagggggattgcaaagctgctaaagatagacccgttttcagtagcattcctcagtgtcgggagcccagttcctgtgtgcccagcaccgtgccaatcgcttagaaggaagcaaagataaagtggaaggcttcctgctttctaagagcttccaaaatagttagaggaaacaagacccctcatttgcagccatttttaacagtgaaggctaatgtgtgattatacccacgcccccctaaatatgaaaattcagtagctattgtatgcctgaaaggggccaggtgcagtggctcacacctgtaatcccagcactttgagaggctgaggtgggagtatcccttgaggccgttagtttgagaccagcctaggcaacatagccagaccctgtctctgctaaaataaaaatttaaaaattggccgggtgcagtggctcacgcctgtaatcccagcactttgggaggccgaggcaggcggatcaaaaggtcaggagttcaagaccagcctggccaacatagtgaaaccccgtctctactaaaaatacaaaaaaaataaattagccgggcatggtggcgtgtgcctgtagtaccacatacttgagaggctgaggcaggagaatcacttgaacctgggacatagaggttacagtgagccgagatcacgctactgcactccagcttgggcaacagagtgagattttgtctcaaaataaaaaaatttaaaaattagccatgagtggtggtacatgcctatagtcctagctactcaggaggctgaggaagaaggatcacttgagcccaggaattggaggctgcaaggctgcagtaagctatgatggtgcccgcactccagcctgggtgacaaagtgagaccctgtctcaaaaaaaaaaaaaaaaagagagagaggaaggaaagaaggaaggaagggagggagggagggactggggctgtgttaactgggctacacaaagaggctacatggagggtgggaattgagccagacttggacatggcgtggagacagagaagattccaggcacaggtgccatgctaaacgatagttctcatttattataggaacccatggatttattttgttctctgccctgagccttatgtttaaaagatttttgccttccaacctgtatttatcaaataatagttcatgtaccaagtccagcataagtgaggaaggcgtttccaacaacttaagttcatggcgaggctagacttggagtttctattcagccagagcttgaaaggccaacaagattcattcattcagcattggtttatttccctctgctgtgtgctcagtcaagggagcagagaattggtgctgcgaagtctgtagcacatacattgagagatatttttgttgagtaggaagcttgagtttacacacactcagctgtttgttttcttgtccgacaatgccacggtcgtctttgaaaaccttcaaaagcatcgctcacagaataaggtcctctcagacccgctgtgctggtaaaatgaggacactcccagatgtgagctttcctgcctccctaccccatcaataccttaagatttggactgacctttagcgttcagcctgactgccacctccccaggaagctgtctttggtttccagcaaaaggggtgtctgttggcacgtttctctctccttgtggcattttcacagcctgcctcctgctatttggggagaaagctcagctcctgttccttacccttaggcaagggtaggaactgtgtgtactggtgtccctcacccccagaacagctccctgagcccagtacatcccaagaagaaaaaaatcagcaaggcttataggagaataacacaatgcgcttgacaaatttgtcctaatggatgtcggaagaaggctgcacttaccagctacaccatgcacacggcacatttactaaaactgactatattatggaccataaagtttgtctcaacagaggtcaaaaagctgaaaaaaatacaaatacaaaacatattttctgaccgtaatgcaattaagctggaaatcagtaacaaaaagagaactctaaaagtgtttgcagattaacagacatgcctctcatttatggatgaaatgatatgatgtctgagctttgctttaaaaatattctaggctgggtgcagtggctcacgcctgtaatcccagcactttggaggccgaggcgggcggatcacttgaggtcaggagttcgagaccagcctggccaacatggtgaaaccccatctccactaaaaatacaaagattatccaggtgtggtggtggccacctataatcccagctacttgggagcctgaggcaggagaatcccttgaacctgggagtcggagattgtagtgaggtgagatcatgccattgcactccagcctgggtgacagaatgagactccgtctcaaaaaaaaaaaaaaaaaaaaattctagtggcaaggcaaagtgtttggaggggatacagaggaatagatgaaacaaaatttgccagaagtaaataggtaagtgtctaaattggtgataggtacatggtgaatcattatattgttttatacttctctctcgctctctctctccccccgttctctccctgtcttcctctcccctctgtcttcatatatatatatatatatatacacacacacacacacagacacctaataagtttttttaaaaaacaaatacatctaaattacccataggtcaaagaagaaataataatggaaattagaaaatattttacttgaacaataatgataatgcatgacaaaatgttgagatgcaggtaaagccacacttaaaggcaatttatagccttaaaggcagttaatccatccatctcaaaagtttaggaaaagaatagaaaaaaaaaaaaaactcatggaaaacataaagagaaaagtagtaaagctcagagaagaaattaatcaatagaaaaccaataatagacccccaaagccaaacattgatctctttgaagactgatcacgtttgtcccaaaagttattcgttccaacagcattatagagtcactggtccctatttctcagagctggttttccctgctccttcccctgacttttctccccttcccttttgtagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatgtaagtgatgctgggacagtgtgtgtggacaatcagagtctcagggaggtggcctcctgggaccagtgagactccaaggctgcaatggagggaccctgagctgggaaaggcagcccaaggacaacacagccccactgaagctggcctgaggctcaggcttttgaagattacaggggctcatgagcagaactctaactatagggcatagaagtctggagggcccccagatgcaacatcatttttcattgtgcaagtgtttagatataattttagatttttgaatacggaaaggttatgtgatccaaaaaccaacacagataaaagatagagtaatatctttggacgtaggcgaggggtccctgccctgaggctcacccagtccttctccagccataccactccccgtgggatgagaagttcctggagccaaggggatgtgtctaccaagagcttgtgccccactttgtaggccatgttttaagttaccaggatcctggaattccctgcccatggccagattccatgaacttgcgtgcaattctcatatggatctgttcgtaacccaactgagggccaaggacatccgaggggtggctgttaacacaaatgtggccagagcttggatgtacaagctggaatgcccacacatatgtgtggagcccctctggcaggacagagccatgactaagaagagaaagggacaggacagggctggctctccccacaccttgacccagtgcagatatccggattctaaattccaccctgaccttccaaagtgtaaaggaaggtatatttgcaaagtagaagcacacagcatgttttatttagttaccttttcaatatttccccgtagtatgtggtctgcttttgtactcttgccctagatcttaaaaatgttagggatgtttctggaaagatgtatccctgcccccacttgcatgctacttcctcttcccacaatatgcaacccctttagttcctcagaatatccttccaatgtttatttatgcaattataattataagcataatcgaatctatgtcctcccccctctttcttatcccaaggagtagcattctatacatgctgttcaattctgtgatttttgttttctcataaccacacgttctagagatctttccactgcaggacatggacagtctcttcacgggtgcacactagtatgcccagctaatttttgtagagacagggttcttccgtgttgcccaggcaggtctggaactcctgggctcaagcaatcctcccgcctctgcctcccaaagtgctgggattacaggcgtgagccaccacgcctggccttctttattcttttgcacagctgcatagcattctattgtgtggctgcccatagttttatttgtttgccattaagagaaatgcttgactggcttcctgtccactgacatggaacatgatgctgctctgccaggagcatgttgcacgtacctcttcatacttttgcagatatagctagggggttggagggtctccattcccagaagtgggattgcaggatcaaagactaaatgcatttataattttatttttggggaagatttttgttttgtttttttggagacaaggtctccctctgtcgtccaggctggagcgcagtggtgtaatcatagctcactgcagccttaaactcctgggctcaggtgatcctcccaccccagcctcctgagtagctgggaccacaggcacacaccaccatacctagctaatttttaagaacaattttatagagatggggtctcactatgtttcccaggctgctctcagactcctggcctcaagcaatcctcctgcctcagcctcccaaagtgctaggattacaggtgtgagccactgcacccagcctaaatgcatttataattttgatagatatttaggtgtgcaagttttaaaccccactctgtcctcaccacagttcaccttccctcacctactatgcaggtaagcagtccccaggcaggtcacttgtcagcagctggagtggggcagagccaaggattcaggatcaaacacaaggatgccacaactgtagtgaccccatagagcaccctggggctgctccatacacacagctctgttgaccagtggaggtctcctcttcacctgccctaagggctgaaattaccattgaagtttaggccagcggttggcctgacccgggagcaatacctggcttcctcctcctgtacatagagaagctgaactttcctcttggtcctagtgtatgttccttaacaacccatttatgcctagtgttccattattggaatgctaatcctgtgggagttatttacatcctgctgctcaaggtcatcactaaggtcggatttttcacacacacaaaaattgcaacctccggcataaatgggttaaggaatttccccacttgtgggtggagggagatttgcaaaaactcatccttgtaatcctgatcaacaaaggcccgttttagttgggagtaggcagcaaaaggagccacatgaacagttgcgcctgtcacgcactgcacaagaatgtcattcatatcatagacaacatacgatttctactgttatcctgataatttattgacagaaaaaaggatgtggggaagggacatggtgttctaatttgcatgaaaacctcgtctgagtgtagcatctctgggaacatgcagcagatccgagctcaggccctctcttggccgtcacctgcaaacagcttggacaaagggtcagcccaattggccaaaactcactggggaatttttgtgggttctaggtttttactttgcaaggctggtgtgagaggaggttccagcaggaaatgaaccctcctgagagggaaagagactgggaaatggagaaggctgggaactcagggagagaatgggagtggggaatgggagctgaaaaaaattgtgagcataaaaaagggatatgtcacagggttggatgaccagagaaagcgtctgggggttcagattaagatgctgggggcgtgcccagtggtgggacaggaagcatgaatttccagagggctcggttataaacatcattgtccaatgggtgtttcccttggaagcctctaagcttagagctaagccacctctggggacacaaactgagtggttaagagcagagactcaggtgtcagcctgtctgggttccttccgactcttccacttccttgctgtgcagccttcggcaaggtgcttggcctctctgtgccactatttccacatgtgcaaaacgaagagaagcatagtcccacctcacaaggcacgaggactaagtaaggtggattcgcatgaagtgtttagaactgatcctggcccggggtgacctccgtgtaagtcaaattccccaccctgcatggtgttccttttagaaatgtgcatgaatttttcattagaacagctccagcagtgcctgaggaagtggagtgaggtgtgagaggtcttactttattcccctcgctggccctgctattaaccactaactcagagtagctttctagcactttccacacatttacatcccaccctcgtcctttggttagcagcccatgcaatgatttggccttaatgtgaacctagaacacagcttctcgcccagggatgatttctgcccccaggggacacttggcagtggctgcagacatttttggttgtcacaactggatgggaagaaggaggatgctattggcatcaagtgggtaaaggccacggatgctactcaacattctacaatgcacagcatcccccacctctgccccaccatagagaatgatccaggcccaaatgtcagtaaggtttctgtcaggaaaccctgggtcagaagaccaaggttccttgaggacggggatgccttatactgcaatcagctgtcactctctgcctctctctggggctgctgtgatcacctggcctgcatggacaacccctaggagcagcccccatccagtgcctggagaagtcagtggataaataccccagctccctccctgtcgggcgttttgctctgccctgcatctctccagtgggatcaggctctggttgcccgcagggttaacctggtcacgtacacacccttcacttgccaccttcccttccctgtctggtatttcctgggatgaacttttagatttatttcctggggctgctataatgaagcaccacagactgagtagcttaaaacaacaggaatttatggtctgacagttctggaagccagaagtccaaccccaagatgttagcagagctgacaacacgcccctcaaaagcctccgggggaggatccttctttgcttcttcctggcttttgctggtttcccacaatctttgggattccttggcttctagagccttcattctccattccagtcttctgtcatctaatagcatcctcccagcccgggcacagtggctcacgcctgtaatcccagcactttgggaggccgaggcaggcagatcacttgaggtcaggagtttgagaccagcctggccaacatggtgaaaccccatctctactaaagatacaaaaattagccaggcgtggtgggcgggtgcctgtaatcccagccacttgggaggctgaggcaggagaatcacttgaacccgggagatggaggttgcagtgagccaagatcatgccactgcactccagcctgggtgacagaatgagactccgtctcaaaaaaaaaaaaaaaaaaaaaaagaaaaagaaaagcatcctcccttcgtgtgtctgtgtgtgttctcctcttcttagaaggacatcagttgtattggatcagaacctaccctactccagtccaacctaattttaactaattacgtctgcaattaccctatttccaaataagatcacattctgaggtaccagggggttaggacttaaacatttttgtgtgtgtagcaggaggacgtaattccatttataactcctcctaaataaaacgacttgcatgtgaactcttgtctggggcttcccaaagtgagataacccctctctctacccctaaaacaacgagtagcgtctgtcaatgccagggtgcaggggctaaggtgcccatctttgagtttctgctgaggaggacacagctgctacgttggagcactcttgggttctgccttcgtgcccagccatctcccttgggctagccctgccctgggtctatcctagaatgagcctcgatctgtttggccataggcaagcagagtgtctggaaatctttgtcctccatgactggtgctggagccgaagccagtgggtgtggccttgccagccaactccatttacccagctctgaacaagctagtagttgagatcaacggagagtccagacagtcgctccaagcatcttggaatccatggacacaggtgtaccgcagaggcttcccacctgggtaggcagccctttgtaagatcctggcaccacatttattctcttaacatcctttcagttatccagtaatcatttattgagcacctactgtgtgccaggcaatgattaggtgattggagacactgcaacgaagaagacagactaaaatctccaccctggtaggagagacagatgcaaatggtaaacatgataaataatcaatcacccagaaagcaggagacactaagcaaatgtgtatgtactatgggaagcccaataggaacgaaagctacacaagagaacaagtgatgggtggttccttagtctaggtcaggcaatcagggagggcttctcagaggaggtgatgtttgagcagagaaggagggagccaggcagatgttttggaaacagcattctcagcatggagaacagtggcagctcacctacaggatgtgtttgattcccttccagattttgtattcgtttcttgtttttctcccttggcttcctggtttaaatgccttttgaagaaatctaagctcaactaatcagcgatgctgttgaaggtttatatcaggatatgcatcccagagttatttacaaaattagaacaaaactggaagcaattgaaagcctgacaataggagatcagttaaataccgtatggtccttccgtatgatggcatattatgtcatcattaaaaatcgtctgctgggagaatattaaggatacaggggaaaggctcaccatataatgatgagtgggggtgctgggcgcagtggttcatgcctgtaattccagcaatttgggagtctgagatgggtggatcacttgagcccaagagtttgaggccagcctgggcaacacagtgaaacccaatctctacaaaaaaaaaaaaacaaaaatacaaaaatcagccaggcatagtggcgtacatctgtagtcccagctactcaggaggctgagacaggaggataggatcacttgagccctggagtcagaggtggcaataagccgtgatcacgccactgcactccagcctgggcaacagagtgaaaccctgtcaaaaaacaaaacaaaaaaaatgatgagtgggagaaacaagtttttaaacagggatcaaggaggccaggcatggtggctcacacctataatcccagcactttgggaggccaaggcaggcagatcacctgaggtcaggagtttgagaccagcctggccaacatggcgaaacctcatctctactaaaaatacaaaaattagccaggcatggtggcgggcgcctgtaatcccagctacttgggaggctgaggcaggaaaatcgattgagcccaggaggtggaggttgcagtgagctgtgatcatgccactgcactccagcctgggcaacagagcgaaagctgcacgagagaagaagtgatgcatggttccctagtctaggtcagccaatcagggagggttcctaagaggaggtgatgtttgagcagagaaggaggaagccaggcagatgttttggaaacagcattcccagcatggagaacagtggcagctcaccctgtctagaaaagaagaaatgataagaggggaaaatgagtttttaaaaaggaatcaaggggaggtaaaccttatgatctcaaaggtacaaatatgaaaatataagtaaagaaaaactggaggacactgtaccaagctgaccttcgggtggtgggatttgggaatcttgatattctcaatacttctttgtatcttcaaatttctctatgatgatcacagtttactttttttttttttttttgagatggagtctcactctgttgcccaggctggagtgcagtggtgcgatcttggctcacttggctcacctctggggttcaagcaattctcctacctcttcctcccaagtagctgggactataggcatgcaccagcatggtcagctaattttttgtatttttagtaaaaatggggtttcatcatgttggccaggctggtctcgaactcgtaagttcaagtgatccaccaacctcagcctcccaaattggcttgagccaattaaacttgtcttgctaaatggttagcggggagaaagaagaaggtctcgggtcattcctagaccaggaggcagggagaaagggaggagaatgaacctttcttaggcaaacagtgtcctaggtgtccttatcttacataatctgtcgagagagtcacactaaaataaatcattgattgattgattgatacatcaataataaatggccagccttggtggctcacatctgtaatcccagctacttaggaagctgaggtgggaggattgtttgagacaaggagttcaagaccagcctgggaaacacagcaagactcatcttaaaaaaatttttttttttaattagccagatgcggtggctcacgcctgtaatcccagcactttgggaggccgaggcgggtggatcacgaggtcaggaattcgagaccagcctggccaacagggtgaaaccccgtctctactaaaaatacaaaaattagccaggcgtggtggcacacgcctgtagtcccagctacgcaggaggctgaggcagaagaatcatatgaacctgggaaacagaggttgcagtgagctgagatcacgccattacactccagcctgggcaacaagagcaaaactacatctcaaaaaaaatgttttttaattagccgggtgtggtggtccatgtctgtagttccagctacttgggaggctgaggcaggaggattgcttgagcccagcagttcaaggctgcagtgagctatgatcccgccactgcactccagcctgggcaacagcaagaccccatctcttaaataaacacataagtaaataaatgatcatttttattttattattaaatacacaagataaatgaaaaacaggcaaatctttcttacaaaagaattccatttaaagtatgtaaacttcactccccactgccccaggaggtggagactaatctcccctactttgagagtgggctggatttagtgactcatttccgaagaatagagtaggtaaaggggaaaatagaagttttatagcggaggaacagatagataccactttaaccaaatgatgaagattagtatcccccagggatgtggatattatgtaacccttgattttatgcctatatagcgttcttcccaaaaactcctaatcccagttttttggggttttgctctgtcttctaagctggagtgcgatgatgcaatcatagctcactgcagctcaaactcctggtctcaagcgatcctcccacctcaacctcctgaatagctagggctgtaagcacataccatcatgcccagctaattgtatttttttggtagagacatgttctcacacattgcccacgctgtcctcgagctactggcctctagtgatcctcccaccccagcctccagagtcactgggattataggcatgagccactgtgaccagcccagaatttttttttaaggagttgtgatgtcgtttaagagatgtgattcttcataacacatcaacaacaagtcccagcgatgggttggataagtcttgggatttcatgggagtattaagcttaaaagactttgcatgatatctgtgaactatatgtgatttctgttggtaatgggggtcactgattctgcggtttgccacctccaatcatcatggaagaaaatgttccacttccagtgaaagtaagaggaagtaaaggggtaattattttctatctaaattcacgaactccttgaattctgtccacagacccctaagtgtttcctccccaaggtgaaactgagagaatcttgccagtgccttccgcagtcactgtggctagaaaacccctcagaagaggtgatagtttagcaggtaactggagttctcaccatccgtgtctggctcagcccccatcacaaccagttacccagcccaaaatgtcagtagtactgaggttgagaggctctgctctaggaggccaggcctctcagaggaaggaggattggggtactggctgggcctcaagatgaacctaccccctaagagctttgggatggcgtgagtttctgtccatacccaaggactacaaatgcaggtttactggaaattctgtgccaaaagtgaggtccaactcacttctaactgctacaaaacaaacctccatcaacatagcccatctctgttcttgacctggaagctccaaggtatccacatggctcccatgcccactagacgggcctcttccctggaccttcctgggccagagaaggctctgggtagccttgtggaatcaagatgggtgatcagccacttcctctgtgccaccctgttttggctacttccctaggcatcagcctgggattccttgatggtaaaaatataaaactctctgagctagggcctttaatatccccattttacagatgaagaaactgagtcccagagctgtgcacagcgattgagagtcagaattcagctctgtctcactcagtgtcaacatcctcagattctgccatttatagcctcccacagcaaataggattgagggctgcttctctgagctcaaggggatagaatggggaaccccatgagtactgcaacaaaactgtttgctggagacaagagctggtggctctgtgttgttctagtgacaggtggcctcatttcacagggaccccctcaccctatgtgccccatgtggctcagaaaagccagaaattgtctccactctcacaggggaaggtccctgaccccctctttgccagctgggccaaggcaaattggggtcacttcatggggtacaggacctaccctctcttggttgcccccaaggaggggatgtggaggggctggggacctggcaggaccagggtgtcttgagttaatttggggctgcctttagccgagggcttctgtgtgcctggcatcagctttacattgtgtcttgatccgtaaaacagccctgtgaggaaagatatttttaaccccatcttccagatgaggaaacggaggcccacagggtgacgtgacctgccaaggtcccctagccaagagtgacaaagccagggttcacacacagctctggacacaattcatcacccttcatccgtctctctctgactctttctttttccctctctctctttgtctctctttttttttttttttttttttgagacagcgtctcactctgtcacccaggctagagtgcagtggcgcaatctcggctcactacaacctccatctcctgggttcaagcgattcttgtgcctcaacctcccaagtagctgggattacaggtgcgtgccaccacacccagctaattttggggggttttgttttgttttgagatggagtcttgctctgtcgccaggctggagtacagtggcgtgatctcggctcactgcagcctctgactcccaggttcaagtgattcccctgcctcagcctcctgagtagctgggactacaggcatgcaccaacacgcccagctaattttttgtattttagtaaagacggggtttcaccatgttggccaggatggtctcgatctcctgagctcatgattcgcccgccttggcctcccaaagtgccgggattacaggcgtgagccactgtgcctgccaattttttgtatttttaacagagactgggtttcaacatgttggccgggctggtctcgagctcctgacctcaagtgatctgcctgccttggcctcccaaagtgctggtattacaggcatgagccaccatgcccagcctttgtctcttttattcttgtgttctctctctctcttccttctctttctccacctccttctccttctctcccttctcctcacccttctttgtgcttttctctgtgagtttctcttcttctctatttctctcctttggtgaatgtcaattagaaaagcagaaaaactgcgtttaatttgtgatcataaatgcatgtccctggccaggcgtggtggctcacgcctggaatcccagccctttgagaagctgaggcaggaagattgcttgagaccgggagttcaaaaccagcctggtcaaaaagcaagaccccatctttaaaaaagaaaaataattaattagctgggcatggtggtgtgtacctgtagtcccagctactcgggaggctgaggaaggaggattgcctgagcccaagggtttgaagctgcaccgagctgtgattacacccctgcactccagcctgggtgacagaaccagaccctgtctcaaaaaaaacctaataattaaaaataaataaataaataaatgcgtgtcccctggccagtggttgctaatgtttggaatcacctttgacccatgccctttttcattcatagatgtttgtcttgaccaaaatcaaagcattagactttggactataaatcactggttcattcaacaaccatcattgaatgcctactgtatgcagacactcttctggacacagaggagttgacgtgttggtggggaaagccagtgatcagttgggataaaaagggcagacagcagacattaaatagtttaggctttgtgggccagatggtctccatcgcaacgactcaatctgctcctgtagcgtgaaagtaacgacagataaagcgcgtaagtgaatgagcatggctgtgggccaattaaacgttaacctataaaaacaggtggctggcccgcgggctgtagtttgtggatcactgccttagagatagtgttagagggtggtgagaggtccgggatagaataaaacagtagagagtttgtgcattgtcaagatgagaggttgcagttcttcttatacaccccgaatggccgggcaccgtggccattatgatctataattctaacactttgggaggctgaggcaggaggatcccttgagccctagagtttaagaccagcctaggcacatagtgagaccccatctctacaaaaaaaaaaatttaaaaattagctggacatggtggagcatgcctgtaggcccagctacttgagaggctgagatgggaggactgcttgagcctgggaggttggggctgcagtgagccgatcatgccactgcactccagcccggatgacagagcaagaactgtctcaaaaaaaaaaaacaaaaaaacaaaaaaaacagacctgaaggaacaaatcatatgaatgcattaaagtatcacatgtatccaaaaaatatatacatctatcagcctggcacggtggctcatgcctgtaatcctagcacattgggaggccaaggcaggcagattgcctgagctcaggagtgcaagaccaccctaggctacatggtgaaaccccgtctctactaaaatacaaaaaattagctgggcatggtggcaggcgcctgtagtcccagctacttgggaggctgaggcacaagaattgcttgaacccaggagacagaggttacagttagccgagatcgtgccactgcactccagcctggacaacagagcaagactctgtctcaaaaaaaaaaaaaaaaaaaaaaaaaaaaaaatatatatatatatatatatatatatatatatatatatatatatatatataatcaattaaaaattttccttaataaataaacatttctctccttctctcccttggtgaatgtcaattaataaagcaacaaaactatgtttagttagtgatcattaatgtatgtccctggctgggtgtgatggctcacacttgtaatcccagcactttgggaggctgaggcaggagaggatagtttgaggccagcaattgcttgaggctttttgaaagacatgaaggagatgaagggagccatggagatatctcagggaacagcagccgaggtagatggaacagccagtgcaaaggtcctgaggcaggatgttcctggcatttgtgaggacatgtagctgcccagatgtccagtggggagtgagtgaggatgaaggaaggagctgatgaaggaagatgataaaatacttcatggatcagccaggcatggtggctcccgcctgtaatcccagcactttgggaggccaaggcgggtggatcacaaggtcaagagttccagaccagcctggccaacatggcgaaaccccgtctctactaaaaaatacaaaaaagttagccaggcgtggtcatgcacgcgtgtactctcagctacttgggagactgagactcgagaatcgcttgaacccaggagatggaggttgcagtgagttgagatcaccccactgcactccagcctaggtgacagagcgagactctgtctcaaaaaaaaaaaaaaaaaaaaaaagacttcgtgaacagacagcctatataatttatgatccaaaccaggacagttttgagagtgaaaggggaaaaagagcactgaaaaaataattagcaggcctggcatgatctataacgggtataaagtgggacacacagcctctctcacggtcactgtcagacttcagctttttcacactcaaatccacccccatgtttatcccatatactggagaaacgggtgttctcctgagctgagttttggggttttttccttttgttttgttttgtttttgtttttttaacatcctgtatactttttctcaatgaaccatgctcaaaaaaattagaggaaaataaaccataaaacagaaggcactgaaggattttgctgggactcagccattagtttgtttgatgagtatttatggagcgctttctaagcaccaggcaccaccagcgatactgggatgaatcagtaacatccctcacccttgaagctctcttgggcccattgttatttacttaaaatactatgcaagtacggagaaggggtgaagtgggaaaaaatcagttggttgtaaaggccagaatgacgggtctagtcccacccatgccatctgcaccctgtgtgatccaggcacatcatgttgcctctctcagcttcagtttctccatccaccaggcacagagatggcgggaatcgaggaagatgtggggagtatttcatcagcccaaaaagacttggctaatgcgaccataattctgccttctgcctctcctttcccagaaaaatagcttaatcatttggatttgggataaacacatttcctgtgtttattatttaaatgatccaccaagctgggcatggtggctcacccctgtaatcccaactctttgggaggctgaggagggcggattgcttgagcccaggagttcaagaccagcctggccaacatggcgaaaccccatctttactaaaaaaatacaaaaaaattagctgagcgtggtggtgcgtgcctgtaatcccagctacttgggaggccgaggcacaagaatcacttgaacctgggaggcagaggttgcagtgagcctagatcgtgccatcacactccagtctgggcgacagagtgagattctgtccctaaataaataaataaataaataaataaataaataaaataaatgatccaccaacaggaaccccaggaacatttgtattgactatgcaactaatgcttagtgagcacctactatgtccctggtgctgatctggacactgggatttagacaggaaaaatctctaccctggaggagctgatgatcaagatgacaatcttgaaatgcataagttgacaagatgattcagacagtggaacgtgctgggaagagaatgagatgtctggctgagctgcaggaaggggcaagtccttttgattgagaggtccaagaaggcttctctgatgggggcacaatggatctaaggttgagtgataagaagaaattggccaagccaagacctaaaggcagagttgctccaggcataggttcagagaatggaaataattggctgattgtgatcttgaacttgacctttcttttcttctgctaactttgggtttggtttgttcttgcttttctggctccttgaggtacgtgttgggttcttaatttgtaattttttttttttttttttgcttttttgagacagagtctcactgtggtgcccaggctggagtacagcagcatgatcttgactcactgcaacctctgcctcctaggctcaagtgaacctcccacttcagcatccccagtagctgggactactggtgcacagcaccacacccagctaatttttttatttttattttttagagatggggtctcactgtgttgcccaggctggtctcaaacccctagctcaagcgatcctcctgccttagccccccaaagtgctgggatgagaggcgtgagccaccacatctggcctctgttttttgtgatgtaggtatttgatgctataaacttccctcttagttgcttcttggccctttagctaaggtcaagtgtaaacttccctcagcactgcttctgctgcatctcacaggtgttggtgtgttgtgtctctattttcattcatttccaaaattttttaagtctccatcttaatttctgcattgacccaatggttgttcaggagcatgttgcgtaatatccatatatttgcatcatttctgaaattcttcttggtattgatttctagttttatcccacggtagtctgagaagatgcttgacagaattccagtattttaaaatttgttgagagttgttttgtggcctaacatgtggtctgtcttggagaatgtccatgtgctgatgagaagaatgtatgttctccatcagacatgcaagagacagacactttctcacctgcctcatgggatccataaaagagtcaatcagaagttggcatttaagaaagaccagaaggaggctgggtgcagtggctcatgcctgtaatcccagcactttgggaggctgaagtgggtggatcacctgaggtcaggagttcaagaccagcctgaccaacaaggtgaaatcttgtctctattttaaaaaatacaaaaattagctaggtgtggtggcgggcacctgtaatcccagctactctggaggctgaggcagagaatcacttggacccaggaggtggaggttgcagtgagctgagatcacaccattgcactccagcctgggcaacagagcaagaccccatctcaaaaaaaaaaagaaagaaaaaaaagaaagaaagaccagaaagaggtgaaggagcaagctacagagatatcaaactgtatcaatctggctgggcgtggtggctcatgcctgaaatcccagcactttgggaggctgaagcaggaggatcacttgagcccaggagttcgagaccagcctgggcaacagagaccccctctctacaaaatataaaaatttaattaaaaagatgtattggtcagggcagccaagttatgctgcagtaacaaacatccccaaagcctccatgacttttgacaacagatgtatttcctgctcatgctacatgtccagtgcaggttggcagtggggaagaagggggctctgttcagtgcagtcacttgagacctagctaatcacctagaacattgccacttgctattccagaaggaaaaaaggaatgctagaaggtcccacactgaaagttcaatgctctggctccaaaatgacagctatttccactcactcctcattggccagcacttagcatgtggtcctcagccaaccccaaagggactcaggaaggaccatcccaccatattgctggaaatatttgatggcagcattaatggggaacagtgttccaggcagtggaagtctttgagcccttggaagaaagacaaggcgatctctagagcacatccttcccaatattaatgaatttaacaaatgagcaagccatcctcccccactctccttcccgaattcagacttgtgcatatccctcccttaacttgaactgccaaagaagagatgagaaccaggagaagagatctgtgaccccatctttgctgatgaactaccacagaacagccatggcatctccagtccttgtgcttgtaaaatgtacttttcattttgctcctgaacgaaatccacccacccccacccccaaaccagggaaagctcatctcctaatccaaaactgcacccagccttccaccaccttcttccctgggaattgttgattccagagtatggaattgaataattggatgagtttggaagagaaaaagtgtctctaaaatcaggcagcagaagcccactccccagagaggatggtgcagatgagagttcaggagggagcttggcttggggttgacgatctgagctatgcagggaacttggacacacctctcaatcagtcattcaacagacaccacttattgagcaccgactgtgtgccagatgttgtcctagggggctgggaatacaggaatacagcagggaacaaaaaggacaaagcccctccctcttgtcgaatggacattccagccaggaagacgagagaacaagagaaataagtaaagtatataggcggtgaaatgcaaatgggaaaaaagaaacaatggggaccagaaatgaggggtgcaattgtaaagggccatcaggggaggcctccctcagaaggtggcatttgagtaaaaaacctgaaggaggtgaggggaaaccatgtagcaatctcaggaaagagcattccaggcagggagggacagcctgtgcaagggccgaggtaggactgtgcttggcgtggttgagaaactgcaaggaagccaggtggctggaaccgaatgagcgagggaaaaggggaggagataaaagcaaggagatgggagggttggaggccccctctgccattcagtaactgagtaacttcatttatttcctgtagcttgaaccacaaagaaccacaaatagagtagctgaaaacaacagaaatttatttattctctcgcagttcaggaggccaggagtccacagaccatcaaggtcagctgggccacagaccatcaagatgtcagctgggccatggtgcctcctgagacttggtctgaaatcccttcttgcctccctcctagcttctggtggtttgccaacagtgcttggtggtccttgtcttgtagacgtatcaccctgatcccgccttcatctccatttcacatggccttctccctctgtgcaaggttgtctctgtgcccaggtttctccttttcttattatttacttatttgtttgtttgtttctttattttagacacagggtcttgctctgtctcccaggctggagtgcagtggtgcgatcatagctcactacagcctcaaactcctggcctcaagcaatcctcctacctcagcctcctgagtagctgggactgcagatgtgagccactgtgctctgcccagatgtcctctttttataaggaaacccgtcatttaggatgaggttccaccctaatgacctgatcttaacttgattccatctgcaaagaccctatttccaattcataggtaccagggattaggacttcttcaatgcatctttttggagagacccactgcaacccacaacagaactgtgggcatgtaacttgacctctcggccaggcgtgatggctcacacctgtaatcccagcactttgggaggccgaggtgagtggatcgcctgaggtcgggagttcgagaccagcctggccaacatggtcaaaccccgcctctactaaaaatagaaaaattagctgggcatggtagcaagcacctgtaatcccaactacttgggagggtgaggcaggagaattgcttgaacccaggatgtagaggttgcagtgagccaagatagtgccattgcactccagcctgggtgacagagtgagactccatctcaaaaaaaaaaaaaaaaaaaatagacctctctgtgcctcagctttctcacccgggaggatggggataattatatacccactcctggggttcatgagaggattaaatgagctcaaacagtccaagcctccacgtgtgtctgttgtggtgctgggtagcatgtcctgtggccagaggttcccaagcttgtcgaggacccaggcaagggcagattcgggtcttgttggcagcacctgagatggacgggctgccttggtatggaagggcctcggctgtttttccctttcagtcctgtccctctcccccatcctccaccctgtccctgtcatctgagcctgctcctcgtgatggctcagagtctccctactggcggccggtgcagagtttcgttccctgggctatatttagccctgagaaatgggaacgagaaccctcagccgccaaagtgatggagagaggagcacaaagccagtgctgccttctgtccagcaatgttccgctgactcggttctttcttccagaaccttccagaagcaaagcattggcatttctgagctcgttaaaacaaggatgtgggctggtggctggcacattcattgtccccagaacctgtctgtgtccatgattaaagctgactttgttagttttattttcagtgcttttttttttttttaatccatggcaaaacacacatgacataaaatttaccatcctaatattttttttaactttgtaacattttttaattgacaagtaattgtacttattcatggggtacatagtgacgtttcaatgcatataatgcgtagtgctcagatcagggtaattagcatatccatcttctcagacctttattgtttctttctgttaggaacattcaagctcctccttctagctatttgaaaccattaatatattgttgtcatcctaaccatttttaaggatacagtttcgtgaaattaagtataatacattcacattgttgtgcaactgtcaccaccatccatctcccaaacttttccatcttccaaatgtaactctgtccccactaaacgcgaactccctgttccccctcccccagcccttggcacccaccatgctactttctgtttttataaatctgacgactctagggacctcctataaatggaatcatacaggattttcccttttatgactggtttatttcacatagcataatgccctcaaggttcacccatgttgcagcacgtatcagcattttctttctttttaaggtaaagttgactattaaaaaaaaacttctgccgggctcagtggctcacgcctgtaattacagcactttgggaggccaaggcaggcagatcaggaggtgaggagttcaagaccagcctgaccaacatggtgaaaccccatctctactaaaaatacaaaaattagccaggcatggtggcgggcgcctgtaatcccaactactcaggaggctgaggcaagagaattgcttgaacccgggaggcagaggttgcagtgagctgagatcatgccactgcactccagcctcggcaacagagtaagactccgtctcaaaaaaaaacaactttttaagaattgaagtagaataaacatacagaaaaatccgcggattataagtgaagagcttgattaattgtcacaaactaaacacatccatgtaaccagcacacaaatgaggaaacagaaacttctcagccccagaagcccccctcatatcctgttcctagtcactacctccccgcaagggtacccctaccaggactttgagcatcattcaccagtttagcctgttttgtattttgcataaatgaagtctggcttcttttgcttgacgttaactttttaagatctcatgtgacctgtggcattgttcattgcatgtatcctctctctcctattgataacagtgtggattgtttgcaatttggagctatgatgaataccattgctatgaatgttcttgtgtgtgctttctgttgtgtaattattcagaattactatttcggaattactatctaattgtagtgatcttggatcagtaactatccaagaattactgggtgttggcaaaggtacatacagttatacactgcacaatggcattttggtcaacaacagatcaaatatgtaacagtggtcccataatggaccgaatacataacagtgattatcatacagtatttttactatagcttttctgtttttagattcttttttttttgagacgaagtctcgctctgttgcccaggctggagtgcagtggtgtgatctccgctcactgcaagctccgccttctgggttcacgccattctcctgcctcagcctcccaggtagctacaggcgcccgtcaccaggcccggctaattttttttgtatttttagtagagacggggtttcaccatgttagccaggatggcctcgatctcctgacctcatgatctgcccgcctcggcctcccaaagtgctgggattgcaggcgtgagccaccgcacccggcctgtttttagatatttttagatacactatagagttacaattgcctacagtattccatagaataacatgctgtatgggtttgtagcctaggagcaataggcgagaccatgcagcctaggtgtgtagtaggctataccatctaggtttgtgtaagtacactccatgatgtttgcacaacaaaatgacctagtgacacatttttcagaatgtatgcccattgttaagcatgacttaattttagcatagaaactctcaaccaatttttcaagtagttgtaccatgtgttatgggttttattgtctcaccccaaaattcatatgttgaagtcctaacccccagtacctcagaatgtgaccttatttggaaatagattcattgcacatgtaaaggttttgccattggcaaaactgccgttatttttgcaccaaccatagcagttaagatgagatcattagggtgggtcctaatctaatacgatggtgtccatataaaaaggggagattttggcacagagacaggcacactcacaggaagaatgccatgtttaaacaaaggcagagctcaggatgatgcctctacaagccaagaatcagcaaagattgccagcaaaccgccagaagctaggagagaggcataaaacagattctgtctcacagctctcagaaggaaccagcccttctgacaccttgagcttggatttttggcctctataactgtaagacaataaatctttgttgtttaagccacctaggttgtggttccttgttacagcagccacaggagatgaatacagcatggtgccctcccattggcagattatgagggttccagttgctccacagcttcacagacacctggtagtaatgacctcatcttaacttctttctcattttagcctttcttccaggcagcagcagtgtcatacatgcttttaaaggtgggcttttaaagccacacttgagagccctgcattctgcaggtgtcacagggtgatcaactattcaaaggctacccctgccctgacagctggaggcaaggcttcccagcacagaggttaagcccatggactctggggccaggtggttagtgcaaatcccatgtccactagtgaataactctgtgatcttgggctgatgattttgtctttctaagcctcagtttcctcaatagtaacatgggcattataacatagaggcatcatgaggattaaatgactaagtgagctaacatacataatgtgcttaggaaggtgccagcacaccataaatactctgtaagtgctggcttttatcattcttttctctctctctctctctctctctctctctctctctctctctctctccctctctctctctgtctctctttctctctccaccccccaacctcctctccttgattttcttcccctcatcttacttccttcttgctatagtgttctattttctgtttcagagagtattctatttgtggacttttttcctcttgaaaattgagctgaaacttctgagaattttttgtgattggcattaaggctgcagggaatggagcagggagacacttgaggaaagggctcatggaccatctgtctggcttggtgatttcaccaggccatcagactctgtggtcatgcatctcctctaaggggagtctatgactgtgttgggagaagagaaggaaccagggattaattaatccatttcaataggttttgtgttttgtttggtttactttttccttctccttctggactgtggtctgggaagtcctcttgtgtttcttactccattcccaggtcaattatgttatgtgaggagaacataattaagagagagctttaccctttggatgttttcttcagaaaacgttcctccatttccccctctgggatgccagagccccagaactccacaagccaagaacatttaagacagagccacaagagaaccgagcttccccttccctcacctgtcaggttctatctgagtcccagtcaactctcacctgctttccctcctcacaccctacagagcaacgatgcctcagggaacacttggaactggttgtacttcatccccctcatcatcatcggctccttttttatgctgaaccttgtgctgggtgtgctgtcagggtaagtttctgctactccccaccccatcccactcactcctctttgctaacttctttccaagtagaggccattgaagctttgttttcattcactagacagagaaaaggcttcttcccttgtttgggttaccagactgttattagcaagccatgcacaggtgcagaggttgtgtactgctaggggtacccagtgagagggttcatatgggctttactttctttacattttttttaaaaaccaatagtttgggtttacttctcccccattttccaaatataaaatcatagcatatgctctaacggtgtattttcctgacccatattgtcctctatccccaagatttttttggcttaatcataaatgggcttcatttttcttaccataagaagtctgggcacttgtatggtggctctatggcaccatcagcaaccccagattcttccagctttccattctgacatctttaccagaggcttccaatctcgtggatacctcatggtcttaagatggctgcctcacgccctccggatggccacttcatgttccaaacaggaaaaggaagaagggaaacaggaagaggtgggacctatggcagagaagccaacctgctgcagaaatctttcattcatggcttattggtctaacttaaaagagggctgaaataattattagccaaaagtatgaagagaatgagaatgaggtatgcagccagtggtggttggcatggcatggttttatcctttcggtttttttcttttttattgtttttttttgagacggtgtctagctttattacccagactggagtgtagggggcgatcatagctcactgtaacctagaactcctaggcacaagcgatcctcctgcctcagcctcctgagtagctaaggcaacaagtgtatgccaccatgcccagctacattttttatttttcatagagatggggcccactgtgttgtccaggctggtctcaaattcctggccttaaatgatactcccatctcagcctcacaaagtgctgggattacagacatgagccactgtgcctggcctttttctttacctaggcacagttgtcgggaaatgtgtgaagctggcagaagcacccatcactataatatcccagtcttttcccagaagtcctgactcctcctgttgaaaactcctgacctccagggacttctgaatccccaaacacacacacacacacaaacacacacacacacacacacacacacacacaaacacacacacaaacgtttcctaacattttcaaaacagccatactctggcttttctatgcttctccagggagtttgccaaagaaagggaacgggtggagaaccggcgggcttttctgaagctgaggcggcaacaacagattgaacgtgagctcaatgggtacatggagtggatctcaaaagcaggtgaggccctttcatcctggggcccagggatggagatcccaggccacggagtacaaagagagtcatgcagtttggagaaggctaagctgggagggttatgatgggaggagaaagagaacctgaattggtagtcccaaattttatcaacaagaatccagagtctgatatgaagaagtctaagatgaagccaggatctgacatcacgtaacttgaattctgaaatcagacgctggtttacatcccggccctgccactttttacccatgcaccacacatccctgtacctccgtttcctcagctgttacatggaggcgatggtagtgcctaagtcatagtactattggagtatttagtaaaataatctcagctgagtcacttggggagagaagtgcctgatacacggtaggcacatatttatttgttcagccatttaacaaacatttagggagcacctgctgtgtgccaggcactgatctaagcactgaggatatgggagtaaacaatacacaccaaatccctgccctcagagctctgatattctaatgagagagataaagcaaacaaatacatgtcatgttgggaactcccaaattcagagaaggaagataaaacagactaggaagataaaacagagtaggaagttggccgggcgcggtggctcacgcctgtaatcccagcactttgggaggctaaggcgggcagatttcctgaggtcaggcattcgagaccagcctggccaacatggtgaaaccctgtctctactaaaaatacaaaaattagccaggcatggtggcgcacgcctgtaatcccagctactcgggaggctgaggcaggagaattgcttgaacccaggaggcagaggttacagtgagctgaggtcgcaccactgcactccagcctgggcaacagagtgagactctgtgtcagagaaaaaaaaaagagtaggaagttagaggcagggtggtcagggaaggcttctctaaggaagtaccctctgagcagagagacctgaaggacgtgaagaaggaagctgtggggatgtcaagggaaggggcattccaggcagagacagcaagtgcaaaggccctgagctaggaacgtatttgagacacagcaaggaagccagtgcagctgaaacagagtgagaggtggggacagctggaggagaggaagacaggaaggtgatggagatcagatcaagcaggggcttataggctgtggtgtggacattggtttttattttgcgcgaggtggggagaatgttggctattgctactgttgcggaggtggggcttgaagtcacaaaccacccagcagcatgttttttggtcggttgagctgtcaccatcagtcagcagagaatgggggtggccgggcagacccttcttcctggtccaagggagaactcatcctccaaatgcaggagcttaactctgtgctcttcctcttcagaagaggtgatcctcgccgaggatgaaactgacggggagcagaggcatccctttgatggtaactgctctaaacccacctcaggggtgggtcccaggggagaagggagaagctgtggtggggagtcgggggagagcaggtgactggttctaaggatcttgcagagggtagacgttcctcttggaggaattttaggacttccatgcagagtttccctattctggcctccacttttttgttttaaccatggacctggttttttctgctttgtgccttggtttttctcatctgcaaaatgggtatgatataaacaataccctagctcacgagattgtttctcagaatgatattcgttatggcaaatagaacacctgggatagtgcctggcatggggtcagcacgtttctgtttgctaaataagtaataattccaccaataatccagtttactgtgaacggctgctgtctcccatgttagaaacttaacgagacagaaccatgactttctttcttttcttttttttttaattgagacagagtctcgctctgtcacccaggctggagtgcagtcacacgatctcacctcactgcaacctctggctcccaggttcaagcaattctctgcctcagcctcatgagaagctgagattacaagcatgagccaccatgcctggctaatttttatattgttgatagagatggggtttcgccatgttggccgggctggtcttgaactccttgcctcaaatgatctgcacaccttggcctcccaaaatgctgggagtgtagatgtcaattcatggtcccctggaaacctgaatatgaaaggagggaccattaaaaaggtgtccaaaagcccaacctccccagcatagctgggagtcaggggacagactgtaagagtcactgtgtatccaacctgaggcttcatgaaagtaaagtttcctagaatttagagatagggttggatgcggtctgtctgtggctcacatctgtaatcccaacactttgggaggccaagacaggaggaacacttgagcctgggagttcaagaccagcctgggcaacataatgaggttccgtctctacaaaaaataaacttagccagatgtgggggcacacgcacctatggtcccagctactcaggaggctgaggtgggaggatcacttgagcccaagaggtcgaggttgcagtgggcaccactccactccagcctgggtgacagagtgagaccctgtttcaaaagaaaaaaaaagaatttagagataggccagaataatatgtctgcaatataataataacagcaataagaaaaataatagtactccctgaaaaatgcaacttcttgcttgagatttatcttctcatactttagaaaactggttagacaggggctgggcgtggtggctcatgcctgtaatcccagcactttgggaggccaaggcgggtggatcacttgaggccaggagttcaagaccggcctggccatcatggcgaaaccccatctctactaaaaatacaaaaattagctaggtgtcatggcacacgcctgtaatcccagctactcaggaggctaaactacgagaattgcttgaacctgggagacggaagttgcggtgagccgagatcacaccactgcactccagcctaggcgacagagcaagactctgtctcaaaaaaaagaaagaaagctggttagacagggtgatgacttttgattaaaaatctgagagatttgagggaaataaaagaactggcactgcgtcccagaaggttataaaatgaattttattatcttagttggggaggggagattacctaactcccctaaatgagttaggtaatctaactcatttagggtacctaaatctttttattggaagtctacacctgaacttgtctgctgtggagcccctggggtgtatagcttgaatatgggggcagaatcccaaaattgcagcctgcctagcgagtatgctacaggtcaaggggtggactgttttcataagaaagtgaggtttcttagaatttaaaaatagaggctgagtggggcggctcacgcctgtaatcctagcacttttggaggccaaggcaggcaaatcacttgaggtcaagagtttgaccagcctggccaacatggcaaaaccccatctctactaataatacaaaaattagccaggcgtggtggtgcatgcctgtagtctcagctactcaggaggctgagggaggagaatcgcttgaactcaggaggcagaggttgcagtaagccaagatcacaccactctctgggtgacagagcaagattctgtctcaaaataaataaacaaataaataaataaaccagaaggaaaatagtggctgagggcccagacctggagtcggactgaacccgacttgattcttgtctttacccctttaagcaaagtgatagtgccaccttgaacctcagtttacacatctgaaaaatgggtatactattagttcccgtgagaacagttgccgtgagagttaaatccaaggacacactgtgtccatatggtctgtgttgcaaaaagggtaacgtctttttctcttgccatgtttccattgttggagctctgcggagaaccaccataaagaaaagcaagacagatttgctcaaccccgaagaggctgaggatcagctggctgatatagcctctgtgggtgagtcccttcctctgccacctatcagttgttcatcacctatcgcccaagagacatggtggggtgggggcagagggcttgcaaaccgtgctgcctggatttgggtctcagctccaccctttcccacctgtgcgtgtgtcctgggcagattacatcattatgggaataacatccgtgcctagcttctcattattttgtgggaattcaactaaatgatccccatgaagcatggcaaaccagcacctggcagggacgaagctcccagtcaagttggtgaatgtttgtgactcattcgggaagtattcatgggggacctgcttatattaggtgcttggttgcaaacaagacaaggcagtcacgaggctgagctgggaggatcacttgagcctgggaagtggaggctgcaataagccattattgtgttactgcactccagcctgggcacagaaaaaaaaaaaaagacacaaactgagccaggcacagtggctcacgcctgtaatcccaacactttgggaagctgagatgagcggatcacctgatgtcgggagttcgagaccagcctggccaacatggtgaaaccctggctctactaaaaatacgaaaaaaattagcctgtagttccagctactctggaggctgaggcgggagcatcacttgaacctgggaagcagaggttgcagtgagctgagatctcatcactgccctccagcctgggcaacagagcaagatcctgtctcaaaaaaaaaaaaaaaaaaaagacacaaaccaaatccctacctacatggagctcacagtccagtgcaggaaatagaaattaaacagagaattacacaaataaacctgtaatggtaatggcacttcagggagaggctctgggcttagcttgctctagaaggatggggagcagtcagggaaggctacctggaggaagtgacggttaagctgggaactgaaggatgggtaggagatcactgtggtggtgatagcagaaggaacagtgtgagaggcagggctcagacctttgccaccacaagggccagagttcgagggaggagggaacatttattctttcccttctcactcctctgtcctattgattcattggctgtgatgatgttgattttgaccttctaaagtgagaatgtattgttattgttgttgttgttctttaatgggtttttgtttttaatggaaggaagagcatccaggcagaggaaataagactggaataagattgaggggagaaggaatttaggctgcttgggaaactgtgtggccgcagtttagaggaagaaaggatggcaagagaaagaggaagggaggaagagaaggagggagagaagtgaaggaaggagggaagttagtacatccatgtgtttctgatccatagtttctgatccactatttcgtattccccttttatcgctcgcccctagtttataaccttattgctgagtttaggcataatttccattgcgatcacatatctcgtagggtggatacactatggtttgtttagccatagctctattatagggtgtttgagttgtttccaataatttctcttacgaagaacactgctgtgcacatttacgtacaatgactccccccaccctttgggcgtatttccttggggataattataggatcaaagatattaacagcttttcaactcattattcaaagagccattctgagtttcaaaaacatggaacccatttataaacctgccaagtatgcatatgttcatggattccccacccaggccatcgaatattaccaatttaatttcctttcccagttaagtgggtttgtaatgaaaccttaaagcttgttttcatttgcatttttaatttccagccaaaacacgcttttctttgtaatggagaactcattctgcttccactcgtgtgtgcatctgtttaatttcctgtaagcaaatgtcaagaattggagcgctcagtaggtgtcttgagtatttgatcaattatgtctgtctcacgtgttacgttacctccattgtttaaaatctgttttatgacgaggtacagtggttcacgcctgtaatcccactgctttgggaggccagtgcaggaggatctcctaagatcagccgttcaagaccagcctgggcaacataacaaggctccatctctgaaaaacaaaatgttgaaaaacttagccaggcattatggcacacacctatagtcccatctatttaggaagctaaggcaggaggatttcttgaacccaggaattcaaggttgcagtgagctatgattgtgccactgcactgcaacgtgggcaacagagtgagaacctgtctcttaaaaaaataaaataacatacattcttaaaaatctactttgctggccgggcgcggtggctcacgcctgtaatcccagcactttgggaggctgaggcgggtagatcgcttaaggtcaggagtaggagaccagcctggccaacatggtgaaaccgtgtctgtactaaaaattcaacaattagctgggtgtggtggcgtgagcctgtaatcccagctactcaggaggctgaggcacaaaatcacttgaacccgggaggcggaggctgcagtgagctgagatggcgccattgccctccagcctgggcatcaagagtgaaactccatcaaaaaaataaaaaatctgcatatacatatatatgtatatatatttttaatttttttaatttttttttttttttctgagatggagtcttgctctagcacccaggctggagagcaatggtgccatctcggctcactgcagcctccgcctctgttaacaaggcaggtgacattgcagctttctaaacagacccaaaacccaggccagtggcttgttctttcatagccacgtttgctacaggcaaatccaccaaaacccacctcatcagcctgattactcaaaaagacaaagaaaggagcccccaatctagccagtggttttctagaccaccccaaaagagatctctggaattccaggattctggcaaggaatcacatttagctttatttatttatgtaaagaatgcaacaatacaggctgggtgtggtggctcacgcctgtaatcccaacattttgggaagctgaggtgggaggatcgtttgaggtcaggagtttcagaccagcctaggcaacatagtgagaccctgtctctatcaaatattagctgggcattgtggcacacgccagtagtcccagctactcgtgaggctgaggtggatcacctgagcccaggaggtcaaggctgcggtgagccacagcatgcccctgcactccagcctgcgtgacagagacttcatctcaaaaaaaaaaacaaaaaaaagtaataatacagtaatgcatatttcaaagtaaggtgggagctatgtggtatttgcgttcacgttcacattataccacagtatgcacagtccttttttttttttttttgagacagtgtcttgctctgatgttcaggctggagtgcagtggtgcaggcatagctcactgcagcctcaaacccctggactcaagtgatcctcccacctcagcctcccaagtagctgggactataggtgtacactgctacactcagctaagttttttatattttttactagagatgggatctcaatatgttgcctaggctggtctcaaactcctggcctcaaacaatcctcctacctccacctcccaaagcagtgggattacaggcgtgagccaccacacctggcccacatgcagtcttatataattggtgattctactgcgctgttgaatcagttgataaacgcactataaagcaggttcattcctaattgatgaacttactgctgaaataaggaacttgaatcatttacatgaaaagttgagccatgttgctgaaaggatatcaatttttttttcttttttttctttttttttgagatggagtcttactctgtcgcccaggtgggagtgcagtggtgcgatctcggctcactgcaacctccaccttccaggttcaagcgattctcccacctcagcctccaagtagctgggactacaggtgcacaccaccacgccctgccaatttttgtactgttagtagagatggggtttcaccatgttggccaggctggtctcaaactcctgacctcaagtgatctgcccacctcagcctccgaaagtgctgggattacaggtgttagccaccgcgcctgacaggatatcaaatttcatttagactgcaggaatacgttcaagagatctattttgtacagcctggcgactgtattaataacaatgtattatatacttgaaaattgctcagagagtaggttttaagcattctcaccgtgagaaaagtgataagcatatgtaataatgcatatgttaactagctcaactgagccactccatagtgtatacatatggtcaaaatatcatgttatgcactataaatagatacagcctgtatctgtcaatttaaaataaatgaataataactttaaaaagaaaaataacagtatggctgggcacggtggctcacacctgtaatcccagcactttgggatgccaagacaggcttgaggccaggagtttgagaccagcctggccaacatggcgaaactttgtctctaataaatatacaaaaatcggctgggcatggaggcgggcgcctgtaatcccaactacttgggaggcagaggcatcacttaacctgggagatggaggttgcagtgagccaagatctgcactccagcctgggtgatagagtgagcctttatttatttctgtaaagaatgcaataatacaggcctggtgcggtggctcatgcctataatcccaatgttttggaaggccaaggtgagaggatcatttgaggctacaggcgcatgccacagtgcccagctaatacttgatagagacacggtctcgctatgttgcccaggctggtctcaaaaccctggcttcaaatgagcctcccaccttggcctcccagagtgttgtgattacaggtgtgagacactgtacctggcctgtattaaaaaaaaaaaaaagaagaagaagaagaagaggaggaaagaagaagaaggaagaaggaagaagaagaagaggaggaggaggaggaatgggaaggggaaggggaagaagaagaggaggaaggggaaggggaagaagaagaggaggaggaaggggaaggggaagaggaagaagaagaggaagaagaagacgaagaagaagcacaatgataaataagtaaaatgtggagcatatgaaaacaaaacaaaaaaaagttgatccattatgaatggaagctgccattgtaactctgcttttttaggaaaaccagaccccatttagatgattttatttgtttttaaaggcaggttcttgctctgtcactcaggctggagtgcagtgatatgatcatagctctctgcagcctggagctcctgggctcaggcgatcctcccagcttagcctcccaagtagctgggactacaggcaccaccacacccagctaatttgttgttgttgttgatgttgttgttgagatggggtctggctatgttgcccaggctggtctcaaactcctggcctcaagtgatcctcctgccctggcttcccaaagttctgggattacaggcatgattttttattaatttatttgcagctgacaaatggtaattgtgtatgtttatggagtgcagtgtgatgttttaatctatgtatacatcatagaatgattcagtcatgctaattaacacatccatcgcctcaccacctcaccgttttttgtgtgtggggaaggcattaaaaatctcttagcaattttgaaatatgcaacacattactatttattaataatgcaatataaatacacaataatgtattaatgcatcactaaatgcgatgcaatgcaatgcaatgcaatagatcactaaaacttactcctccagtctaactgcaacttataccctttgatcaacatcttctccttctcaatccctcctcctcccctgcagcctccaggaaccaccttcctgctctttctatgagatcaattttttttagttttaagctcccacatgtgagatcatactgtaattgtctttctgtgccagcttattttactcagtataatgtcctccagttctgtccctgttgtcacacattacagaatttctttcttttagggctgtatagtattctatttgtatacataccacattttctttatccattcatccattgtgggacacttagtttgcttccatattttggctattgtgaataatgctgaagtgaacgtgggagtgcagatgttctgaaaagacttaaatgtcagacctgaaatggtaaagatgctccaagaaaacataaggagaaagctccatggcattggtctcgggaatgattttttggacaggacctcaaaagcacaggcaacagaagccaaaatggacaaatgggatcgtatcaaactaaaaaatttgtgcacagcaaaggaagcgttcagcagaggaaagagacaacctaaggaatgtgagaaaacgtttgcaaacaatacatctgataaggagctaatatccaaaatatataaggaactcaaacaactcaacagcaagaaaacaacccaattaaaaatgggcaaagacagctactcgggaggctaagatgtgacgatcccttgagcccgggaggaggaggttgcagtgagctgacattgcatcactgcactccaccctgggcgacagaaggagaccgagaccctgtctcaaaataaaaaataaaaatgtgcaaaggatctgaacatacatatcccaaaagaaaagacatacaagtggccaacaggtatatgaataaaatgctgaacatcactcatcatcagggaaatgcaaatcaaaaccaccattagctatcacctcacacctgttagagtagctattatctttttgtttgtttgtttgttttttgttttttgttttgtttttgagagggagtctcactctgtcacccaagctggagcgcagtgttgtgatctcagctcactgcaacctctgcctcctgggttcaagggattctcctgcctcagcctcccgagtaactgaaattacaggcacacgccaccatgcccagctaacttttgtatttagtttcactatgttggtcaggctggtcttgaattcctgacctcaaatgatctgccctccttggcctcccaaagtgctgggattacaggtgtgagacactgtgcccagcctagagtagctattatcaaaaagacaaatgaggtttgttgaagttctaacccctggtacctgcaaatgtggccttacatgaaaatagggtctttgcaggtggtaatcaagttaagatgagatcaaacttaattagggtgggtcctaaatccaatgactgctgtctttataagaggagaagcaggctgaccaacatggtgaaaccccatctctactaaaaatacaaaaattagctgggtgcagtagtgcacacctgtagtcccagctactcaggaggctgaggcaggagaattgcttaaacccaggaggtggaggttgcagtgagcagacgtcatgccactgcactccagcctgggtgacagagtgagactccatcttacaagaaaaaaaaaaaagacaaatcataacaagtgctggcaaggatgtggggaaacggggatccatttacatcattttaataacacaggctctatatgggtggtattgagttcccagagttgccattacaaaatgtcacaaacccagtggcttaaaacaacagaaatttcttctctcacagttctagaggccagaagtccaaactgaaatcaaggtgtcagcagagccaccacgttccctcagaaggttttaggggagaatctgttccatggtattttcttagtttctggtgctgccagcgatacttggtgttcctcagttcatagatgcataattccagtctctgcctctgttgtcatatggtcttctttctgtgtttctgtatgcgatttcttttttttttttttttttctgagacaagtctcactccatcacccaggctggagtgcaatggcacgatcacagctcactacaaccccaacctcacaggctcatgccgtcctcccacctcagcctcccgagtagctgggattacaggcgtgtgccaccatgcccggctaatttttgtatttttagtagatacggggtttcaccatgttggccaggctggtctcgaactcctgaccttacgatctgcccatctcggcctcccaaagtgttgggattacgggcacgagcccaccgcacctggccctaattactttatttttttgtaaatttttttttgtaaatttcatgtagcctgagcatacagtgtttataatatatacaggagtgtacaataatatcctaggccttcacattcactcaccactcaactcactccctcaccaagagcaacttccagtcctgcaagctccattcatgccaagtaccctatgcagctgaaccaccttttctcttttatactgtgtttttactgtaccttttctatgtttagatatgttcagacacacaaatactatgatgttacagttgcctacagtattaagtacagtaacatgctgggcaggtttgtagccgaggagctacaaaccacgtagcctgggtgtggagtaggctacaacatctaggtttatgtaagttcactttaagatgctcacacaaggacaaaattgcctaacaatgcatttctcagaacacgtctccctcattaagccacacatggctgtattacaatttacatataattttaagcgtatataaattgccagaaatcaccagatgaatccttggcggtgacataccccttcccccaccatagaacattgcagactggcccggacgcccagtatctcatgcctgtaatgccagcactttgggaggctgcagcgggcagatcacttgaggttaggagttcgagaccagcctgaccaacatggcaaaacaccatctttactaaaaatacaaaaattattcggacgtggtagtgggcacctgtagttccagctacttgggaggctgaggcaggagagtcacttgaacttgggaggcagaggttgcaatgagccaagatcgtgccactgcactccagcccgggtgacagaatgagactctatctcaaaaaaaaaagaaaaaaaaaaaaaaaggaaaagaacatttcagactggtaccagttacaccggctcttgatcccttgaatgtggctgaccctgaactaggatgtacttcataataacacgtccggctgggaatacttagtacaaaagaaagagtataaaatatcttttgaatccaccttgatattgattccatgttgaaatggtaatattttggatgtattgggttgaataaaacatctcatgaaagtgatttttaaaaatctagaaattgtctgcaattataattccagaccacagagaaaaacgagagacaggaatgtatagaaaaagggaacgtgggacaaagtgagtatgaaattcaactaacagaagtgacagtgcctagcatggggtccagcacttagtaggtgttcaattaatattcatttccctctcccttaccagtgaagggtatgcctgtcgtggggaatgtgtcttcaggctgagtgatcaggaaggactttctcaatggctggcacgtgaacctagtcatgatttcagctcttgaggttgtactagaagatttatatccaataatcgtaaggtaccacttagcatcacgctaagatgtattaattcatttatgcctttggatggccctttgaggtaggaagtgtggttgtctccagtttaccaaggtggcttgcccaaggtcatctgctggttggtgattaagccaggttttcagtgtggctccagcaggagtgggggctggggaccttctacctgctgtggtttctctctctctctctctctctctctctctctctctctcgatctgtggaacatcccccctgtcccccaaggtcccaagggtcttatttcttttggccaagccctttggagacctgcagatctggacacatctttgagagtttcaggaactagggccagaaatgctgggcagggtcatgaggagctgccactggggttgagaaggtgatggacatgaggggaagggtctttgcagaaaggagaggcgtccctgtaagcaggtcacagccactgggcctggccaactgcagccgagtggaatgtgcccctgccccatgaccatatgccccaggtgtgcaatgtggcggcccagagcacacactctgaaccatcttgacacatcttcactggttactagacccccctcagcctgtttccttggctgtaaaatggggatgacgctggtccctacttcctagggctctgagcaggagtaagtagcttgtcgtataaaacatgttccctgcagtgcctggtgcctgctaaatgttccataaacgtcagctgttattttcattcaggggaagctgaaatccatattttcatggaaaatctcccagtttttaaatgtggaccaataatttcagctttcacaaacccagtatgagtcggtatggcccctagggtgccaactcaaaatctctgttgagaattttgctgataggaagtggcctccttggaggtgtttgctgtgtcctgtgtctggcaagtggggtggttttgataaacgtgctggatggatgtatgggtgaatggataaatggaggaatgaatggagaaacaaatgagcaaatgaataatgaatggatggatgaatggatgagcgaatggatggatgaatggatgagcaaatgaatgatgtacacacaaaggaatggataaatgatgaatgtgctaatgaatttaagaatgatgaaagaatgaatgaataaatgaacaaatggatggatgaaagaatgaatgaatgtactaatgaatgaatcaatcaatgaagaaccatttaaaaatgaatgcaactgagggtttataagaaaaggtatcttaagcctgggcatggtaattcatgctggaatcccaatgcttagggacgctgaggcgggaggatcgcttgaacccaggagttcaagaccagcctgggcaacacagggagacctcattgctaccaaaaacaaaattgttttaattaagcgggcatggtggtacgtgcctgtagtcatagctacttgggaggctgaggtgggaggatcgcttgaacccaggagttcaaggctgcagtgagctaggatcaagccactgcattccagcctgggcaacaaagcaagatcctgtctcaaaaaaaaaaaaaaaagatgtattttagaaggtaaattcaatctgtccaaaactgagctctgaccttcccctaaacctgtgcccattcagtggatgagagctccatcccttaaggggttcaccaattcatccattcctttgtatgtacatcattcattcaccttggctcatccctctctcttacatccacaccgttccatcagcaaatgttgaatctgtcttaaatgattcatcccaaatcctccccgcttaactaccacccaactccagcccccatccatcatcatcatcacttgcctggatgggttcagtcacctccagcctggtctcccagctcccgtcctcacctctcactgtctactctcccactcggcagccagagggtgcctgtgaacacccaaatcaggttccatccctcctctactcagaaccctccacggctcccccctcactcagggtaaaagccaaagtcctccttgtggtccaccaggccatgcatgatctgcctgtcacctccctgccttcaccaccttcctcttttcccctcaaccactccactccagccacactgacttccttgtgctcttccccaaaaatgtcgggcagacacattcatgcttcaggaccttaaatttgctgtttcctctacctaagatactaaagtgacaagtcaacacactcaccttgaccatgcaatttaatgttgcagcctaccctgtggactctccaagggctcccagtccctctgtgatgctttactttttctcttaaaaaaaaaattgttatttaaaagaacttgtctcgctgtgttgcccaggctggtgtcaaactcctggcctcatacagtcctcccattccagcttcccaaagtactgggattagaggcatgtgccactgcacccatcccaactttttttttcccatagcacttttcattttccatcccactgttaatttacttattacgtccactgtctgtctcctccccttagagggtcagaccccggaagtccaggctctgttgcctaatgtatcctgagcccctggaacagagcctggcacaaaataggtactcaataaatgcataagagcaaaactatatgtaggcagaggacacacccagcttattcctcagtgatcacttctaaagttaaatgtccatggaaaacagtctcatccacatctctttctggaggccttccaagcgtgctccatgcagctctgttgcctgcccctgcatcagggaatggaggctctgctttatcctgccctgtggtgtgactcccagaggcatcagatgtggctgggagtgggagacatggaaaattggctcctgcaacagagaactatcagccttcccatcaattggttacttctaattctgttatttttcaggggcactgtcttctcataagctccatctatgcaaaactaagcccatgggtcatgatggttccctcaggccagaggcttgctggagagactaatggatcccctggctaaaatctgtgcttgggctgcacattggttaatttcttctgaaggaacagcctgagcctgacattctccatcttttccctggcaggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttgtgagtatcacccagccccacccctgccaactccctgatccctccctcacaccctttttccacttctctttctctggtagtatgtgtatcttctttggtcctcattgaatctgccctttcctttagccatttctataactgtcactggggccaatgttactgttgctatgacaatggaacccatctcccttagacctgagagctggaagctggaattcagaccaacaaatgctcctgtgattcctttctaagagagagggacagaggggtgctggtgaaggggatgttggaagagagacagagaaagacggagctcataagatagacagatagaaacagaaacatacatgtattaataatttttatgtacatctctggaaatgttcataacttatggttaagagaggatgccttagaaataaggagtggcttatatgttgccctcattttctctacttatttctgactctacttctctcttctttcaaaccttctgcttctttcctgttaggttggtgcaaaattaattgcgttttttgccttttttttttttttttttaaccacagttacttttgcaccaacctaatacttcctcccctgccctttttggcttccttattcattcatagaacatcccctccagtatctgcgagagcgttttgctccctcaaggtacaaggcccactaaggctttgccctctgggcctattcccagattctatgtgagttagcatgagatagtatcaaaattgagggccaagtgagggtgaggaaaagcagcaaaagatggggagatgtctgagcaggatttaaaaagtaaagagctcgaggaatcaacaagagcagcgactggggccaggcatggtggctcacacctgtaatcccagcattttgggaggctgaggtgggtggatcacttgaggccaggagttcaagaccagcctggccaatatggtgaaaccctgtctttacaaaaaatacaaaaattagccagatgtgatggtgcacacctgtaatcccagctactcaggaggctgaggcactagaactgcttgaatccaggaggcagaggttgcagtgagccaagatcatgccactgcactccagcctgagcaacagagagagtgtctgtctcaaaaaataaagtaaaataaaataaaataaaataaagagtagtgattgggcagtgaggggggcaggtggatgccctggctttggctcacaggccccaagtaaggacttctcaaaacgtcttttgcctactggctgtctaatttattcactgaccttctgacctggttcagaattgacttaggacagcaagaagagacagtctagtctttgacctagaaaggcccgtgagcctagtccaggccattgtcttcttataaccctccttgttcccagtcacgttggctgaccccccaggacacccctcaggaaccagttctccttcccagggccctgacctagtttcaaacttagtaattgtttttagtccctctggagtctcttataaatgaggactctacttcgtgttttaacttcctctaatactctatttttaatctcctatattctctctactaatcatcttgtacagtctgtcctggttcaggaacaagggactgagacttcctgcctgggtcctcagtgtctataaaggtcctttactcattcccactttccctttgagaaaactgagacacagagaggttaagtagattgcccaggatcacacattagcttggcatgatggcgggcgcctgtaatcccagctacttgggaggctgaggcaggagaatcgcttgaacctgggaggcagaggttgcagtgagcccagatcatgccactgcactctagcctgggcaacagagctagacgccatctcaaaaaaaaaaaaaaaaaaaaaaagatacacattaatttcagagatgtcaaaatataaacaaaaatgtatatcttggcatcagtgaagtgtagttgtttctctggatctcagactccacatctatgtggtagaaaccggatttgatggtcctgaaagttcttccagatgcaacaatgctaaggataagtaattctttcaagtcttgtgcatcacctgctatcatgtttccatggtaactgaggaacaagatctcagaaactcttcagtcctcccagagttacttctggtgggtctaggaatgtgtcagatgttacaaacagacttcctctgctgatattttggtcctaggaaccctagagttcccctcagacactaagatctccttagcgtcctataaataaggagaaattttggtgataaatactgtgaaggactttgacggtcagttcaaaacacctcttaaaagcatgacatagcaaacacccttggcaaatatcttagttcatttgtactgctataacaaattacccgagactgggtaatttgataagaacagaaatttattttctcacagttctggaggctgggaagcccaagatcaaggcattggcaggtttccctgtctggcgaaagctactctctgcttccaagattgcaccttgaacactgtatcctctggaagggaggaacactgggtccttacatggcagaaggtggaggagcaagagggacaaacttcctctgtcaacctcttttataagggcacctaatcccattcatgagagctctaccgtaatgacttaatcacctcctgaaggccccacctcttaatactgttacattggcaattaagtttcaacgtgaattttggaggggacacaaacatttaaaccatcacaaccaccaaacacaattagctttgtggccttaattagctatatgaaattcatggaagttagtttcagtcctctgtctctttcctttctgtatgctttctgctcctcagaaaccctcctcatctctcctttctatccattaagtacccacgcccttcctaactcctcatcttcctaccctaccaagaaagccctctcagaaaaggatctgatgtcagccatttatttgctggagcaaatgcatatccatgttttacccctccctgaggcatttgcaattttatgcttgctcatcaaagaacaaaaggctttgtcttactcaagactttttaggtcactcacaacacaggatttctaggggacataagacaagttttctgagttaggagaaaagccataccttaggtgggttgcctgtgtcgctccaactaagtacttaacttcaggattacaaataggatatcattatgatttctatttccttttatcctttggagctcagtcacgtagaagtagattaaatataattgttagatcacagcaccctggcattatggggccgttatggtccattgttattatgtgaattattcagttaattagtttattttttaaatgtgataaacacccaggaacccaccagtcaacacaaaagtccttggcaataatctatatccgatccttctcatcgaaccagggcaaaaactacaagatggagacccactgatatttttctcattccttttaaaatcggcctaaggttggttagcttgttggttggagggtagggcataattgttgctttttttttttttttttttttttagacaaggtcttgctctgtcacccaggctacagtagggtggcccaatcttggctcactgcaacctccacctcccaggtttaagtgattctcatgcctcagcctcccaagtagctgggtttacaggcatgtgtcaccacactggctaatttttgtatttttagtagaggcggggtttgccatgttagccaggctggtctcaaactcctgacctcagttgatctgaccgcctaggcctcccaaagtgctgggattacagacgtgagccaccatgcccagccagctcttcctttttaacagaggggaaactgaggcccatgggaaggacaccttggacagggcgtggccacagtgggtcatgtatataatcccagcactttgggaggctgtgctgggaggatcacttgaggccaggagttcaagaccagccagggcaacatagtgagacccccatctccacataaaaattttaaaaagaaaaaagataagtcagaagttgggtgtggtgacacatgcctgtagttctagcatgttggaggccaaatcagggaaactgtttgaggccaggagtttgaaaccagcctaacagcatagcaagacctcatctctacaaaaaataaaaagtttaaaaatgataataaaaggaaagtcagagccacctggaacccctaccctcagcaagcctaacctcctctctgtttcctccttctcccttctagactatgcagaattcattttcttaggactctttatgtccgaaatgtttataaaaatgtacgggcttgggacgcggccttacttccactcttccttcaactgctttgactgtggggtaagtgctcttgtttctaagagttcatttctccagctcttgcctggaatgacagatacctggacacattaaagggagaaaggtaaagtcacccctgaatatgagagactcagatggatgcagaaggaatgagaaaacaatcccaaacactggcaaggatacagtgtacccagaaccctcaaccaccgccagtgggaggaaaacgtatagaccccctttggaaagctaagtgggggacataagacaagttttccaagttgggagaaaagccatgccttaggtgggttgcctgtgtcgctccaactaagtacccaacttcaggattacaaacaggacatcaatatgatttctatttcttcttttcctttgtagctcagtcatgtggaggtagatgaagtataattgttagattacaacaccctggcattatggagccattatggtcctttgttattttgtgaattactcagttaattaatttattttttaaatgtgattaacacccagtaacccactagtccacacaaaacctaagtcctggagaataatctacgtccaatccttctcatcgaaccagggcaaaaactacaagatggagatatgacccagcattccattgctaggaattcatcctagaaaatctcacccagatacctaggagacacaggccagaatgtccctgcagctggaagtgaaattaaggttgttcgcaaataagtggagaatgcctggcccagggcagccctaatcatttaccatagtcctgttggtctcagaaaggcttaataatttatttatttttttttattttttgtttttattttttgtttttgagatggagtctcgttctgtcacccaggctggagtgcggtggcgccatctcggctcactgcaagctccgcctcccaggttcactccattctcctgcctcagcctcccgagtagctgggactacaggtgcccgccatcatacctggctaattttttgtatttttagtagagatggggtttcaccgtgttagccaggatggtcttgatctcctgacctcgtgatccacccgccttggcctcccaaagtgctgggattacaggcgtgagccaccacacccagccagcttaataatttataataactgaatgttgtactgttttctgccattatagaaaattatgttgttggagaaaacaaaatacatacaaacaagcaaaccttccctacataaatgacccaagtagttaaagaataaaaccaatttctttccattaaaaagaaaagaaagccgggtgtgatgcctcatgcctatagcctcagctattcaggaggctgaggcagcagaattgcttgagcccaggagttgaaaaccagcccaggcaacatagcaagaccctgtctctacaaaaattaataataattagccaggtgtggtggtgcacacctgtagccccagctactcagaaggctaaggtgggaggattgcttgagcccagcagtttgaggctgcagtgagctatgatcacaccactgccctccagcctggacaagagagtgagaccccatctctaagaaataaaagtaggccaggcacagtggctcacacctataatcccagcactttgagaggcggaggcaggtggatcacctgaagtcaggagttcaagaccagcctggccaacatggcgaaaccccgtctatactaaaaaaatacaaaaattagccaggcgtcgtggcacatgcctgtaatcccagctacttgggaggctgaggaaggagaatcacttgaactggggaggcagaggttgcagtaagctgagattgcaccactgcactccagcctgggtgacagaatgagactccgtctcaaaaaaaaaaaaagaaaaattttaaaatgtcctgagcaaccttgtttgtaatagttccaagtctcaatatccgtgtatccctttgctgtagaacagataaatattttgtggcatatctatataatgaaatactctgtgacaatcaaagtccaccaacagcagccacatgcccaacaacaggaatgaatctcacccatgtaacatggcacagaaggaggcaggagctagcaacgtaagtccatacagttcatgcaaagttcaagtggacaaaattaaactctctctctctctctacatatatatatatatatatatatattttttttttttttttttttttttttttttttttttgagacagagtctcactctattgcccaggctggagtgcagtggcgcaatcttggctcactacaacctccacctcccgggttcaagccattctcccgcctcagcctcccaagtagctgggattagaggcatgcaccaccacccccggctaattttgtattttttgtagagaccgggattcagcaatttgcccaggctggtctcgaaatcctgatctcaggtgatccacctgccctggcctcccaaagtgctgggattacaagcgtgagccaccacgccccgccttaaactgtattttttaaggatgatacttgaatacgttaaaaaggcgaggaccttgaaaacacaacgctcggtaaaagaaaccaaacacaaaaggtcaagtattgcataattccatttgtatgaaatgtccagagcaggcaaatccatagagacagaaagtagattagtggttgctagggtctgggtgagggagagtggggagtaactgctcatggggacagggcctcctttgggggtgatgaaaatgttttggaacttgatagaggtgatagttgcagaatattgtgcatgtacctaaaggcactgaattgtgtaattcaaagtgtgaattttatgttatgtgaatttcacctcagttttttttaaggtaagaaaatggttattacaaaattcaggatggtagttatatcacagtgtctctggaaacttccagggtatccacatgtccctttttattttattttattttttattttatttgagatagggtcttgctctgttgcccaggctagagtgcagtggcaggatcatgaccctctcctgtctcaaattcctaggctcaagctatcctccctcctcagcctcctaagtagctgggactataggcacatgccaccatgcttgactaattttttttttttttgtaaagtcagggtttccctgtgttacccaggctggtcttgaactcctgggctcaagtgatctgcccacctcggcctcccaaagttccagaattacaggcatgagccactgccctagccttctcctaattgttgacataggtagtagttgcatgacattcactttgtaattatgtgtttcaggaattctcaggcctgtgggagctcttaataaataaaaaagaggccaggtgtggtggctcacgcctgtaatcccagcactttgggaggccgaggcaggcggatcacgaggtcaggagttcgagactagcctggccaacacagtgaaaccccgtctctactaaaaatacaaaaaattagccgggcgtggtggcgggtgcctgtaatcccagttacttgggaggctgaggcaggagaatcgcttgaacctgggaggcggaggttgcagtaagctgagatcgcgccactgcacaccagcctgggtgataagagcaagactccatctcaaaataaatgaataaataaaaataaataaataaataagaggccgggtgcagtggctcaatgctttggaaagtggaggccaacagttggagagaccaaagcaggaggatggcttcagcccagaagtttgaggccagcctgggcaatactagcgagacactatctctataaaaatgttttaaaattagccagatgtggtggggcacacctgtaatcccagctactcaagaggctgaggtgggaggatcacttaagcccaggaggacagtgctgcagtgagctatgattgcgccactgcactccagcctgggtgacacagtgagacccggtctctatagataaatgaatggatgaatgagggggtcaaggatcctcacccggcttccatttggagggaggagtttggttgagttcttgcaaggttggtacctaggaaatgcttgccagttctggagcccagacactgtccctggacatgagaccaggttctctgccctaggttatcattgggagcatcttcgaggtcatctgggctgtcataaaacctggcacatcctttggaatcagcgtgttacgagccctcaggttattgcgtattttcaaagtcacaaagtaagtctttggggttcctggacatttgtacagggggtggggatgggggacatggtggggccgcctccagaaagttgggaaagtgagcctcgtgtttcgagggctgactccggggccctgcctcccccgcctggcctgagtcctcgcctggcctctgtcggcaggtactgggcatctctcagaaacctggtcgtctctctcctcaactccatgaagtccatcatcagcctgttgtttctccttttcctgttcattgtcgtcttcgcccttttgggaatgcaactcttcggcggccagtaagtccttcacaggaattccaactcctggttccctggggtcaggctcagggaacacacagtcccctccaccgtgcaggctgccttcctcgtagcccagacacccattgcggtcacccaaatgggcagggccctgggtaccactcagggtttcctggggacagagatgatggagacgttcgtttccttggagatgagatactgagccacaccctcagagcaccccgggtggggccaacgtgaaatgtctgtgtcctccctgcaggtttaatttcgatgaagggactcctcccaccaacttcgatacttttccagcagcaataatgacggtgtttcaggtacagcctccacctggccccacgggccaacacctctcagtgtcacagatgaaagtgcctgctccacatccaaggggcttccctgaactcctccttctctacctggccttttcacaccactttgaaacacagattttatggttatcattattcaattatggtgaggccaacagatcaggagatgaatgtcattggaaagatagtttgtggctgggcacggtggctcacacccataatcccagcactttggccaggtacggtggctcacacctgtaatcccaacgctttgggaagcccaggtgggcggatcacttgagatcaggaattcgagaccagcctggccaacatggtgaaaccccatctctactaaaaatacaaaaattagccgggcgtggtagcacatgcctgtaatcccagctactcgggagatgaggcacaagaattgcttgaacctgggaggcagaggttgcagtgagccaagatcgcgccactgcactccagcctgggcaacagagtgagactccatctcaaaaaagaaaaagaaaaaaaaaaccactttgggaggtcaagatgggaggactacttgaggccaggagtttgagacaagtctgggcaacatagtgagactccgtctctgcaaaaaaataataataataattagctgggcatggtgatacatacctcctagctactagggcagctgaagtggaaggattgcttgagcccaggaggttgaggctgcagtaagctacaatcacaccactatactccagcctgggcgagagagcaaagccctgtctcaaaaacgaaaagaaagtttgttatactcacagatcctcagagaaggagcacaccatgcaggaccaagcagagaagcaacagggtcaagcaggaagagaaggaaaatgtgggcaagaggcttgattgtggtttccatgggacggaatgggtgaggcagagtaaacagctcgagactggctagtttggatcatttcagtgggctctggggcagaggagctgttcctacttgtctaggacctggccttggggtgattagggcaggtggatagtgctgggaagataaaggaggtggttgggatatgggctggttgggatattgtttggtttgcttttaaaaagcctgctcagggctaaattgtttactacctctagggactggctagtgctggaccgggcagtccctccagagtcagcaagaccccagatgcatcagaataaagaaaataaaatgcgtggccaggccaatgaggtggttcatgcctgtaatctcagcactttgggagaccaaggcgggaggattgcttgagcccaggagttcaaggctgccgtgagctccagcctgcaccacagagcaaggccctgtctcttaaaaaaaaggcagagaaaaaaaatggctaatacacccatcaaatctgaagataccttggtctcatattccagggtgatcaacccaaagcaacttctgcacccatgtgggcgcattccctgaggcttgggactggcccagccgggaccttcagagcatctttggtggattctttctctttgagggactgagagtgtatagaaaatgtgacttcactctctccttctcctggggaggtagtttctaaatgagaccccaagacagggagttgaagaggaaaccttccatgaagggaagttctgagcccccacataagcgattttttttttttttttgagatggagtctcgctctgttgcccaggctggagtgcgacggcacgttcttggctcactacaacctctgcctcctgggttcaagcgattctcctgcctcagcctcccgagtagctgagactacaggtgcatactaccatgcctggctaatttttgtatttttagtagagacagggtttcactatgttggccaggctggtctcgaactcctggcctcgtgatctgcctgcctcggcctcccaaagtgctgggattacaggcatgagccaccacacctggcccataagcgattattaatagcactgatcgctagtcatgtatctttagctcagaggttctcacccaaggacaagtctgtcctccaaggacatgtagcaatgtctgcaagcattgttggttgtcacagctagggagagggtgctactggcatctggtgggtggagactaggaatgctgctcaatatcctacaatgcacaggacagccccaaatagaataatctggccccaaatatcagcagtgctgaggcttagaaaccctgttttagcagattcatgtttttggagttctttaacatttactttatcctcatggggatatggatagaaggaaggaagttggatcttttttaaaggagcatgtaggtgctgtttgaatatccccttggttctttcagtatgcatcagcacaacttgcgtctgtcaacacctaatcctttgccttggtctttctctggtcccctgctctgcccccaaggaactgcagtccagcagtactgtgaattttttgtgccacaccttaaaaggagcagccgttggtggataaataccccagctccctcaccctcaggtgggatgacccctagagctccccagcaagaccaagccccggttacctacagtggaaactcgcttgatcacatactgtttacgttccaccctcttttcccttttctcacttctcctctcccctactggtgcttcctgagatcacctcccagacaaaccacttgcacccgaacccttgttccagggtctgcctcaggcagggggaccccaaacgtgtccttgtgctacatttgtgctatccacgtagtagcttgtttaatcatcaccatgaccacatgaggaacacaggtaaatattaaaatcctgtcttagtctgctcaggcagccataacaaaataccacacactgggtggcttatacaggaaacatttattctctcatagttctggaggccgggaagtccaagatcaaagtgttagcagggttagttagttcctggtgagggccctcttcctagcttgcagatagccaccttcttgctgtgtcctcatatgtcaaagagagagagagagagttgtgatgtttcttcctgttctttttttttttttttttttgagacaaaaatctcaaaaaaaaatctattttttttttaggcaaatcacatttttttgtcacccagcctggagtgcagtggcacaatcatagctcactgcagcctcaaactcctaggttcaaacgatcctcccacctcagccccttgagtagctgggactacagatgggcaccagctaatttttttaaattttttgtaaagatggggtcttgctatattgcccaggctaatcttgaactcctgggctcaagtgatcctcccaccttggcctcccaaagtgctgggattacaggcatgagccatggcatgcggtctcttcctgttcttataagggcactaataccatcatgaagtcccccatgacctcatctaaccctagttacctcttaaaggccccatctccaaataccatcccatcataggttagggcttcaactcatgaatttggaggcgggcacaatttagtccataacaaatccccttaatcacatcaagtaagacagagttacaggagggtctgtgactcctccagggtcccattttcctagaagccaggctaagagccccacgacgcaggaacggccctttctactcgcaaacaaagagaaaagccaaggagaagccaacacggagtctggctctgcaaaccgggcaggattgttaaagacctcctgggctcggggatggggtgggcggattccggctccacagctgcatctccaaggggcccgtggctgagaggggggttggctgtgtgtttcttcctcccctttcagatcctgacgggcgaagactggaacgaggtcatgtacgacgggatcaagtctcaggggggcgtgcagggcggcatggtgttctccatctatttcattgtactgacgctctttgggaactgtatccttcatggagagagagaaggggacaggcctggacctctggcagaggagaggttgcaggggctcaagggagggtactgagagacccagatacccagggcccaagtggtgtcccaccagtggttgcttttcctgactcagacatttgcagacaccctcctgaatgtgttcttggccatcgctgtggacaatctggccaacgcccaggagctcaccaaggtggaggcggtgggagaatgtttctctggcaaagttaccacctgcccatggcagatcaggacgggggtgggggtgggggtgggggtgggggtgggggcatgggaacagggttagaacttttgccggggatgcaccatgcaaagagaaggcgcctctccccccactcccagaaacagactgtccctcatcaagcaaattctacagccaagagggtgggaagggggaaggcagtgaggtcgctgcaggaaacggatggcaaactcaaccaaaaggccgtttacagggagtaagcagggtttccaaggaatggtgtagcccccaggctagtggatgggagagggagtgctgttatggggacccagtcagagctggggccaaggaaaaagggctgccaccagccctgggaccttagagaacccagaaccatggcaaggcacagatggagtggccaataaatgtccccaccttctctcttcctctggcttcccgctggagcctccccttagccaaacgcagcatgttaagagctagcctccgtccagcctaagcctctccccaaggaccctattaagttaagattacatgtaacaggtacagggtcttcctctcagccctggggtctccctcagcattgcagccccacctccagtgcctcgaggtattcaggacatgtttgtgaaattgaaccaaaccaagcagacgttgccaacgctccatctgccggccctggcaggagggagagagagtttcccggccccagctcccagtggagggaagcggaagtctctgccatcccaagcacacggccacaagcctggccactgtggagctggctggcatggctgagccgagggctgatccagccatgagctcatccaagttccaagagtccatccttaggggctggtgcaggagggtagcagaaggggagggagaaaggccagttcgtttatctcctgggaggtgtggacattcctctccagatccacattctttctttcattgatcctacaagcatttcttggtcatttaatacgtgtttttaatcctattcagtcctcatggaaaccttaggagccaagttctctgagccccattttacagatttcatcattcagtaagcacttaatgagcacctactgtgtgaccaaggccctggtctaggacttagggattaagcagtgaacaaaaaaaggcaaaaatccctgcctccgtggagcagggattcaagaggggagacagacaagaaacaagataaatttgtaaacatacgtagcttgtcagttggtgataaacacaacagagaaaaattcagtagggaaagtcagggagagttggaattttagatgagatgtgtgtcgcacagagaggttgagagacttgcccaaggccacacagcagtaagttgtggagctgggatttgaacccaggccgtctgggtctgcagcttgtgctcttaactgctgtgtaccagttgcttgaatttgggcatgttttatgctcacttgggaacctgtgggaaatgcagattccagggcccagcactggttctatagattatttggggagcctgaggatctgcattttaggtgtttctgaggcagatggtccagagacctagctctgaaaaatgctgggaatggtgccaggaggggtgggggtggccctatgagagcagggtggccagccagatcccatctccatgttgtctctgacagtgtcctgatctgaccatttccaaggtggtaaggttgctccccgttccagtgattcggagcacagcgggagagctgcctgcaatggcatgacttttcttatgggcgggttcatttctggccatttctttctcgttgccttttctttgctttttctttgttggcttttctgttttacgaatgaggccctgcatgaaggctgaagaaggatttaaagtccaaaaacgtctttttctgtatgtatttttaaaacctcttcccccattctcctcctctctgaacctaaccaccagtgagcagcagcaccctgggcagttggctgtagcccaagtgccctgctctcctctccccaccgccttcctgtcatgggggctgggaatataaattcctctcctcattctccttctgggggctgttgacagtgcatggcaggggccatcggatgccaggctcttctgtgtgtgagggtagttggtgttttttgaaagttggttcagagagttcacatggctcagaaagcctagtgagaggaaaatctttgcactgctttccagctcattaagacaggatgcaggggccaggcatggtggcacatgcctggaatcccagcactttgggaggccgaaatgggaggatcatttgaggccagaagttcaagaccagcctgggcaacatagtgagaccctgtctctacaaaaaaaaaaaaaaaattaaatgtatacaggcatagtggcatgcacctgtagtcccagttgcttgggaggctgaggtgggaggattgcttgagcccaggagttcaaggttacagtgagctatgattgtgccactgcactccaggctgggcaaccaagggagactctgtctctgaaaacaaacaaaagaaaaaaaaataggctgcaggaaagtcttcattgtaggaagagaagggacatttttattttttgttatctggctgtgtgttaaaataggcttcataatgagttagatgtcaaacttatacacagaggggatagcaatacacttaaccaatagcaggtacccattccaattggggagccttggttctgattggtcgaaatatttcaaatgttgcccctggtcagcaacagggtcagaagtgagtccccaaggcctagttcatgttttgtgaacaaagattccacgtgccttttaggacgagcaagaggaagaagaagcagcgaaccagaaacttgccctacagaaagccaaggaggtggcagaagtgagtcctctgtccgcggccaacatgtctatagctgtgtaagtgcccctaatccctgggatgctaccctggctcctgaacgtccacactatcccaggcacagatttgggaagcagtgggggtggtccttgacagaactgagctttaggaagagacacttcttgtccttccacccactttcactcaataaatatttggttagcagctgttatgtacccagcactgttctaacttctggggatacagcattaacaaggaggaaaaaaaaaatcccacctgtgtgtagccattctagcaagggaaggagtcaataaattagataaataagtaaattatatattgtgttagaaggcgatggaactacagagaaagtaggggagggaaatagcaaatgctgggagtgaagagagttgtgattttaaacgaagttgtcagggaaggcatcacctagaataggggtccccagtcccggggctgtggactggtaccaggccgaggcctattaggaacggggctgcacagcaggaggtgaacagtgagcaagcaagcattaccgcctgagctccacctgccgtcagatcagcaggcagcattagattctcataggaacacaaacactattgtgaacggtgcatctgagggatctaggttgcgtgctccttttaagaatcgaatgcctgatgatctcaggtgaaacagtttcatcccaaaaccaccccccacacctaggtctgtggaaaaactgtcttccacaaaactggcccctggtgccaaaaaggttggggactgctcacctagaaggttacatggcctgaaggaggtgagggaggagccactggggggcctggggaagggcatcccaggcagagggaacagcataggcaatggccctgaggcaggaacatgcctgatgtgaaggaggcctgtgtgactagaatcgaatagtaagtgtgaggaggtgaaggcaaggaggtgacaagcagattacacagggccttctgggtcaggggggaggacttgggcttttgcccctagccaggtgggagccatggagggttcttgagcagaggaggctgggacctgactcagatgctcacagactcctagcattcagtggggagtagagggtggagagcaggagtgggaggctgagatgtgggttggttcgcctgggtcatccatccaagctacagtgcctagcaatgctctaagtcctgtgaccatgccactgcaggaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaagtaagtggaggtgacctcgaatccgcagaatgacggtaacattaataatgacaacagccaaagtagcacgtgctgtgtatttgtttataaaaatatattataaaatgctgtatttggccaggcgcagtggctcacgcctgtaatcccagcactttgggaggccgaggcggatggatcacgaggtcaggagttcaagaccagcctggccaagatggtgaaaccccacctctaataaaaatacaaaaattagccgggcacggtggcaggcgcctgtagccccagctactcaggaggctgaggcaggagaatcgcctgaaaacagggggcggaggttgcaatgagccgagatcacaccaccgcactccagcctgggcgacagagtgagactctgtctcaaaaaaaaaaaaaaagtgctgtatttggccaggagcagtggctcatgcctgtaatcccagcactttgagaggccgaggcgggcggatcacttgaggtcaggagttggagaacaggctggccaacatagtgaaaccccgtctctactaaaaatacaaaaattagtggtggtgcccacctgtattcccactactcaggaggctgaggcgggagaatcagttgaacctgggaggtggaggtaggttgcagtgagctgagatcgtgccatcacactccagcctgggcaacagagcaagactctgtctcaaaaaaaaaaaaatgctgtatgtttttgtttttttgacacagggtctcgcctgttgcccaggctggagtgcagtggcagtcatagctcagtgcagcctctacctcccgggctcaagccatccgcctcagcctcacaagtagctgggaccacagacatgtgccacatgcctggctaatttttgtagagacagtgttttgtagagacagggtttcactgtgtttcccaggctggtctcaaactcctgaactcaagcattccgcctgccttagcctccctaaagtgctgggactacagggttgagccaccacactcagcctaatttttttacctttagtagaaatgaggcctggctctgttgcccaggctggtccccaactcctggcctcaagcaatcatcccacctcagtctcccaaagtgttcggattagaggcttcacagatggggaaactgagagattgagtgagctcctcaaggtcattcctctaaccagtgtccttgaacccaggctctctggcaccagaggccttgagcatttcagggaaactattaagagaagccccactgtcgtccagaattatatagtcttctgtgttcttgctgtgtgacttttgcaaagtgacttcatatctctgggcctcacacaatggaaatagtgggatctaattgggtcattgccaggattgaatgaggtaatgtatgcaaagggcctggaagagcagctgacacataataagtgctcggtaaatttagagcatttttggccattttcagccaactctatttacctaatgctattctttggaagtttgaaaagccactctgttgggaggccaaggtgggaggatcacttgataccaggagttggagaccagtctgggcaatagaggcagaccccatctctataaaatataaaaaattaaacagatgtggtggcatgcacctgcagtcccaactacttgggaggctgaggcaggagggtcactggagcccaggatgtctaggctatgatgagctatgattgcaccactgcacttcagcctgggcgacagagcaaggctttgtctcaaaaaataaaataaaaaataaagaaaaagaaaaggcactttgggccgttagaattgaagggagagcagagtttcaaagctttggatgcagcgggatgtggtggctcatgcctgtagtcccagcactttgggaggccaaggtgggaggatccacttgagccccggagttcaagaccagcctgcgcaacatagtgagacctcaccttttaaaaataaataaaaatgttagaaagcttttgaggcatcttccaggccagcaacttatccattcagaaccagcatcctctttttcataacgacattttgtaatactttctagcagatgctatagtgattctgcatatagggactcaacaacttacccattaaaatagacatcgtagacattgtcctattacaaattaacctgctcttagtcctcttttatattaccatcagggcataatattgatttttttaatgatgggtttaagtgatcctgttgtatgacatatgaggtaggccagcacttctcaaaatctaatgtgtatgtgaatccccagggatcttgttaaaacacaaattgtaattccgtagggctaaggactcagtggagcctgagattctgcatttgcaacgagctcccagatgaggctgatactactggtccagggaccacattttgagtaatgagactctggaggacatagtgaagtaattctgatatgtacaccatacacaaaatcaccatgaagtgacaggcacaaatgatggctaactctgggttgtgtggacaattcaaaccacatgaggggagttgccagcagtgtcaagatgttccacaatgttgaacacctcttggcaaagttccatatacaaaagagtctagtctttcttccatttatttaatagttgcattgcaggaaaatgcaatgtatattaaaaacatacaaaaaatatgttgtgttcttatgtaaaagagttaggtttaaactaaaagcacaggatcaggtgcagtggctcccacctgtaatcccagtgcattgggaggctgaggaaggagaatcgcttgaggccaggagttcgagaccaacctgggcgacataaggagacctcgatctctacaaaagaagttttttaattagccaggtgtggcggcaggtgcctgtagttctagctacttggaaggctgaagcaggaggattgcttgagcccaggagttcaagattacagtgagctatgattatgccattgcattccaacctgggcaacagaacaagtccttgtctcaaaaaaaaaaaaaagaaagaaagaaagaaaaaacccaaacaaacaagcaaactaaaagcacaggtaattacaagcaagatttttcacctctttgagggacattagaaagtcatgaagaggaaaagataagtctttcccatatgggactgtcatgtacatggtagggtatttagtataactgcctaccattctctaagtgcctgcagtgcccctcaatcattatgttattaggtttccacgtagttctacaacagttttctgaaaaccattgttctaggtcattctttcgcttcaatcttctcctatgggtttatgcattcattcagttagtatttactaagtgcctactatattctaagctcatgctgtgagttcagtcacacaactgcaagtgaagtggtctgagacattctgagaaatacgaccaagaaactgctcccagggtctcagggcaggtttccagaggagcaatctgagaagggagtagagtgtttcagtctaacaacagcatgtgcaaaggccctggggtggaccagaaggaggccagtttgcaggacatgactagtgacgagaaagtgacaaagaaattgaaggtgcattgatgagactctggggctgtcagtcactcaggggaatgagagatcaaaacgggagtttaggtggaataaagtgtttaccacagcactctctgtatagtaaagaccaatgaagagccaggtacaggccagtgtgatggttcacgcctgtaatcccagcactttgggaggcagagacaggtggatcacctgaggtcaggggttcagaaccagcttggccaacatggcaaaaccctgtctctactaaaaatacaaaaaattagccaggcgtggtggtggacgcctataatcccagctactcaggaggctgaggcacaagaattgtcctgcgaggcagaggttacagtgagctgagatcacaccactgcactccagcctgggcaacagaacaagactctgtctcaaaaaaaaaaaaaaaaaaaaaaagccaggtacagtggtatgcacctgtaatcccagctactcaggaggctgaggcaaaggattgcttgagcccaggagttcgagaccagcctgagcatttagagaatgggaggccagtatactaaataccctaccatgtacaagacagtctcatatggaaaagaattatcctttcctcttcatgactttctagtgctcctcacacaggtgaaaaatcttgcttataattatctgtgcctttagtttgttggtttatttagggttttgtttgttttttttttttttttgaggcagggtcttgctctgttgcccaggttggattgcagtagcattgctcattttagagatgagcaagacctcatgtctaaaaaaaaaagaaagaccaatgattattaattactcttgctattattactaatattactgttattatcagccttattaacagatctactgttattgaaggaggcagagtgacagggacaaaatgtctctccctaacaatatgccaggaagagtttttgaaagacaacagtaaacattggaaactacaagagcagcaaagcctggttgtgaaaggcaaggactttggggcaggcagtcacattcctgccctatcacttccaggctgtgtgactttcagaatttcactcctctctgggcctccatttcctcatctataaaatgaagataagaatagtagctacctccttctctgggtataagatttaactgagccgggcgcggtggctcatgcctgtaatcccagcactttgggaggccgaggtgagcggatcacaaggtcatgagttcaagaccatcctggctaatatggtgaaaccccatctctactaaaaataccaaaaaaaaaaaaaattagccgggcgtaggtggtgcacgcctgtagtcccagctactcgggaggctgaggtaggagaatggtgtaaaacccgggaggcggagcttgcagtgagccgagatcgcaccactgcactccagccggggagacagagcgagactccatctcaaaaaaaaaaaaaaaaaaaaaaaagatttaactgagttagtacgtgtaaaatgctttgagtggttcctggcttataccaagagctcaataaatgttagcaattttttgtagcattttggggtctcactatgttgcccaggctggtgtcaaactcctggcctcaagaaattctcccactttggcctcccaaagtgctggatttacagacatgagacaccatgcctggccatgttagctattattaatatgaatattattaagtactcaatgaatgctatttttagcagtaatagtaagcactcaggaagtgtcagctaatactgttagtaatactctcatcaataaacataaaaagcaataaggacccagcttgcccaaatcccacagatggttcctgctccctctcttcttcagaggaagaaactatctccccactttcacccccatagcctcagctggccagacccccattctgaaccaggggagtactgctaattccattattaatagacacatcaaacaatctggccgggagagacattattcatttggctgataaagaggttctaaggctctttggaaataaaagttcatgaagattcatgcactttaagagaaaaaaattcaagatcagtcattcatctgctttaaaaaaagtggcaaagataaaactttatttgagaatataaaataataaaaagacattttcgttctctgttgtgacaaagccagtggccttcggaggtctgccttgtacatttttcctcttcttcagtcattccttgaggctttttgcaaacgtaccctgtgtttttcattctccagcatattgataattttttttttttgagacatggtctcgctttgtcatccaggccccggagtacagtggtacaatcatggctcactgcagccttgacttcctgagctcaggtgattctcccacctcagcctcccgagcagctgggactacaggtgtgcatgaccatgcctagctaatcttttgtattttttgtagacacagggttttgccacattgccaaggctggtctccaactcctgggttcaagcgatcctcccacctcagcctcccaaagtgctgggattacaggagcgagctaccttgccaggccgatcatatttttttcctttttattcactttgtcttctcctcattcctaccttcatctgtctttcagtggctcactccagtgaaaagtggactgacgcacattctatttcatataattcaatggctgctggccccagatcccccataccaggtggccgagcccagtggccctgcagggtggacaaaatgagggtggaactttcccagactgtcagtaaaaatctatggaggacagagcttctgcctctcccttgcaaccaggcagtgccttctcccaggcctatctgcttgcaaagggaacttttgccaagacctgctccactctagaattcttatctctgctgttcgcatcctaattccacctgcatctgtcaccatgacaacctgctccccaaaaggaacaggaagagagatgctggacttttgagctccacagtttatcctgcatgggggtagggagtggttaattacttagcactctaattcttacggtacccccaatgggcccaagttggtttttttaaaaaaaaacagtcttgctctgttacccaggctggagtgcagtggcacaatcatagctcactgtagcctcaaactcctggactcaaatgatcttcccacctcagcctcccaagtaactggaacaacagtctcgtgcaactacgcccagctaattttttttttttttttttttttttagagatggggtctcactatgttccccagactgatctcaaactcctgggctcaagcgatcttccttcctcagcctcccaaagtgctaggattacaggcgtaagccactgtaccaagctgccccattaaagctttgaacaccagagagcccagctcagctgttttccagctgggtaactctgggtaactttgcctctctgaacctcagtctcctcctgtgtgaaatggggctgatcactatacccatctcggatggtggtagttgcagggattaaatgagttaatacgtgaggtccttaggacagggggtggggacacgagataagcaataaacaggaactgctgttattatcacccccacataatccgatctcagggtctgagtgtgccccaggcaaggtgtccacagccctctgcagaaggatgcccaagtgatcagctggcacaagaacgccacgcacagcaggtgttatgcaactggccacctattccaggcagaggatgccagatccccagggagaagggggtaggggtgcagcttcaaagttttctgccccttttgagttctccttggagacactttggaaatgaaacctcccggaaattgatattaggcctctgcaggctgagcttgttaaaatttcccaacaaacagagccaacagacgctctacaaggaagcaaaaacaagacaaaacacattggcagacccttttccatctgctcttggtagatggtattcctctaagaaaatgccgccacgagtttctccatggcttcttgagctggtggccaaaggatttaggttctctttgaaattataacttaactgggcctgctttatggcagggatatcactctctgaaatgtgtatatatatgtgtatgtatatatatacacatatatacacatatacatacacagggccaggcgtggtggctcacacctgtaatcccagcactttgggcggccaaggcaggtggatctcttgagccccaggagttcaataccagcctgaacaacatagtgagaccctgtctctacaaaaattaataaaaataaccaggcatggcagtgtgtgcctgcaatcccagctacccagggtgggaagatcgcttgagcccaggagttaaaagttgcagtgagctatggtcataccactgcacttcagcctgggcaacagagcaagaccctgtctcttaaaaatatattattattattatacacacacagacacacacagacacacacacacattacagatgatgagaaaatactctcagccaggttttcatgatacacaacttctcaaaaagcatcacaagcaggttagaattagggatttctttgtggactgtccaagatgttgaggaaatattggtttagaatttacctcatttaggccagaaatggtggctcacgcctgtaatcctaacactttgggaggccaaggccaatggatctcttgaagccaggagttttagcctggccaacatggcaaaatcctgtctctactaaaactacagaaaaaaaaaaaaaaattagccgggtgtggtggcacaggcctgtagtcccagctactctggaggctgaggcaggagaatcacttgaacctgggaggcagaggttgcagtgagccgagatcgtgcattacacttcagcctgggtgacagagcaagactccatctcaaaaaataagatagataagataaatatatataatatatatgttatatatataatatagaaactacagaacaagtgatctttgtatgtttccagaatataacagcgggacaggcataggatagacgttcccattgcaaaagggagaaattggaagggataaagaggtcaccagtcctaagcaagtgctaaatccagcaagacaaatcccattaggtttcaaggcctgagaataatcctcggtgactctcagctcattaacatacttagttctcagagccagactcaatgaggttacggcccgcatgttatgggtcaggaactgaggctaagtaactcactggagattatgtggtaaagaaggtccaggatcattgcttcagtctccaggatatggggaaggttctactcctgttatcccaaattttaaaatgtgggaactaaggctcagagaggttaagcaaatcacacagggttgcacagctagtgatgttgctgagatttccctgtgtgtagtggctcatgcctataatcccagcattttgggaggctgaggcaagagggtcgcttgatcccaggagtttgagaccagcctgggcaatatagtgagacctcatctctacaaaaagaaaaattaaaaagttagccaggcgtggtggcaggcacctgaagtcccagctactgggaaggctgaggtgggaggattgcctgagcctgggaggtggcgattacagtgagctgagatcgcgccactgcactacaacctgggcgacagagtgagaccctgtctcaaaaaaaaaaaaaaaaaaagacattgccgagattcaaacccaggtcagcctgtcttctgaaatgtccctctatgacccactcacaaaactgagaaggcagaaagttgcttggacctgtctatttcccctgtgcagtctcagagaaacagtggaactgcctcggtttctccttccgggaagtattcatagaagcatcccacttacctactttggtctgaaaataaattagcttgtctctcttccacttactaaaaacaccgtgggtttttgcaagttaaaatgcaaaaataaaatgaggagaatggtgctggtagtttagccagtgggaagccctctggggaaagccagccttttatttattacttatttatttatttattctttctagatagatttatgggaaaccagggctgtgttgtccaggggtctgtagtccagaaggcatcagatgggctactaagtgagtctttgtccacctgtagatggcaagaggcagggcccaggtgtccatggcttggagaggcaggggttgatgggaggtttgaggctgtgggatctctcctggggcctcagtatcctcatctggataatggggacattctggccaggcacggtggctctatatatccagcacttagggaggcctataatcccagcactttgggaggctgaggtgggtggatcactgtaggccacgagttcaagcagcctgggcaacatggcgaagccctgtctctactgaaaatagaaaaactagctgggtattgtggtgcacgctggtaatcccagctattcgggaggctgaggcacgaggatcacttgaatccacgaggcagaggttgcagtgagccaagatcctgccactgcactccagcctgggcaacagagtgaggctctgtctcagttaaaaaaaaaaagaaaaaagaaaaagaaagaaagaaaaagaaaatgggggtattcatttatcatttgacagtaagtttacccagcattgactgtgtgagaggccctgtactaggcagtgaaaactcagctaagaataagaaagttaaaaacaagctgggcattgtggtttacgcctgtaatcccaacattttaggaggccgaggaggaagaatcacttgaggccaggagtttgagaccaccctgggcaacatagtgagacgccagtctctacaaaaaattgtaaaattagccagacatggtggcgtgagcctgtagcctcagctacctggaggctgagatgggaggatcactggagcccagaagttcaaggctgcagtaagctatgatcctgccactgctctccagcctgggcaacagagtaagaccctgtctgaaaaaaaaaaaaaaaaagaggccaggtgcagtggctcacacctgtaatctcagcactttgggaggctgaggtgggtggatcacttgaggtcaggaattcgagaccagcctggccaaaatggtgaaaccccatctctactgaaatacaaaaaattagccggtcgtagtggtgggcacctgtaatcccagctactcaggaggctgaggcaagagaatcgcttgaacctgggagccagaggttgcagtgagccgagatcacgccactgtacgacagagcaagaaaaaagaaagaaagaaagaaaagaaataagatgatggggagttgtggaaacctgtccatgggcacgtgaaggtcttgacctctgaccaagaagtgaacaggctcctctcaattccaggcactgcagggatctgggacatgacttctccatgaccaaactgtaccctttccttttcttttttgtttttttggtgacagggtctcactctgtcacccagactggagtgcagtggggcgatcacggctcactgcagcctcaacctcccaggctcaagcaatcctcccacttcggcctcccaagtagctagaactacaggcacacagcgccacgcccgtcaatttacacattttttgtagaaatagggtctcactatgttgcccaagctggtcttgaactcctggccttaagcaatcctcctgcctccgcttcccaaagtgctgggattacaggcgtgagccactgcgcccagcccaaattgtactcttgaaagatggaatcttagctaggatcctgaactgttgccttttatcctaaatcagttgttggttctttttcattcacttgccttcctcagagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaaggtgagaccctctgctctcacatcactgggcaggggacctggcgtccctggagccagaggctctgctgagtgaccctggactgtgaccccatctctctggcctcagtctcctcccctggaaaatgggcataggcgtagtttcctaccccacagggctgtggagggttcagtgagataatttgtgcacagtgcctggcacggggttgtgttcagtcgggttagcaatatcttctacgtccttccttcccaaggggagccaggaagccaccccatttgaggagcaatagggtcctctgatggaagcttgagggggtcagatgattgattctctcggcccagcactgtccaaaagaaatgtaacacaggccacatgcaaatgtcagtttaaactctctagtcgccacattaaaaaaggggccagatgtactggctcatgcctgtaatcccagtacttcaggaggccgaggtagagtgagccaagatggcacctctgtactgcagcctgggtgacaaagcgagactgtctcaaaaaaaaaaaaaaaaaaaaaaaatggtgaactgctgggtggattatgtcttaagttcatctagtgtcagttctatgtgagagattttcatgagtttgctggataaaggctttccatggtcctgagacctaagatcctaaggtcttgtcactgtgcccattttatagatgtagggactgaggctcagagaggctcagcctgcccgtgggcacataagcaggctgggctgcagaatggaagctccagaggctgatggctcctccccctgagtcaagagaggggtgctaatgggggcatgccatgcagtttatgggaggtctcagtatttctatctgttcagtgggtctcttggcactctccctacctgcctgcaagtgagggtgtgaaggtccaacgaggataggggcaggtctgtgttaatatcccatgagggccccaccgcactcaaggctatagagtggttgagagcaggctctcgggggccaggccgcctgggttccaaatgccagctctgccacttcctgctgtgtgaccttagacaagtcactttacttctctgtgcctcaatttcctcatctgtaaacaggagatcagaatatatcaacctcagggctatacaagggttcagtgatgtcataagatgcctggtatatacagcaggcactttagaaatgtcagccgcttcttgcctgccctgggagtacacaggagttcccagagacttgtgggaaattgtggagggagccctgtgttggttcttgtcccaacagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccgtgagtatggcccccagcaagggcagggggggcctggggctcccaccagggtggcggaagtcaggccagatagagggcaatgagtgagtgttgaccaccatgagtccagggatacctttgaacaagttgaaaatggatgctccttccgtaagtcaggtaagatgatttgtcacaatatactttgttggaagagacccctgtcctgccatccactagaaaatcattgttatttatgacaataaataaacaaatttgtcataaataaacaaataaatttgtcctaaacaacaaataaatttgtcataaataaacaaatcttcactgtgatgtaagaggcacccccttagaaatggctgccttgtgcagtacacagcctgaacaactgcacgtggcagccctaggacctgaactctgtttctaacctagactctgtaagggtttagattctgggcggatagtgtctgagttccatggccttctgtcttgggcatctttgaaatggatagactatttaggggagaaatttatcccatgaatgtcgtagtggctcggaggttgttttagaattgaatgtctcccagggatatttcttgaaagcctgaccgctcaaaatgcttcttgacaatgaaggatcatgtcagataagatgggggagaagctgctttctataatctgcctcttggcaactcaccctgggtagtaataaataaaagtacctttaaagtacttttttatttagttgacttatcgattttactaaggaaacacttatgtggtatctactcagtgccaggcactgttctgagtgccttaaaattttttttaatttctctgaggttgttactatgcttagctccatttgacagatgaaaaaactgaggtccagagacgtgaattcacctgcccaaggtcacacagcaagccagtgggagagctggagtttgagcccagacactggctctagcctccttgttcttaaccactcagctctgctgccattcacacaaccttatgaactatttattattggctccacttattaagaggttaactggcacatcccattggcacattcaaggctctgataaggcctgcaattcataatttcaataactaactttttggagcccctatcatgagccaggcataaattaagtcttgggtctcatgattttgtgaagtaagcactagtattacggctattttacagatgagggcaccaaggcacagaggggacaagtaacttgcccaaggtcacacagctaatttttaaaaagaaagaaagaaatctacttaacccatagattcacaatattgtttggccctgggacatttaatatcgaaaagcctttttatctcctacagaattaaggaccgtatttcttcaacctagcttggggatcaagatacttcaagagggtcgtttgggagtgataggaactttgctaaacagggcatgtgaatgtcttctctcaccgaggtcccctctgccttcttggggttccaggacccagagagggcccccacctggaggagtttaatagtttgttgtgtaggaggccttgggggttggagatctcagtagtggtaggtaacatgagattatggaagaaaagggtttgtgagcctgtggtctgagtggacctctgcacgcccatctgtctccaacagccttcgccgcctgtgccattacatcctgaacctgcgctactttgagatgtgcatcctcatggtcattgccatgagcagcatcgccctggccgccgaggaccctgtgcagcccaacgcacctcggaacaacgtgagtcccacagagcacaccccttcctagcctggctgctctgcctcaggccactttctcctgcatccaaaatgctcataggtagggtgggatgttggggtcacccctaggcatagcccttatggctgctggttgagaggggaagctctgattccttggggatgctcttgggagcaagacattccttgaggcagtttctctgtgagcctggtggggtggaggtggcccagagtgactggggctgaaaattgctggattctctaatggaggcgtgagactagcaggatatggatgttgcacattctctacatggaataggggggttactggggcaggggcggtgctcagaggtggtcccctccgcagtagacatttccctttgtacacgaagctttgaaagaaacaactatttggctcagaaacacagcctaagcttttggtttttatgaaagcaagcccctttgcggatggtgggtctgttgacaacccctgttaattgagcacttgctgtgtcccaggaagaaactcagcatgcagtatctcatttaatcctcacaatgcgcccccccaaccccccgcccaggcatccccatttgacagatgggaaaactgaggctcaggggaatgagagagtggtaagtggcctgtccagggtcacacagcagaattccaactctgcatcccccaaagctcccactgcttcccccaactgtctgcatttactaatcacctactgtatgctacggatgggtgtgcatagcccctttgagtcctgacaagcaggaatgagtgcatgcttgtggttgagatggggaaaccgaggcaccaacaggcaagggcgtgcctcagtcatgggctgcgggcagaggcttgaccccagggcctggtagagggtggactggtggctcctgtttccctccccagctccctcccccaacccttccctcccaacccagagccaaaaaagtgtgttttctgctggtccaaggctctgctgccctggctaagtaggttaggacccaggcaaagctggcgagccccatccctcaagcccgcccacagcttaccatgcactttcccttccttcccaggcctggcaggcccccctggggacctgatgggggagatggaaggaaataattagaacgcagctcctggaggaagctagagccagtgctcagcctcctcacagtccgcttagttgcttcccgcagcctggtttcccccaggggcctccaggagccaggcgtggggaggaggtgtccctggaggggtccacaaaccccctgctgacgcgaggatgctgaagaaggcgttgccttcggcagggagggcacaggcatggatgatccagggggcacggcagctcccagggctgaagggaatctaggcagtgctcagaccaggccccagggactgtttgcaaagagcgttcagctccccggccccctccctcgtccatctcgcagtcgaaacttctctacaagaacactgtggccccataacgttcacaccacgtaaccaccatccagggcaagaaatagaacaaaaacgccccacgcggcatgtgcctcctcgatcccccacccccaccgccttctttccctctagagctgctggggacactgtctggagacatttttggttgtcacgacaggaggggggaggtgctcctggcatctggtgggtggaggccagggatgttgctcagcacccgccgatgcccaggacagcccccactctagaggatgatccagacccaaatgtccacagagcccagcttgagaaaccctgccttaccggtaaccacgaccccagcttctggaatgagcgtttttggcttctctctttttcccacctgcacaggctttttttttttttttttttaagagacaatgtctctctctgtcgcccaggttggggtgcagtaacgtgatcatggctcactgcagcctcaacgtcccgggctcaagtgatcctcccacctcagccccccaggtagctaggaccacaggcatgcaccaccacacccagctaatttttaaatgcttgtagaaacgggcctcgctatgttgccaggctggtctcgaactcttgacctcaagcaatcctccctcctcagattcccagagctctggaattacaggcatgtaattccaattcttacatgcctgtaattggccaacactggccaattcttaaaaactgaatttatgtttgctcttctgtaacattcaataaatgagacacttctatgcttcgcattaaatgagtacatgttgcttttgcaggattgatgggcattcttttttttttttttttttttgagatggagtcttgctctgtcacccaggctggagtgcagtggtgcaatcttggctcactgcaacctccgcctcccgggtttaagcgattctcctgcctcagcctccagagtagctgggactacaggcaggcgccaccacacccggctaatttttgtatttttagtagagacggggtttcacactatcagccagactggtctcaaactcctgacctcaagtgatccgcccgccttggcctcccaaagtgctgggattacaggcgtgagccaccacgcccggtcaatgagcattctttatgatgctgttttgagatttactgtgtggcatgggatgtgttatccatcccctgttgacagatgtttgggttgtttctaagtgtgaatactgtccccatgccacgcccctcaacatgtttcctgagtcacctggacagtaatttctccaggaggccagatgcagtggctcacgcctataatcccagcacttcgagaggccaaggtgggagcaatgcttgaggccaggagttcaagaccagcttgggcaacatagtgagacccccacctctaccaaaaaaaaaaaaaatttttttttttttaattaaccgagcgtggtggtgcacacctgtggtcccagccacttgggaggctgaggtgggaggatcacttgggtctggaaggtcaaggctgtagtgatccatgttcataccactgcactccaacctgggtgacagagcgagaccctgtctcaataaataagaattcctccagggtataaaccaaaagcgaagtttctagagcatataatttgcaagtggttggcctcagtaaatgcagcttgaatgtttattggacaataaacacagtgaccctttgggaggccaaggcgggtggatcacctgaggtcaggagtttgagaccagcctggccaacatggtgaaaccccgtctctaccaaaaatacaaaaattatctgggcgtggtaacacacaactgtaatcccagctactcgggaggctgaagcacaagaatcacttgaacccaggaggtggaggttgcagtgagccaagatggcgtcactgcactctagccttggcgacagagcgagaccctgtctccaaaatatatataaataaataaaaataaacacagtgggccgggcacagtgggccgggctcgcacctgtaatcccagcactttgggaggccaaggtgggtagatcacgtgaggtcaggagttcgagaccagactggccaatatggtaaaacctggtctctactaaaaatacaaaaattagccgggcgtggtagcatgcgcctgtaatcccagacacttggaggctgaggcagaagaattgcttgaacccgggaggcagaggttccagtgagccaagattgtgccactgcactccagcctgggtgacagagtgagacaccatctcaaaaaaaaattaaaaaataaatgaacgcagtggcccttgcaccagtagctcatgggaactcctgttcttccacatccttgtcaacacttggtactgtcgactgtttcatttggccgatctgctgggtgtggagtgagatcttattggggttgtgcttggcatttccctgtaatgaatgagatcaagcacttttttggattagactgagccacaggaaataacattttcaaatagatgaaaaagatctaagtattaggaatacttgaacctaatttattggtcttttgatttcctcttgcacagcttattaagagctccagaattagattcacctgacccccacggcctgccctttcccagctccctctcttccttctttccttccattcattcctttagtaagtatttgataagcaactactatgtgccaggtactgagcgagccagggaggattgacagggtatgagatggtccctgcactcccagagcccacaaaccaccaggcctttgaccaggctgtgcccactgcctcgtgcacctgaaatactctcccaccaccatcccctctgcccacccaggtctttcaagccaatccccttgcaccagcccctccctccaggaagtcacctcaccctgaccccaggcactctggtctctgattcctcttcaagcaccacatataacaggaatataagttataaccacacagatcacagagcccagctcctccaggacccagtacagccccaactgttgatgcattcattcaacaaacatttcttgagcacctactgtattcctgaccctgtattataagctggagacgccatggtgacagacagacatccctgtccttgtggggctgacatttgggtgggggagatggacaatgagattatcagtaactacaacaaatgttcagggagtgataagtggccgggggtgtggtgggcagagggaaggagagacttcgtaaagaggatctcaagcaccaggagatggaatttaaacagccggtcaggggagtcctcactgggaaagtgttatttgagctaagtcataaaggaggagaaagacggaatcaaatgggatgtgggggaaagcattccagagagacagaacagcctgtgcaaaggccctgaggtggaagcatcttggggaacaaaaggaagtgagcaagggagagaatgagaggaagtgagggcagggagctgaatggtcagatcgtgcaggggcttgagggcctcggggaggactttgacttttatccctgaatgaggtgggagccacggaggattgtaagcaggggaaggatgtgcctgacttctttggtgttcacagcgccctctggtggccatgttcagtaatgctcagcccttgcagcttctgggtggatctgattttttttttttttttttttttagacagtctctgtctcccaggctggagtgcagtggcacgatctcggctcactgcaacctccgcctcccacgttcaagtgactgtcacgccttggcctcccaagtagctggaattacaggcacacgccaccatgcccagctaattttttatatttttagtagacacggggttttgccatttggttaggctggtctcgaactcctgacctcaagtgatctgcctgcctcagcctcccaaagtgctgggattacaggctcgagccaccgtgcccagccggtgtccaccccatgtctagcaccagccagacactgtgccggcgcaccctcatcttcaggcctgggtgacaccagaggtgtgctatggtgtgtcctggacaggggctgggccagaggacattgctcgtccaggcagaaacatcaggcctggggaggggcacaggaaaaatcaacctaccctggcaggggcctggccttgaagcaggaagagatgccgtggcaggaagttggccccagtgtttaaaaaaaccacgtagcaactatttctcgcccaggatgcccaggaaagcaagggtactgggggattagatccatcaccaagaaggatacagtcagccctgaacttctctggggccgcttctaatccactacagggcttggggcaaattttaaaaggtacccttcccgtgggttagcgaactggcctagtacagtgatttttttgttaggatttgctgccatctgctggacaatttcattcacaacatacaaatctgcagtatgaaaagagatgggaggggcccttgtgcagtgcacgccctgcgcaactgtatatagcagctgtgtttcctcttctgggtagaaactctgctccccagtaggcgatcgttagttttaccggggctctgctggaacaggccagtgatccactgctctcttgcttttatcccttacaggtgctgcgatactttgactacgtttttacaggcgtctttacctttgagatggtgatcaaggtgagtgcagattataagtgagaacacacggtaatttttttttttaagcaagtgcagggctgggcacagtggatcatgcctgtaatcccagcactttgggaggctgaggcaggcagatcacttgagatcaggaggttgaggccagcctggccaacatggtgaaaccccatctctactaaaaatacaaaaattagccgggcatggtggcacatgtctgtaatcccagctactcgggaggctgaggcaggagaatcacttgaaccctaggctgcaatgagccgatgtggaggctgcagtgagccgagatcttgccactgcattccagcctgggtgacacagcgagactctgtcaaaaaaaaaaaaaaaaaaaagagctgggattccaggagatcctgagcctccaagaatgccccccttgagaggatgagtctcccagaggattagaaatgcctggtgtgtttgaagagcagcaaggaagctggtgtggctgggcggagtgagagaacagtggggaaacgaaggacagagagatgagtggggaggtgagggggcaccttgtgccggggatcacagagagggctcttcggctcttactttgagtgaggtgagggccatagagtgttctgagcagaggagggacttgatccaggtgttcacaggtgccctttggcatctgtgggaagccagaggacctgtgagcaggtgatcacactggtccccatgggcgatgacggggacaggatcaggctggtgaccaaagaagaggtgagaagtggacagattcttggaaggttctggaaatagagccagtgagttttgctgatagagccaccaatgagggatttgggacaaagaggcatcaaagaggatcccaaagtttggatctaagagccggcaagccagagctggcttccatcaggcaaaggggggccgcctcatggggcaggggctccccactcctccctggagtcctctggccactgcccatccctgcaagatgaggtggcctcattggcttccctgcctctccccgagaggctagagagtgggtggcagcaccccagggtggggatcaggtgggggttctgagcaccctctcttctcccccacagatgattgacctggggctcgtcctgcatcagggtgcctacttccgtgacctctggaatattctcgacttcatagtggtcagtggggccctggtagcctttgccttcacgtaagtctcctcgcaagggttcctcttgcctcttttcccccaacccccagcctgggccacacatcggattacaggacatgttctcagggtctagggatggggtgtgtgggctccggggacgtgggagatatcagcatgccaccaggaagagcttcgatggctttttgcatgatgtccatggaggaagaaggagaagggaccccccctcctgccaaccttctacctcctcacacagcaacgggcctcagccacatcactggccccttgctgtgcagcttcctgtagactagcctcgccggaacatctcatccccctactactccacaagcgccgcccaaaccgctgtctctttggaaagtccctaaagagacaatcaggaaacgaatgtgcatgagaattctgaccccctccctatgcctgaaggccccgtagttgtagacctggtgactccctttgtgtgtctttcacttctcctggcagtcctaggattctctgccctctgaaaggccatgtgtcatcctgcagctccaagatggcgccccagttgtaggcagccatttcaggatggcacccaagctcttagtagtcatcccaagatggcatccaagttctgggtggccattccaagatggcccctgagttctgagctatcattccaagatggcctctgaatttggggtggtcattcttagatggtccctgagttccaaggtgaccttcaagttctgggtagccattccaggatggtccccaagctctgggtggctattccaagatggccccaagttctaggcagccattgcaagatggcccctgagttccagggtggcccccaagttctgggcaaccattccaaggtggcatccaagttctgggtggctattccaagatggcctctgatttctgggctaccatgctaagatggcctctggattcttggtggccattcttacatggtccctgagttccaaggtggccttcaagttctgggtagccattccaagacggtccccaagtcttggatggctactcgaaggtgacccccaagttctgggcagccatctcaaggtggcaccctagttctgggtaaccattccaaaatggcacccaagttctagggcaaccatttcaaaatggcccccaagttctgggtgactatttcaagatggtacccaacaggtgagtggccattagcccttagggccctgatagcagacttagcagtacattcctgaagttgtagacatttggagcgggatgaaaaatatctaatcagtctttaatcaagaaacaaatcttggggaccctggctgtgcccatcatggtgaatgattccctgacaggttttgaaaggatcttgacacattcactcccatcgtgagagaatcaggggcttcctcctgtgcctctgcctctaggctccctcctgagccaatctggaggggcccttgaatggtctccctcaccaaacaatgaggacttggtttgtcaggagggccaaaatagtggcccatttccagtagaagggctgttaagtaggccacacttagattcttctctgggaacacaatgaggtcaagttgtgttagaacaaaaaatctccagagtttttggatgcctcagagctggagatgtatcatgaaggttgggaggctgattatacttctttctctttctctttcactccttcctcctctttctcctctctttttgttcgtttactcttttctttttctcttctcctctccctccccacatccttccctctcctcaaagcttttcagtgtctatttgactactagagcaatgcacggtggcttacacctgcaatcccagcactttgggaggctgagacaggcagattgcttgagcccaggaggccaagaccagcctgggtaacatagggagaccccatctctaaaaaaaaaaaaaaacaattagccaggcatggtagtatgcctgcactagcagctacacgggaggctgaggtgggagaattgcttgagcccaggaggttcaaggctgcagtgagccgaaatcgcaccactgcaccccagtctggggaacacaggaagaacttgtctcaaaaaaataaaaagtttaaaaaattaaaaatcaatgaatttgctatttagaatattatgctttatatggttactgaataattttaatagtgatgagtacaaaaaaaacaggtttagcaagctgttctgtaggttaaaaagtaaataaataaataattaattaaacaaaatacaatgcacatcaaattaggggacaaagattgtgacgaataagacaaggagtccatgtctttaaaatatgaaaagcagttacaaatcaataagaaacactacttctcaatggataaatgggcaaaggacataaacagaaatctgatagaatgctggcaactagtaaaaatggaggtaaatcaacccttggaattcagagaaatgtaaaataaaaacgagatacaattcattccctatcaagttagcactgttcccgccgcacccccacacacacacaaaaaatgatttttttagctaataaacagcatatataagaatgtattataataggctgggcacagtggctcacgcctgtaaccctagcattttgggaggccaagggagggggatcacctgaggtcagcagttcgagaccagcctggccgacatgacaaaaccctgtctctactaaaaaatacaaaaattagccaggcatggtggcggatgcctgtaatcccagctactcaggtgggtaaggcaggagaattgcttggacccaggagatggagactgcagtgagccgagatcatgccactgcactccagcctgggtgagaaagcaagattttgtctcaaaaataaaaaaaggaatgtattataataaaatatacttttctccccctctatcacctatttaagcaggtccttcaagttgtcaggtagacatcatgctatgagaaaatttaaatcctgaaaagccagaatgttttaccaccctcagcctggaatgaatccttctcctatggaaataacctacgggtttctccacccctctctgcctttcagccccttccctccctctcccctccttttctttctccctctttctcttcctcctttcccctctcttccctctctcttcttccctctctctgtctctttctgttcgtctttctccttttaccccctctcagtttctatctttttattttcctctttctctctctctctccctctctttctctctcactccctgcactgttgatgacctatgtccttgggtgatgtgggcctcccctggaccgtgtagcttggagaaagctgaccctctgtcatcggtctggcaacagggacttggcccccctaccctgcattctgatgaggaatggtattcagacaaaggcagatcccaggacacaggaggacatgctcaggcagggacccccgcccctttcctctggggcaaggtctgctcagcagcctccaagattcctagggctcaagaggtggcaggtagctcagggcactagggcaggcagtggggtgaatatgtcactcatatccacctgtccacacacaatgcttaccttggccacctgtgcccaggggaatgggttttatcctgtgaatcctcccagtgaccaccactgagtgtggcacagataaatggtaccaagcccaagctgttcaggtctccaatgtcactttcctctcagacctctgttgtagctgacatactgtaatgctgaggagggccgggcacagtggctcatgcctgtaatcctagctctttcggaggccaaggcagatggatcacctggggtcaggagttcaagaccagcctgggcaacatggtgaaaccccaggcaacatggtaaaaccctgtctctactaaaaatacaaatattagccaagcgtgatagcaggcgcctgtaatctcagctactcgggaggctgaggcagaagaattgcttgaacctgggaagtggaggttgcagtgagccaagattgcaccactgcactccagcctgggcaacagagcaagactctgtctcaaaaaaaaaaaaaaatgctgaggaggtgactgtcccacctccatcctccgagttgaccatcacaatttagggaggggaatgacctacaaaggacccagaagcaagcctttcaattgttgagcttttgccattatgggccatcgtttacaacatgctgtttctaggttctctggaggtaaaattagcctcctcttttaaacaaagctaatctgcaaaagcgaaccaaaaattcttttccaccagagatcaattagcagaatgagctgggtgcgatggctcacacctgtaatcccagcacttggggaggccgaggcaggtggatcacttgaggtcaggggtccaagaccagcatggccaacatggtgaaaccccatctctactaaaaatacaaaaactagctgggtgtggtggggagggcctgtagtcccagctactcgggagggtgaggcaggagaattgcttgaacccaggaggtgaaggttgcagtgagccaagattgtgccactgcactccagcctgggtgacggagcaagactccatctcaaaaaaaaaaaaaaaaaaaaaaaacagcagaatgattcttttggggagttgactttttttttaatttctgagttttctttttaaatatcaagttatacaagggcattcaaattggcctacaactcacaggaatttggcagcctgtttgcagagtcaagcttttacattgttctcatgaaattggtacaggcataaagccacccttcactcttgaaaatccattttgaatgttgttgttttaattcttatgcaagaaaaggatctggatagggatttcaggccatcctgtcaaccctggcaggcttgtagatcatgcaggaactgggaggtgtgagattttgccagtaggatcctggcaagtgcctgggactctcccagggttttggaagagccgacggacatgagtccaacagggagcatctttatatcatggccgaagggatgagagaggagaccctcaaacctcacgcctaccacaccctccccaccccactgtcaagagtccatctggtactgctgttcctcccccagggcagggctgcaggcccagcacagctggccaggtgccttgatcaagccattcctgcacacctaagagccaaactgctagaaaaccagaataggagctactgcttttttccctaaaaagttttggaatcttctccccgttacaggtttctggcctcttttgcctgagaaggtctctcaccctatgaggactttgcttattgtctttccttgttatcggatagttggcacattggaaggagcatggatgctctgaggttctcagcctgagcgctgaactctccacccgccccccaccccccaccccagggtcctctgcttatttcctttctggtcttttaacttgctttgtctgtcctctgtgcatatcccctcatagacaaggctgagagccccacaagtattagattgaccttattgttttaagaaattgtccctccaggtctgtttgatttctctctagatgtgcaagtcctttagcctctctgtgcctcagtttttcccatctagatgaggaaactgcggcccagagggactgtggagggaagtaagtccgacaagatcactgaggttgggttcagctgtcagatgctacccatctcccagccctgaatacggaggctcacagtgagcagaatgatgctcagcagcctggccagcctgggttctttgaggcctggcagggctgcgagatccaggggaagggaataggggaagggagcataaggttattcccttccttgttgaaaggaaccttgccattctggcctgttggggtcaaagcaaggattcttcccccagtgctgtgattgtggcctcgtctccgatatgggagaaaactatccctgtggtcccaccaagggatgtattgaagctcttctgaagatgtccacccctcctgcacctcacccaaatatctgtgtgtgtgtgtcctgctcaattcactgactgtgtcccttgtatccatgcgtctaccataaacaccccatttcatgagccatcacacgtggtatcacgctctgtgcccatgcatcagggcggccaactgacatttctcagcagctggcagatcatgatcctgccctcaccgccaagagtccatctggcgcggctgttcttcccccaaaggcaggaccgcaactggcagagcgccttgatcaagctgctcctgcatacccaggagccaaactgtcaggaagccaaagatggagccctcaggctgctatctcttgatcctcatcttcaaaacagcccccacccctgaaggcattatttttcttgtgtatgatgaaatggaaagaagattagagtgcgagatacccacacctgggtttgaatcttagtctgtcttcccagctgtgtgcctgcccttgggcaggtcactctttttctctaggcctcagcttcctcatctggaaaatggtcataatggtgctgtcttcccataggcaaatgcagtgatgtccagaagactcccatattaaacctaaagtcagcagattaggcaaaaatcactgtcattgaaaactccctcaatcatccgtaaagaagctgggtgtggtgtctctcacctgtagtcccagctacttgggaggctgaggtgggagaatcacttgagccagggagttcaaggctgcggtaagctatgattgtgctactgcactccagcctgggcgacagagcaagaccacgtctctaaaaatataaaataaagccgggtgcggtggcttacgcctgtaatcccagcactttggaaggctgaggcagcctggcaacagagtgagaatccatcaaaaaaaaaaaaaaaaaaaaaaaaagtagaatctatatgattctacgtatgcaataattcctagatacactgaatttgagaaccccaagtcagactacaggaaaaggagatgagggggtgtggaggagaatccacttggaatatttgtagacatttaaaccattctgtgttttaaaaaatatcacagccgggcgcggtggctcacacctgtaatcctagcactttgggaggccaaggtgggcggatcacgaggtcaagagatggagaccatcctggctaacacggtgaaaccccatctctactaaaaatacaaaaaaaattagctgggcgtggtggtgggcgcctgtagtcccagcactcgggaggctgaggaaggagaatggcgtgaacctgggaggcggagcttgcagtgagccgagatcttgccactgcactccagcctgggcgacagagcgagactccgtttcaaaaaaaaaaaaaaaaatcactaacttccagaggggtcgtggatggaaaattccatagagtccgcttggcgacagggtttccgccattctgatggcggtcaagtctttctaacctggatctccagtcattgttgaaggcgcctaatgagccccaagcctgattccaatgaatcacgagaggaccagctgctaggtgctgatagctttccccaggcccgcatttgctcagagggcttcagagttgcttctaattccatcccaagtcagaactctttgctgaccccctccttcataaagagcaaagccaaggccatagcttttgttaatcaaacatcagaattccacagacctgagttggttggttgtttgttttaagagacagagtcttgcccaggatgcagtggctcacacttgtaatcccagcgctctgggaggcctaggcaggaggatcacttgagcccaggagtttgagaccagcctgagcaacataatgagacccccgtctctacaaaaaatggaaaaatttgcctgtatttccagctacttgggaggctaaggtgggagaatcacctgagccctggaggttgaggctacagtgagccaagatcccgctactgcactgcagcctgggcaacagagggagaccctgcctcaaaaaaaaaggagagaaggagagagacagggtctccctatgttgtccaggctggtctcgaacttctggcctcaagcaatcttcccaactcgtcctcccaaggtgctgggattatagctgtgagccacggcacccagtctgggcctgttttgcagatgaggataacgagaggcagagtcaggattcaaacccaggtcccctcaacttcaaagctcacaaccttttagacattctaaaaccttgcagctccacaacgcctggagaagaggggtttctccggctcttggcagtgactttccgtggtgaattcacctttggtaactgacagctttgcagctgtcctgctacctggaaatttggctttcttagtgctttcttgggcagtgccaggtgcctgccaagggcgggggactgaatggaggtgggggcggcttccagatggaaggatggacatcggccagcgccatgagcctgaggctcccccaactgctgcccgggcgggactcgggggtgctcaggggtgcgtgtgtgtacgtgcgtgttctgtgttcttttttctgaggccacttacgatctgtctctccctccgatgccacatcaccaggagcagtacacggtaaagtctctctctatctttctctctctctctctttctctctctctctctctcatattctgtctctcgtgatctgtcccctggtgcagcctcgttagttctgggcctgtttctgtggccttgtgtccttgctgccgctgtcctgtcgcttcaaatgaccagaactcactccctgcgaaggaggcatcccaaagggtcttgccaatgcctccgcccatgccccaccagttcttgcagagaacagaaggggcagaggttcagtttcaataggcaagctgggtggagcagttatcagaagcaatgaaagtgggccagacacggtggctcacgcctctaatcccagcattttgggaggccgaggcgggtagatcacttgaggtcaggagtttcagaccagcctggtcaacatggtgaaaccccatctctactaaaaatgcaaaaaattatctgggcttggtggtgcacacctgtaatcccagctacataggaagctgaggcaggagaatcacttaaacctgggaggtggaggttgcagtgagctgagattgcaccactgcactccaccctgggtgacagagtgagactctgtctcaaaaaaatatataaaataaattgaacaataaaaaaataaaatggccatggaatcgttttcagatgaggagatgcagaatgcccatggagacatgctcccaattgtcacttgtttgggacatcaagattttagccagttccatgtgcaacctggatgtacagttccttgactttttttctatcaacatgtattctaaagttcaatttcaaaaggaaactttagccaggtgcagtggtgcatgcctgcagtcccagccatttgggaggctgagactgaaggatcacttgagcccaggagttggaggctgcggtgagctatgatcgtgccactgcactcccccctgagattccatctctttaatttaaataaaaaaaaaggaaactatattatccacttacaaccagcattgctaacctaagataaatctgcaactgcaaaagtaaatgtaggccagacatggtggctcacacctataatcccagcactttgggaggccgaggcaggtggatcacttgaggtcgggagttcgagaccagcctgaccaacatggagaaaccccgtctctactaaaaatacaaaattagccggacgtgatggcacatgcctgtaatcccagctactcgggaggctgaggcaaaagaatttcttgaacccgggaggcagagactgctgtgagctgagatcacgccattcactccagcctgggtaacaagagagaaatgccatctcaaaaaaaaaaaaaaaaagtaaatctaacagaaaccagacaatgttgttgccttcaagctgggctctttgttaaaaggaaaattactaagtgttagggaggtgttaaaggcctattagcatctacctgaggcttcctttctcgcaaaagcagagcgtctgaaagatacgtggaaaagaaacttaaagtataataaaaaagaaagaaagaaaaagaaatgattatgcccctctgagatccaattatttaatctgtgcccctgttctgcctaaaattatctcagtgactgtccaacgtgtgtctcacacttgggggcacagccttgagatgataatgatgatgttagttttaaaaagaaaaaaaaaggttcagagttctgaatcctggagtatatctctgcctagcaggctaaaatacaattatcgtctttgttccctgaaaaatgaaaaaaatggagtcctttaaaaagcaaatggtgtgaagaatgatgtttttgcactggatactgagacccatcgtgatgggggtctctggggcagctctgctcatgacctgggaggtcactgtagggagatgttttctaggtgacctccccacccaaatactccaaccggaggcattcacgtgtcctgagaccacacgccaggcgcaggctaggggctaggacaagaatcaagattaaaggggaaatggccaggtgcggtggctcatgcctgtaatcccagcactttgggagtcaaggccagtggattacttgaggtcgggagttcgagaccagcctggccaacacggtgaaaccctgtctctactgaaaatacaaaaattagccaggtgtggtgactcatgcctgtagtcccagctattcgggaggctgaggtgggagaatcacttgaacccaggaggcagaggttgcagtaagccaagatcatgccactgcactccagcctgggcaatagagcaagactccatctcaaaaaaaaaaaaaaagattaaagggaaaatgaacacagagaagagtagattacactgtaagcctttgaagagttttctgtctaaaaccagagaccgaagaaacaaacaaagattaactccgaaatagcacataggagctggcaggagccagaggtaggcagtcaggaaatgctgtcggagggagcaacaggtaatttgggctttgaggaccgggtagttctgtgactggagaagtggaggaagggcatttctagcagcgggaacagtatatgcataagcagacagaggcaaaagaatgtggctggggcttgagatatgtagccataaatgggaatgcaaaggtgaaggtaagttggactagattttcaagagcattgaatgccatgcccagaagtttgcacttgctcttctgagaattcacgtgctccagaagaattctgagcaagagaaagagtgacaaggtcattggctttagccactgtgtgcataaaacatggaagaaaaggcagggaatgaggagcaagttgggagacgggtgaggggggatggcacccaggaatggatggcgggatgttaaggaaggtgacccactggggatggggatggggatagagggcaggcagttgaccatgactctcaggtttctggtgtggacaactggatgggtcatgagtgccatgaaccacaagctattcatggtcccactcaataccctcctcttggggggcctgagtcatggttggccaagggtgtcatggcatctctggggtctgcattgctaagctcagttccaacagaccttggactgaacttctgtgcagtcctctctggcaaagatgggctcagagacccttggagcaatgcagcagagaccatggcagcagccacatcagcatctgaaaacagcggcacccggttattttccctccttcagactcagggaatatggtgggggaggggagatttggtataagggccactttaagtatcttccagaatcccattggaagggggagaaaatcccatttttttaagagcccactgataccacctttaaaaagaatacacagggggccaggcgcagtggctcacacctgtaatcccaacactttgggaggccaaggtgggtggatcacctgaggtcaggagttcaagaccagcctggccaacatggtgaagccccatctctactaaaaatacaaaagttagctgggcatggtggcacgcacctgtagtcccagctacttggagaggctgaggcaagagaatcacttgaacctgggaggtggaggttgcagtgagccaagatcataccattgcactccagcctgggcaacaagagtgaaactccatctcaaaaaaaaaaaagaatacataggggaccactaaactcctagaccaagggcttttttgaaaatagctgtgaccaggtgtagtggctcacacctgtaatcccagcactttgagagggtgaggagggcagattgcttgagctcaggagtttgaaaccagcctgggcaacatggtgaaacctcatctctacaaaaagacaaaacaattagccaggcgcagtggcgtgtgcctgtagtcccagctacttgggaggctgaggtgggaggatggctttagcccaggaggcggaggttgcagtgagccgagatcgtgccactgcactccagccttggtgacagagccagaccctgtctcaaaaaagaaaaaagaaaagctgtgcagaaatgggggtggggaatcagccaacccccttgtgctgggtctcagggacacccaatacagctgctcaggcccagccagatggcaaagggccctcaaccaaccctgggaccagaaccacaaaaagccacgtacttactggctcccgagcccaagcttaacaggtgaaatggaccactcttcaccaggaagggcagggctgtgccaagctcaccccagacttctaggcctgggagggtagggtcccatggagctgtgggctgccccctacccaacctgacctctgcttcctctcttcccttcttcccacctaaacattcctccacagtggcaatagcaaaggaaaagacatcaacacgattaaatccctccgagtcctccgggtgctacgacctcttaaaaccatcaagcggctgccaaagctcaaggtgagattgggagatggtggggtgcggtgggggggactgtcagggttatcatgtacagctgagcaggttgtacactgctcaaggacaacacattaaaggaggtgctgataacatcctagccatcgtgtatggatatttgtattattacaacttcccagcagatggcagtaaagtgagctgacctaaaataatctgtgtattatggcagtttttctttagatgaagtgtcttggggttaagatcctttttcctaattcgcatgaaggcatcatatggatttaaaagggtataaccgtgatctgggaagcaggaactagatttcttgttccataaaattttgacttttcatctacctattctaggctctagtatctcccattccaaaatagcatgaaccagcatttcccaaaagcctgtcattcaaaaacatatatatatattaagggaaataaaatccagtcattagagcacccactttcactctatgcttcacctgggggtccccagtattatctcttatgtaatatgtttctttaaatcaagtcacacccgtaatccctgcattttgaaagaccaaggcaggagtgttgcttgagcccaggagaatgagaccagcctgggcaacatagttagactctgtctctactaaaaattaaagacagaaaacagatactgttatggaaatctaaccaaatatggctgcctgcctaaggctttgtgcattgacaactgctctttcttggttaaagagggaaaatgtcaatggtaggtgttaacatggtagcaactaagtaaaaatttctccttcactcaaaaggattgagagagttggaaaggaagtaactttgttaccttgtttttctgtgttgggctcctgtatcacttaaaagcatctctggtatcccatctgggagttttagatccatagaatgccaggattgagtccaactcctccaacgcttatttctgaaagctggggggaccttaccctagtgacttgacttatgaccttgcctgtaaaatgggaatgatcatggcagtattttggtatgatgggccactggaggcagaaggttgggcaggtccccagcccctcatgctctctgtcaactccaccccacaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcggtgggtctccactttccagcacattcccattggaaccagcaggtgggcaggggggaagtggctagaggcattggccacttgggctcagagactggagaagtgatgagccttggaagtgactcagttgcaaccagcttggatcttgggtagaaagaaaaccggttttagaatttgagtcaccacccagagccacagaatgagtcataagcaaattgattgacctttcagccaccgcctttgtcatgtgagggatattaatacacatccacagttccttacttgaaatcgttacaggcagatgtgtttcaaagttgagaatattttgagattcccatgtgggacatgacaccctcagctgggtctaaggcagccctataatcaaacacaatatttctgccataaaatgtgtaactatttacatcaaatggggtaaataacaagtataaagagcttcatgtccaatcagatcaggtttcattaccaaataagttaggtaagaggccaggtgcagtggctcacacctgtaattccaacactttgggaggctgaggtgggaggatcacttgaggccaggagttggagaccaggttgggcaacataatgagagcccatcctacaaaataaattttaaaagttagcggggcatggtagcacacacctgtagtcccagctacccgggaggctgaggcgggaggattgtttaaacacaggagttcaaggctgcaatgcactatgatggtaccactgcactccagcctgcgtgacagagtgagaccctgcctctcaaaaatatatacatataggccgggcgcagtggctcatgcttataatctcagcactttaggaggccgaggcgggcggatcatgaggtcaggagatcgagaccatcctggctaacacggtgaaaccctgtctctactaaaaatacaaaaacctagctgggcatggtggcagacgcctgtagtcccagctacttgggaggctgagacaggagaatggcgtgaacccgggaggcggagcttgcagtgagcccagattgggccactgtactccagtctgggcaacagagccagactccatctcaaacaaacaaacaaacaaacaacaacaacaaaaatatatatatatatatatgtatatatatatatgtacacgcacacacacatatgtattatatgtgtgtgtgtatatatatgtatgtgtatatatagtgatattgttaccagtgtaaagtggcattttgcaacacatggtagcctgttgttatcttgatggctatttattgaaattaggaggatgccagatgtctggataggagtctggaactaacccttgtttcctgccttgaaaaggagtagcaacctcccttagcctgatgaacctctaaatgtcccctatgtctctctgcctcctcctaaactccctccaccccacccccagcaagcctgaggctctcaccctgaggactagaagttatcacgttggaagagggtgctggaccctgggtcagctctcccaccaggagtaaggttgtgccatcacccatggatttatctcaaagtagatgcacacgtcatcccctatgaagcacaggaacacatggtggcaggatggggagtcactgcttcccaagcagtctaggctggtggaccactcttcctttccctccccctgtctctgataaccaaagacaagtgcaagacagcccctctttcccatttactaacagtccccactctctgtggcagaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacagtaagtggcccgactggaaatctatccaggaggagccctggggagcaggaggataaagggcctgagagcttagcaataagaaaggtcttggaggccgggcatggtggctcacgcctgtaatcccaacactttaggaggccaaggcagatgtatcacttgaggccaggagtttgagatcagcctggccatcatggcaaaactccatttctactaaaaatcccaaaaaaaaaaaaaaaaaaaaaaaaaaaaaagctgccaggcatggtggctcacacctgtggtcccggctactcaggaggctgagacacgagaatcacttgaacccaggaggcagaggttgcagtgagccgagattgcaccactgcacttcatcctgagtgacagagcaagactatggcctccccgccttcaaaaaaaaaaaaaagtgaggctgaatcatggacttagtctttatttaaaattttgagccacttgtggtggctcatacctgttatcccagctactcaggaggctgaggtgggaggatcgcttgagcccaagagttcaaggctgcagtgagctgtgattatgccattgtactccagcctagacaacagaaggagacccctatccctgaaaaaaaaaaagaagaagaaattgatatttgttcatcatggactttttgcattaattttgattttttaaaatattggagcaaaagattatcttgattactgagattttcagtacccccttaatttgcacccaaaacaaatgcctccctccctcacctcgtccaagtaatggtctttctctcagaggtcttggaaatgccaggctggaagcttggtagattccagcatgtgccctcagcatcctcacctccctccctctctcagcaaatatgccaacctgaacatgccctactacccactctcagacacatccagtactcacacatgtgggaataatgctaacccacaaggcacctttgagcaaagtttttttaaacacctttctcaacagacttcatttccatctgtctgaaaatcatcgcaatagacttaaatgattttgttcaaacaaggcactgaaggaccacctgccaaaaaattgtcatcatgaatacacaaatctatcatgcctatcatgtgaaggtatcgcttagacacagagcctttgagcagtgtgcaacctgcactactgtacagagctgctgtgcacttacccactctcatatatatccccattgtacctcctgagcacccagcaccacctgtgctcaaatacccactctacatgcatacacccacctctactccctccattgccacaacctgtctttaaatcccaacttggccacttataagtgggtggtcttcagcacgtccctttaaattgctgaacctcaagttcctcatgtgcaaagtggagccagtaataacctccctgggagggttgctgagccggtggggatgaattgttgaatattgtttccagcacacagcaagcccttcatgcacagcagtagaaatgactgacattggccaggcgtggtggctcacacctgtaatctcaacagtttgggagaccgaggcaggtggatcacctgaggtcaggagttcaagaccagcctggccaacatggtgaaaccccgtctctactaaaaatacaaaaaaattagccaggcttggtggcgcatgtctgtaatcccagctacttgggaggctgaggcaggagaatcatttgaacccgggaggcggaggttgtagtgacccaagatcacgccgttgcactccagcctgggcaacgagagcgaaactccatctcaaaaaattaaaattaaaattaagaaataactgacattgttgtcagcctttcaaaaaacagcgactacttaaatttctttttcatttccctctgttcctgttctgccatctcacttccaccctctctccaccttcctcatcaccccttgggtccctgtctctctccttcctgccccttccctctccctgccccattccttgcagggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgaggtgccacttccaattccatctgtcctttaaaaactggggacacacacaaactttaaaacacacacaacacccaggaacccctttctaggggtacctgggggagggaacagaagcattgtcccaaccgaatccagtcttcagggcagcccttcatggagtttccagaggaaacacatcatatagtgtatgtatcagtcagtttagactaggttatgccgcagtaacaagcaaccccagatttcattgccaaatatccacaaagggacttattttttgctcacactgcatgtcaacatcagttgtggatcttgccatctttattctggttcccaggctggcagagcagcagagcagcctccctctgagatgctccagatgaaaaagagagtatgtcagactgaggttcagttcttcaggcttgtgctcaaaaattacacatgtcacttctgctcacatttcatcagccaaagcaagtcacacatccattctgacatcagtggagtgggcaaatacaatctcccctagcgaagggtggtgaatatttatgaatgaaaagccaagccaggtgtggtggctcacacctgtaatcccaacattttgggaagctgaggcaggaggatcacttgagctcaggagtttgagaccagcctggccaacatagcaagaccccatctctactacaaatcaaaaaaattagccaggcaggatggtgcacacctttagccccagtaacatgggaggctgaggtgggaggatgcttgagcttgggagttcgaggctgcagtgagctatcattatgccactgcactacagcctgggcaacagagcaagaccctctctcaaaaaaagaaaaggaaagaaaatccagtcccctgtctaccagagagtatagacatgactctttgcctctctggcatcatccaagctaaatagaggacctagaatatatcctctgctcccttgacccttaagacttaataaccactattcctccttctctctccctcaaagagaaggagaagacgcagcaaagtattcagtaagaaagaatgggctgggcgcagtggctcacgcctgtaatcttaacactttaggaggccaaggcaggaggattgcttgagcccggaagttcaagaccagcctgagcaacatagtgagaccccatctctatgattaaaaaaaaaaagttttaattagctgggtgtggtggtgcacgcctgtagtcccagctactcaggaggctgaagcgggaggatcacttgagtccaggaggtcaaggctgcagtgagctgtgattgcactgcactccagcctgggtgacaaagcaagcccgtgtcaaagaaaaaaaaaaaaaaaggaaggagggagggagggagggaaggaaggaaatgagagagagaaagaaaggagggagggaaggaaggagatagggaagaaggaatgaagaagaaagaaagggagcgaaggaaagaaggaagaagagagaaaggaaaggagaaaggggaaagggtggaaggaatgaagggaaggaaggaaaaaggaaagtgaaggagggagggaggaaggaaggaaaggagggagggaaggagggagggaaggagggagggagggaaggagggagggagagaaggagggagggagggaaggaaggagggaggaaggaaggaaggagggagggagcgagggagggaggaaggggaagaaggattaggcttcaatttgatttggcacactcggtagctgtgtcacctcaggcaagtggtttaacctttctaagcctctattttggtgatctgcaaagtgaggccattgatagtacccacttcccatgtttgtattagccatgcaataatggggaaatgtcagtgcaagttttggcagttggtgacatctcaagcaactgtagctgttgggataagaaagcaatggtgagaaggaagagagagcccaggaatcctggctgggggcaagagaggcagagactcaagcagaagcacttgagaaccgcgacgagttagacagagggtgcccggtgtacagccaccttcctcctgcctctgccgctctcaccactggcctctctcccgcagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaaggtaagtgccccacaccagcccccagcactacttaacccccacctcgttcctgcctctaccctgataaaatgaaaccatctgcagtttcccagacagaccacactctggatcacctctgagattttgttcctgctgttccctctacctgacacactgttcccaccactcccccggccagcttcttcttcccagctgtacctgcagacctcttcctccagaaagccttccctgaccacccaagactgcttgaggtgcccatcttagcaggcatcctatctttatgtcgcctgccacaaaaatctgcgtcaggttgcatgacagtgtcccccacccatttatgatgacctcagccctgaattcctagaggccaacaaggatctggctcagacggaacaagaagctctctataaatgtttgattaatgaaatgagggggctgggcgcggtggctcatgcctgtaatcccagaactttgggaggccgaggcgggcggatcacctgaggtcacgagttcgagaccagcctgaccaacacggagaaaccgcatctctactaaaaatacaaaattagccaggcgtggtggtgcgcatctgtaatcccagctactcgggaggctgaggcaggagaattgcttgaacccgggaggcggaggttgccatgagccgagatagcgcaattgcactctagcctgggcaacaagagcaagactccatctcaaaaaaaaaaagaaaagaaaaagaaagaaatgagggagaaggggtaggtgaggaccctaaaatccccagggctaaggagcggcttccaaaaaaaaactctgaaaacctttcaccctgtgctttggactccaaagcgtggattcaagcccagctcttccatttaattcatttacctttgtacaagcaaccagtgactttctggggactcagtttccctgtcaataaaatgggaatgataataagagcacatttgccccctccagaggaggtgagaggattgaatgagaaagttcatgcaaggaccttagctccttctcggcacttcaaaaacgatcaatagtggccgggcaaggtggctcacacctgtaatcccagcactttgggaggtcgaggcaggcggatcacttgaggccaggtgttcgggaccaactggccaacatggtgaaatcccgtctctactaaaaatacaaaaattagctgggcgtggtggcgcatgcctataataccagctgcgtgagaggctgaggcatgagaatcgcttgaacccagggggcggaagttgcagtgagctgagatcacaccactgcactccagcctgggtaacagagtgagactccgtctcaaaaaaaataaggaagccggggacggtggctcacgcctgtaatcccagcactttgggaggccgaggagggcgatcacaaggttaggagatcaagaccatcctggctaacacggtgaaacgctgtctctactaaaaatacaaaaagttagctgggcatggtggtgggcacctgtagtcccagctacttgggaggctgaggcaggggaatggcatgaacccaggaggtggagcttgcagtgagccgagatcgcgccactgcactccagcccgggtgacagagtgagactcctcaaaaaaaaaaaaaaaaaaaaagtataattcagccaagcacaatggcgtatgcctatagtcccgactatcaggaggctaaggtaggattgtgagttcaagcccagcctgggcaaaataggaagaccccgtctaccaaaaaaaaaaaaaaaaggttgggggaggtttttgtttttttggatgtgaaaagaagagcctagtccggcggagagcggggctttcctgaactgtgcctcctaccagtgaggttgctcagaccttgcctggggctggagtgttgcctggagaacagccatgaagctgcctccccacttcccacttcccacccctgctcgctgacccctgctactcctgcttctttcccctagttctatggggcttctgttgcttatgaaaatgccctgcgggtgttcaacatcgtcttcacctccctcttctctctggaatgtgtgctgaaagtcatggcttttgggattctggtaagtaccaccttggggctacagctatgggcttgggagaagcccaagggggaacaatgggtcctggatgatggtctcccaacgtggccccaagaaccccaacctcaagggtggcttcagtatcctgccagtggccacagatcctacttaggcattcttgtgtttgccaaggagtcccagggagacccaacctgtgagtgttaccatatggctgcttatgtatccagttcctcaaaatgatgggagtcatcatggctgggagtctttagcatccattttagagataagaaaactgaaatcaggctgggcgaggtgtctcatggctgtaattccagcactttgggaggccaaggtgggcggatcacctgaggtcgggagttcgagaccagcctgaccaacatggagaaactctgtctctactaaaaatacaaaattagccgggtgtggtggcgcatgcctgtaatcccagctactcgggaggctgaggcaggagaatcgcttgaacctgggaggcagaggttgtggtgagccgagatcacatcactgcactccagcctgggcaacaagagtgaaactctgtctcaaaaaaaagaaagaaagaaagaaaactgaaatcaggctgagcacagtggctcatgcctgtaatcctagcacttcaggaggccaaggcaggaggatcgcttgaagctaggagttctcaaccagcctgggcagcaaagcaagcccctgtccctacaaaaaaaaaaaaaatttttttttaattagccaggcatggtaactcgtgcctgtagtgccagttactcaggaggctgaggtgggaagatattttgagcccaggaggtggaggttgcagtgagctatgatcatgccactgcaccccagcctgggcaacagcaagactccatctttaaaaaacaaacacagaggtcaggcacagtgactcacacctgtaatcccagcactttgggaggcagaggcaggcaaatcacttgagcctaggagttcgagaccaccctggccaacatggcaaaaccccatctctactaaaactacaaaaaattagcctggcgtgcttgtgggtgcccatgatcccagctactcaggaggctgaggcaggagaatcgcttgaacccacaaagtggaggttacagtgagctgagatcacaccactgcactccagcctgagcaacagagcaagtctcaaaaaaataataataataaaaataaatatgtctttatttttcaccagccactaactaaattttaacatttccttccatcttaaagggagataacaaacccttagtattagtattatcaacccttaatattatcaacatgacctgtgtcacttataaacatcagatattttcatactgcattataagagctgcagataccttaacatttaatttgcattcatcattgctttaaaatgttgcttgtgattaaacctacagctagaatttgttactcagtgtttttttgttgttgttctgttttgttttgtttgagacagtctcgctgttgcccaggctggagtgcagtggcgcaatctcggctcactgaaagctccaccccctgggttcacgccattctcctgcctcagcctcccgagtagctgggactacaggtgcctgccaccacacctggctaattgtttgtatttttagtagagatggggtttcaccatgttggccaggatggtcttgatttcctgacctcatgatccgcccgcctcggcctcccaaagtgctgggattacaggcgggagccaccgcacccggcctactcagtgtgttaatggagaagtatattcattgttagatcgccatttttaaaactttttttttttttttgagacacagtcttgctctgttgcccaagctggagtaccgtggcacaatcttggctcactgaaacctccacctcctgggttcaagcgattctcccatctcagccttctgagtagctgggactacagatgcacaccagcatgccaggctaatttttatatttttagtagagacggggtttcaccatgttggccaggctggtctcgaactcctggcatcaagcaatctgcctgcttcagcctcccaaaatgctgggattacaggcatgagacactgtgcctagccttaaaaaatattttgatagctattttattacaaaaggtaaccttgaagcccttgctattttgttatgcatttacaagcctttatgcataaaataaaatagccagcactattctcacatggccaaggttcatagcacacacacaaaagtatagttggctgagtgcggtggctcacacctgtaatcccaacactttgggagacagaggtgggtggatcatgaggtcaagagatccagaccacccttgccaacatggtgaaaccccatctctactaaaaagtacaaaaattagctgggtgtggtggcgcatgcctgtagtctcagctactcgggaggctgaggcaggagaatcatttgaacgtgggaggcggaggttgcagtgagccgagatcttgccactgcactccagcctgggtgacagagtgagactccatctcaataaataaataaattaaattaaattaaattaaaattattttttaaaaaattgggggctgagtgtgatggctcacacctgtaatcccggcagtttgggagcttgaggagggcagatcccttgaggtcaggagttcaagaccagcctggacaacatggtgaaaccccgtctctactaaaaatacaaaaattagccaggcatggtggcgtgtgcctgtaatcccagctactcgtgaggctgaggcccaagcatcgcttgaacctgtgaggcggaggttgcagtgagccaagatggcaccagtgcactccagcctgggtgacagagtgagactttgtctcaaaaaaaaaaaaaaattaaggtgaagaaggcttatactagtgggctgggacttgaagtgaagtgaattcttgaaggtccccagtgagtggccaaggtgggacttgaaccaggacatctgttctcttgaccaccagcttagtccatccctttgaagagagtgacctacagtctgggtctcagccagggtctcaggaaaccaggttcccaccttggctcacggaggtggttaggggcatcagctttagcaccagagttcagatcttgcctcgtcctatataagctttgtcacctccccatcattaaaaggagccatcctccccctccacctcagcagagccctggtaaacagcaaatggactaacgtgcatctagagggttgaggatgaagcctggcctggcatgggcactcaataaatgctaggggccaggcacggtggctgacacctgtaatcgcagcactttgggaggctgaggcaggtggatcgcttgagcccaggagtctgagaccaacctggacaacatagtgagattctgtctctacaaaaagtacaaaattagcctggtgtggtggcgtgcacctgcagtcccatctacttaggaggctgaggtgagaggatggattcagcccaggatgtcagggctgcagtgagtcgtgattgagccgctgcaccccaccctgggtgacagagcaagaccctgtatcaaaataaataaataaatgctaggaaagggatcctactaatggacctttttcctccaaaacagtggctttcatttggtggagatgctacttattagaagcacttgaggccaggtgtggtggctcatgcctgtagtcccagcactttgggacttctgccaaggcagaagaattgcttgaacccaggcgtttcagaccagcctgggcaacatagcaagacctcatctctagaaaacattgaaaaattagccagcatagtggcacatgactgttgtcctaactacttaggcgaaggcaggaggattacttgagctcaggagttcaaggctgcagtgagctgcgatcacatcactgccctccagcctgagcaacaacacaagacccggactctaaaaatcaaaaaagaagcacttagggaaatttcttaaaattaaatgataccctgagcaaacccctagatgttctgattcatttggtttggtgaggtgggagggaatcactgaatctgtaatttattattatttttttttttttgagatggattctcactctgttgcccaggctggagtgcagtggtgcaatcttggctcactgcaacctctgcttcccgggttcaagcaattgtcctgcctcagcctcccgactagttgggattacaggcgcccaccatcacgcccggctaatttttgtatttttagcagagacggggattcaccacgtcagccaggttggtctccaactcctgacctcaggtgatccgcctgcctcggcctcccaaagtgctgggattataggcatgagccaccgtacctagcctgcagttattttattctgagttgatcttctgctggtgaagtgagtcttccactggggcctggagctgcatctccctcaccctgccaatcctgcaagagccagcactgagcttcccctctgctttctcttttttttttttttttttttttttgagatgggatcttactctgttgcccagcctgttcttgaactcgtggcctcaagcagttctccctccttggcctcccaaagtgctggaattataggcatgagccaccacgcctggtctcccctttcagttttaaatgaagccacaagttccctgtataacatttgggagatagaggggagctctctagcctaggggttgaggtctgtgaccaaacgcctataaagttgtctttgtttggactcccccagaagcagagcctgagacaaggattgagtgcaaggaatttatctgggatgcagggcagtaagggagagaggaagtgacacagggacagaaaggcaaccaggaaagagtgtattattaagccagttcctgctgtgaacaaatggggctcagtttcagtggatacctccaggaggcaacagagagcacataccacagagtcatcccacctcacagggagggaattggagtatttatcctccagtgcccatcagacataatcacaggccactcccaggggagctattaattccctaacacttgtgcagccacagagagaccctgggcaaagtagtgtacctcaggtgtgtagttgagctatgggcagggccccagcaacacctgccaaaatgccaaaagtgccagtgggacctgaattcctttttatttatttatttatttatttatttatttttatttatttatttttgacggagtctcgctctgtggcccaggctggagtgcagtggtgcaatctctgctcactgcaagctctgcctcccaggttcacgccattctcctgcctcagcctccggagtagctgggactacaggcgcgcaccaccacgcctgcctgatttttgtgtgcgtgtatttttagtagagatggggattcaccatgttatccaggatggtcttgatctcctgacctcgtgatccgcccacatcggcctcccaaagtgctgggattgcaggcgtgagccaccgcgcccggccccctgaattccttttttaggcagttgtgaaacaacaacatcccatctgttgggcacctactgtatattccatgctcagcgacgcacattcattgtctgattgctgtgttaccactgccttccagagaagggcgcagaggccccaggcacttcgcctaggagggaagcacagctctaaggtcaggctccttctctgtaaggtagaggggctacttcagggtcacactgaccgccccaacccctgacctggcctctgcttctgcgaagatgctgagaaggccctgtgttttgtgttttgggtcccactgaccccagaggggagggccatctctttgacccagactcttggatccaaactggggtgccacccatcaccatgtcagtacccggttgaggggagtcagagatagcaggagaccttgtgggacttgaggctgtgactgttctccaaacaatgtggagtatttccatattttaacaaaagagaggccaggcgtggtggctcacgcctgtaatcccagcactttgggaggccgaggcggatggatcacaacgtcaggagatcaagatcatcctggctaacatggtgaaaccccgtctctactaaaaaatacaaaaaattagccaggcgtggtggtgggcgcctgtagtcccagctactcaggagactgaagcaggagaatggtgtgaacccgggaggcagagcttgtagtgagccgagaacgtgccactgcactccagcctgggcgacagagtgagactctgtctcaaaaaaaaaaaacaaacagagaggttatgcttgtgtttccccttgagccagcacccagcccaggaatgcagcagtcaggatagatcaagtgaagctgcagtaacaaacagcccccacatctcagtgacttaaattgatgggaagggttttttacattcagcagggaagctgtttgcctcatagttacccagggacccaggctcacagagtagctgccattcaaaatgttactggtcgccaagcccagggttgagaggctagagagtccaacactgaccagaaagtgaccacactgcttccacacacagcacatcactgcacctagacacacatggccccatctaaacacaaggggaccaggaagtgcgtgtgcctgaaaggccccaaagccccgtccagtgcctgttctgcaccctgttactgtccgcctccagatcaggaaatggaggcccagagaggttaagccacttgcccatagccacacagctgtggtagcagagctgggatttgaacccagagtctcctttctttgcgagtatgctgccaacctagtggggacctgaacacagactgtgggctctctgaggcctgggttcaaatcctggctttacatctctgtgctgctagcctcaggcagatgagtggcttggttacctcctagaaaatgggtatacctgggagtggtggctcacgcctataatcccaacactttggaaggccaaagtgagcagatcacttgaggtcagaagttcgagaccagcctgaccaacatggtgaaaccccgtctctactaaaaatacaaaaattagctgggtgtggtggcatgcacctgtggtcctacctacttgggaggctgaggcaggagaatcgcttgaacccaggaggcagaggttacagtgagccgagatcgtgccactgcactccagcctggatgactgagcgagactccatctcaaaaaaaaaaaaaaaaaagagaaagaaagaaaaagaaaatgggtgataacccttccctccaggatcttcatgaggagctcagtgatgtcatttataaagcccctggggtctcgggagccctcaaaaatgctggagagacaggccacagctctgaagagcagccccagccctgtggagctgaagcagggtctggaggccccctctggggccaggccaatcatgggaaggcccccaggagttcccagggagggagactcagcacagatgatgtcgaacagcctttaccgcagcccttcgaacaaccataactgtcccgggcactccgctgatgggcaactgtgcctctaacatgcacccggccagcctagggggccgggaaccaagccctctgttggcatctctgtcttgtgggtccccattctagaattatttccgcgatgcctggaacatcttcgactttgtgactgttctgggcagcatcaccgatatcctcgtgactgagtttggggtaagtctccctccagcttctctctgggtgactctgggctggacgaggcaggcggcagggggcgggggagcggtcccagaggcagtgtgtcccggaagccatagctgcttgagccagcacttggccatgaccagagagggagaactggggccccggggacaagggcagcccctcaggagggcattgtggggagatgggggtaaccaaagcttggctgtagggccagcactgaggggtgggctttcctgcatcctggcctaggaattaataatgcagatgagtacactgagggaactgagacactcaaaagctctgaaagctgagccggctcccaaacaccaccctatgtcaggagcccagaaagaatgggtttcaagtcaattctgtttgaaccaaccctctcctagttagtgggcaggagagagccacagccctcaggccagtgtggggacaccactcccagggccatagaggggtccccagggtgtcttccctcctctagccccgggcctgggagactctcaacatgggagtctctggacctctctgtggtggccccacaggccacattgcccttctccttttctggaagactcagggccccagaggtcctgtcctagaccctctccttggccatctgccaatgagcccaggcttggggtccctcaggagattggggggagggtagaagatccttgcagggggaagcaatggtcaaaaaagggtgtcaaagccaagggtcaagggtgataccaatgtcatcttactaacaataaaaataacaatagctcacgagaatcgcagccttgctgtgtgccagggaactgtgccaagtggtttacgtggattggctcagggtagaggtcttggtctcagctcgtaagagaattccctcggagggttcaactgaaggcacccaaatgcagacctcactggtggaggggaagggaagggtacccacaagggtggcaaggtgtccagcgaccacccaccgtggggagctgtcacctgcccaggtgctgaagtggggagggaacctgagccggaggccaggagaagccaccaagtgggagctgtcctgtcaatgtggagagacagagaccagggcccaagcaggcagagagcaataggggagaaacaccccaacctttctctcccctcatcccttatctcctgccagagcctcccatggcccaaagtaaaccggaagcaagctgaatatgatgctcagagcaggcagggaagtcaggagaatagatctgggtgtggtcgggcctgaggaagagggtgttgcctcatttcacagatgggaaaactgacctcagctgggcacggtggctcatgcctgtaatcccagcactttgggaggccgaagccggcggatcacctgaggccaggagttcaagaccagcctggccaacatggtgaaaccccatctctactgacaatacaaaaaaattagccaggtgtggtggtgcatgcctgtaatcccagctactcgggaggctgaggcaggaaaattgcttgaacccggaaggcggaggttgcagtgagcgacggtcataccattgcactccagcctgggtgacaagagcgaaaactccatctcaaaaaaaaaaagaaagaaagaaaactgatcttcaatgcctggggaagtgagagacactcccaaggtcacaaagccaggcctgggtgactcctgagagtacactgacagctcctggggtgtcccagtcagatccccctacagaaaaggatctgtttgcctgctcttccgtcctagaaggccaggaggggctggggaactacacaaaagagggggccattctttgatatgtcctacggcacccgcacccaagtgatacacacttatttgccttcagctccagtgagccagaattttccccttcccctcaccctatccctgaaaccttcctctagagggttcttgcccacatgggggctctctccactggggtgcccccacctggtcattctcccctgtcctgagtttctagagagggctggagctccagctggcaatcaaaatatcttgccatccggctacatacaagacagccttgaaccaatgtccctttgggtcaagaggttagaaggatggtccagctccccagaagggcaggtggggtggaggaagttagctgaaaccttcaatcaccagtaagagagctgtagggacagactccaacagcctgttctcctggctggcaggaagatggggcatggggtgttcatgggacatcaggacccttgcagtagccaaacagcccccagccctccctaccagctgtttgatcttggacaacttgcgctatctcttctcatgtagagtggggctaaccattgcaaccaacctcagacacttgcaagactcacagtgatgcatgcactcaaaagacattcattgagcacctactgtgtgcctggtgtgattataagtgctggagacagaacgagaaggaggggtgccaaacaaaacagaccaagaatacagagtgtctgctcccatagagctgacattctaaggagagagacgggaactttttacaagtaaaagcatcaacaggccgggcatggtggctcacgcctgtaatctcagcactttgggagaccaaggcaggtggatcacttgaggtcaggagttcgagaccagcctggccaacatggtgaaactctgtccctactaaaaatacaaaaattagccgggcacggtggcaggtgcctgtaatcccagctactcaggaggctgaggcaagagaatcacttgattctcaggaggcgagaggttgtagtaagccaagattgtgccactgccctccagcctgggcgacagagtgaaactctgtctcaaaaagaaaaggaagaaaaagaaagaaagaaacgtgaagtgcttggcacagaacctgccaggaaaccaggagtttgaaaatggtggttgttaactattactgctgttgttattgttattgtgaatgggtgtgtagttttgttagccagccctgagttacagtcaatttgagggaaagatagggggtgggtgtttgggtccttctgggacaattaactcccaacctggagtagggagaggcatgtcctggcaggcaaggaggtctcagttgcccctttctgcctcccaggtaagcccactagttctgaggccagggcttggccaggctgagacaggaaatgccagatgcttgggcgggcaggtccctggggtttagggggcagagggcatgcggcagtactaaccagtgctgtctcagctgctgcccccaagtggctggggtgatgtgggtttgccctgtgtgcaatggataatgactgtgtttcttgtcttgtctcttttcatgcctgctcttaaaactgtatattggcgcaacgccgtctgaaaaactcatccaatcaaaatgcactatgaaattcatttgttcatccatgacatggtctgtgtgttcatacaccaatgacttatctcccaacccaccgccaccaccacccccactccccgcccgggaaccgaaacccattggttttttggcactggttacaaatcaacctaaaaaatgctgaacacgcctccccaactgcccccgcccgcccgctccccctcatcttcaacatctgcatctagaatccggttggtcttacttctttctgaagtctaaatgccttacattaactgtgaacgcatctcctcgcgtcggcattgcatgccacaccctgcctctccaacgtgggatgcctgacgctctcctcaaccctccgctctcctctgtctgtctgtcctcccgcccccagcccctgtgcctcccacttcctgtagactctgtctctctgtttttatcgggttctgaatgggggttttctgtttggggtggtttgcgtcttttgcagagaaagggatgggttttcccagcgcagcacctctctcttgccccatcccgcacacacatcccctacactcagagacaatagaggcaaatccactcccagccacctctcaccactcctgtcccccattcagctccatggaccccaggccccaggaaagctgccaactgtctcctcgcccctccagctctctccatcctgctgtccccaatcctccatctcaagcccacaagatctttggccttgaccagcagagacttgactctccaagtctgataaaggagacctgaaggccaggcagtgtgccggcaaagactctcaggcagaggaactcagaagtgccagacttggatctggtagcttcatgtggggctggcccactgaggccctctcctggagccttgaactgtacgtgcacacgcagtcacacagtcactgcacacagacactgcacacacagtcactgtgcacacactcagtcactgcgcacacactgtgcacacagtcactgcacacagacgctgcacgcagtcactgcagtcactgcacacagtcactatgcacacacagtcactgcacacagacactgcacacacagtcactatccacacacacagtcactgcgcagacactgcacacacactgcacacacacaatcactgcgcacacacagtcactgcacgcagaaactggacacacagtcactatgcacacactgcacacaccactatgcacacacactgtgcacagtcactatgtacacacactggcactgcatgtagtcactatggacacacactgcacagtcactgtgcacacatacactgcacacactgtcactatgcaaacacagtcactgcacacagtcactatgcacacacactgcacacacagtcactgcacacagagccactatgcatgcacacacagtctgcattcacacattgaacacacagtcgctatacacacacagtcactgcacacacagtctatgcacccacacactgaacacacagtcactgcatgtacagacactgcacatagtcatgacctcttctctttttctcactcattctccaattctctctctctctcgctcttttttttttttttttttagacagagtctcgctctgtcacccaggctggcgtgcagtggcacaatgtcagctaactgcaacctctgcctccccgtttcaagcaattatgatgcctcagcctcctgagtacctgggattacaagcatgtaccaccacgccaggccacttcttgtatttttagtagagacagggtttcaccatgttggccaggctggtctcgaactcctgacctcaagtgatgcacccgcctcagcctcccaaagtgttgggattacaggtgtgagccactacacctggcctctaatcctcattcactgttcctgtctctgtgtctctcacatacagtcatgcatgcatgcacgcatgcacacacacacacactggccctctctgctacatctacccaccctgtacccccactccagtacatactgcacacatctctctccctcccccacttctcagccccttgcacaccccttgttctgttaaatctcaactgcctctgcccctctcctacccaccaatgaggcccttagagggacgccccaatggcatctttgccctggaatcatcccttccctgctggcaatacacatgcattcacccaccaaacatttaatgagcccctatttggtgccacagatggaattatgggcagaagcagacaccattactgtcccctcttaccacatacagtcaggtgggggaggcaggcatcggtcaaataaccccttgactccacttaaaattatacctgcactgcgagctgaaggatgagcagcattaacaaggcagagagagatgcacagagcattccaggcccaggacagcacatgcaaaggccctgtggtgggacggaacctgtgaggggtcaggatctgcaagcgagggaatgtggctgatgcaaagacagccgagaaaggctggcctggagacagccgaagaaggcagaaggggacaggacccggggctggggagggcggggctatattgtggaatatgggctttctcctaagcaccaggaagggcctgggaggataggaagcaggggaggcgcgactggtcatgtgactagacaagctcgctctggttgcagggcagggaacagcttgacaggaggctgggctggaggtgggcaccaggaatcgcagcaagagatgacagtggaggagagagaacagtgggagggttgtcctctgcaggacccagggaaagatcaggtctgaactgagatgaggtgcctgggagcagtcgggtctggcttaaaactgggagataggctgagcacggtgactcaagcctctaatcccagcactttgggaggctgaggcaggaagatcacctgaggtcaggagttcgagaccagcctgaccaacatggtgaaaccccatctctcctaaaaaatacaaaaattagccaggcgtggtggcaggtgcctgtaatcccagatcctcaggaggccgagacaggagaatcacttaaacctgggaggtggaggttgcagtgagccgaggtcgtgccattgcactccagcctgggcaacagagtgagactctcttaaaaaaaaaatactgggtgatagaggtgagcgagtgcaaggaaaggaccaggttgggggaagagaataggtgtgggcatagcaagtttgaggtgcctttaggacatcccgaaataagtcagataggcaggtgttgtgggggctgcagcttggagctgaggtctacaagtagtaggacttttctggagcccttaggtgggtggtctccatatccttctgagcacttgaggaacatctgagcacagcactggaaaagaaaagaccacaaggacgctgtcctcatgtcttccaggggctgtgtcccacccccatcacattctagccaggaagttcaggggaggtgttgaagagaggaagctgcacctcccaagccatggattgaaatgtggaaggcaggaagagggaacttgtcagaagttctgggggcagtggaaagaattggtactgatgcaggaagagatggagggtggatgagggcagactagtacccttcccccactgccccaaacccttcccgtctccacccctacctgcctcatgtgtctcctcccccacttggctccaagaagggaagcatgttttctgcacgcatctccctgccagatccctggcttttttgcatggttgcaagcttcccctgctctcctccaaacccccctcctgaggctgcttccagggtccgcctgccttcgcatgcctggccgagtccacatgttatgatccgccccatgaaagggatggcttgtactctggggttgaacgggagggggctggggatacctgagccatcggccccatccccaggtggagctgggtggccaggcagggatgggggtcagggcagcagggcacagagagtgactctgttagccaagctgggtttggggcttgttcgaggcactggagacattctcacagcacttgagcccagtgtggtcagggtaggatcccccagcccccttccccatcctagaggcctaaggacgcactgatgtgtcccagagagcatcctagacattgccatcaaacccagaggcctcagaaattccttgaactccagtccttgcctctcagctcccaggccaaagccagcacaagacacagatctggcagccagaaagccctctggaagccaccaagtaggatgcccatgtcacccaaactaggacacttttgaaacaggagggaggctgtgactgtatggtcaccctgtgccatttggggggtgaaggttagaccaagttaaatcttgctacgtggcctgtagcaaatcctacaaatcccatagaacaagtctgattaagccccttcccttagtgtggagagaccctctactcctcctgccttcaccctgctgggtactggccagcgaaggagggtttccatgtctgcctgaggctggggtctcaaactcaaatgcctctgggggccaggcagacaccagtcaaccaggaaagcaagtgccatttctaaaacgtgaggaccctggaaaactggagatcatgtggcctgcttccagggagcaatcgcagcaggcctggggttgccagaaagccagattggtgggcaaaatctcttgatttttaaacaatggcaataatttttaattaaaaacaaggacaaatgaaaaaacactgctcgggcccaacaaaacagttttattagctagatttggcccactcgtgacttcgagagtcccaccccccccaccaaggtcccttgaagccccacaatggccacttaactctagctggtctcctccctgactctccaactctctggccccctggttcttctagcttgggtgggaggaggcagaggcagtgactagacagggggtttttgagcagaggcagtggccacccagggaggtcctgggggcagggatggccccacctcccggcccccagcacccgccccttggtgggcccgggctgatttctgagctcacccacccatgggagctgagtgcttcctgcttcctgcaggcctggtcccgtgctactccacccagccccagaagctgagaagccatccctgagaggggggaaaagggccccaaatgcatcttctccgactcagcgggcagcgaggactcaccctgcagccgaacagtcccagctccctcccgtcctccccattcccgctcgccaagggggtaagaaaagatgctcttccgcttctcccaattggctcgagccgctgctcctcttggccgtggggtgaggtcagggcgggcaggagcgggtgggcagctcggcagggcagggcagggcagggtgcccggtgagtcccgtgacagatgcatttctggcccggagcgtaacatgccctcggaacccgcacatgtccaccaggcctgactgtgctggcgacctccacccccacccccgccctggtgtttgtgcatcgtacacgtatgatagattccgcaacttgaccggcttgtgtcctttcgtctcagtgcatttggttgttgggagaaacaaaaaccatctcgatttttttcctgattggatgattcggatatattttctttttcttgttcttttgttatttcttccccatccccgttcctttttcctcctttctttttcttttcttttccccattgtgggtggggctggcagggagggcttatgcttttgagttgatgccttttcctccctcccaccctctctctcccaacattattcctttttcgagtttttcctctgcatcattgcattaatagtgctttctctctccctccttatttggggtctggcttgcttttttcctgttggttggcttcatgtaggggcctctgtgagtggtgacagctctgagccttttggggtgggtggatggtcacccctcttcctccatctccccagaataacttcatcaacctgagctttctccgcctcttccgagctgcccggctcatcaaacttctccgtcagggttacaccatccgcattcttctctggacctttgtgcagtccttcaaggtgagtcctcgtccctgctgctggcccagggctgagaagacaggtgaccctcatgctctggctgaatgtagaagtcagattggaagtgcctctgtgatgtagtcgtgcagagaatctgttatctccaaggctgttgtcaaacttcctgtccctggtgtgtcttcagagctgtaagggcctcatcctagagcccccagagatgcccaccagccctggaaggactctggcacgtggcatatggccacccaacccagtggggcagagcactgggacaagggaggaagacagtgcggctgagggacccccagcactcttcttcattgccttttttcccaccaggccctgccttatgtctgtctgctgatcgccatgctcttcttcatctatgccatcattgggatgcaggtgagtgtcgtgtccctaaggttcccagagcctcccaaggagggcagccacccttagaaaggggtgggtcagaggagcctggttcacagaagcagccatggaggttgagctgggtttcccagaagccactggaggaatggcagcccctggtcgtcaccctccaattccacaggtgtttggtaacattggcatcgacgtggaggacgaggacagtgatgaagatgagttccaaatcactgagcacaataacttccggaccttcttccaggccctcatgcttctcttccggtgagaaggggacctgctctgataattctgtttccgtggggtggggtgcctgccttcatccttctgttcccatagaggatgtaccctcctcttccaatgcaagacgtgccctcctccttctcttctggcaggggcgcgccctcacccttcttttccggtagggggcgtgcccttctcttccggtaggggacgtgccggccttctcttccgatagggggcgtgccctcctcctccttttctggtgtgggggtggccagatgtgctcttatccttcttttcccgtgaggctggaaatgggtgtcgtggggggcccaggaatcctagcagggcagaagcagagggccctgggacatagtcatcaaggtcattttccaggcattatctctgaatcttcctgaccaccctgtgaggaagggattcttggcagccctatccgacaaataagaaaacaggcttacagaccgtgaggcttgattctttggttcatcatcttggctgcacacaaaagttccttcactcgttcagtgtaggttttttgggggggctttttttttttttttttttttttttggagatggagtctcgctctgttccccaggctggagtacagtggcgcgatctcggctcactgcaagctccgcctcccgggttcacgccattctcctgcctcagcctcccgagtagctgggactacaggcgcccgccaccacgcccagataatttttttgtatttttagtagagtcggggtttcaccatgttagccaggatggtctcgatctcctgacctcgtgatccgcccgcctcggcctcccaaagtgctgggattacaggcgtgagccaccgtgcccagcccttttttttttttttttttagatggagtctctctctgttgcccaggctggagtgcagtggcgccatctcggctcactgcaagctcctcttgtggaggtgtattgagcacctacagcatgccaggcagggctgaaaaacgaggatgcaccaggaaatagagaaaagagacattttaagcactttggaagctaacatccccatggggaagacgaataatcaggaaacaaattatagaggatgctggaaaaagataaaattcaagaataaaggggaatagggccaggtgcagtgactcgtgcctgtaatcctagcattttgggaggccgaggtgggaggatcgctttagcccaggagtttgagaccagcctgggcaacatagtgagaccccgtctctacaaaaaaattgtttttaattaactgggcatagtgccacacacctgtagtcccagctacttgggaggctgaggcaggaggattgctcgagcccaggagttccaggctacagtaagctatgattgtgccactgcactccagcctcggcaacagagcgagactctgtctctaaaaagaaaaatatatttttttaatttttaaaaaaagttacagaggtagatagtggtgatagttgcataataatgtgagcttacttaatgctactgaattgtacacttcaaaatggttaaattgataaacttcatgctgtgtgtattttgccacagtaaaaaataataatgtttttaatctaacaacaaaaaaagaatagagggccggcaggttatgcctctctgaaagtgtgacatttgagagaaattggcaagggagggagtcagtgggtatatggggaagggcaggccaagccgaggggactgcctgtgtaaaggccctgaggcaggagtatggctggcatgtttgaggactgtgaggagcccagcatacctagaacagagtgatctagggagaatatagtatgagatgactgtcaccttcatggaggggagcttttttttttttttaatctgagacagagtttcggtcttgttgcccaggctggagtgcagtggtgcgatctcggctcggcgcaacttctgcctcccaggttcaagcagttctcctgcctcagcctcccgagtagctgagattataggtgcccgtcaccacgcccagctaatttttgtatttttagtagagacggggttttgccatgttggtcaggccgttctcaaactcctgacctcaggtgatccacccgcctcagccacccaaagtgctgggattacaggcatgagccactgcacccggcctgaagggagcttttttttttttttgcttttttttgagacagaatctccctctttgtcacccaggctggagtgcagtggcgcgatctcagctcactgcaacctccgcctcctgggttcaagcgattttcctgcctcagcctcccaagtagctgagactacaggtgagcgccaccacaccgagcaaatttttggtatttttagtagagatagggtttcaccatgttagccaggatggtctcaatctcctgacctcgtgatccacccacctcagcctcccaaagtgctgggattacaggtgtgagccaccgcgcccagccaagaggggagcttttaaagcataacagtgaccagcctgagcaatgcagtgaaaccccatctctacaaaaaaaaatagtttaaaaattagccaggagtggtggcgtgtgcctgtagtccccagctactcaggaggccgaggcgggaggatcacctgagcctgggaagttgaggctgcagtgagcagtgattgtgccactacactccaacctgggtaacagagcaagaccctgtcaaaaaaaaaaaagagagagagagagaaaagaaaggaaaagaaagagagagagaaggaaaagaaaagaaaaaaacatatcagtgtcctcaaatcccaccctagaccaactgaatccaagtctgctggggtggggcacgggcattggtattttttcaaagctctctgtggacttcagtgcacagccaagaatgtgaattcccttctctcagctcccagtaaaaggaggtggtccacctggggcttgcctggccagctccagagcccaagtgctcaacgtgtgtgctccacctcctggggaggcgttggtacccagtcagggctgggtgtccgagtctctgatttctccctgtcctcaggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctggtgagtctgtggacactgtgagggccgtctgggctccctaagcctggcttcctttcaggggagtgggtttctgtggaatgtggctgtgtcgaaggcttgttccctccaaggcttctctgaaccagcctgggatcaggtgaccctgagcgtctcaaactcagcactgttgacatttgggggtggctgattctttggggtggggccatcatgtgcactgcagtgtatggcagcatccctgtcctccccccaccagatgctggcagcacacgccacccgttcctcctgttgtgacaaccaaaaatgtctccggacattgccaggtgcccccagggggtgggggtggggttgggagtgggggccagaattcccccatttgagactcaatgaaatatttcagctgggcgtagtggccgatgcctgtaatcccaacacttcgggaggctgaggtgggagggtcacttgagcccaggaatacaagaccagcctggacagcatggtgtgaaacccatctctttaaaaaaaaaaaaaaaaattgaattagctgcacacgtggtgctgtgcacctgcagtcccagctactcaggaggctgaggtgggaggatcacttgagccttggaggtcgaggctgcagtgagccatgatcacaccactgcaccccagccagggcgacagaatgagatcctgtctcaaaaacaaacaaaaacaaacaaaaaaaaaaaaaacattgcgagggaagaaatacctcactttggccttgttgggggcagatgtgggaggatttggggtcacagtggttctcttggtgttggtccctgtttcagaagcctcccctccctctcactgactctgtttctttccatcattcttggtctttgtctctctctctcttttttttttttctttgaaatggagtctcactctgttgcccaggctaaagtgcagtggcgagacctcagctcactgcagcctccacctcccaggttcaaccgattcttcagcttcaacctcccaagtagctgggattacaggtgcacatgccaccacacccagctaatttttgtatttttagtagagacagtgtttcaccatgttgaccaggctggtctcaaactcctgacctcaagtgatctgtccacctcggcctcccaaagtgctgggattacaggcgtgatccaccgtgcccggccagtctttgtctctttgtatctctctctctccatctctctctgtttctctcttcctcttccccatctctccacttgatctctctctcactggacctccttgtgtgagtgagcatcacctctccattccccagtctctttctgtctctgtctcatttcctttccccatcttctctctatccctctctccatctgggcctctgtgtacatgtctttgggtctgtctgtccgtctgtctgtctgtatccttctcactcactcattcattccctcggtctctgcccccattctctcttggtccccggggtccccacagatgctgaatctctttgtcgccgtcatcatggacaactttgagtacctcacccgagactcctccatcctgggcccccaccacctggatgagtacgtgcgtgtctgggccgagtatgaccccgcagcttggtaagaagtcaccccgaatcctccagccacaatactcacctctccctggaactggaacacgggctaggtcaggccccagactctggagcactgaactcctggggtcctagcaggggtctcacaggttcagtcaggagagaagatataagaatcatcacccttgcataccccagattaaacacgtagggtgccaaccctgcccaaaccctggactttctgggaaatgagggagggcgtcaaccatgagatgtcctgaagagccctctcctcctacgagtctctcctgtctctcactgtgaagtctccagatggtgaggatgcattagccaggctccagggagaaaaccaacagcatcccagcctcagttctcttgagagtgtggggaggagggctggcctacccttggcagacaggattggcagcaacatcagagtagcagaactcagctcccactgggacccgtgaacctgggagtgagaggacatacaggccaggggaggacgcagagcctcaggggcccatgcatctttgtggccacaaagggagtgggcgctcccatctgggtagacaccagaggggtccctctccactgacgggcaatggtttcagagggtgggttccaccttgtgcacgtgtattgagtgcccacccaacaccaagccttgaaggacactcagaggctttatctgaatacctggaacccaccagccactaactgaggatttagttcaggctggtcttggggcctgaagaagcattactggggggccctcagcagcctaagccccatcttcctctggcctcagcaccagagaggaggccgtcacgaggaaggtgggcaggaggtggtcttggctattcccatagcctcaaacaagtactccatgagaccgagaggctggggagagccgtgggtctggggctgggctttggctggttcctaactcttcctcttttgattttaggtcacagcaattggatgctgtccccaaggcctctattccacaagcccccccccacccctgtagcccatgtagactgtggaggaggcagatgcagagagagccccaggggaggtgccctgcagtcccgaactcgactgacatcctacacccctgggtctccccagtgtctgggaatgtactggggaccttcacttgtccccagtctctcccactccttcaagccagggacaccccagcctcgggcatcatgacctcgctgtgtgcccagggagcccgtgtgaacccattgcctgcactaaccccctttcttctcctttcagcggtcggattcattataaggatatgtacagtttattacgagtaatatctccccctctcggcttaggcaagaaatgtcctcatagggttgcttgcaaggtttgacttccactaaaacctgctagcatccatggaatgagtgtggcttggggttcttcaatatatatatttcatatatatatatatatatatctctctctctctctaaaaaaacagagccatctctctttcttgcattaaactagaaaactctcttagccaacagaatgcagtcatgtagactcgataaagcatggaacatatttcctccttcccttcagccttcagccatctttgcttgctcttagctgaagctgcccatcctggggtctccacggcaccccaaatcagatacatcccctgggggattgtaactttgcatttctcccccaaccatcacctccactctctccccctccacccctcacctcccaaagcccctagccctcctcccctccctggcactggcccctgctccccacctaggccccctcagagaccagcctcagccaaaccagagaacgtgacccaactgtagaaataacagtgatggccgggcgcagtggctcatgcctgtaatcccagcactttgggaggccaaagcaggaggatcgcttgagcccaggagtttgagaccagcctgggcaacatagcaagaacccccttctctataaaaaattagccaggcattgtggcgcatgcctgtagtcccagctacttgggaggctgaggcagaaggattgcttgagcccaggaggtggaggctgcagtgagctatgatcacaccactgcactccaacccaggcgacagagagagaccctgtctctttaaaaaaaaaaaaaaaaaaaaaaaaaggcaatgaacaaaagcatggctctacgtcttccaaagtgagaattctccctcccctccgcatccctccagaactgtagctcagagcccacgctgaatctgacttttctcttttctctctctctccctgctcccgagcagtgaagtaatctttttttactgaccttttcttccattttttttcctcctcttttccattgatttgaaatatctattttatcattctctgcatctttctctctctattttttcggctcgtgtggatttcttttttctttcttctgtttctccccacctctcttcctttggttctctgttcccattcccgttttgtttttttgtttttgtttttgtttttttcattttcggtgctgccaggggccgcatgccttacctggacatgtatcagatgctgagacacatgtctccgcccctgggtctggggaagaagtgtccggccagagtggcttacaaggtagactacccttgccgaccaccgacgtccaggcactgggtttttttttcttcttcttcttctttttttttagtgctgaccagaaacacccggccgactctctttttccaacgtttctcttcttttttgtttttgattcttttttttcttttctcgagtcaactgatcatgaccatcccttgattctaagcagcacactgtgtccgtcctttctgatgagtgtcttcgtgttttgagactccattatggccgacatgccggggggagggggaggggagcgcccaggtccccttgcacctggtctcccaggtaccaaattggaaacaaacacgcttcttcagggagtcaaaacccatgcttcccacttctgcccacccagagcggcccccatgcccaggctggggcaggcgccttgcagagaggggctttagcccccgaaagcaggcgaggtcccgggtccccgcccctgccacgcacacctgaagctgatctctgacctagggccttggggattcgagaccttccaaggagcaccaagaacctctcttcccctcccttccttcccctggagtttcgtccccagcccccgtccctaatccccccaagacaccccaacatgcctctccattgttccagagtgggcaggcggccgcagctggacccctggacggtggcacactgatgcaggccatgcacgctgccttggcggggcctggggcgggcaggcaccatggccgacggggggtggtgcatgctggctgagagagcgagcgtcctgccgccaagcggctggcccgggccacccctccagatccctgtcctggaatctcccttggtgcccaaggacagatgctctgttccctccattcatccacaagaagttcagggatgacctttaaagattctccccacccaaaaagtattaccccatcatcctattctcccatccaccttgatcttccctgcgtccctatccatcaatgctatttgtacctgccccgtgttgccacctcattcctttccttcctctgtgcacccctcctcacctaacctatatgtctcccctccttctcaatcaaagccggggacaaggttgtcccaccagcatctcagacaatgagcctctcctggcacctgtcgctctgtgcccctccctgccgcccccccccccccccccggttttcctcaagtcgcttctctcagtctctgcttagatgaatgtgtgcgcatgtgcaagagagggagggcgagcccttcctctcctggtctttgtgcaggaccaccatgggtccataagacaactttgtgcaaatttgaaaaaggcaccctttccacagaacatgcctgttggaaaattgttgcaatctaccaatgtggtgagaacaagacactttttttctatcacctgggaagctgttatatttaatatacaaatcgggggctgggcgtggtggctcatgcctgtaatcctagtgctttgggaggctgagacgggaggatcacttgagcccagttcgagactagcctgggcaacatagcgagaccccatctctacaaaaagaaaaaatattttaattaataaataagtacataaatctatcatttccaagatgggagccctttgtgcggtgtacaacctgcacaactgtgcacagtggcccagtctatgtgtgtttctctatttcccacctccttccccaccctacccccagtgtcccctccagtgtcctgctctggatttaccatacccctccccatcttcaactctgtgtttcctgcccacttgtgtctgaatccccacccaagttgccctcaccccccttctctgtgccacttcagcctgggctggtgcacaccagcccagcatcctctcccatgccaccaagcatggtggacagagcccctgcctgggacatggggaatcttttcttccctgggctggaagggagtgcccctcaccccttccccctgccattgcacagagagccaagatctggacatgcccctgagatacacttcccacggagctatgaatgagtctcgagattccgtctgcatgcgcccctgtctgtgctgttctgtgtcacagcctcgctgcatgcctgcgaggggcctgccccgtcagtggggggctgcctgcctgctgcttctcagaggaatgatgtggtctgtgcccatctgctctgtcctggtctgggccaagccagggattgggtgtggggagccagtggcaccccccaccagcggctgtggtcctggccccctcagccttggctgttgcatgcactgctcaaatccagcttgtgctctttttctttggggtcagactgaaacggggccatccagaagaactctggggcagggcgggggtggggcaagggttgaggcaaaccctggaaatgccagctctcaggtcaagcaggtgggggaaaaaaggagagggcaggggaccagaagtacaagagagccttttgtgccctccctgcgggccaccaagagaaactgagtactgggacaggtaacctaagtaagagacacctcagccgccacagctttcagagttcttcctgggactccctgggtaggggcgggcgcggctcacgggagacccaggagggatgcctgggaatgactgcgcttgccttgggttttctgtagcggcttctgcggatggacctgcccgtcgcagatgacaacaccgtccacttcaattccaccctcatggctctgatccgcacagccctggacatcaagattgccaagggtaaggaagggacaggggcgggcacagacaggcgtgacagggtggaaccggggatctccctccctaccccaaactagaggatctgctgtcaccacccggatcttcattcactcttccattcattcgttccacagggttttttggggtttggggttttggtgtttttttttttttttttttgagacagagtcttgctctgttgcccaggcagcagtgcggtgacatgatcgcaagtcactgcagccttgacctcccaggctcaagtgatccttccacctcagcctccccagtagctgggactacaggcacacaccaccatactcggctaatttttttttttttggtgtgacaatttccctctgtcacccaggctgaagtgcagtggtgtgatcttggctcattgctacctccgcctcccgggttcaagcgattctcctgcctcagcctcccaagtagctgggattataggtacccaccagcacacccggctaattttttatattttgggtagagatggggtttcaccatgttggccaggctggtctcgaactcctgacctctggtctcaaactcctgacctcaagtgatccacctgcctcgacctctcaaagtgctggattacaggcgtgagccaccatgcccaacctaattttttatattttttatagagatggggtttcatcaggttgcccaggctggtctcaaactcctgggctcaagcagtcctcccaccttggtctcccaaaatgctggtattacaggcatgagccaccacacccggcccatttggcagatatttagtgcactccttcaatgtgccagagacccgtccaagcaggggaggacccagcagcttacactttagatggatggggaggccgccactgaggaggtaaggcagtgtctcatggatccctggggggaaggtgctccaggcagaaggactggcaaaggccctgacagaggggtgaacacaggacacccggggcattgagctgactcaccttctgagtgagggcacgccacgcaggttcagagcagaggaggaacctgacccaactcacatttgaacaggttccctccggccactgaggggatgggagaccgaaaggaggccagtgtgggggctgctgatatcatctgggtggagacagggcggcagcttagatctaggggtaggctcgacgtggtggctcacgcctgtaatctcagcactttgggaggccaaggtgggtggattacttgaggtcaggatgaccagcctggccaatgtggtgaaacccccgtctctactaaaaatacaaaatttagccagacgtggtggtgggtactgtagtcccagctactagggaggatgaggcagaagaatcgcttgaacctgggaggcggaggttgcagtgagccgagatcacgccactgcactacagcctgggtgacagagcaagactctgtctcaaaaattaaattaaattaaattaactggacatggtggcatatgcctgtggtcccagctactcaggaggcagagatgagagtattgcttgaagccaggagtttgaggctgcagtgagtcatgatcgcaccactgcactccagcctgggcgacagaacgagatcctagctcaaaacaacagaaagaaaaagaaaaaaacattttttttaaagctgagaaggggctgggcgcagtggcttacgcctgtaatcccagcactttgggaggccaaggtgggtggatcacgaggtcaggagttcaagaccagcctggccaacatggtgaaaccccatctctaccaaaaatacaaaaagtagccgggtgtcatggtgggcgcctgtaaccccagctactccggaggctgaggcaggagaatcacttgaacctgggagacagaggttgcagtgagccaagatcgcgccactgaactccagcctggatgacagagcaagacgctgtctcaaaaaaaaaaaaagctgaggccgggcacgctggctcacgcctgtaatagcagcactttgggaggccgaggcgggcagatcatgaggtcaagaaatcgagaccatcctgggtaacacggtgaaaccccttctctactaaaaatacaaaaaattagctgggtgtggtggcacgcacctgtagtccctgctactcagaaggctgaggcaggagaattgcttgaacccgagaggcagaggttgcagcgagccgagcttgtgccactgcactccagcctgggtgacagagtgagacttcatctgaaaaaaaaaaaaaaaaaaagccgagaaggctggacatggtggctcacacctgtaatctcagcattttgttgaggccaggcacagtggttcacgcctgtaatctgagcacgctgggaggccgaggtgggtggatcatttgaggtcaggagttcgagatcagcctggccaacgtggcaaaaccctgtctctactaaaaatacaaaaattagccgggtgtcgtggcgtgtgcctgtaatcccagcactttgggaggctgaagcgggtggatcacttgaggtcaggagttcaagaccagcctggtcaacatggcaaaaccctgtctctactaaaaatacaaaaattagccaggtgtggtggcgggtacctgtaatcccagttactagggaggctgaggcagaagaatcacttgaacccgggaggcagagattgcagtgagccgagatcacatcactgcactttagcctgggcgacagagcaagactccatctcaaaaataaaaataaaaataaaaaataccgagaaattcccccaaagacctagctcagggctcactctccatcattagggggaaagaagaagaggaggccagggaggcgggcagagaccagggcagtgtgggctcctggaggcagcttctatgtttaaaagggcggcttcaggaggaaggggaccaaccgtgtcaggcactgcccagagaccaaggatgacaaggatcacaagtgactggtcatcatggtcactttgaccagtgcagctttggcggaggggtcaggggtcccctgtctggagtgcatttcggaggcccgaaaggggatgtgatgtgatttggcagctgattaaggacagcagggcagagagacaggcgcacaattgccagaagaaacggggacctgaggctcacgcctgtaatcccagcactttgggaggctgaggaaggtggatcacttgaggccaggaatttgagaccagcctggccaacatggcgaaaccccatctccactaaaaatacaaaaattagccaggcatggtggtgcacacctataatcccaacaacttgggaagctgagcacaagaattacttgaacctgggaggcagaggttgcagtgagccgagatcaaaccattgcactccagcctgggggacacagcaagactctgtctcaaaaaaaaaaaaaaaaagaaagaaagaaagaaaagaaaaaacaaatgggaccagaaaaaaggagtgggtgggagaggagcaggtggatagtcccacacatgggaaggtgctgagcccagctgaaaccactagtaagtcaggaggagggaagactgagcctcgagacatatgtgccttccagggtcttgagggaaagaagggaggaagagccaaggccacgtggcaagactcaaggaggaagtggcagggaaggtgggggactggaggggtggaggacagatattgttaatgccaggaacaaagtgaaggtaaagagagcacaaggaagttgggagcagtggctcacacctgtaatcccagcactttgggaagccaaggcaggaggatcacttgaggccaggagttcaagatcagcctggccaacacagagagaccccatctctacagaaaattttaaaattagccaggtgtggtgatgtgcacctgtagtcccaactacttgggaggctggagtgggaggatcactggggactgggatgtcaaggctgcagtgagctatatgatgaccacagacatagcagcttaagacacacctatttgtcagctcacagtcctgtaggtcagaagtccaaaaagctggactgggctgtctgctgagggtctcacgaggctgaaatcaaggtgtcagccaagctgggctcctctctggaggatctgggggagaatctacttccaggttcattcaggtgttggcagaattgaagtccttgtggctgtaggactgaggtcttgttttatcactggctttttagctttttgctcctggaagtgcatgtaatcctccatgtgctctcattctctctgacttccccatctgccacccagcagagacaatactgtgcttttcaagggctcacctgattggggcaggcctaccctgatcatctctgtattttgaggtcagctgacttgatattttttttttttcttgagacagaatttcactcttgttgccaaggctggagtataatagtgtgatctcagttcactgcaatctccgcctcccaggttcaagcaattctcctgcctcagcctcctgagtagctgagattacaggtgcccaccaccacgcccagctaaatttttttgtatttttagtagagatggggtttcacaaggttggccaggctggttttgaactcctgacctcaggtgatccacccgcctcagcctcccaaagtgctgggattacaggagtgagccaccatgcccagcattttctttctttttttttttttttttgaaacggagtcttgttctgtcacccaggctggagtgcagtggcgcaatctcggctcactgcaacctccatctcccgggttcaagtgattctgcctcagcctcccaagtaggtgggactacagatgcgtgccaccacgcccggataattttttgtatttttagtagaaacggggtttcaccatgatagcaggatggtctcgatctcccaacctcgtgatctgcccacctcggcctcccaaagtgctgggattacaggcgtgagccaccgcaccgggcctccggtattttaattatatctgcaaagtcccttcatagcctgggcaatggtccctagattagtgtttgaataaacagaatcttggcagaagggcagcttttgaattctgcctaccacagttccttcgtttgtacaacgggtctaacaacacccccactctttgtatgtaatgccatcgtaactcagcttctgtggcactctgagaatctgtgttcaggggtcccaaaaccacccacaggttcagtgattccctggaagaactcagaactgagaaaagtttttatactcacagtttattacagtgaaagaatatagattaaaatctgcaaagggccgggcacggtggctcacgcctgtaatcccagcactttgggagggcgaggtaggcagatcacttgaggtcacgagttcaagaccagcctgaccaacatggtgaaaccctgtctctactaaaaatacaaaaattagccaggcgtggtggctggcgccagtaatcccagctacttggaaggctaaggtaggagaatcacttgagcccaggaggcagaggttgcagtgagccgagatcccgccacttcactccaggctggacagagtgagactctattagaaaaaaaaaaaaaaaaaaaatctgcaaagggcctggcatggtggcttacgcctgtaatcctggcactttgggagggcaaggcgggcagatcacttgaggtcacaagtttgagaccagcctggccaacatggcgaaaccccgtctctaccaaaaatacaaaaattaggcatggtgccagacccctgtaatcccaactactcaggaggctgaggcaggagaatcgcttgaccctgggaggcagaggttgcagtgagctgagactgtgccattgcactccagcctgtgtgacaagatcaaaactctgtccaaaaagaaaattagccaggtgtggtggcatacacctgtagtcccagctactccagaggctgaggcacaagaatcctttcaacccaggagatagagctacattaagccaagatcacgccactgcactccagcctgggcaacagagcaagactctgtctcaaacaaacaaacaaattccaaaaacataaaatgcgcaaaggaagggcatctggggaagggtccaggagacaccaggtgcgagcttccagttgtctgcctccagtggagttgcacagacaacgcttaattctccctgcagtgtgtgacaacacgcaccgtgtactgccaaccagggaagctcacctgagccttggtgccccagggtttttattgagggtttgtcatataggcagggctgacgtagttactcagtctccagtccctccagaggtcaaactgataccacgtggcccaagaccccaacgataaatcgcattgttagaatgaactgtatggaaaattatccaggcgtggcggcgggcggctgtaatcccagctactggggaagctgaggcaggagaatcacttgaaactaggaggccgaggttgcagtgagccaagatcgcaccattgcactccagcctgggcaatagagcaaaaacaccatctcaaaataaataaataaatagaatgaactgtattggccgggtacagtgactcatgcctataatcccagcactttgggaggctgaggctggaggatcgtttgaggccaggagttcgagaccagcctaggcaacatagtgagaccctatctcttttttttaaaaaaaaaaaaaaaaaaaaaaaagaatgaactatacagtgtggcccaaggccccctgctaaataaagacactcttcaggcaggacatttcaaaggcttagagatcacctcccaggagcaagtcaatgggccagtcctttcatcggaatgtgcagggtttggacaacactagcctactgagctagtccttactgcttagcaccccagcttctatgacacctactggattcccttcctgagggtttcaaagactcctggagatgtctctgaatttggctgtcacagttgttacttgtaccccagatgccactcagttccctgaagacaatgatcccccagatttctcagccaggagcccctccacctcttgtcctcagtgggtgccaggcctcatcctggagttccacagctgagccaggctctcggggttacggaaggtcaagagggtgtggggacaacaatggaagagtgataacagtggcagccctttgagcagatgcgggtctcaggagaacataacgcgctttcttttcatagttcagctcactttctaagcacactgagcttcctttccagcaggctaaggggctgcaaagggggtacagattaacctcattcttcagattctcaaaaatggtgtcaccattcattgctggagactgggagaaagggggcaagtccatctcattctctctgtctctgtctctctctctctcttccctgtccatctgtttctctctcccacccacccctctgttctctctgcccagaagaatctctattttggttttggttttgtttgttttgtattgttttgagacggagtctcgttctgtcgcccaggctggagtgcagtggcgcagtctcaactcaccactgcagcctccacctcccaggttcaagcgattctcatgcctcagcctcccgagtagttgggattacaggcgcacgccaccacgcccagctaatttttgcatttttactagagactggtttcaccatgttgaccaggctggaccctatcctctttcaagccccccaccccaggcattgagggcagagccaactacctgcctgaaccaattagcatattaaacgtaaacccagttagcatatccaaatagcagcccacagtgacattctgactgtcagaatgtggattgcttgagcccaggagctcaaggcttcggtgaacaaagattgtgccacagcctgggcaacagagtaagtccctgtcgatcgatagatagatgatagatagatagatagatagatagatagatagatagatagatagatagataaatttttaaaaaaaataataggccaggcacagtggctcatgcctgtaatcccagcactttgggaggccgaggcaggcagatcacctgaggtcaggagttcgagaccagcctggccaacatggtgaaaccctgtctctacaaaaatataaaaatagccaggcagatgtctgtaatcccagctactcaggaggctgaggtaggagaatcgcttgaactctgaaggtggaggttgcagtgagccgagatcatgccattgcactccagcctgagtgacagagcgagactccatctcaaaaataataacaataataaaaataataataaatgctctggccccaaagtggcacattacatggtgcacaccccattagcaaggactcatcacatggccctgccaaccacaggaggaacccccccatgtactcaggtaggagggccaggaaacaccgtcagagagctttaatgactcaccccatgactggggtgagggacgagggactggctgcaggccaagggcatgtccgtggcagtggagacttgggaaaggggaaaagacctcctctgagccacgcacagtggctttcatctgtaattccagcactttgggaggctgaggtgggaggatcttgagcccaggaggtcgagactgcagtgagctatgtttgtgccacggcactctagcctgggcgacagagcaaaaccctgtctcaaaaatcaaaataaaaccaaaaccaaaacttcctctgttggggatgctccagggcgtcccagccttgaacagatgggtcactgcagtaataatcctatggcagacactgtcccaaggctgcacgcacgttactttgatcatcaaacaaccaggtgatagccaggcatggtggtgcgtgcctgtagtcccagctactcaggaagctgaagcgggagaatctcttgaacctgggaggcggaggtaacagtgagtcgagatcacatgactgcacttcagcctgggaacagagagagactctgtcaaaaaaaaaaaaaaaacaggccagacgcggtggctcacgcatgtaatcgccagcactttgggaggctgaggagggtggatcacctgaggtcaggagtttgagaccagcctggccaacatggtgaaaccccgtctctactaaaaatacaaaattagttgggcgtggtggtgcacacctgtaatcccagctactcgggaggctgaggcaggagaatcgcttgaacccaggaggcagaggttgcagtgagctgagattgcaccattgcactccagcctgggcaacaagagtgaaactccatctcaaaaaaaaaacaaaaaaaaaacaaccagccaggcgcggtggcttacgcctgtaatcccagcactttgggaggccgaggcgtgtggatcacccgaggttaggagttcgagaccagcttgaccaacatggtgaaactccgtctctactaaaaatacaaaaaattagccaggcatggtggtgcatgtctgtaatcccagctactcgggaagctgagacaggagaattgcttgaacccaggagtcggaggttgcagtgagccaagctcgtgccactgcactccagcctgggcaacagagcaagactctgtctaaaaaaaaaaaaaaaacacacacacacacacacaacaaccaggtgaggcaagtactcttgctatcatctccatttcacagatggagaaactgagttactaagtggtagagtaacctaagtcatgcagccgataactgggagacaagattgggacccaggtcgcccagctgttctccatgccgggctgtctcctgcacagctgctccatggtcctggccccaccgaaaaccagagcccacaaggtcattccagcagcactgcccagggcctcctctgggccaggccgttggggaactggagaccccatggggaccagaaagattggggtctcgttctcgggagcctatggctttgcagctgacccagagtccagctgacacccaggcaggcagtcagggtctgtctacacccccattgcaggaggagccgacaaacagcagatggacgctgagctgcggaaggagatgatggcgatttggcccaatctgtcccagaagacgctagacctgctggtcacacctcacaagtgtaagagctgagcccagccctgggatccaatccaccaggacagatggagggggagggaaaggggaggcctggggagagtgttggcctgggctggtatacacagggacccaggacaagggccccaaagaggcctgcccttggtgagctcaccgtgtgtgtgcccccagccacggacctcaccgtggggaagatctacgcagccatgatgatcatggagtactaccggcagagcaaggccaagaagctgcaggccatgcgcgaggagcaggtgcgctgttcgccgctctggggacatctgggctggggacagtggcttgcatgtcaccacgggaaccaactggaatatgagggtggctgagccccagggcaggtccctgaaaagtaggggctgtgcacagcagctcacacctgcaatctcagtgctttgagaggccagggcagagggatcgtttgagaccaggatgagaccaccctgggcaacacagtgagactccatctctacaaaataaaacattagccaggcatggtggtgcacacctgtagtcccagctatttaggaggccaagatgggaggatcacttgaggccaggagtgggagaccagtctgggcaacatagaaagacccatatctctacaaaaaaaaaataaaattagctgcatgtggcgccatgcacctgtggtcccagctacttgggaggctgaggcaggagaatcacttgaacctgggaggtggaggttgcagcaagccaagatcaagccactgcactccagcccgggtgataagagcaggactctatctcaaaaaaaaaaaaaaaaaaaaaaaaaaaagttcttgccaaggacacatcatgtggattcattcttcattcagctgctccaccaacacttattgagtattactgtgtgcagggcgctgttctcagtcctcggggatgcacccatggggaaaataggccagaatccctgccctcagggagcagacattccaagtggggaaatgccaatggtagcaaatgactgaatcgtgcaacatccagcaaagagaaagaaagtgtcgtgggggaaagtggagaagaatccagaagataggagtatccaggggaggaggggatgcggtgggaaatgggtagttggggagcctccctgagaaagtgacatgtgagcaaaggcttgaaggaaaaggggagagggagtgagctaagcaatacctggaagggtgttccaggcagaggaaacagccagtgcaaaggctctgaggctggaccgtgcctgggttgtttgggtaacagcaaagaggccagtgtggtggaaaagagcagggaggagacaagggcaaggaggtgacagggcagatccttcagggccatgggagctgcaggaaggactctggctttttccccaagcaagtgggagccatggagggttctaagcaaaggagggataggacctgactcaagtgctcatgggcgccctctggtggctcttgtggaacagtggggttgaaggtaggagcgggagacctgggagaaggtgcctgcagtgagagatgaggacgtgggaccaggctggggctatgacttgggtggaggagtgagaagtggtccagttctgcgtggaattggaagggtctagatggatgagacctgagagagtgtgtgtgtgtgtgtgtgtgtatactggggatgtcgcaatgccttctgggtaccaccgtcccaccaccccacccttgtccacacactgctctctgccccattccccaggaccggacacccctcatgttccagcgcatggagcccccgtccccaacgcaggaagggggacctggccagaacgccctcccctccacccagctggacccaggaggagccctgtgagtgtcacccctgccagggaggtggagtgtgggggtgccgtggtccccacgttctggaagctgcccaagcgcccactgctaccccggcctctgtcccccatgcaggatggctcacgaaagcggcctcaaggagagcccgtcctgggtgacccagcgtgcccaggagatgttccagaagacgggcacatggagtccggaacaaggcccccctaccgacatgcccaacagccagcctaactctcaggtgcctctgtcccccaactccccaatggctcccagggcccgggtggttcaggtggaagggatctgggccccccacacacacacacctgcagctccctccctctgcagacaccagggatctggaggtcaggccccagagctcatctggctttgccatctgctccgcagtccgtggagatgcgagagatgggcagagatggctactccgacagcgagcactacctccccatggaaggccagggccgggctgcctccatgccccgcctccctgcagagaaccaggtgagggctttcaccactgccctggggctggacccctcactctgcactgggtagggccaggcccccccacaagcagcccagtgcatcccctccctgccggactcaggcctgggtagggactccttcagtctctgaagcagtctgcaggccccacccaccacctggtcacacctggagcacctgcagaccctcctccctcacagaggacagagaggaaagtgctccccctggggcagagggcagtggccactgcaaaatggtctctggctgccctggttggaggctgcagacaggggaggttgtggaagatttgtgggtgcagcagggttcaacagggccagctgagacctgccacgaagatcacccctacacaaacacacacacacatgctcaacatacatgcacacacatgtgcagctgtgcgcctactcagatgcttgcatacacacacgtgtgtgcacgtgggcatatacacactgcacatgtactcacacatgcacacatgtacgtgcacacgtgtctgcatatgggaacttggcaggtcctaggatacagtagcagagtctggggtgggtctgggggcagctgggctcgtattttctgtctggtctctgtgggagtcattggggggcacaggggtgtgtgcttgatgtgtgtctgtgtgtggccgcttcacccagctgccaggcccacctgcaggtgatcccgttgccttggactcatgggacagagggcccagaggcatagctggctgcccacccggcctgaacagcgggggcccatgcacgcagcccgcctctggaggagaacagggcatggctgtgagagcctggcccgggtgcgtggcatgtgtggctgtggcgagctttccgtgtgccgtgtgtggcgtctgcacggggcaggaggctgtgctgtgcctggctggaccagggtcacctgagggcctggcctctggctgctgggaacgtgggttggggagcacccagcgtgcatgctgctgctccctcaggaccgagctgctgggccccaggagagggttgggacaagcccagctgacggccaccacatggaagctttgagcatcggccggagccaggggttggggtgtgcatcgcatgaggcagagcccagggccaggggctcgaggctgcgccgtcctgtctttcggtcccatgcctctgccatttgtctgtctgcatctcctgtctgtctcctctgtacccatgggaatagaggacgcccagccccgggggcctgggacacccacccgccaggactttaacttttcttttcctccctgccttctccctccgatttctcttgatgccagtgccactcccctccttggcttcttctccatgcaccacctcctcactctccctcttgccttttatatttattttcttctttctgttttttctgtgtgcaccatcccatggggctgtgacagaggagaaggggccggccacgtgggaataacctcagtgtatgtaccgcgcctgcccagcgcccagcagggctccggccccctcttcctccccaccccccctccagggagtcccgtcatctctcaccgtccccggaccccaccctttctttggcaatcgcaccctctcccctccatggagcccaatccttgtgtgtggtgtcctgtgtgtgcccctcacccataagccctggtgggcggggccatccccatcctcacccctacccccttttcttcagggccccccacgccggaggacactggctctccaagagcctggcccactctgcacctctttctggggggcttcttctcctgacaccaccaccaacccctggtcctgcagctcctacctggagcagggccaccagcgctcagctgggctggaccctgggaggcgggcgtctgccccatctccctccttccctcctctgcctgctgcagagaaacctgtgtgtcagggcttgacccagggatgaagcaccagggaaaagagtgggcccccagagcctccagtgcctgggtatcccccacccccacccagagctccctagcttgggcctcaccagaaggactcagacttgtgggggcagcgagcacagccccgttagccgggaggacccaaagctgccatgccgggcacctggtcctgagcccataggtcagccagccacagtcggaggcttctcaccctcccaggagagcaagctggggcagggatgagtgcggcagtccagggctcccaggtttgcaccctggatgtggagagggcttccctctggccagcctgagcctgcccaactgtggctgggcccccaggactggagagtgaggatcagatctttctggtcagaacccaggatgggctcaaaaggagcagtcctgtctctgagggacagaggaatcctcaggctccaccctcagaggcctggccacacccagagccctgattgatcagggggagccaaggccccatggcatcccctggcccctgccccaggatggtcacaccgcagtcaccgaaggccaccaccaggctgccacaatggggcaggaaggaccgggaccacttggtgctagctgctgaccccagcccaccggcctgtcccctcccccagaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggtgggcagccctgtggtgctcagggacaagcagaacagaggagaggagaggggaggagaaggcagggcggaggagacactaaggaagaagaaagggagaggcctccatggagaggggacagagggggccaggcagcagctgcaggaacctgggtactaccccctccccccaacccactgacctgcctcggttcaggggatctctagggcccccacaccttccaggtggcctcctgtgtgtgcatctgccccacctctccctcacgaccacctgtgtgtctgtctgaccctcacccggcccaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcaggtgggtgcggctgcaagtgaccccaggctgggctcggccgggaggcggggaggagagaaggggataccccatccaacagccactctaggcaaaggtccccggatcccggctgtgaccacctcccatcctgcccccaagccaccggggtgcccggcggccggagcggacacggatccccaccacaccagctgcctatgctgtccccccagcccccttgcccacccgccgccccctccccgccgcccgcagctgcttgctcctcggttgtggatcatatttgagttctgggccgtgccgcccgacctttcactttcctttaacccggcttctgtttttgtttcaattatgatttctgtcctctggacgcctgtgagtaatttttgaaacttctgctatttttaaccccgaaacttacaaaactccatttctcatttctcttttcactttgttgtgttggttttcgactcctcccctccctgtctcactccccctcctcccctccctcctccctgtggctgttgcttttttccattcaatgtcctgtgtcccccctctcctcctcctcctcctcctccccctccccctcctccctctcctcccggcccctctcccttcgctcccctctcttcctcccaatcccgtgtctcctttgattttgttgtatctttttttttgatttcctttgtttcaattttcgtgtagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaatcaaa

SEQ ID NO: 6289 - DNA, 61792 bp, Homo sapiens
tccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgccgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggtaggtaccatgggggggaacacggactcagggggacaggcagggcgctgggtggggggtcgcttcccctcggggtggccggtggccgctgctgacagacgggcgcgcatgcgtggggtggtgcggcgcgcagcggcagttggcgcgggcagggtggcacttccggtcgcgcgtgcccgggctgtttggcgccaaaatggaccgtggattcccccgtagctccctggtggctagaaactaggcggggtgggggttctcttttgatccccaaatacagcaagctttgggttcgtttccggggtccccttcttcaagcagcggtgggccgggctcttgactccagcttggtcgcacaggaagtgggcagcccgcggccaacggacacccctcgggcaccggcacttcggcctccacttccggtgtccggcccggtccccgggggcgcttctgtggtggggggtccctcagtgcctttcccccaaagctgtgcatctcgatggcggcctccagagacggatgtcacccgtcggggcctgggctgggctggctcatgttcgagagcccagccttccgtggggtactcattctgtcagttgggactgtgtggttcttgctccttgggaaagtccatgttttggcaggaactttaaccgtgcattgcagcgcagggcccgggaagcgtgaaggctgcatggttggtcttttcctgtaaatctgtgcctgtgagccgtgggcatcagggaagtcttgctaatgagaactggctacactttcgtgtgtgtttgtgtgtgttcatgggtgtgttctttagtgtgtgtctaatgttggaggccctggctttagcagttcatgcctctgtccaacttccgtgcacaaggatcagtgggagcactggtcccagccccttgttcatgaacgccatcagttcattcctgaaaacttgttcaagtgaggtgtgcgtgagtcagaggaaccctcaccaggcgtggacacttccagctggatttgtgaaagcactctttgccatttttctatttccttaggcttgttaactgacctggttgggccagtccggttctgatttgggtctttggggagggatggatatttggttcaacccccgctttttttcttttctttttttttttttttttgaaggctgggtgctgtggcttatgcctgtaatcccagcaatttgggaggcagtggcggacgaatctcttgagccaggagtttgagaccagcctgggcaacaaggcaaaaccccatgtctactaaaaatacaaaaattagcctggagtagtgccgtgcgcctgtggtcccaactactcaacagactaaggtgggagtatcacttgagccccagaggttgaggctgtgtgtagcgagctgagatcgcgctattgcactccagcctgggtgacagagtgagaccctgtctcaaaaaaagaaacactttttatttttagagatgggtctcactctgttgtccaggctggagtgccctggcacaattataactcactgtagccttgaactcctgggcttaagggatcctcagcctcctgagtagctgggaccacaggcgcccaccaccatgcccagatgactttcttagtttttgtttctgtatacgtgaggtttcaccatattgcccaggctggtcttaaacccctgccctcaagcagtcctcctgcctttgtgtcccaaaggttaggattacaagtatgagccatcatgccttaactactacttttttttgtttgtttgtttgagatggagtctcattctttcacccaggctggaatgcggtggcgtgatctcggctcactgcaacctccactttcagggttcaagtgattctcctgcctcagcctccgaagtagctgggattacaggtgcacaccaccacgcctggctaatttttgtgttttcagtggagtcggggtttctccatgttggtcaggctggtctcgaactcctgacctcgtgatccacctgcctcagcctcccaaagtgctgggattatagtcaaaccacttcttaaccagttagtgggtatatatcttcttgaatcatctgtgccagtattctcccaaaataaaacttgatttaaaatggaatggaagtgaaattatgaaagtgcctggcttcatgatgttacacccaattcagagaagtttgggcccggccttccttttttattccttttttttattttgtagagatggggtcttgccatgttgctcaggctggtcttcgattcctggcctcaagcgatcctcctgcctcagcttcccaaagtgttgggattacgggtgtgagccaccatgcccagcctgcccagccttcttgaaaacatgacctccactggctcaatgaccttaaacaagcgtatgccacctctatatccatagtctaggaataatgacatgggttttcagctggtattgggttaaatgagaatatgcatggcacataaaggttcacatgctagtggctaacttagcttgtttttttcagtttttttttaagagacaggatctcactgtgtcacccaggctggaatgcagtggcacagtcatggcttactgcagccttgaacccctgagctcaagcaatcctcctgccttagcctcctgagtggctggcacatgccaccatgcccaagttaatccttaaaaaattttttagaaggctgggcgcggtggctcacgtctgtaatcccagcactttgggaggctgagatgggcagatcacctgaggtcaggagtttgagaccagcctggccaacgtggcgaaaccccatctctactaaaaatacaaaaaaattagccaggtatggtggcaggtgcctgtaatcgcagctactcgggaggctgaggcaggataatcgcttgaacccaggagccgagattgcaccgttgcactccagcctgggcaacaggagcgaaactctgtctcagaaaaaaaaaaaatttttttttttagagatgagggtcttgctttgttgcccaggctggtcttgaactcctggactgaagcaatcctctgcgttggcctcccaaagggctgagattacaggcgtgagccacagggcccggccattattcctcaagagttcttaaaagtggatgctgcaggagttaactgccaggaagcaggaattcctgctaaggtctgctgcttgccaaagcctttcccttcaacaggggttgccagtaggccactggctcaggggctctgttggccctgtgcaaatattttgtttggctgaattggaataccattaggtgagccttacaatccaccactgaccctgggttccacatttctttacactcagattgcttcactgtaggcattggagttttggaggactgcttttgaccatgtggtagacattgaaattgtagtttatatgactcactccacagacttttttttttttttttacattttgaaaatatttcattaaatgaaaaataaacatggtatccaacagtacttgaaacttagatttttttttttttttaattgaggcagggtcttgctctgtggcccaggctagagtgcaatggtgtgatctcagctcactgcagcctccgcttcccgggtttaagcaattctcctgtctcagcttcccaagtagctgggattacaggtgtgcaccaccacgcccagctaatttttctttttccccctcgaggctgagccttgctctgtcgcccaggctggagtgcagtggccgtgatctcggctcactgcaacctccacctcccgagttcaagcaattctcctacttcagtgtcccaagtagctgggattacaggcgcccgccaccaagcccaggtaatttttgtatttttattagagactgggttttgccatgttgaccaggctggtttcaaactcttgatctcaagtgatccacttatcttagcctcccaaaatgctgggattacaggtatgatggtgtccagccggttcattgtttttattttattttattttattttattttattttattttattttattttattttatttttgagacagagtcttgtgctgtcgcccaggctggagtgcagtggtgcgaacttggctcactgcaacctccccctcccgggttcaagtgattctcctgccttagcctcctgagtagctgggattacaggcatgtgccaccacgcccggctaactttttcttatttttagtagaaaccggggtttaccgtgttggccaggctggtgttgaactcctggactcaagtgattcgcctgcctcagccccgcaaagtgttgggattacaggcatgagccaccgtgcctggccttttaattcattcttaagcctgctctcagacagctaggcttgcttctccacaataaagagtgttgaattttgtcggtgtatcccgcatggtgccattataacactgaaattagtgattatttcagggtctgttaccagagcgtgtctgccgtattcactgtatctgcagcttggagcacagtagactcaaatgcttgcatgccagctcttcccctgtacagcctggattaacactgatgctagcagactcctttgcacaactgattagctttcgtaactaccacagctttcttactgctagtcattctgtgatgggattaagctaggtcttgaactccttaactccagttccttggctactactgagtacatactgaataaggcaaaattgacttacctcttttgttttgctcccctgtggtagaattctaggggtacagactgctgggtttcaaatgccgccctacttgccagccgtatggctaagttattgaacttcttggtgccttggtgtttcatctataaaaagggggtggggctgcctgctcgacaggggtgttaggaagactgagcttatcagtacagatatgttgagagcagcacctgtccaaagcccttcatcactggttattacgtggtactgtgtgtacagtggggatgctgtgggtttggttccagaccactgcagtaaagtgaatctagcaagaaagtgagtcacacacacattttggtttcctagtatgtgtaaaagttattagactaggccgtgtgcagtggctcatgcctgtaatcccagcagtttgggaggccaaggcaggaggatcgcttgagccaaggagttcaagactagtctgggcaacataggaagaccccccccatctcaaaaaaaaaaataaagccaaaagtggtggcatgcacctggggtcccagctactcgggaggcagaggtgggaggatcacttgaacccatgaggtcgaggctgcagtttgccatgattgtgccactgcactccagcctgggtgaaggagtgagactctgtctcaaaaaaaaaaaaaaatcagctgggcgtggtggctcacgcctgtaatcccagcactttgggaggccaaggtgggcagatcacgaggtcaggagatcgagaccatcctggctaacacggtgaaaccccgtctctactaaaaatacaaaaaaaattagccaggcatggtggcacacgcctatagtcccagctccatgggaggctgaggcaggaaaattgcttgaacttgggaggcggaggttgcagtgagccgagatcatgccactgaactccagcctgggcaacagagcgagactccgtctcaaaaaaaaaaaaaaaatcatctgagtcttcagcgattcataatctttttgcaggtggagggtcttgcctcaaacttgccggcttaaaggacatacatttattaccttatgcaggtcagaaatctgatgtgggtttcaccggatgaaaatcaaggtgtaagcaggctgcattcctttctgggggctccaggggagaatctgtttcctattttggggtgttggcagaaggtggtagttgtaagactcaggtcccattttcttcactggttctaaactgagggtcgttgcccgcttctggaggcggtctcatccctcggctcatgcccccttcctctacctttaaagtcagcatttgcgggttgcatctctctctgacccgtcctccaacgttgcccgctctctgcagctagaaaggttctgtgttcttaagggctgaagtgattagattgggcccaccccagataatccaggataatctccccatctcaaggtctgtattcttagttacatctgcaaaatcgctttggccacgtaaagtaatatattcacaggttccagggattagggcatgaacatttttcggtgggtccactctttttgagatggagtctcgctctgtcacccaggctggagtgcagtggcatgatctcggctcactgcaacttctgcttcctgggttcaaatgattcttgtgcctcagcctcttgagtagctgggattacaggcgtgagccaccaagcccggttaatttttgtatttttagtagagatggggttttgccatgtttcccaggctggtcttgaactcctgagctcaggtgatctacccgcttcagcctcccaaagtgctgggattacaggcatgagccactgtgcccagtgggtctactcttttgcctactgcggatgccttcttgggcagccctgctccagctgccatgcagccggcctgaagaagctggtttgacagagacttgtaacttgtcttgcatggtccactatattttatttttagagacaaggtcttgctgtgtcacccaggctggaatgcagcggcacaattatagctcactgggctctagtgatcctcctgcctcagtctcctgagtagctaggaccacaggtgcatgctgccacaccaagctaattactattttttgtttaggcagggtctctgctgtgttgcccaggctggtcttgaattcctgagctctattgatcctcccgctttggcttcccgagtagctaggcctataggcacatgctagcacacccagctaattactaattactattttttgtagagacagggtctcgctgtgttgctcaggctggtcttgaattcctgggctctagtgatcctcccgcctcagcctcctgagtagctaagactataggtgcatgccaccacacccagctaattactattttttgtagagacaggttctcgctgtgttgcccaggctggtctcaaattcctgggctctagtgatccttccgcctcggcctcctgagcagctaggagtacaggtgcgtgctgtcatacccagctaattactgttttctcgtagagacagggtctcactgtattgcccaggctggtcacaaattcctgagctctagtgatcctcccgcctctgcctcccgagtagctaagactataggtgcatgctaccacagccagctaattattctttcttgtagagacagggtctcgctctgttgcccaggctagtctcgaattcctgggctcaagtgatcttcctgtcctggcttcccgagtgtagagattacaggcatgagccactgcgcccagccatggtctgctgtatttcagacgagcatttctggcgtagaggtgttagagtaatctaacattttataatttcttcctatccaatctatactagatacctctgctgggttagttttcttaacacggctctgatgtcattggttctacttccccttgactgctttggtgtttgttaactatggaacaagatggataagtgtgatgcttttgccctccctccgactgtccccagccacctctctggaggtgcctttccctccctgtatgtggccagtctcacgtttgtttcttgtgtgtttccagaaccagccacttctcaatggtgcccctgtttgagcagcttcctgtgcccggttcacacagagctgtcaacttcttcctgaggctgttataccctttctcttgggaatcccgcaggcgtgagctgtatttgccttattcctctgtggttgtttatatatatctttttttttttttttttttttgagacggagtttcactcttgttgtccaggctggagtgcaatgacgtgaccttggctcaccgcagcctccacctcccgggttcaagcgattctcctgcctcagcctcctgagtagctgggattataggcatgtgccaccatgcctggctgattctggatttttagtaaagacgaagtttcttcatgttggtcaggctggtctcgaactcctgacctcaggtgatccgcccgcctcggcctcccaaagtgctgggattacaggcatgagccaccgtgcctggccagctgtttatatatatcttatctcccctctgcagagggttcatctctgagggaagcactaggaaggaatcatagggtctcaggctgggcactaagccggcattctgagtcctctgctccgtccttcacggctgtctgcgaccctcctggcttcagcaggtgtgatcggtgtcatcacagttttaccagggaagggatgtcgctaaagttaccctcccgccagctcctcactgcctgcctgggatcccacctgccactctggggccaggcaggttaaatccagtttctactggatgaaacattctaggggttttgaaggtttctctattctctttgccaggctaaatatcccagttcatatgaggggttgaaagaaagcagacccattctgcaaggacaccttggtctccgcaatcagttgaaccttgtccttcacaccccaggcaacctcgggatcaggggactggctggcttggtcgaggtagaagccatgtccttccagttttctcagcggcgtgactgagaagtcaagtgtaacgctattaccacagcgtgtgtgcctctggctggaagtaccagtttctgtagccctcctgacttaaggctctccttggaccccagttgctacaagggtagaatgacttttgcctggaagaggttccttgtgctcctggaaatcctgatgtcaaagcatctttttttttttttttttttcttttgagacagggtcttgttctgttgcccaggctgaacaggctggattgcagtggtaccatcataactcactgcagcctcaacctcccaggctcaagcgatcctcccacctcagcctcccaagtagctggtaccacaggtgcacactaaccacacccagctaatttttacattttttttgtagagatgggatctctcagtgtagcccaggctggtctcaaactcctgacctcaagtgatcctcctgccttggcctcccaaggtgctgggattacaggcatgagccactgcgtcttgcctggccttgtagcaccttgagtccaagtgatacagtatatataatatacagtctatattaccactgtgtttgtagggtgctaagtgtctcttctacagagcagtcttttttttttttttttgagacagagttttgctctgttgcccaggctggagtgcagtggcatgatcttggctcactgcaagcttcacctcccgggttcacgccattcttctgcctcagcctcctgagtagctgggactacaggcgcccaccaccacgcctggctaattttttgtatttttagtagaggcggggtttcactgtgttagccaggatggtctccatctcctgacctcatgatccgcccacctcagccttccaaagtgctgggattacaggcgtgagccaccgtgcccggccctacagaatggtctttcctaaccacacagcaagtcaggaagtccctgcctagtgacacctacatctaatcacttagctctttgcctggagcagggcctggcattcagcaggtgctcatatgtgagcggcgctggtggggaatcagggcccgcatgacccagagcagctgttgtaagacatgggtccagcaaagcattcctcatgctgctgcctgcacttaccctctaggaaggccagcctggaggagccacttctgcccttcaggcaaatgataactgagcacctgtctgtgcgggtgctaggtggaaaggtccagagatggcagtggcctggtccctgcctggggcaccttctctccaccaacagacacttacccagctggttaggcctgttctcaccccgcagtctgtagttagcacccaggctgggaacaacagcctgtgttcctctccctttccttggtaccttctcttcttgttcctttatttttttctgaagagataggatcgccctatgttgtccaggctggactcgaactcctgcccacaagccatcctcccaccacagcctcctgagtagctggggttacaggcacgcagcaccgcggcactgcaccggctattgttcttttatttttttccctctttgtccctgaaagagtcaagctactaattgtcagtaatcaaatcagaccacgatttcccaggcaaactcctggcagttctacatttaggaatgactagctagagacatcctgaagaatgagttattcggggaggcgccagccacctcctctaacttcacctctatctgccctctgtgtgggtaccccttgcttccctggatgcttgactcccccatttcatcctcaaaatgccaccaccccccaccaggcctttaggaacatcagctggctgttccccacagtgtcctgtggccctgggctactcattctgacactggccatactgtggcacaccttgttatgggctgttgtcagacccaactggagaaagaccagctgtaggtcatttcccttacgggagtgccccaactatatgacctgccccctctttcctggtatctttttgagtcagggtctcactctgtctcctagattggagtgcagtgatgcaatcacggctcactgtggcctcgacctcccaggctcaggtgatcttccttcctcagcctcccaagtaactgggaccacaagcacatgccaccaaacccagttatttttattttattttattttattttattttgagacagagtttcactcttgttgcccaggctagagtgcaatggtgtgaccagctcactgcaacctctgcctcccgggttcaagtgattctcctgcctcagcctcccaagttgctgggattacagccacccaccaccacgcctggctaatttttgtatttttagtagagatggggtttcgccatgttggccaggctggtctcaaacccttgacctcaggtaatccacccaccttggccctcaggtaatccacccaactgctgctgtatgttgggattccaggcatcagccaccacgcccagccactaatttttgtatttttgtagagatggagtttcgccatgtttcccaggctggtctgaacgcctgggctcaagtgatccgctcgccttggcctcccaaagtgctgggattataagcgtgagccaccatgcctggtctctggtaccttttaaaatatacaggctgggcatgatggctcatgcctgtaatcccagcactttgggaggctgaggcaggtggatcgcctgaggtcgggagttcgaaaccagcctgaccaacacggagaaaccctgtctctgctaaaaatataaaattagctgggtgtggtggtgcatgcctgtaatcccagctactcgggaggctgagccaggagaatcgcttgaacctgggagtcggaggttgagctgagatcacaccattgcactccagcctgggcaacaagagcaaaaccctatctcaaaaaaaaaaaatatatatatatatacacacgtatatatacgtgtatatatatatacacacacatatgtatacatatatacgtatgtatacacatatatacgtatatatacacatatatatgtatatatacacacatatacgtgtatatatatacgtgtatatatatatgcatgccagacatggtgactcatgcctgtaatcctagcacttcaggagactgaggcaggcggatcacttgaggtcaggaatctaagaccagcttaaccaacatggtgaaaccctgtctctactcaaaatacaaaaaattaacgaggctggtggcacctataatcccagctacttgggaggctgaggtgagagaatcacttgaacccagaaggtgagggttgcagtgagctgagatcgcaccactgcactccagcctgggcaacagagcgagactccatgtctgtctgtctgtctatctatctgtataatgtatatgtatgtatgtatatatgtgtgtgtatatatatacacatatatacatacatatatacacacatactctgttacagagctgctgtgtgtgtgtgtatatatatatacacatatgtatatatacacatatacacatatatatgtatatatatacacacatatatatacacatatatatgtatatatatacacacatatatatacacatatatatgtatatatatacacacatatatatacacatatatatgtatatatatacacatatatatgtatatatatacacacacacacacatacacataattgtgttacagagctgctatgtaatctcacaatcatcagaaaaatgacccccaaaaggggaaccttgttcagatcagatgacttcttagcattaggcattccagtaggacactctagactcttgcggggagacaaaagccagcttagttttttctaacactcatatgttaaacttgtttgtgtccaaaacttctttagaactgtgatattcttacaggcaaatgaagttgcttaacaagtgtttgtattttctcccctatttcttcctcccaggctcaaagatttggaaagagacagcttaacagaaaaggtaatctccaccttaaaatttttcttattaccaaatctgactgacacactttgtggctcataaaaagaaatttgttttctttaaatggattttgcattttttcccatggagtttcaaagataatttggatattcttgttaaatgtcagcactaatttgctgctaatagttgggtggtggtggtgtttttttttgttgttgtttttgttttttgagacagagtctcactctgtcacccaggctagagtgcaatggcatgatctcggctcactgtgacctctgcctcccggattcaagctgttctcctgcctcagcctcccaagtagctgggactacaggcacgcaccaccatgcccagctaatttttatattattagtagagatggggtttcaccatgttggccagactggtcttgaacgcctgctcgtgatctgcccaccttggcctcccaaagtgctggaattacaggcgtgagccaccatgcctggcccaggttttttttttttttaaccaatctcagttcctaaacaatctactctggattgtaacttgtcctggtaacactgttttattgtgtttttgttattgttttgagatagggtctcattctgtagcccaggctggagtgcagtggcacaattttggctcactgcaaccttcgcctcccaggctcaagtgattttcccactcagcctcctgagtagctctaactacaggctcaagccaccatgcccagctaatttttaaatattttttgtaaagatgggattttgtcatgttgccccaggctggtcttgaactctggggctcaaagcaatccacttgcctcggcctcccaaagtgctgggattataggtgtgagccactgtgcctggccgacactttacagaagcacagtattattcttataaaccatgatatgtctccatctcacctccagctttcccatttttcaccactttggagacaggagtgaagtgatcctaatggaaattccctgaacacatttcatgactgtttagtgttttgactgagacagcattgcctgccattcactcattgtgatgtgatcaggcagctcaataatttgtgtattagtccactagtgaatagcttgggaatgtgggtactgctaaacctatatccttcccttaggaatgtgtgaaggagaaattgaatctcttgcacgaatttctgcaaacagaaataaagaatcagttatgtgacttggaaaccaaattacgtaaagaagaattatccgaggtaagtcagttctcagcatcctagcctctagaaaaatgtctcctcctagtaacttgtctgtgaccagggaggcagcaagatccccagctgtcctcattgcctgatgatgatgatgatgatgatgatgatgaaggaaacacatgtgtttccttgttctctgacacttgtttacattcactgctacttaaattatcctttcctgctgtaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcgtaagagcagatgattccttttatttttaattgtttttgagatggagtctcactgtgttgcccagtctggagcacagtggtgtaacctcggctcactgtaacctctgcctcccaggttcaagagaccctcctgcctcagcctcccaagtaactgggattagaggtatgtgccaccacacccagctaatttttgtatttagtagagatggggtcttaccatgttggccaggctggtccagaactcctgacctcaagtaatccacctgccttggcctcccaaagtgctgggattacaggcataagccaccacgcctggccctgcttaactctctttctttctttcttttttttttttttttaatgacagagtcttgctctatcgcccaggatagagtgcaatggcgcgatctcggctcactgcaacctccgcctcccagtttcaagcgattctcctgcctcagcctcccaagtagctagtattacaggcgggcaccaccatgcccagctaatctttgtatttttagtagagatggggtttcaccatgttggccagactggtctggaactcctgacctcaagtggtcctcccgccttagcttcccaaagtgctgggattacaggtgtgagccaccgtgcccggccccacttggctcattttcaacctagaagcaggctttggtagcatataagggggcagttaaacttggaccccaggtcagtgtgtccaggttcctttcttttgtacgcatcctcactagtaattactggacacttcctaactagcttagatgtgtacgtctttaaattttgtcttagctgggggtgtggtggctcatgcctgtaatccctgcactttgggtggccaaggtggctggatcacctgaggtcaggagttcgagaccaccctgcccaacatggcaaaaccctgtctctactgaaaatacaaaaaatttgccagacgtggtggcgggtgtctgtaattccagcctgggcaacaagagtaagacactgtctcaaaaaaaaaaaaatgttgttttcgaccaagttgcagcattagatcccaaaacatggctatgagtgtgacaggttgcagatgacaagtgctacaaatacttactccttctaagaccttatatgcctggttaaacatttattctcagactcttgcccagttttaggcaaaggaactctaatggaaattttttttttttttttttttttttgagatggagtcttgttgtctcccaggctgaagtgcagtggcgcaatctcggctcactgcaagctctgcctcccaggttcatgccattcttttgcctcagcctcccgagtagctgggactacaggcgcccgccaccatgcccggctaattttttttgtattttttagtagagacgggatttcaccatattagccaggatgatttcgatctcctgacctcatgatccgcccgcctcggcctcccaaagtgctgggattacaggcgtgagccaccgcgcccagcctcttctggaattttttaaaaaacaaacaataggatagtacttgagctcaggtctggttctcagctacttcatttttattttgttttattttattattatttttgagagagaatctcgctctgttgcccagtggcacgatctcggctcactgcaagctccacctcccaggttcatgccattctcctgcctcagcctcccaagtagctgggactacaggcgcacaccacgcctggataattttttgtatttttagtaggatggggtttcactgtgttagccaggatggtctcaatatcccgacctcgtgatccacctgcctcggcctcccaaagtgttgggattacaggcgtgagccaccatgcccagccttattttattttcttttaatttttattttattttttgagatggaggcatgcgccaccacgcccagttaatttttgtatttttagtagagacagggtttcaccatgttggccaaggtggtctcgaactcctgacctcaggtgatccacctgccttggcctcccaaagtgctgagattacaggtgtaagccacctcacctggccctttattttatttttttttgagatggagtcttactctgttgccaggctggagtgcagtggcacaatctcggctcaccacaacctccacctcctgggttcaagtgatttttttgcctcagcctcctgaggagctgggactacaggcacgtgccaccacgcccagctaatttttgtatttttaatagagacggggtttcaccatgttggccaggatggtctcgatctcttgaccttgtgatctgcccgtcttgcctcccaaagtgctgggattacaggcatgagccactgcacctggcctatttcttttttttctttctttcttttcttttttttttttttttaagagacagggtcttgctctgtcgccaaggctgtgtacagtggcgcgatcttggctcacggcaacccccatctcctgggttcaagtgattcttgtgcctcagcctcttgaatagctgggattataggtgtgtaccaccacgcccagctaatttttttgtatttttagtagagatgggggtttgccatgttgtccaggctgttctcgaatacctgagcttggattattttcccacctcagcctctcaaagttttggtattatagatgtgagccactgtgcctggcccacttcatcttttgatattttaacaagaggctctgtttcctggccttctttagcatttggcccctcaaataactgacatgatatggctcaacaaactggcaggtgctaactgccaacattagcaagctggttgttgactagaataaaaatgcaaagatgcttagtccttagaacctggcttcctgcaatagcttagtaatgttgaactgcattattgctgtgggctttctattgatagtggcttttttttttctttttaatgctttttcttctttaaacagctgaaccttcacctagccccaggattacaaggaaaagcaccaggcaaaccaccatcacatctcattttgcaaaggggtcagtatacgataaattggcggctgccttttttaggggccggctgttttgggatggaattggtagggcgtcacgtggcaattctgtcttccgtgttgtataggttttcatcttgcggttctgttctctagacatttatgaatagcatttctgaaaacgttacctgtttttactcatataggaaagttcaaatgtacacaaaatcatgagttttgtataatgaaccctgaaatacccatcatctagtgccaacagttatcaagttacagccgttgtttcatctatacccccatattgtgtgtccctgccccacctggattactttgtccatatatagtttagtatatttctagacaatgagatctcttttgacaactttttaaaaaattactcatattttacaataattgctaacatttagcagtcttttttttttgagacagcatctggctgtcacccaggctggagtgcagtggcacgatctcggctcactgcaacctctgcctcccgggttcaagtgattctcctgcctcagcctcctgagtatctgggattacaggcgcgcgccgccacgcctggctaatttttgtatttttagtagaggtggggtttcactatgttggccagactggtctcaaactcctgacctcaggtgatctgcccacttcaacctcccaaagtgctggggttacaggcgtgagccaccgtgcccagccaaaacagtctttttaacaaaccaaagtataatactgttctgatgtctttataaaaatgtaagaattccctgctatcagatatatagttggtatttacgtttttccctttgtggtgaacaagccgtgtggcaaacagacagcgtttggttgacttgttccttaaagttatagattccttccctcctattttacttaaaattcctcacagattttaaattccttcatctcttatcttcttgccatttacttgaagaaattcatttgtccaatagttcctagattgggccgattgcatccttgtggtgttccacaggtccccttgccttctgttccctataaactgataggattacaggactgatcagattccagctttttattttttgagactgacttttttttttttttgatacggagtcttgctctgtagcccaggctggagtgcagtggcatgatttcggctcactgcaacctccacctcccaggttcaagcgattctcctgcctcagcctcctgagtagctgggattacaagtgcccgccacaacccctggctaatgtttgtatttttggtagagacagggttttaccacgttggccaggctggtctgaaactcctgaactcaggtgatcctcatgccttggactcccaaagtgctgggattataggcgtgagccactgcacctggtctgaggctgactttatggatggtgctgtgtccctccatcagaaaggtgtgtgaggtctcttctctgacactagcagctgttgatcggtgtttagacccgtgatttcttaggacttacaagatggcaagacaacattctaaacccgtcattcagagaaacattaaacttgaagcctctttcaacatcctggtgaatgagggtccacttcaggccagctggaggcctagggtcttgttccactaatggttggcctcactgtgtgtgacagccctgccaaacggaaacctcaggaagagtctgaaagagccaaatcggatgagtccatcaaggaagaagacaaagaccaggtagggccagtgctttcatttcctgactctaccttaacttggtgtatttgatgattgtgacttcatatgtgttctgtccaagtaaataaaaaccctgtctagggctctatttagggctctccagagagacaggaccaatagaatgtatatgtgtgtatacagctataggtacatatatacatatgcacgtgtatgtatatatatataattcgtttgatttttttcttgtttttatgggtacatagttggaatatatatttatggggagagactttattttgagaaattggctcacaagattgtgaaagccagcaaatttgaaatctgcagggcaggctggaggtccaggggagaaatgatgtcatagctcaagtggcaaggcagtcttacatacatacatgttatatatatgtgtgtgtgtgtgtgtgtgtgtgtgtgtgtgtgtgtgtgtgtgtatgtatgtatgtatttagacttctttttttgagacttttttttttttttgagacagggttttgctcttgtggcacaatcttggttcattgcaacctcagcctcccgggttcaagtgattctcctgcttcagcctcccgagtagctgggactacaggcgcgtgccaccacgcccggctaatttttgtattttagtagggatggggtttcaccatgttgcccaggctggtctcccatgttgcccaggctggtctcgaactccttgagcttaggcaatctgcccgcctcagcctcccaaagtgccaggattataggtgtgagccaccgtgcccagccaatttgttttttttgttgttgttgttgttgtttttaattttttttagatggagtctcactctttcactcaggatggagtgcagtggcacgatctcagctcactgcaacctccgcctcctgggttcaagtgactctccatcctcagcttcctgagtagctgagactacaaggcatgtgccatcatacccagctaatttttatatttttagtagagatgggatttcactgtgttggccaggctggtcttgaactcctgacctcaagtgatccacccgcttcagcctcccaaagtgttgggattacagttctgtcttttttcttttcttttcttttctttgagacaggtctcattctgtcaccaggctggggtgcagtggcgcagtcatggctcactgcagcctcaacctcctgggcttaagcgatcctcccacctcaccctcccaagcagctgggactacaggcgcatgccaatgagctaagttttgtattttttgtagagatgaggtttcccatgttgcccagactggtctctaacaaataaattaaacaaattcctgacacaagatggagaatctttgattcttttacatagtatcaccaggcgatctctagtgatgggcagtgtgcctgcctacttctcggacctgcttttgttttggggttggtggggattaataccagagtaagagtttctcagatcttctccccaaaacccaggccccttcttttcccactcttgctctaaccatgtcaaatgtgttaatatttcaactcacacttttggtgttgaccttcccttgaaaccagtattctaatcttttttgttcttccttccctccacacaggatgagaagagacgtagagttacatccagagaacggtaagaatagttactatacctttctttttgttctacgagttgtgtaatcttgatcacaaaactttttcagaaagtttaaggccgggcacggtgactcatgcctgtaatctcagcactttgggaggccaagatgggcgaatcacttgaggtcaggagttcaagaccagcctgaccaacatggcgaaaccccgtctctactaaaaattcaaaacttagctgggcgtggtggaatgtgcctttaatcccagctactcaggaggctgagtcagaaggattgcttgaacccaggaggtagaggctgcagtgatctgagatcattccactgcactccagcctgagtgacagagcaagactccatctcaaaaaaaaaaaaaaaagtttaaaaagaagaactttatcgtgtgtttccatggcaaccatatcgttatgaagtatctgaatttggggtcagatcattagcgtttagattcaagtagaattctcctgttttcttggaaggaatgaatcgagggcagctggcattcgaaccaggtgtaaaagtcatatcaaatactaaatgttaaatgagtatgtgtctgtcagggctcctgagataatgaagattgcttttgggggaaagaggagctttatgaaaactgcttctttggggaagctcctggcactcacacttggggtctgtgttattttgcttgacagagttgctagaccgcttcctgcagaagaacctgaaagagcaaaatcaggaacgcgcactgaaaaggaagaagaaagagatgaaaaagtaaagctctatcacctctaagtttgttaattctcccttaatcctatatggtcccaatttccttccaggacgtggggacagggggtggggaacgtggaagaacaagatgggttttgctagtgatcgaaatgcctttgactttggctaaacacctttcaaacttgttttctcgtggtctctacatgaaaggtgggttatgagattgtgatagtgaggacccttgctacttatttgtgatattttattttattttatttatttatttatttttgagacagtctcccactctgtcacccaggctggaatgagtacagaggtgcgatctcggctcgttgcaacctctgcctcccaggttcaagtgattctcatgtcccagcctcttgagtcactgggactacaggcgcccgccgccatactcggctaattttagtggagatggggtttcactgtgttggccaggctgatcttgaactcctgacctcgagtgatccacctgcctcagccaccaaagtgctaggattacaggcatgagccaccacaccggccaacctatgccacttaatcaactagtcacagagcttcagtttgtcacctcgccttcttgcttctctggctgatgagatctttgtgaagatctaattttcagacgtacgaggtgctaaaactttttttttttttttttttgagatggagtcttgctctgttgcccaggctggaatgcagtggtgtgatcttgtctcaccgcaacctctgcctcccgggttcttgtgcctcagcctcctgagtagctgggattacaggtgcctgccaccacagccagataattttgtatttttagtaaagatggggtttctccatgttgatcaggctggtcttgaactcccaatctcaggtgatccacctgccttggcctcccaaagtgctgggattataggcgtgagccaccacacccggcctaaaatacttttcaaacttatttttttgtagttctctacatggaaggtgggttatgaggttgtcatagcgaggatctttgctacttatttgtggtatttatttaatttaatttaattttttttttttgagacagtctcccgctctatcacccaggctggagtgcagaggtgcgatcttggctcattgcaacctccgcctcccaggttcaagtaattctcatgtcccagcctcccaactagctggggctacaggcgcctgccaccacacctggctaatttttgtgtttttatttatttatttatttatttatttatttatttatttatttgagacggagtctcgctctgtcgcccaggctgaagtgcagtggcttgatctccgctcactgcaagctccacctcctgggttcacaccattctcctgcctcagcctcccgagtagctgggaccacaggcgcctgccaccatgcccggctaattttttgtatttttagtagagaaggggtttcaccacgttagccaggatggtcttgatctcctgacctcgtgatcctcccatctcggcctcccaaagtgctgggattacaggcgtgaaccaccgcgcctagccaatttttgtgtttttagtagagacggggtttcaccatgttggccaggctggtctcaaactgctgacctcgaacggtccacctgcctcagccatcaaagtgctgggattacaggcacgagccaccacaccggccaacctatgctacttaaatcaactagtcagtttcagtctgtcacctcagccaccttctctggctgacgagatcttggtgaagatctaattttcagatgtaggaggtgctaaaattctttagcatcatccagacataaagttgtattctcctctctgaagtcagaccagctctttccccagtccctcatcttctttgtaaaatctgagtctaaggttctatgcaatacagatgctgggtcctgtttttttttctgtttgttttgttttttaataagatgactgagggccgggtgtggtggctcatgcctgtaattctagcattttgggaggccgaggtgggtggatcgcttgagctcaggagttcagggccagcctgggcaatgtagtgagaccccgtctctgcaaaaaatacaaaaatcagctggatgtggtggagcttacaacaggcagtgtgcctgtagttccagcttctcaggaggctgaggcaggaagatcacttgagctcaggaggctgaggatacagtgagccatgattgtcccactgcaatccagcctggatgataaagtgagactggtcttaaaacaaacaaacaaacaaacaaaacaaacaaacaaaaaaaaaccaagatgactagaagtttcttaccaacttaggtaggtgacgagtgccttacttgggagcttagtaaaggatggctgtccattggggaatcaactaaaatgtacagtaattttttttgttttttgagacggagttttgttctacttgcccaggctgcagtgcagtggtgtgatctcggctcactgcaacctctgtctcctgcgttcaaacaaattctcctgccttagcctcccgagtagctgggattacaggcttccgctaccacgcccagctaattaactttttgtacttttagtagagacaggggttcaccatgttggctaggctggtctcgaactcctgaccccaggtgatccacccgcctcggcctcccaaagtgctgggattacaggcgtgagccactgcatccggccgctgtacaataatttttgaaccattcagtacttgaggttggtctttcttgctttttttctttttttttaattgagatggaattttgctctttcgctcaggctggagtgaagtggcgcaattttagctcactacaacctccaccccctgggttccagcgattctcctgcctcagcctctccagtagctgggattataggcgcccgccaccccgtccgcctaatttttgtatttttagtagagacagggttttgccgtgttggccaggttggtctggaactcctgacctcaggtgatccacccacctcagcctcccaaagtccaggattacaggggtgaaacaccacgcccggccgaggctggtctttcattgatcacctttcctaccctgatcctagttaaattagacagcagttgcagtcagtgcatacctcgaatttgtttcagaacaagcagtcctaacgggctagttcaaccaccaccttccaaagaaggaacctggggcaagatcgaaatccctcacctgtaagcatactctcaggatttcttcttgtagtaggaagatttgctaagcgttttttttatttttatttgagacggagtctcactctgtcgcccaggctggagtgcagtggtgcgatctccgctcacttcaagctccgcttcccaggttcacgccattctcctgcctcagcctcccgagtaactgggactacaggcacctgctaccacgccaggctaatttttttttgtatttttagtagagacggggttatttatttatttacttatttattttttgagacggaatctcgctcttgtcgcccaggctggagtgcagtggcacgatctcggttcactgcaagctctgcctcccaagttcacgccattctcctgcctccacctccccagtagctgggactgcaggcgcccgccaacacgcccggctaatttttttttttttttttttttgtatttttagtagagacggggtttcactgtgttagccaggatggtctcgatctcctgacctcgtgatctgcccatctcggcctcccaaagtgctgggattacagtagtgagccactgtgcccagctgcaaagtgtttcttaatattcctgacctttgcgatctcttcacagactaccacatgtggagtttctgagggttggatttgacttgcctgattctctggcaagatgtgtctggttctttaaatgcagcctcaggctgggcatggtggctcacgcctgtaatgccagcactttgggagaccaaggcagacggatcacttgaattcaagaccagtctggccaacgtgatgaaaccctgtctctactaaaaatacaaaaattagctggtcatggtggtgtgtgcctgtaaactcagctacttgggaggctgaagcaggagaattgtttgaacctgggagttggaggttacagtgagccaagagtacaccactgcactccagcctgggtaacagagtgagactccgtctcataaataaataaatgaataaatgcagtctcagaggatgtgttgttgtgtctcagttggagctacttttcagattgggccatcctatttcattcctttaatatcggaagtagagatttataataaagttactttctgtgaggctatcaacacttaactgatgacaagtagtagaggaattttgaagtaaaaatactgaaactgcagtgttgtagtatctcctttctaagagtttcatttcctgtctacttaccccactgaagaagaaaagaaaattgctgtcttgaacacctggcacaagtgatcctctcacctcagccttccaaagttctgagattacaggcatgagctactgtgcccactggtagacagtctttactcccaccagtggactctagaatcagttcaggtgttttatttccataggacactttaatagaaagatccaaaccaaatggaaaaaattaacttgtcttttttccctgcaacttaggaagaaaagagactccgaagtcaaaccaaagaaccgtaagtgcagcgaacctgcctttgtgctttgttgtgaaactgaattgctaacataagtatcttggtaaaataacgggttggtgtggaacagtgggcactaatcatatgtctcttatgtgggcaagttctgcttgtgaaaggtgagaccaccctgaagtgaaggctgaagttaacttttttaactttaatttaatttaatttaattttgagacggagtcttgctgtgtcacccaggctggagtacagtggtgcaatcctggctcactgcaacccccacctcccgggctcaagcaattctcctgtctcagcctcccgagtagctgggagtatgggcctgtaccaccatgcccaactaattttcgtatttttagtagagacagggtttcaccatattggtcaggctggtcttgaactcctgacctccgtgacccacctgcctcgcctcccaaagtgctgggattacggggtgaagttagcttcgatttctcctcccaaccccagggcccttctcagggttggtcacacagctgtgtgtcatgtggtagtgaaaggccatcaggtgagcagctgtgtcacttacctttcactgtgaaaatgctgtgtgacaaatggctccaaggccagaggcctagaacagtgagcatttttcaagctcacttgtctacagcttggtggctgtcggctgatcttgaggtggcttagtggggatggctgggctgacccagctctgcctccgcaatttggccaggctgggtacacgcttgtggctgtgccagaccacaagggcagaaatgaaaagtagcactttttcaaacctctgttgaaaaaagttgggccaggtgcagtagctcgcgcctataatctcagcactttgagaggctgaggcgggtggatcacttgaggtcaggagttcaagatcagcctggccaacatggtgaaaccccgtctctaataaaaatacaaaaaattagctgggtgtggtggtgcatgcctgtggtcccagctacttgggagactgaggcaggagaatcacttgaacccgggaggcggtggttgcagtgagctgagatcacatcactgcactccagggtaggtgatagagcgagactctgcctcaagaaaaaaaaaaaggaaaaaagaaaaagaaaacaattagctgaagcaaattttgagactgagcctgaatccagaggtgggcagaataccccacctgagcggcagggccctggcagagtgggaggtgaagactcggacccctgtgtgcagtcagctgtccacggtcactgactgacgctgatcgcacatcagcccagctctcaacctaggcaggccagacatgggtcttcctccaccgcaggctggattcccatcaggccacggaaatcatgacatccctttgtctgctttttgtattaaaccactggcatctctgaccaacattcagatggggtattgatggtgttcctgaagaccttgagtcctggagtagtaaatgccctctgggcttcctgcagtgaagacaggagaggcagcctgtcctctgaacctggggaggagcttgtgtcagcccttaggagctgttggccccggtgcagggccccccccgagctgaccagcctgtgtgtgtgttgtcttctgtgacagaacacccaaacagaaactgaaggaggagccggacagagaagccagggcaggcgtgcaggctgacgaggacgaagatggagacgagaaagtaaaggcgggttatttgtttctgaactccccctcattcttctgctcctgtttgcttgggcgggagtgcgcagggtggggctctgggttcaagtccagccccatccacccaggctccatggggccatccagactctgggaaggtcaccttttcctccttttgggggccgggatttgtggctggatgcctgtgctggatgcctagtgaacactcagttgtcctctgtctttcacactagagagggtctgtgtgagcctgggctgagatgtgcatgaagcatcctctcctgaggcctcactgctgagaagccttgacacacagtcagctctgacgcacatgtcagccacacctttgattctttcccagcctcctacgttctgagtctagctctccccctgccagcctccccagtctagtttagccaagtgcatgcgtttaaaccctaaagcatcatgtggaacactgctgggcctctgtcaaagtacaggatggccaggttgcctgcaggccctcctgcatgaactctagggaagggagctaggtcatcggtggggggcggcgggtccctatctaagagatgccgaagaccccaagagggtctctgggtttctgcctgttacaatctagagagtggagcccaaggtcacgggcttgctgggtgacaagcaccctcacttctgacccggtcgccagtgggcttccatccccaccccatagcaggggagcctttggtattgcctccagcctcccatccctcacctcttctgtccaaatgttggtcaccttactgtcagcactccttcagactggagtagtcacattactccctgccctctattggaaactggcaggggcctgagctcacactgccagcacttttgcctcatggtagaaagggatgtgagggctgggcatggtggctcactactgtaatcccagcactttgggaggctgaggtgggtggatcacttgaggtcaggagtctgagaccagccaggccaacatggtgaaatccggtgtcacctaaaaatataaaaattagccgggcatggtggcatgtgcctctaatcccagctacttgggaggctgaggtaggagaatcacttgaacccaggaggcagaggttgcagtgagccaagattatgccgctgcactccagcctgggcaacagagcgagactctgtctcaaaaaaataatatggtaataataataaaagcagtgcccagagaacaaggattgttggctgttccaccccagggggccccttgcacaggaggtgccatctctgcctcccaaagctctaagagccactgtcccccatcccaagagacagggtcttgctttgtcacccaggctggaatgcagtggtgcaatcacggttcactgtagcctcgacctcccaggctcaggtgatcttcccgcctcagcctcccaagtagctgggactataggcaggcaccaccatgtccagctaatttttttttttaattttttgtagagatagggttttgccatgttgcccaggctggtctcagtcaaactcctagactcgagttatccacctatctcagtcccccaaagtggcggagtggtaggattacaggcatgaaccgttgcattcagtctgtttggtttgttcttttttttttttttttttttttttttttttttttttttttttttaagatagtctctctctgtcatgcaatggtgtgatctcgagtcactgcaacctccacctcccaggttcaagtgattctcctgtctcagcctcctgagtagctgggattacaggcgtgtgctactatgcctagctaatttttatatttttagtagagacagggattcaccatgttggccaggctggtctctaactcctgatctcaaacaatccacctgcctcagcctcccaaggtgctgggattatgtgtgtgaggcaccacgcccggcgtgtttgtttgtttgtttgtttgtttgtttttgagacaggatcttgctctgtttcccaggctagagtgcaggagtgcagtggtgctatcatagctcactgcagtctcctgggttcaagtgatcctcccacctcagcctcccaagtagctggcactacaggcatgcaccaccatggatgtctactttttaaacttattttttgtaagccaggcgcggtgtctcacgcctataatcccagcattttgggacactgaggtgggcggatcacctgaagtcaggagtttgaaatcagcctgaccaacatggtgaaaccccagctctactaaaaatacagaattagctgggtgtggtggcgaatgcctgtaatcccagctactagagaggccgaggcaggagaatcgtttgaacctgagaggcagaggtgagccaagatcataccattgcactccagcctgggcaacaagagtgaatcaatctctctctctctctccatatatatgtatatattaaccatatatatatgctgctttttgtattaaaccactggcatctctgaccaacattcagatggggtattgatggtgttcctgaagaccttgagtcctggagtagtaaatgccctctgggcttcctgcagtgaagacaggagaggcagcctgtcctctgaacctggggaggagcttgtgtcagcccttaggagctgttggccccggtgcagggccccccgagctgaccagcctgtgtcatatatatatatagtatattttgcagagatggggtctcagcatgttgcccaggctggcctcgaactcctggcatcaagcaatcctcctgccttagcttcccaaagtgctgggtttacaggcacatgccactgcacacagcctgtaaataaagttttattggaacagagccacactttctcatttacattttgcctgtgggtgcttttgtgctaccatagcagagatgatcatcctgacacagaccacgtggtcagcaaagctgaaaatactgatcctctggctcttacaaaaacagtttgccaagccctggtctaggaggttctttagtgccctcttgttagtttcaggtggggaattaagtgagggaaagtgaagcctcgtgtctacccggtagatctgcccaggcctgcctgtcttccagctccacagtgctgggatccctaacctgtaacttcagtgtttgcattttatctcactctggctcagaaactaattttttcccttctttatctctctacctcccccttatttttctgtcaggatgagaagaagcacagaagtcaacccaaagatctgtaagtgtttaaaatgcttgtgcttttgtgtcatctggatcagtagaaagcctgttctaggccaggtgtggtggcttgcacctgtaatcccagcactttgggaggctgaggtgggtgaatcacctgaggtcaggagttcgagaccagcctagcctggccaacatggtggaaccctgtctgtactaaaaatacaaaaattagctgggtgtggtggcgggtgcctataatcccagctactcggaaggctgaggcagaactgctagaagccaggaggtggaggttgcagtgagccaagattgcgccactgcactccagcctggacaagagtgaaactctgtctcaaaaaaaaaaaaaaaaaaaagcctgttctagaaacctgtggtgatgtagatgtgtggggaccctggggcctctgaaggcctcgtctcgggatgacaagctggcagtgtgcctatagagctcccatgggtatcttgctttcccatggggaggcattagtttgtcactttccgtgcgagttggcgatgtggttagtgtttctaagctgctacttgctgtgtatctgttcaccctgcagagctgccaaacggaggcccgaagaaaaagaacctgaaaaagtaaatccacagatttctgatgaaaaagacgaggatgaaaaggtaaaggtctcacttttctttctttcttttttttttttttttttttccccaagacggggtttcgccatgttgcccaggctggtcttaggaaaaagaagactgggcgtggtggcgcacgcctgtaatcccagcactttgagaggctgaagcgggtgaatcacatgaggtcaggagttcaagaccagcctgaccaatatggtgaaaccctgtctctactaaaaatacaaaaattatctgggcatggtggtgcacgcccgtagtcccagctactcgagaggctgagataggagaatcgcttgagcctgggaggtggaggttgcagtgagccgagatcgcactccaggctggggacacagcaaaattagctgggcgtggtggcatatgcctgtagtcccagctgcttggaagcctgaggcatgagaattgcttgaacccaggaggcggagattgctgtgagctgagatcgtgccactgtactcctgcctggacaacagagcaagactctgtctcaaaaaaaaaaaaaaatgctgggcacagcggctcacgcctgtcttttcagcactttgggaggccaaggcaggcgcatcacctgaggtcaggagtttgaaaccagcctggacaacatggtgaaaccctgtctctactaaaaatacaaaaattagccagttgtggtgataggggcctgtaatcccagctgcttgggaagctgaggcaggagagtcacttgaacccaggaggtagaggttgcagtgagccgagatcacaccattgcactccaggctggggacacagcaagactctgtctcaaaaccaacaacaaaaaatacaaggacattggtcttattggatggggccccacctttattacctcatttaaccataattgtctcttaaagactctacatccaaatacagtcacatagcaggttagtcttaacatatgaattttgcaggggacatgactcggtctgtataccccctcatcaattgtttgcttacctttacattttagtatttatttttgagacagggtctcactcttgtcgaggctggagtgcagtggtacagtcatagctaccatagccgcaaactcctgggctgaagcaatcctcccacctgggccttcaaggtagctgggactacaggcagatggcactacacccagttaactttctatttttgtagagacagggttttactgtgttgcccaggctggtcttgagctcctgtgctcaagcagtcctcccacctgggcttcttcaagtgctggaattacaggcatgggccactgtgcctggccagttatttatttatttatttatttatttatttatttatttatttacttatgtatttgttttttgagacagagtctcgctctgccgccaggctggagtacagtggtgcgacatcggctcactgcaacctctgtctccctggttcaagctattctcctgcctcagcctcctgagtagctgggactacaggcatgcgccaccgcgcccaactaatttttgtatttttagtagagacagggtttcaccatcttggcgaggatggtctcaatctcttgatctcgtgatccatccgcctcggtctcccaaagtgctgggattacaggcgtgagccatcgcgcccggccctgtgcctggccaattatttgtttaccttgaggtgtccacttacacaggaaagctaaggttttaaaaaattggcttttcctctaaatcttttcaggaagtctttggttatgagatttatttattcatttattttgagatggagtctcactcactctgtcgcccaggctggaatgcagtggcatgatctctgcttactgcaacctctacgtctcgggttcaagcaattcttctgcctcagccttctgagtatctgagattacaagtgcccgcctggctaatctttgtatttttggtagagacgtgatttcgccatgttggccaggctggtctggaactcctgacctccagtcatctgtgtgccttggcctcccaaagtgctgggattacaggcatgagccactgtgctgggcctgactataagattttgtattctatgactttagatggtagagtgagtcagagctcacctgctggccctctcactgcctccctccccttctctctgttttatgataatcacttatacaaagttcttaacaccgaagcactatctgggtgtaaaacactctcttagcctttaatcctcttttgttttccctgtgtaggaggagaagagacgcaaaacgacccccaaagaaccgtaagaatttattcttgacattatcgaaagcagatggtaatgttaaaatgatggttctagaacaaaagggaaggggtttcagtaattgccagagcaaccttaggctcattttggatcgggttggtgaacataggaccaaggtgcgtcaggcaggatgcccctgcggtgaagagccactgtgaccacgcgcctgggcctcactgccacagccggtgcctccctgtgccacaggcacctcaggcagaaacctcacaggggcgattttgatattttctgaaacaattaaacaaacgatcttgtgatttttttttttcccccagaacggagaaaaaaatggctcgcgccaaaacagtcatgaactccaaggtaaacatctgccgggaataaagccggtggcggcgctcacgaggcggctgggagctgctctctgagtgccatcatctgtgttcctgctcccacagacccaccctcccaagtgcattcagtgcgggcagtacctggacgaccctgacctcaaatatgggcagcacccaccagacgcggtacgtacagctctcttcccagccttcctctgcctgtcccttgtcccactgctcaccagccccgtgtccttcaggtggatgagccacagatgctgacaaatgagaagctgtccatctttgatgccaacgagtctggctttgagagttatgaggcgcttccccagcacaaactgacctgcttcaggtaagtgcactttcgtgtgcatgtttgcttcgtggaaggaggcacatccccagaggtgcctgcgggctcacgattctggtgatgttttttagtgcctgacctgcaacatgtcttaagctaacacttcgtggataagagccaccgtggagggctgggcgcggtggctcatgcctgtaatcctagcactttgggaggccgaggtgagcagatcacttcaggtcaggagttcgagaccagcctggccaacatggcgaaacctaccgaaaatacaaaaagtagccaggtgtggtggtacgcgactgtaatcccaactactcgagaggcttaggcaggagaatttcttgaactctggaggcggaggctgcagtgagccgaggtggtgccactgcattccagcctgggcgacagagcaagactccgtctcaaagagccacgtggaaagctgatgaagggacaatagagctttgctgatttttggtttggtttttgggtttttacactacacatattacccctccattctgcccacatcctgagggtcacacgctcagatgaaggcctactctgtgctaggtaccagtgatctaggtgtcgtggatgtagctgctcaggtcctgccttcacggagccagaaatgggtgatacctgtcgggtagtgacagccacgacagattttaaaagcctggtgacatgcagagagaataagtgggaggaggaagttctgtgaagacgggagaggtaatgattttcagtaaagaccttgatggcctgtgagagaagaggccgaggggatggccggggtggggcaccctaggtagaaggggacaccattaccagggctcggaggggcctgtgccagctgtggaaggtgaatggtgagtctggtgtggtggttgctgggttggggctgggccacacagggccttgcaggcctcagcactgactctcctgtcctctgagggaaggtgcctggcgtccggcccgtaccttcaccgaggctcacgtcagctcttgagtgggcagaggccctgtgctctcaggcatccccagccccattttgctccctctccctgcgggtgcagttaccctccagggcttcaccttgttcttcgtgggaaatgcctcagctccaggaacggccctgcctccttttaggcctgggtggtattttccctctctgtgaagaggagggggaagtgccttggggacccctgttggaagcacccccaggcagcggttcctgtacccactgggagggcacccacacgttccccgtgcttggctgatggttgttcccctccctctccttctatgggatccttctatctagatcaagatgctgttgcgtccaccagcaaccgctagccccccgaggcctggcccaaagcagggccacacacctctgcctgctggtgtgagtgaggtgtgctgtggtgggcagagctggcaaccatgcccgagggcctcactctggccttcaccagggacaaaggcttgggggagcctggggctggggctgccagagtcctgagtgtctcagcttcctccctaagttgagatctatcatagattcgttcctggagggtggatggtggcctggaggacactttccagaagtcacatgccttctgtccactggagctggactgcctgagttatttaggggctctccatactgctgtacttggcttgaaactggcgatagaagccagtcatgggtggggtctggcctaccaaccagtgggtcctgcccctgcctggggcttagagcttctctcccatgtctcccctatggagagagcctccagcccacctgtgcagcggggagcgggaccccctcttctgtaggccctcccttgatccacgctggcttcatctctctgtctcttcttctgggccttacatcctgaggcagggctgcaacctattctgtctgccatgcctggtacgcagtaggggagctccgcaggaggtatgcagtgttttgtttgagcctttctggcttccaaggcactaagctgggtgagtgtggtggagggtgctctccagagacctgtgcagacttcatatgggggctctgaggatagcccagcatctttggccgggaaagggtggtccttgtctagatgagcaggtttgtaagcagaacacccagttcatgtctttttccttgagtttgacatcttgcctctctgtcttcactaaagaacgtgctcccgaatgtcaaggggcatctggacagtggggccgcaggtgtttgagatttatgcccaaaaggaggcagaagtccttccttcccacatcccttttcacactgttctataacctgctttattttctaaattgaggtctaactcgtataatataaaattaaccatatgaggtatcttgaataggtgaattcataggtatagaaagcagattggtggttgccgggggctgggggctgagggccggttgggaggagactggagagtgactgctacttgatgggaatgaggctttattaacatttgagtgacagaaatgttctgcagctgaatagagctagtggctgcactgcatagtagaaggtgttctagaaaccggtatttcccgcactgtaagtctgactgatcttttggtgttgctgttgcagacacacatacacttgatgcttaggtgggagaataaggtagaaactctgggtgatagaacgctgtcttaatccagtgttcccgcaaccaaaaaatgagtgtcggggccaggcatggtggttcagcctgtaatcccagcactttgggaggctgaggtgggtagatcactggagataaagagtttgagaccagcctgctacacatagtgaaaccccgtccctactaaaaatacaacaattagccgggcatggtggttcaggcctgtaatcccagctactcgggaggctgaggcaggagaattacttgaacccgggaggtggaggctgcagtgagccaagattatgccatcgcgctccagcctgagggatagagcaagactctgtctcaaaaacaaacaaaaaaagagtgtcagacttgtacattctctcattgcctcgtgcctgatctgaagtctgcacgaagacccgccttcacggcttagctggtaagcatgtgctttgtttcctgtctagtgtgtactgtaagcacggtcacctgtgtcccatcgacaccggcctcatcgagaagaatatcgaactcttcttttctggttcagcaaaaccaatctatgatgatgacccatctcttgaaggtaaggaatagtccgggattatgtttggggcacactttaaaaacagccaggcagggtggctcacatctgtaatcctagcactttgggggtctgaggccagaggatcacttgagcccgggagtttgagacgagcctggacaacatagcaagagcctgcctctattaaaaaaaaatatatagcatatatatatagtatacatatatacttatatatatgtataaataaaaaacatacttatgaagcaatagtcagctggagttgctgctgcctcttaaagttagggtgtgagactttgtgccaggagcagctgtaggccaagtcattgtgatgactgaggagcacccgacctggctgatgggatgtctgctgagtgggcgcttagagcgcctcctgggtttgggatgtgagtcagagcctttagtccatttcctttttctgctctaggtggtgttaatggcaaaaatcttggccccataaatgaatggtggatcactggctttgatggaggtgaaaaggccctcatcggcttcagcacctgtaagtgtgtggcccatcataggctggccggggtctgaaaggggccttcatgttctccttcctgggggctgacggggctctggtgggaattctcagcaggcttgcagaaggccatgtgactgggaaccttagcaggttcagttggggtagcctcttgtgttagttatgactggctctggaactgactctccagttgtaagagcaggtcttggccggatatggtggctcacacctgtaatcccagcactttgggaggccgagttggggggatcatttgaggccaggaattcgagaccagcctagcctggccaacatggtgaaaccccctctctaccaaaaatacaaaaattagccacgcatggtggtgcatacctgtaatcccagctacttgggaggctatggcaggagaatcacgtgaacccagcagacagaggttgcagtgagccgagatcacgccactgccctccagcctgggtgacggagcaagactctgtcctcccctgaaaaaaaaaaaagagcaggtcttattcttgcaacccaaacccagactgaattccaaacaccagagatgagctcaatgaaggcctactcagctagtcttcgctctctggctggctcagacaggcttcttcagaacaagccagctatgatgtgttgtgccctatgtttctgacatttgggtacgggatgacttttagactgttgggtgagtttggtagactcctccatgccctgtggccactgtaggcgccatcagattccagccccttttccacacctcctctgttcaccccagcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgaggtaagagatcgagggtcctcagcatccgggattcccactggaaacttgccttcagaaccagcagacactgttcttcagttggatttaggccagtttggcttaagcatgagagaaacctgttctctttcaagaccacggttcctccttctggcctcaacttgaaccgcttcacagaggactccctcctgcgacacgcgcagtttgtggtggagcaggtggagagttatgacgaggccggggacagtgatgagcagcccatcttcctgacaccctgcatgcgggacctgatcaagctggctggggtcacgctgggacagaggtaaggatgcggcagggaccagagtgaagactggagaccggggagggtagagcatggcccacatcctctgtcccagtcctctgagatgctggaacctctcccgtaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtaacctcacctgtgggtgctcccgctcccctaaggtggcccagcctctggcctgatctgaggactgctccatctttctctctgtggcttgagactctggctgctcaaatgtgacccctgagacagaaattagttagtggtctgggaggaccctgcatacttcattgaacgtcaataggacagatgtccacagaggcatgcttgggtgctttgctgataatgccactgtccttaattgaagagcctggcttctgggtggctctgctgtgcctgcatctcacagtctgaaggcccctgttggactgctaaaggggtattcacatctaagtgggcactttgtccagcttagatttgaggccctcaggaggcgtccctttctgtgagtttttaaaatatatgtttacttcactcaggaggaactaacttcctagtcctatgacccaaagaccaggactattttgatacctattacctgactttcttttggataaagactggcttcagggctttgcttttgatccccgctggcatctcttaacaggagcctgcatgtcctcaccattgttattttggttttattttatttttcttggttaacacacgtgtgtccaatgttttataacttctaaaatcttttttttttttttttaatttttttgagacagtctctctctgtcacccaggctagagtgcagtggcaccatctcagctcaccgtaacctccgcctcccgggttcaatcagttctcccacctcagcctcccgagtggctgggattataggcacccgccaccatacccggctaattttttttgtatttttagtagagatggggtttcaccatgttggccaggctggtcttaaactcctgaccttaagtgatctacctacctcggcctcccaaagtgctgggattacaggtgtgagccactgtgcccagccctaaaatcatttgtttttatttgtgtaactgttacgtgttgatactggtagatctagttatttcattttaaatattctgtagtattttgttaaatgaatatcctaacttactcctcaatgataggcacctcttcagtattgtaaatatgtggcagcatccttgagcaaagcttctcgcgagtgtatctgcttagaagtagcgttgctgggttgtgggtgtgtattcttaactttgatctagaagattgctctccaaaatggttctaccaacttaccatttgagcagtgtgcgttcttctttcctcacaccacctatctggcttcttaacccatctggagaatgggaagggaattttatttctctcacttaccatatttctaatgaggttgaatattgctttttttttttttttttgtagagacagggtcctgctgtgttgccttgcctggtctcaaactcctggcttcaagtggtcctcctgtcttggcctcccaaactgccgggattagaggcatgaggcactgcacccagccaaataggcacatttttaaaagtcttggttttgttgttgttgttgttgttgttgttgttgagatgggtctcgttctgtcacccagtctggaatgcagtggcatgattgtagctcactgcattctcaacctactgggctcaagtgatcttcccaccttagcctcccaagtagctgggaccacaggtgcacgccaccatgcccagctaattaaaaaaaaacattttgtagatgggattttgccatgttgcctaggctggtcttgaatgcctgaactcaagcagtcctcccgccttagcatcctgagttgccgggactgcaggaatttgtcacacgcctggctaattttaattttttgtagagttgggggtcttaatatgttgcccaggctggtcttgaactcttggactcaagtgatccatctacctctgcttcagcctcccaatgtactggttcaggtatgagccaccatgcccagcctaaaagtcttaattcaccgtttgtttcattgttgctaagggctgtgtgactcactttttttttttttttttaattttttgagacctaaaagtcttaatgcatcatttgtctcattgttagtaagggctgtgtgatttgccctttttttttcctttttttttttttttttttttttttttttgagatggagttttactcttgtcgtccaggctggaatatggtggtgtgatcttggctaactgtaatctccacctcccaggttcaggcaattctcctgcctcagcctcccaagtagctgggattacaggcacaccctaccatgcctggctaatctttgtatttttagtagagatggggtttcaccacgttggccaggctggtctgcaattcctgaccttaagtgatctgcctgcctcggccttctgaaatactgggattacaggcatgaaccactgtgcccagccctgatttgcctttttaatgccattttttaggtgtgtcagcagcctgagtgtgggaaatgtaaagcctgcaaggacatggttaaatttggtggcagtggacggagcaagcaggcttgccaagagcggaggtaggtcaggccgagtcttcctcctgtggcagaggacttgccagctggtggcagatgcactgtggagaagggcctgcatgtgtgggacagcaccaggattccttcgttaggcattgtctcaggacctgtccctgttatgaagaaaacagccccggttggtcttacttagaaaaggggccttaggtataaccagtgacattgcaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaaggtaacccttggagccccttggtcagctcactgccatgttcccaataagcaggttgccctctagtatctcgccaacctgacctctcaggcagcctgagccccggcactaagaaacctgtctgtttgcccctgagaagagcgggactggccaagagaccatgttccatggctcagtaccagcaaggcatttttgtgtggccacaaggctcagttctcctaatgtcccaaaatgggcatttgacacagttctaggggcatcaggcaggtgagccctcatagcttgtttttctgttttgttttgtttaagatggaatcttgctctgtcacccaggctggagtgcagtggcacgatctcagctcgctgcaacctctgcctcccaggttcaagcgattctcctgccccaccctcctgaatagctgagattacaggcgtgcaccaccatgccaggctaactttttttgtatttttagtagagacggggtttcatcatgttgcccaggccattctcgaactccggcctcaagtgatccacccacctcagcctcccaaagtgctgggattacaggcaggagccactgtgcctggcccctcatagcttgtttccaagagagctgtcacagccccctctggtgtggggtgggtctttttggggcaccaacagatggcctcccatccgttctgtggtcattggcttcactgaaggtcagttcctttaccacagtgtgagagagaggagtgagtatcctctgtgttgcttctctgacgtccataaattaaagatgcaatcagttcacttaattatgaggcttgccacctgctggctgcctgggccgtggctgagcccctgcaggaggacagacatgggtactgctgcatggcatgagtgcctctgcagggtagggggctgggaggaggctggggccacgaggccttgcagaggtgacacctgggctgagatggagaaggtcaggtaggacctagccacacgacctgggggagagctgcactgaggtggcagtcagcttactttgttggagaaaaggaaggaggcccctgcagctggagtggcttgagccaggggatgatgggcaggacaggggtcagggttcaggctgtggccttacagaccatggtgaggtattgtgggctgtgctgttaaaatcaaatcctgggacccgagtggcagagcagaagtgggagggacatggatgcccttggccacagcatctggccaaggaaggtggatgttcttcttttttcttattattgaagcccttgtagaacaggatgttctctttagcagcaactcttcattgacttcttaatgaaatcgagtcatgtcttactttaagtaacagaggaccatgcaagtcaaggccagcaaagaccctcagaatgatcctccatgaacttatgctctcattttcagactgatgggaagaagagttactataagaaggtgtgcattgatgcggaaaccctggaagtgggggactgtgtctctgttattccagatgattcctcaaaaccgctgtatctagcaaggtttgcatctttctttttgcttgacttctgcatgcactttctcatcaagtaggagatgcctgttttgccaaaatagcaccagcagctttttgccctagatgaaaactgaaaaggacgagtgctcctgcatagacttggtcacatatctgctggccaagtcagaactttctccccatgcccgtcttctgattccagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggaggtgagtgcctggtgtccctcgtgagcccctgccttatcgtggagggtcactgctgacgtgcgttctgttttgttttgatttgtatttttttttaatttggttttttttttgtttttttttttgttttgagactgagtttcgctcttgttgcccaggctggagtgcaatggcatgatctcagctcactgcaacctccacctcctgggttcaagtgattctcctgcctcagcctcccgagtagttgggattacaggcacccaccatcacgtccagctaattttttgtatttttagtagagacggggtttcaccatgttggccaggctggtctcgaactcctgaccttaggtgatccacccgcctcggcctcccatagtgctgggaatacaggcatgagccactgcgcctggcctgacacgcattcttatctcccaagggaggcatggatcccgagtccctgctggagggggacgacgggaagacctacttctaccagctgtggtatgatcaagactacgcgagattcgagtcccctccaaaaacccagccaacagaggacaacaagttcaagtgagcactggggctggactcggggtcagcaggcactttcagcccacatcactcccttttcccgtgtgcttccgtctggttggcttccgccaacggccccccagtttgtgtctcttgctcgtcaaaggccagcctgactatgaatgatgctcaagtgtgtagatggcctggagttgctttaagtgtgtggatgacctggcgttgtctttgtaagagggttccctacccaggaacagggttcgtcttgccatttcaagacttcccgtgtgttcttcagtgtgtgcccagctcttgcatgtttttggctgtttcttagatattttctcctgtaaatgagacctcttatttgattcttttctttcctttttttttttctttttttttttttgagacggagtctcgctctgttgcccaggctggagtgcagtggtgcgatcttggcttactgcaaactcagcttcctgggttcatgccattctcctgcctcagcctcctgagttgctgggactacaggcgcctgccaccacacccggctagttttttgtatttttagtagagacgaggtttcactgtgttagccaggatggtctcgatctcctgaccttgtgatctgcccgccttggcctcccaaagtgctgggattacaggcgtgagccaccacacctgtcctcgattcttttgtaactgggtgactgctttgagggaagcttttattttttattttattttattattatttttttaattttttttttttttttttttttgagacagagtttcgcttttgttgcccaggctggagtgcagtggctcaatcttggcccaccgcaacctctacttcctgggttcaagcgattctcctgcctcagcctcctgagtagctgggattacaagcatgggccaccatgcccggctactttttttgtatttttagtagagatggggtttctccatgttggtcaggctggtctcgaactcccgacctcaggtgatctacccgcttcggcttcccaaagtgctgggattacaggtgtgagccaccgcgcccggcgagcttttattttttaatgtccaatgccccatgccttctttttaacctccgtacctcacttgtttcaactaaaagcagcagccagcacccccagaggagcaggtggcaaccagggaaacccaggaggccaagagggctccccgggggcatctgtgcttctcccataagtctcgtgctagctttggcttgatctctattttcattttattttttacttttttgtgatggagtttcactcttgtcacccaggctggagtgcagtggcacgatctcggctcactgcaacctccacctcctgggttcaagtgattctcctgcctcagcttcccaagtagctgggactacaggcgcctgccaccatgcccggctaatttttgtatttttagtagagacagggcttcaccgtgttggccaggctggtctggaactcctgaccttgggtcatctgctcccttcaggctcctaaagtgctgggattacaggcatgaactactgcacccaacctcatttacttatttatttatcacccaacctcttttatttatttatttatttatttatttatttatctgagacagggtctccctctgtcacccaggctggaatgcagtggtgtggtcacagctcactgtagcctcgacctgctgggctcaagtgatcttcctgcctcagcctcctgagtagctgggactgcaggcatgcaccaccctgcctggttaatgttttaaaaattttttgtagagacggggtctcactgtgttggccaggctagtctcaaacttctgggctcaagcgaccctcctgccttggcctcccaaagggctgggattacagacatgagccaccatgctgggccttgatctctatttttaaggccatcttcaagtctcctttaagggcttactagtcaagaataatgttgaatttcctcaaatacctgttgagcctttatggagagaacagtaggagtctctgctggattgagttcctcactgagccactcgggactgttgctcgtggtgtgttcttaaccatattctagaccctgttcattgatatcttagggtttttgtctcaatgactcaaaagttgcctgattttcttgctatgttctctctgggctttggtctcaaataagtgccttcaaaatgtcaacacaaagcacaagaaagccacctcttccttctagcatctgcaaatgttttttcctcttggttaccagagtctctggattaagctggcagtagctgctgcggccactgccggccacctcagggccttatgtttctgtccctttgtttccttcagattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaagtaagtgccccctcggagcagccggggccagggcgctccaggctgagccaggctggctttgtggtgtccccctccttacagacattgccaatccctccgcaccagctgttgtcctagccgtcacgttggcataggtggcaaacagacaacataaatcgtgtagactgaccatgatgctattgcagagcaaagctgagcgtaaaagtcaactcgctggtttggctgggtgtggtttctcacgcctgtaatcccagcgctttgggaggccgaggcagtggggaatcatctgaggtcaggagtctgagaccagcctggccaacatggtgaaacctcgtctctactaaaaatacaaaaattagccgggtgtggtggtgcgcgcctgtagtcccagctactcgagaggcagagacaggagaatcacttgaacctgggaggcagaggttgcagtgagccaagatcatgccactgcactccatcctgggcaacagagtgtgactccgtctcaaaataaaaaaagaaaaaaaaagaacttactggataaagcgcgagggacagctgggggcccacccccaagttctgcctctgcccaaggacacctcctctccgtcccctactgtgaagtgggagagtgggatcttgcctgctggggctcgaagggttgagtgagttgaaagtgctccatacagtacctggcttaaagtaaaggtttaacggacatgagttacttcttggttagagggaatcacatcagatgacttctctgtgtcagaggatcgaggctcttccaggaaaaacctaaagccacagatcgtttccacactgatccattctgtgttttttctaagaatcagcgtgtggttggaattacagccaacgttttccagatgccttcccggctcacaattccatttccttagagccccagctcccttgccttagttcagttactgtgaattatgagaactggagaagcaggttccctccagccttggcacagttggggcgcgttaccccctctggttgtccttggtgggaaggggacacctccccgtagtgttttctgccagttgctcctggcaaagtgggagagtcagcacagagacgcctttggggcccgtcagactcctggggggcctagtggggagaacgtgacagctgacttccctaacggcaggccttcttcaaagaacagcttttccacactagtcagaccacactcccattgtcccaggccctgtggcgccttacattggcctccagtgtcgcttctagatcagagccttagtcagggtagcgtaggttgtatcatagcaacaaccccaaatcacagtgacttaaaaccacagaagctggactgggtgcggtggctcatgcctgtcaggagttcaagaccaagaccagcctggccgacatacctgtctctactaaaaataaattagccagggttagctgggtgtggtggtgggcacctgtaatcccagctacttgggaggccgaggcacgagaatcgcttgaacctgggaggaggagttgcagtgagccgagattgtgccactgcactctaacctgggtgacagagtgaaactctctcaacaaaaaccacggtagccgctgtctcgctcatacgaggtgcccatcacaggtcagcagaggactccacctgttgtgtcccttggatatctgggccgctggagtcagaagttgccagtgtttgagcccaagggaaagcacacaggacattccccaggcagtgacatcctctttggtcacttctgcccacgtcacatgccaggaaacacaagatgccaagtagtcgggaggcaggagcctggggtatttgagcagtgtcagccaccaccgtagccagtaatgcgcagagggtgaatgcgtgcttcaaactgtgagactaaatctgcagctaaatcttttttttttttttctgtgagatggagtcttgctctgtcacacaggctggagtgcagtggcacaatctcagctcactgcaacctctgcctcctgggttcaagcaattctcctgcctcagcctcccaagtagctggaattataggcatgtaccaccacacccggctaatttttgtatttttagtagagacagggttttaccgtgttggccagggtggtctcgaacttctgaccttgtggtccacctgccttggtctcccaaagtgctgggattacaggcgtgagccacaatgcccagcctaaatcatttcttagggtacacacctaccttaattcatcaggtgcttgactttaaatggttattttcactggtcagtcatgcctgactgaccactgcaaggtggaaggttcattgatgtcaagtgggtgcttctctgcagcatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggtcagcagaggcctctgttcttccacgaggccacagactcttctagaaggctctgcctgaaacaaggttgtggcatagcacccacagttgttctaagagttaggttgaagtagctgtttttccaagtgtttctgattatcggtgggcactgataatgactagaattctagttcccagccctcacttttaggtccttattttaatgttgcagagccctttttccaaaagaaatccttaagctggctgggcactgtagctcacgcctctaatcctagcactttgggaggctgaggcaggaagatcacttgagtctaggagttcaagaccagcttgaggaaacgtagtgagaccccggccctaccaaaaaaaaaaaaaaaaaaagactagctgggcgtggtggcacacgcctgtaatcccagctacttgggaggctgaggctgaagggatcactgaaacccaggaatttgaggctgtagtgagccatgatcccaccactgcactccggcctgggtgacagccagaccccgtctcaaaagaaaaaacgggtagagtgcctgggcacccccagagaacctcccaagctccatctatgactgtccaggttctgtcccgctgtccccacctcttcccaggtcctcctttctgtctctgggattttttctctttcctaagcttttggcctattacgttttctttttctaagacccgagtaacttgcggtgattaggcattaacctgaaactagcctgtacaggaagctatacacttgcctcacctcttagctaacatagatcaaagatttcctgaagcctttgtaataacaggaaataaaacaagggctgtgagtggtacaggtgagagaaacacactcgagaggctgctaccggcaggcggacacagcagggcagggccaggcgtgcagagcaagcagccaagctgacctaatggttggggggtctctaccctgtggttccctaattgggggcgaatctaccttgcagttccctcatttggggaggggttatctttacctgcggttccctaagtaggggggtctttaccctatgactccctaactggggaggtctttaccctgcggttccataactggggggtctttaccctgcggttcccaactgggtcgggggtcattacctggcggttccctaattgtgggggaatctaccttgcagttccctaatgtgaggaggggatatctttaccctgtgattcccttactgggaggggtctttaccctgcgattccctaacttgggggatctttaccctgtggttccctaactagggggggtctttaccctgcagttccctaaatgggggggagtctaccttgcagttccccagtgtggggaggagatatctttaccctgcagttccctaactgagggggtctttaccctgcggttctcgaactagggggtctttaccctgcagttccctgagcaccccaggaacatggtactgtttaattcagcataagctcaccacaaaggagagctcctaacgaggcctctcccgctcgcaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggtggtgcccctgcttgctagagggaaggcttcggggtcaaagttggccagaaggagtctgatgtcgggttatacacaaggcggcttggctgcagggtttcagcttttgtaagaagtgggtggttggctgacgtgaagctgttctgcaggagctttacgggggtctgagcagggttctccagagcacaagttgtatgagattcaagtggtcccggagtttaacactcctggtttttaaaaagtacgtcattagagaacctaacgttttagtgtcttggtgcaactgaacgttgaggaccatgaggcagcttccaccagcctgactggtgtcttagtatgagttggagaaggtgcccctgctcctgggtcccttgggccaggcgcctacgtccaggcccagcccacatgcctgtgcgggtggccctcgttatggagagggcccacgagtcagctgatcaagctcatgacttgtaaattgttggggcttggcctttccgtgttgttaccttaaaacgatacatccacgttctcccaggcatggatgaggtagcccaattggacagcagattctgcatagcactttttcctgttctagaaggtactctcaagtgcttgtaataggcatttcagtgtcagccagatcaaatgttagtattaataaaatggattgttttaagtttctattgtagcaaagtcaaactactcttattggtggctaattggtcatggccccactgagggagaaattaagtgactatcaaattgccttcttactagtctgcgttagagaggggacagtgcgtttctctcccaaacgattgcagttctctccttttcaggcctataatgcaaagagcaaaagctttgaagatcctcccaaccatgcccgtagccctggaaacaaagggaagggcaagggaaaaggtacgtcattgtatgagtttcttttcaagttattcttctgtaacttggaggctgcctgtgaatccctcagtgtaaaaccacctctggtgttactgactctgggacagcgaggccgcctgagttaacaaggcgcttgagagcaaggtggacttggactctgaggatcgggtttagcctctggcctctctcccccagggaagggcaagcccaagtcccaagcctgtgagccgagcgagccagagatagagatcaagctgcccaagctgcggaccctggatgtgttttctggctgcggggggttgtcggagggattccaccaagcaggtgagcgcccgtaggctccatctctgaatacctggtgagcccagaccgggcaggtgctacctgaaacgacttccaaccccggtcaccttcctgactcaagaatctccttccgaggccaggcacggtggcgcacgcctgtaatcccagcactttgggaggccgaggtgggtggatcatgaggtcaggagtttgagaccatcctggccaacatggtgaaaccccgtctctaataagaatacaaaaattagctgggcgtggtggtgtgtgcctgtagtcccagctactcaggaggctgaggtgggagaatcgcttgaacctgggaggcagagcttgcagtgagccaagatcacaccactgcactccagcctgggtgacagagcgagactccatctcaaaaaaaaaaaaaaatcttctggagagttgaaagcatggcttcgtgcttgatctgccaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcaggtaaacgggtagaagccccccagtgttgccagacggcccggggctgtgccgcatgtcagcagtggtcattttcgccctgcactgaggcctctgccccccggaagctcacagctcagctctcaccagggagagactttgataacattcgtgaggggcttccggcacagtgggtcgtttcttccctctgtctgtggaggtgactcctgcagtctctcctgccccctacagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggtgggccctggggctggggcgggcagacagatgtggccagcacgtgacccggccagcagccagccatcccttactgaaggcagggttcaatggcataggcctgccatccaggcagcagaggctggcatggtgctctgtcccactggcggagtcaggggagatgcgtgctcagccggcccccagcaagtccaccgctagtgtctcttgagctgtgttctcgaacatgcctgggagggctggctacaatgggcttctcgccatgcagctcctggctcctttccctcgatggggaagggtgagcagcccaccatggagcactgtggaatggctgagtctgcacagagcgggaggggaagtgaggtgcgcagagccatgtgtaggcggcagctgttcgattggtttaaaagacagttttgctctgggtaactgcgcacacaaacccccacagatggccgagggttgcactccaggtggctgtgtctgcagggacagggatggacatagtctgtggggcccaggccttatctgaaaagcatcccccatcctctctgtatcagctcagcaattgagggcataattaaaaatgaaacagctatccagatgctagcacaggatgtctgcctaagtgggcaagcacttggctacccggtcccctagctcagcctcagggcgactcaggctcaccagacaagacttgttgcagccacgttctctgtccttgtgaccacagccatcagggaagcgacagggctcctggtctccagtgttctccccgagtgctaagaccttggggcccttgcagtgctttcagagctggccggacttccccgcagggtttgctcccaccttccccagtggctgtcccctgggctcagctgcttttgttctttatctgctccaaactcctctgaccaggagcacgcctgctgaggtaactggggatttctgcaagtgcactccgcattggccagccactcccgactcaggctgctgaccctgggcctgggtctggccagtccagttgggagtgtcccactgacggtggggttgtccgtccttctcccccacaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggtaggtggcccccgtcgctcctccacacactgccgagcaggcctcagtagctcatggggcccgtgagtactccctggtgaggcttggggaggagaggatggtacagcatctgccctgccacacggtgctctgccacatggcactctgccacctgtggtctccagttctgaccctgcatcatctgcttccctagtagatagcatgtgcagagcggccagccgcatgcttggctgtggtcatccacaaagcccacgccatagccccatccccccttccagatggcatccaggcacactgccacccatgtgacctcgggcagtgctgtgatctcgggagaaggccatctgagcaggcagggggtggcacctgtgatgaggggacagctgctgcgtgcatctccagaggtgttgacctcctcctctgttgcaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggtaatggcaccctgacagagcggctcctcctcgaggcccagcccagcagcctcgtgggaacagtcagcctgcccaagactcaggggagacatggaatctgatcccaggctcctcctcccgagtcctcagcctttgtgtgacccctggtctctcttgcatggtcatgggaagtgtcagagctcccgcagtcctggacttggtctggaatggtgtcaagccactgcccacccaccactgccttcccccttgctgcctctccccgcatgttttcccaggatgccaagaccagccctttcaccatcccctggcaccactccccttcccccaccctaaaggctcagcttagattcccacgctctcctacacctgcgctgcctcaggtccctgccgtggcctcgagccaagtgcgatatccctgactgtctctttcccgatgggcgtgagccccagggggcttcctggtcaccatggtgttcccagctcccagcccaccatggatgctcggatgctgctcacatgaggtgacagctgggccccccacactctttcaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaaggtgggtcctgtaagttgtggttcccggtgggctgaggggaaggaaggcagagccctgggcctttggcctgtgaacctggaggccagggcagggcacagacacaccaagcctgggtgtcccagagaaggtagctgctgaccatgttgagtagtaaaagcaggctgggttcatggcccacacctataatcccagcactttgggaaaccaaggcgggaggatcacttgagcctgggaggttgaggaggctacagtgagctgtgattgtgccattgcactccagcctgggagacagagtgagaccctgtctctaaaaagaaaaaaaaaaaacaataaataaataataaaagcaggtcaggcacgatggctcacctctgtaatcccagcactttgggaggccaaggcaggcagatcacttgagatcaggagctcgagatcagcctgcccaacatggtgaaaccccatctctattaaaactacaaaaattagccgggcgtggtgtcgcacgcctataatcccagctatttgggaggctgaggcaggagaatcgcttgaaccccataggcagaggttgcagtgagccaagatcatgccattgcactccagcctgggcaacagagcgagacatataatactaataataaaaacagtgcccagagaacgaggattgttggctgctccaccccagggggccccttgcacaggaggtgccatctctgcctcccaaagctctaagagccactgtcccaagcctataccccatcccacaactgcagcctcatcactgtcctgtcttccagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcaggtaggtggggagggggcatccgagggcctgggtcaggccctgtacttggcggcctaactaggtggaagtgtgggtttagccaagtgggggacagcaccccaggaccccaggcacctggcctctgcctcctgcccctccacgtccacgggacaagctcataggccaaggccatggccgtatgctgtcacagtgccatttccctccctgtccccgacggtgacccggcctgggtgctactgccctcgcccaccgcgcctctttcccccagggccgcgtgctccacccagagcagcaccgtgtggtgagcgtgcgggagtgtgcccgctcccagggcttccctgacacctaccggctcttcggcaacatcctggacaagcaccggcaggtcagtggggcggcgcccgctgggtctggacaggaaggaggcttctgtgcctgtcaccaggtggggctggggccagcgcagtcacttccgggaggacgcctgctggctgccgggtagccccatcactctcagtgggaagacggcccacaggagggacagtgctgagacatccgagtcaggctgcgtccctatgctggttccttactgtttgtttttgaggcagagattgagccagaaggacagtccgtcgcgctaaaggagcaggctaaaacccatggtggcgacagctcactcgctgtaggttcaaatgaactagcaccttaattcctacctgcttctcaggtgtcgggttggcttaacaagttagtctatgagttagtctcagttaagtgtattttcatcatagggcacgcgcattgcttaaaaaccagtgtccacggttcttgtgaaaaccacatttcacccctccccccgaatctggttctcgggaagcagccactctctcttttttttttttttttttgagatggagctttgttctttcgcccaggctggagtgaagtggcgtgatctcagctcaccgcaacttccacccccctggttttaagtgattctcctgcctcagcctcttgagtagctgggattacagtcatgtgctaccacacccggctaatttttgtatttttagtagagatggggtttcaccatgttggccaggctggtcccgaactcttgacctcaggtgatccgcctgcctcggcctcccaaagtgctgggattacaggcatgagccactgcgccggccagggaagcagccactcttaactgggagcgaaacgtgtctaggtggcccatttgtcttttttttttttttttctgagacagggtctcactctgtcccctaggctggagtgcagtgacatgatctctgcccactgcaacctccacctccagggttcaagtgattctcctgcctcagcctcctgaggtgctgggattacaggcatgtgccaccatgcccagctaattagtttttgtacttttagtagagacggggtttcaccatgttggcgaggctgctctcgaactcctggcctcaactaatccacctgccttggcctcccaaagtgctgggattacaggcgtgagccactgctcccagccccacgtgtctttgtctcaagtctttctgaagctcttcaaaggcccagtgacttgtggctgtggggcgggatgatgggccagttggagggtccaaggatcttgtgctggaagggttttgggcccatgtgagcaggaccagaacccttccccaaggggtgcaatgcccaggttgtcctccatctgagcaggggctggcagtacacctgcccccgggccttgggcctgggtgtccacatcaggcattgcccttctcccctcctgcaggtgggcaatgccgtgccaccgcccctggccaaagccattggcttggagatcaagctttgtatgttggccaaagcccgagagagtgcctcaggtatggtggggtgggccaggcttcctctggggcctgactgccctctgggggtacatgtgggggcagttgctggccaccgttttgggctctgggactcaggcgggtcacctacccacgttcgtggccccatctttctcaaggggctgctgtgaggattgagtgagttgcacgtgtcaagtgcttagagcaggcgtgctgcacacagcaggcctttggtcaggttggctgctgggctggccctggggccgtttccctcactcctgctcggtgaatttggctcagcaggcacctgcctcagctgctcacttgagcctctgggtctagaaccctctggggaccgtttgaggagtgttcagtctccgtgaacgttcccttagcactctgccacttattgggtcagctgttaacatcagtacgttaatgtttcctgatggtccatgtctgttactcgcctgtcaagtggcgtgacaccgggcgtgttccccagagtgacttttccttttatttcccttcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaaccacc

SEQ ID NO: 6290 - DNA, 95045 bp, Homo sapiens
tgcgcttcccgcgggcgcgcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgaggtaaccggccggcagccccgactgctgcggtgacagtcgaggtggaagctcgagaggttctctttatatcatcttatgggtgtagctagagacgggcagaaccggaagggccaactaggcccaaaacctcatgttaaagatgattgctgctttttttcataggacttttgggttttggcatttcctgaaggttattttcattcattgttattggaagaagctggatgctcctgtgatagaaaattcaggatttcagtgtcaggcttaagttaggcttacgcttaaaagcttgaaagtttattctttcattaggtaatattgttatgtacccaggtattagaagttgcgtcttgtttattggaaagccaatacttgtttcccttttctaaagcttgcatattctgggaaaaaaaaccctttgaagaacgatataacatctcatacttactttccacatagtttccaacatgatgataacagctatcaattgttcagtattttcaaagtgctagacatttgcacatttaatcctcagaacaaacccatttatctagtaaatggcaaggtggggttttgaaccaagctcacagcccgtacagtactgcttctcaagtaatttaagttcttgctgctaaaagtgtggtttgtggaccagcagcattggcagcagtaagcaagggttggcatgctttttctgtacaggaccacatagtaaatattttcaactttgtagactagagaatctctgttggagttattcaactcttcaactctaccattgtaacacaaaagcagccttagataagatcagcttccagcatgacagcttaaggaacccattcctctgtaaaactggtgaaaattcttttttgttttgtttcgttttgagacagaatctcactctgtcaccgaggctggcatgcagtagtgtgatcatggcttactgcaaccctgaccaacctccctggctcaatcagtcctcctgcctcagcctctcgagtagctgggaccacaggcgtgtgccaccacacctggctaattttttttttttttttttttttgagacggagtctcgctctgtcacccagagtgcaccgggctagagtgcaatggcgcgatcttgtctcactgccacctccacttccaggttcaagtgattctcctgcttcagccttccaggtagctgggattacaggcgtgcgccacctcgtctggctaatttttctatttttagtagagacagggtttcaccatattgggcaggctgatctcgaactcctgacctcgtgaccagccgacctgggcctcccaaagtggtgggaaagtggtgcgattacagatgtgagccaccccgcccagcctcacctagctaatttttgtaaagacagggttttgccatgttgcccaggctgatcttgaactcctgagctcaagcaatccactcgccttggcctcccaaagtgatgggattacagatgcagccaccacgcctggcccaaaaattctttttttaaaatcaactatttaaaccctccggcaatggtcctgagggcaaacaacaaatgaaaaaacacctattcaagaaaatctacaaattcggtaagaaagatgagagggtatggtatttgaaccaagatcattccctccttactcactcctagcttagtgaggtggagcttctactccagactattgcaaactgtaataccgggcactgctcccccagctcccaatcaaatgctttcttcccaggaaaagcaggacatcagcatttctcatcctacctagagctacttgttgctgaggttaaaacctgtgtgagtgcaattgaaagttggagctctctttttttttcttttgagacggagttttgctcttgttgctcaaactggagtgcaatggtgtgatctcgcctcaccgcagcctctgcttcccgggttcaagcgattctcccacatcagcctcccaagtagctgggattgcaggcttgcgccaccatgtctggctaattttgtatttttagtagaggcagggtttctccatgttggtcaggctggtcttgaactccctacctcaggtgatccacctgcctcggcctcccaaagtgttgggattataggcgtgagccactgtgccctgcgaaaagttggagctcccttcttccacctagtccctacttgtggaacaggactgtaccttggacatgacatactgaaattactggtgccccaattgctcatcccccagttcttgcaggctgagcctcaggttattgcggtcccctgcctccttccaccaagtgctcagttcctagagtgagggtatttctcagagagaatctttccagggtccttccccacagctccagagccttggctccgggattttgcctcaggagagaagcaggccctaaaacagatagctcctaatctctttccaatggcagtgacttcatttgcaacacagtgtggagaaattcatgcctaagggcaatctggagatgtgaaggttttggtaagaggcaactgggagatctgcggatttaatggagatgcagcctagactgtaggcctcctggtttgctggaaagaattggggaataagacagctggaagaagccattctaggatcagaagaaggatcaaacattgaccgcagcatggtggctcacgcctgtaatcccagcactttgggaggctgaggcaggcagatcatctgaggtcgggagtttgagaccagcttgaccaatatggtgaaccccatctctactaaaaatacaaaaattagctgggcatgggggcatacacttgtaatcccagctacttgggaggctgaagcaggaaaatcacgtgaactgggaggtggaagttgcagtgagccaagatcacgccactgcactccagcctgggtgacagtgaagctctgtcctgtcacaaaacaaaacattgaccacagacctctgaggtggtggatgtccctcctgtcctggttgtatcattatacattgtatattaatgtatcgaaatactacaggtacccccaacatgtgtacaactattatgaatcaataaaaaacaatttgaaaagtaaggtatgtggcagaggtggaaaaaaatgctttcctccaaacagccacaatttgattgtatcagtttgtagagtaagagcaagttatgcctcagtgtgttgttgaaaataatagaacaatatgccacaattagtggagcttcatagctgggtgtggtcaaggagagaatagaagagaaccctaccaaaaccactgtcatcccagggtgactgtgagcatacccaaagctgcacctccctgaagagcaatatcataggccttaacacttttcaggggaaatggatttcactcaaataatccagccagtcgctaaacaaataaataacaattggccctggagagggggtaccaatccccagagttgctacagtatattatctaaaatgtccagtttccaacaagaaattgtgagacgtacaaagaaacaggaaaatatgacacatacactggaaaaaagctggcagcagcaactgcctgtgagacaaggggccaaattaatgaaaaaggcttcaaactggcctatatatatattcacagtactatatatattcacaatactaaaggaaaatatgatgacaaagaagtaaaggatggtatgacactgttgcatcaattaaagaatatccataaagatatagaaattataaaaaaagaatcaaatgaaaattctggagttgaaagtacaataacagctgggcgcggtggctcacacctgtaatcccagcactttgggaggctgaggcgggcggatcacctgaggtcgggagttcgagaccagcctgaccaacatggtaaaaccccgtctctgctaaaaatacaaaaattagccaggcgtggtggccggcacctgtagtcccagctacgcgggaggctgaggcaggagaattccttgaacctgggaggcggaggttgcagtgagccaagatcgagccactgcacaccagcctgggcaacagagcaagactctgtctcaaaaaaaaaaaaaaaaaaaaaaaaagtacaataacaaatttaaaaattaactagagggactcaggactcaataacagatttgaactgggtgaagaaagaattcgttaattttttttttctttttgagacagagtctcgctctgttgcctaggctggagtgcagtggggcaatctcggctcactgcaacctctgcctccctggttcaagcgattctcctgcctcagccaccgcacagtggctttgggagtactctgggaggctgaggtgggtggatcacctgaggtcaggagttcaagaccagcctggccaacatggtgaaaccccatctctacaaaaatacaaaaatttagttgggcatgatggcgggtgcctgtaaccccagctacttgggaggttgaggcgggagaattgcttgaacccgggaggcggaggttgtagtgagcagagatcgtgccactgccctccaacctgggtgacagagcgagactccatccctgccctgaaaaaaaaaaaaaagatgtgaaacacatacaaaaaaaagtaaaatggcagttgaatgccaagtaattagataacttcaataaaatggacaaactcctagaaagatataaaccaccaaaattgacccaagaagagacactatctgaatagacctataacaagtaaagatattaaattagtaattgaggggactcgtggggtaacttgcccttgggaaccagtagtatggcatcgggctgcaagattggcctgtccatcctcaatgctacctggccaatttaggggcccagtgcctctggatgctagactctggggtcgattatctccaccggaatgtaatggatgaacatgcatgtgatggtgtccaagccagaacagtgggtaaagccaatggctataagaggagccaatcagtacatctttcatctcgaggaaactgagaacccaggggctttgattaaagacattcaggagaatgggatgaaggttggccttgccataaaaccaggaacctcagttcagtatttggcaccatgggctaatcaactaggtatgaccttggttatgacagtggaaccagggtttggagggcataaattcatggaagatatgatgttaaaggttcactggttgaggatccagttcccatctttggctatagaggtcgctggtggaatagatcctgacactgtccataggtgtgcagaggcgaagctaacatgattgtgtctggcagtgctatggtgaggagtgaagaccctagatctgtgatcagcctgttaagaaacatttgctcagaagctgctcagaaagattctcttgattgatgaaaccttaaggagcccaatgtttgtttatgaaatctcctttttactggaaaacaggaatattgactaccaaatcatagtgtagttgaagccattctgcgtttttgagcagttattcgtttcagtgattataattgattgtgcagagtattctaagaagttagaaattggtgtgtataactacattttcagtgatgcaatttaatgattagtgagtgagatactgtttttattgagagccttgatttttataaagagtaaaaatatggctgcattaagggtacaaacagaaaagtgtcttaatgtctaaggagggcatattagctacactataaaaacaatttttttctgtatttctgaaaagaattttgttgtttctcagttgttttccaaaagcaaaggaagtcttaatgtttttttctatttcgtgttatgtgtgatttgtttatatgcttggtaatatgagtctaatggaatttaaaaatataagtttgggtaggatagtatacccttaaaaaataaataaataattagagagagagagagagagagagacctgggcacagtggctgttgcctgtaatctcagcactttgggaggtcaaggcaggaggatcctttgaggccaggagcttgagaccaacctgggcaacatagagagaccccaactctaaaatatacatactatatctaaactcagctaggcgtggtggtgtgagcctggagtcccagctactcaggaggttaaggtgtgaggatcacttgatcccaggaggttgaggaggcagtgagctatgattgtgccacagtgcttcagccagggtgacagagtgagaccctgtctcttaaaaaaaagaaaagaggctgggtgcagtggctcatgcctgtaatcccagcactttgggaagccaaggtgggcagatcacgaggtcaggagttcaagaccagcctgtctaatatggtgaaaccccatctctactaaaaatacaaaaattagccgagcatggtggagtgcgcctgtagtcccagctactcgagaggctgaggcaggagaatcgcttgaacccgggaagttggaggttgcagtgagctgagattgcgccactgcactccagcctgggtgacaaagtgagactccatctcaaaaaaaaaaaaaaagaagaaagaaaagcaaagcaaagcccaggcctgtacctactagaggtcctgataacttcaccactgaattctatcaaacatttcaagaaaaattaatacagttcttcacaaagtcttcaaaaatgaaaaagaggagaaaatacttacaaacgaattttatgagactggtattaccctgttgccaaaaaccaggaaaagacattacaagaaaagaaaaccatagacaaatatatcttacaaatgtggaagcaaaaatcctcaacaaaaatactagcaaactgaatccagtaacatataaaaataattatataccataaacaagcaggatttattccaggagtgcaaggttggtttaacatccaaaaatgaattagtgtaaataatgtaatgcattatatcaatagaataaaaaacaaaaatcaccttgtcatctcagtagacacagaaaaagcatttgacaaaattcagcatgtttttcatgataaaaacactaaataaactaagaagagaagagcagttcctcaacctgatacacagcagttatgaaaaacccacagctaacttcataatagtgagactgaggccaggcacagtggctcacgcctgtaatcctaacactttaggaggccaaggttggagggatcacttgaggtcaggagttcaagaacagcctggccaacatggtgaaaccctgtctctactacaaatacaaaaaaaaattagccaggtgtggtggtgcatacctataattgtagctacttgggaggctgaggtgggaggattgcttgaacctgggaggcagaggttgcagtgagctgagatagcactactgcacacaataggctgggcgacagagctcaaaacaaacaaacaaacaaacaaaatagtgaaagactgtatgcttatccttaagattaggaaaaagagagataagtctactttcactactgctattcagcattgtactggaggttctagccagggcaattaggcaagaaaatgcaataaaatacatctatgttggaagggaacaagtaagatcatctctgcagatgacatgatcttgcatatagaccctgaggaatccactaccaaagtattggaactaataaattattagtttagtaaggttataggatacaagatcattacacaaaacttagttgtaaatgtatccacttggaatgaacaatctgaaaaggaaattaagaaaattccatttacaataacctaaaaaataaaaatacttataacaaaagaggtatctttttttccatcctctgacagtttagtaaaagaaagtataaaacttatactctaaaagctgtaaaacatttttggttttgttttttaaattaattttttttgaaacggagtctcactctgtcgtccaggctggaatgcggtggcgcgatctcggctcactgcaacctctgcctcccaggttaaagcgattctcctgcctcagcctccggagtagctggagctacaggtgtgcaccaccatgcctggctaatttttgtatttttagtatagagggggtttcaccatgttggccaggctggtctcgaactcctgacctcaggtgatccacccgcctcagcctctgaaagtcctgggattacaggcgtgagctagtgcgcccagcctggccttttaaaatatttaattaattgatttttttttttctcggacttgcactgaagtgagaacaagtgcagtggtgcaatcatatctcagtgcagcctagaccttccaggcttaagtgatcctcctatatcagcctcccaagcagctcagaccacaggcatgcgcgatcatccctagctttttttttttgtttgtttgttttttaatttcttgtagagacagagtctccctgtgttacccaggctggtcttgaacctgacctcaagcaacctcccatgttggcccctcaaagtgctgggattacaggtgtgagccaccgtgcctggcctgtaaaacatttttaaaagaaagaagatataaataaataaataaatagaaaatagctcttgttcatggatcataagacataacgttgtcaaattggcagtattttggaaattgatctacacgtttgacataatccctgtcagaatcccagtttatttcattgtagaaattgacaagtctccaggcgtagtggctcatgcctgtaatcccagcactttgggaggccgaggcaggcggatcacctgaggtcaggagttcaagaccagcctggccaacatggagaaaccctgtctctactaaaactacaaaattagccgggtgtggtggcacatacctgtaatcccaggtactcgggaggctgaggcagggaatcgcttgaacctgggaggcggagcttgcggtgagctgagatcacgcgccactgcactccagcttgggcaacaagagcgaaactccatctcaaaaaaaaaaaagaaattgacaagtcaattcataaattcctatggaatcgcaagggacccacaatagctaaatcttgaaaaagaacaaagcagaaagactcacgctttgtgatttcaagacatactataaaacaactaatcaagacaacgtcaccaggcaccgtggcttatgcctataatcccaacactttgggaggccaaggcaggcagatcacttgaggacaggagttcgagaccagcctgggcaacatggcgaaatcttgtctctaccaaaaatacaaaaattaaccgggcgtgggggtgcacacttgtagtccaagctgcttgggagggctgaggcacaagaatcccttgaacccaggaggtggaggttgcagtgagtcgagatcgtgctattgcactccagcctgggggacagagcgagattccatttcaaaaaaataaaaataaaaagacagtgtggtactggtataaggataaatgtgtagatcagtggcatagaattgagagtccagaaataaacccagtggaatagagttgagagttcatggtcacctgattcttgacaagggtgcaaagaccattcagtgggggagaactgtcttgtcttgtcttttcttgctacatgccacagactgtgagaaggaatagtcctttcttttcttttttctttttttttttgagatggagtctcgctctgtcatctaggctggagtgcagtggtgcaatcttggctcactgcaacctccgcctcctgggttcaagtgattttcctgcctcagcctcctgagtacctggactacaggcgcctgtcacaacgcccggctaatttttgtatttttagtagagatagggttccactatgttggccaggctagtctcgaactcctgacctcgtgatccacctgcctcagcctcccaaagtgctgggattacaggtgtgagccaccgcacccggccggaatagtcctttcaacaaatggagctgagacaactggatagccacatgcaaaaaaaagaagaaattaaacccttacctcacactacatacaaaaattaactcatggctgggcacggtggctcacacctgtaatcccagcactttgggaggccaaggcaggtggatcatgaggtcaggagttcaagacgaggctggccaacatggtgaaaccccatctctactaaaaatacaaaaagtaggccgggtgcggtggctcaacacctgtaatcccagcacttcgggaggccgaggtgggtggctcacgaggtcaggagatcaagaccatcctggctaacatggtgaaaccctgtctgtactaaaaatacaaaaacaaaattagctgggcgtggtggcgggcgcctgtagtcccagctacttaggaggctgaggcaggagaatggcgtgaatccaggaggtggagcttgcagtaagccgagatcgcactactgcactccggcctgggcgacagagggagactccatctaaaaaaaaaaaaaaaaattagctgggcatggtggcgggcacctgtaatcacagctacttgggaggctgaggcaggagaatcgcttgaacccaggggtgagctgagatcacgccattgcactctagcctgggtgacagggtgagtctccatcccccacccaaaaaaaagcttaaaatggatcaaagggccagttgaggtggctcaccccagtaatctgagcactttaggatgttgaggtggatggatcacttgaggccaggagtttgagaccagtctggccaacatggtgaaaccctgtctatattaaaaatacagaaattaggctgggtgtggtggctcatgcctgtaatcctagcactttgggaggctgaggcaggtggactgcttgaggacaggagttcaagactaccttggccaacatagcaaaaccccatctctactaaaaatacaaaaattagccagccgtggtggcatgctcttgtagtgccatctactctggaggctgagacatgagaatcacttgaactcgggaggtggaggttgcagtgagctcagattgtgctactgcactccaacctgggcaacaaagcaagactctgtctggaaaaaacaaaaacaaaaacaaaaaacaaatgtggagaaatgtgaacccttttacactgctggtaagaccgtaaaatggtgcagccagtttgaaaagcaaactagttagccaggcatggtgggtcatacatgtaattcctgcactttgggagaccaaggtgggaggatcacttgaagccagaattttgagaccagcctgggcaacagagtgagaccttttctctacaaaaaatttaaaaattagccaggcgtggtggcttgcacctgtagtcttagttacttgggaggttgaggtgggaggatcacttgagcctgggagaggctatagtgaggcatgactgcaccactgcacctccagcctggtaatcaaagcgagaccctgtctcaaaaaaaggaagacaattagctgggtgtggtagcgttcctctgtagtcacagctacttgagaggccaaggtggtaggattccttgagcccagaattttgaggttgcagttagctgtgattgtggtgctatactccaggctgggcgacagagtgagacccagtctcaaaaaagataaaaagaaaaacatggtggcagttcctcaaacagttaaacacagagttaccatataaccccacaattcaacttacagatgtcttctcaagagaaatgaaaacatagctttacgagaaaaacttatatgtgaatgtttatagtagtattattcataatagccagaaggtagaaacagttcaaatatacatcagctgatgaatggataaacaaaatgtggtctatccttactatggaattacttggcaataaaatagaatgaagtaccagcacgtgcttcaacatggatggaccttgaaaacactatgctatgtgaaagaaaccagccgcaaaagaacacatatgattccattcatatgcaaatctaggataggcatatctacagagacaaagtagatcagtggttgttcagggctgggaaaaatgggtggggtagagggtgtgatagctgaaatatacaaggttttatttatgaagtgatgaaaatactctaaaactgactggtgatggttgtacacactgaatgtactaaaaactactgaattatacactttaaatgggtgaattttagggtatatgaattatatatcaagatgtttaaaaaaaaccttaggcaaaatgtaaacaatgggcatgactgtgttccaagaaaactttatggacacagaaatttgaatttcacataattttcacaagaaaataaacattaaaaaatgtaacatgctgggcactgtggctcacgcatgtaatcccagcacttcgggaggccgaggtggacggatgacgaggtcaggagtttcataccagcctggccaatatgtaaaaccctgcctctactgaaaatagaaaaattagctgggcgtgatggcacacgcctgtaatcccagctactcgggaggctgaggcaggagaatcacttgaacctggaaggcggaggttgtggtgagctgagatcacgccgttgcactccagcctgggcaacaagagtgaaactccgtctcaagaaaaaaaaaaaaaaaaagtaaaaatcattcttagttctcaggccacacaaaaataggtggtgggttggatttgtcctgtgggccatagtttgctgatctctgatctaagttactatttgatagatgttagatgttgtgagagggtaagagagactagcctataaggaaagggattttagttttttgggggtttttttttttgagacggagtctcgctctgtcgcccaggttggaaagcaatggtgtgatctcagctcactgcaacctctgtcacccaggctcaagcgattcttctgcctcagcctcccaagtagctgggattacaggcatgtgccaccatgcccggctaatttttgtatttttagtagagatgggctttcaccatgttggccaggctgatcttgaactcctgacttcaggtgatccgccctccttggtctcccaaagtgctgggattacaggtgtgaaccactgtgtccatccaggaaagggattttgtatgacatttttcagccgcaattttgccaggaaaagctcttttttcttcattaagtagattccagacccaaagatgttggacagtattatcagctagagcaaggtttttcaaccctggcactattgacattttggctggatgattctttgttgtggggagctgtcttgtatgttctaggatgtttagcaggatctctggcctctacctactagatgccagtagcattcccccaccccatcccagttgttgtgacaaccaaaaatgtcttcagacattgtcaagtgtccctggggtagggaggacaccctccaatctcctctttctccctacccaacctccatgaccacattgagaaccactgatctatagaaaaggataatagtagtgacattcagagaggcaggatggtatagtgcaaagcttgccaaactttaattttacataaatgacctggggaatcttggaaaaatgtaggttctgattcagtagttctgggatggaagtgagaattttgtattaataacaaactctcaggtgatgatacctgtgccaccggcccaaggaccacactttgaatagcagagcagtagtagaaagtgcatcggctttgaaagaagacagacctgggcttgaattctagctaaaatacttctactttggacaagttacatagctctctggaccttattttctcattggtaaaatgagactaataatgctgaccctgcagagttcttataaggattcatggaatgcatagtccctggcagaaaggaagatataggagggactataattggcctaaagtaggaggctctggttaccatgggcactgccctgttgtgatttatcaagccattacacctcactgaacctcagatttccagtggaaaaacctgtttgtaaaccatgttcacatattctgttgaaagtaatcatagtttgatttatgatgatagggctcaggtaagtgattagttttattctcctgcctgctttttatgttgtccattaatgagcaaggtgctgatgcaaggagatggcagatgcattttgaaaaaaaaggagagagagagtacttgtagaattcttgactttattgaggtcaaatgtaggtggcttttcaagaaggactcaatttcagaaccggtggcatttaacatatgagtcatgttaccttatgctaataagttcagactttttttctttttactgcagagatagggggaaaaatctcctgcactacttgctgcattgctcaattggctggatgctttggaagatttttccacttgaaagatttgttgtttgtcattttgagaaagtgggtgctgagtgtaatttgccaggaggctaaacggctatgttatttcttatctaggctggaattttactctaataattcaatctatcagtaagaaaagccaaataggaagttgtaagagatcctaatactatcttatattgaaaacaaagcctccttctcctgttgtttggcattctaaatgttttcacatacctaagtgagattatgattgtattaaataccaacattgcagatcattccagcatacaagtggacgtaagttgtccataacagaaggaactttctaaaggggaagacagatagaacaattctggcattttcagtaaaatcttaaatcctaggctccctaggaccaggcaaaccatccccttcaaggatgtaaactctggagggcagtgtagttgtacagggtaatagttctatactctatattagtgcaacaagaaacttctattcctgtttcagaagtaagactgttatctacctttttttttttgagatggagtttcactcttgttgcccagactggagtgcatgatctcagctcaccaaaacctctgcctcctgggttcaagtgattctccagcctcagcctcccgaatagctgggaatacaggcatgtgccaacacgccctgctaatttttagatttttagtaaagacagggtttctccatgttggtcatgctggtctcgaactcctgacctcaggtgatccacctgccttggcctcccaaagtgctgggattacaggcacgagccactacgcctggcctgttatctacctttttaccgctgtgctctcccatgggttttttttgtttgtttgtttgtttgtttgttttgagatggagtctcgctctgttgcccaggctggagtgcagtggcgtgatctcagctcacttcaacctctgtctcctgggttcaagcaattctcctgcctcaacctcctgagtagctggaattacaggtgcctgccatcatgccaggctaatttttgtatttttagtagagatggggtcttaccatgttggtcaggctggtcttgaactcctgacctcatgatctgcctggctcggcctcccaaagtgctgggattacaggcatgagccaccgtgcccgacctctcccatgggttttaagtagtgcctatggatggcatgggtgccactactcaggtctaggacaggcaggggtgagtgatgagtgcgtgcgtgctgatgaaggggtgcgaagaaacagatgctggctagtgctgccctccactggaccccattctgcctttgtgtgggacaaagggctagggactagcagttactttgtgctaggtaccatgctaaatgctttaaatgcacactacctcatttgatataacagggactcatttattcattcaagagatattataaaataggctaggcacagtggctgacacctgtaatcccagtgggaggccggggtggccagatcacttgaggccaggagttcgagaccagtttgggcacatggtgaaatcctgtctctactgaaaacacaaaaattagccaggcgtggtagtgggcgcctgtagtcccagctactccggaggttgaggcaggagaattgcttgaacctgggaggtgagggttgcagtgagctgagatcgcgtcactgcactccagcctgggcgacaagagcgagactctgtctcaaaaaaaagacaataattaggcgtggttgtgcgcacctgtagtcctaactacttggtaggctgagacaagaggatcacttgagcccaggagttcgaggctgcagtgagctatgttcgtaccactgcatgaagcctgggtgacagagtgagactctgtctcttttatttatttgttttttaaataatagagacagggttggccgggcatggtggctcattcctgtaatcccagcactttgggaggctgaggcaggtggatccctgaggtcaggagttcaagaccagcctggccaacatgggaaaaactcgtctctactaaaaatagaaaaattagccgggggcaatggcatgtgcctgtaattccagctacttgggaggctgaggcaggataattgcctgaggtggaggttgcctgagattgagccactgcactccagcctggatgacagggagagactccgactccaaaaaaaaaaatagagatgggggtctccctacgttggttgctcaggctggtctcaaactcctgtgctcaagggatcctcctgcctcagcctcccaaagtgctaggattataggtgtgaaccaccacacgcagctctgatttactgggtgcccacgttgaccaggcagggaacacctcctagcagtgatcaaggactactttggacctaggttctgtaactgacttcatctttaagtggggaaacagaggctcagacaggatacatagcatgcttaaaggcttagtgcagccactatctattctgaaagaggcagaataggacagggacaggtaggtagtgagagaatagggagaatagatgggcacaccctttaacttaatatcgaccagtaaagcctgcagttgcttatttgaacctcacattgaggctgacatgtaagttgagcaaatcttaactcaagcttcagtttccttgttggggccgctgaggcagcatagcctagagattacaagcatagacttcagagtttgattcctggctctgcctctaaccagctttgcaaccttaaagctccttaaccccctcacatgcctctgttccctaactgtaaaatggtgaatgtaattaattcttcctgcatagtgttacaagaattaaatttgagtaattactggtaaagtacgtagaatagtacctaacacaagataagtgctatatataatggttgttacctaaagaaataacagcctgggcaacatggcgaaaccctatctctacaaaaaatacaaaaattagccggttgtggtggtgtgcacctgtggtcctagcatctcgggaggctgaggtgggaggatcacatgagcctgggaggtcgaggttgccataagcttcctgattgcaccactgcactccagcctgggtgacagagtgagaccttgtctcaaaaaataaataaataaaataaattaaaaaaataaaaaggaaataagttcagtgcctgtcgttagcttgctccctttctcagcctctcctccacttcctcacgcaccctcttgctctgagcctattatcctggtccctccttcacactgccacatctttgcataggctgttctctttgcctggaatgccattctcatttgttgcttggcagaactgaactcattctccttctaggctctgctcaagggtttcctcttctttgtgtccaaagtcaccacatagcttctaagtgatgggactgagatttgaagccaggtcatctgtctttcaggccagccctctttccactaccctatgctacccaaataggaagcgtaaaagagaagtaggagagaaaaagttagaaacctggagagaacttaggtatttggtaaacaggaaaaagaaagtggaaagaagagatcatttgaaggacttcctcaacttaacaactatttgcctatggcattattttattgcatttggtgtatgatactatctcaaaagcattttgtaaacttgccagtggcttacatttttgccggatgaatgacatgactaacgatccgtgctacattacctcagtgtctagtttgtcattttgaatcaagtggacattttctgtaagtgaatcattttcacttgctcatgatataatgagaattccttacctttggcttaaaatgaggcttatgttataacagttaagcattgtctagttgcatatttaacatagtcagaatgctcctgcctgtattcagcctggtgtcttataatatttggtatgcccacctagatagcaattggtaacatctttattctgagactctttcatgtatggattttgaaaagttagttaactgttcagacgacattgtttctttgacttttacaatccgcttccctctcactgacagttcagttttggaagaccctgtatttttttttttttttttttttttttttgagacagagactcgctctgtcgcccaggctggagtgcagtggcgtgatctctgctcactgcaacctccacctcccgggttcaagcaattctcttgcctcagcctcctgagtagctgggattatgggtgtgcaccaccacacatggctaatttttgtatttttagtagagacgaagtttcaccatgttggccaggacggtctcgatctcctgaccttgtgatcagcctgcctcggcctcccaaagtgctgggattacaggcgtgaaccaccgtgcccggccttttttttttttttttttttttcgagatggggtctcactcagactggagtgcagtggtgctatcacagctcactacagacttgacctgctgggctcaagtgattctcctgcctaagcctcccaagtagctgggactacaggcacatgccaccaatacctggctaatttttttgaagaaatgggatcccgctatgttgcctaggctggtctggaacttctgggctcaagcgatccttccgcctcagcctctcaaagtgctgggattacaggcatgagccaacatgcccagctagagatgtgtgtgaattggtagcttcaagctagatattggaggctcatgaagcccaggttaaagaggcttgtattcatcagatgcgatgaagagctttgaagtttttactagaagtgtgatttaaagtggttggcatgcaaaatgatttggaacgtttggggtttggggtagggagagagaggttggaagtaggaaacaattagaaggcaaacgctttgggcaaggtatcacattgaaacctgaacagcagtgggacttgctgggggttgggacaaaactaggcagatgtaagcatctagtgaatctagagattagggtgttctgtgaccaagaatgagcagaagacctgctaggctcaagattcaggagattctcaggtccaaagccagtcctcagtctccgaagtcagtcaggcagaagggaagttggatcaagctggccagagttgagctcaggaagtcagtgcactttctcttgtctggttcctgcatcgttttacttgtgtaaaatcatcaagatccctaaaccgatgtctgaacaccaggcttctaggcagagctccaccgtgtgaccttgggcgcatcacttatttcccccaggcctcagttcttctgaaagatgaggggaagaactcacattcaaaggccctcagctttagcgtcttattttaggtgatctgggcagaagagtctcactgtgctcctctccctttcatatttcctgctttggtaggaagtcatctcaagacttgagtgtataggcatgaggaagtctgctagaggacaggaagaatattgcttaaagaataagagctacagccctgatggaaggggtaaattggcctgggaaaagccctgcctctgctacctgcttcccaagtgaccttgaacttaactctttaaacctcagttgctgcatctataaaatgagaataatagtatcttttttatagggttttttttgttttgtttgtttgtttttagacggaatctccctctgttgcccaggctggagtgcagtggcacgatctcggctcactgcaacctttgcctcccgggttcaagcgattctcgtgcctcagcctcctgagtagctgggattataggagtgcaccaccacgcctagctaatttttgtatttttagtagagatggggttttgccatgttggctaggctggcctggaactcctaacctcaagtgattctcctgccttgacctccctaagtgctaggattacaggtgtgagccaacgtgcctggccagggttgttttgagacatgaatgaggtggacctttacaggcacttggttcagggcctgacccgtagtgagcatttgataaatgttacctatctatgttgtcatgggctgggagtgtgggaacaggaagtgtctcatgccagaagcactgtgaattttctcctttaatcattgccttcattttctttgaaccttattcagattgtccatgcctttgtaattgtagaccctctaaactataattagtccaaataaaatggactcaccttatgccatgttcttgttgaagggtcctctttctttctttctttctttctttctttctttctttctttctttctttctttctttctttctttctttctctttctctcctctttctgtctctctcttctttctctctctctctctctctctttctttctttctttctttctttttctttctttctcttttcttgctctattgccaggctggagtgcagtggtgagatctcggctcactgcaacctccgcctctgcctcccaggtttaagcgattctcctttctcagccttccgagaagctgggactacaggcgtgcgccactaatttttgtatttttaggagagacggggtttcaccatgttggccaggatggtctcgatctcttgacctcgtgatccacgctcctcggcctcccaaagtgttgggattacaggcacgagccattgcacccggccagatcttcttttttgtaacatgctaagtaatacaatctctatttagcttgatgtccacggtgatagcaggattcttttcggatttctgccatagttaattattctgcattcttttgtccctagtgtgtcatattgaaatttttcttttttctttgtttttgatgacttctccagttattcatgctagttttgcattcctgtccaagaacatttttgctgcttgtttatttttaatttcataaactaaagcgtttgaggttttaaaaacccagaattgagttttctcagagctgctaatctttctagccagctggtgacgaggcttctcaattcttgttacaggatgatgtgttctgtcctcctgtctgtgctttgtctaatttagattctaaatccacatgtttaggacatttttagcgtgtcaaaatttattaccaaagtagtgctgacttcagggaaaaatttttaatggaatctttagtcactcatgttgacacaaggtgcttgtcctagtgcaggaatctgtgtggcaccactaggtggtgccagactgcatcatttttaaagacagccttttctcttccaactcttttgccactgttctcttttttgcttctttgccaaatttggaccgagctttgaaaacttcatataaactttctcttagtgagttatgttgcttatagcttttccctccaccttgcctgttttagtcttcttgtttcaatagttttgatagtttgacattcagataaaacttaaaactgaagcccaaagtaattactaaatgtatctcgactgatctgtggttttaaattcaccaacagtgcatctccctacttgcttaatcatattgattttgagattaaatcagtctcataaatatgttagtcttcagcccacggtagttctcatccatctgcagactttttttttttttttttttgagatggagtctaactctgtcaccaggctggagtacagtggcgccatctcagctcatggcaatctctgcctcctgggttcaagcgattctcttgcctcagcctcccgagtagctgggactacaggtgcttgctaccacgcccagctaatttttgtatttttagtagagacagggtttcaccatgttggccaggatggtctcgatctcttgatctcgtgatccacccgcttcggtctcccaaagtgctgggattacatgtgcgagccaccacgcccagccccatctgcagatatttttaccagtcctatccactcatgcctgtaccttctaatgttattaaagtcagttttattatcattgatgaccatgagacttaatcaaaaggtcaagctagaaacagagaatattcaaaatttctttccaggcaaacatctgggttcaatagaagctagttcacatgaatggatcatgctctagctctgttgtgctggagcttttttgaaggaatgcattgttacatactaaccacaatttttacattgtccagggcaggagtaaccagttggttgatacttagtcaggggttgtgtttcgtaatctgctagttgtacttgatgtttaggcatttgaaatttaaccttgtgccttatttgtgctgaatttactattgtttcctatttgtagtgctctgcaaaattattctcagtatatcacacatttgtaatcattgccaatcactgaatatcaataacatgctaggtgataagaacttctatttttcagcagcattatcattcccaattttactacatcagagagttcatcattatacagtcaactcatgattattaggagtaaggaacgtaatagcagaccctgaatgagggaaaagaatgtgaaaccacacataaactaaaggtgaagtcatttacatccctgaaaatgattttaagatacagaatgagatgttaaaggatcaaaagaaaattatcgtagcaatgaaaaatgctacatggtttatacaaagtcatgtcaagctcatagactcagagagtggtgttaatcctgaagaccacttgatgattatggaagccgagacccaaagaggttaagtgacttacccagcacagcgggtttgggtgttttatagctgtttgactatatgagctatgattgctctcatgttgtgagctaaattccaaagatattgtcgtgtttgcttttgtggggactgtattgctttcatagcatgatggttgtattgtttctttttgctttgtcatctgtcagtcaactttgaagtgaatcttctttgtttacagcatagtaaaatatggtgattgcatggctcataagagatttacaaatgaagaaactgaggcccggttgagctgcatggcacacccaagtcatagacttgtgtgtggttgaggcagagaatctaggatacagacctccctgctgggttcctcccgctcccataactgctctgcacttcagcgggaaagatgccagaaactgcaagcataaggcctttttttcccctaaaaaactgtaattcatttggttttgaaagacttaccagagtttaaaagctccattttgtggcttcccaaggtgctgtgatttgtttcttactagtctcctttgttctgtggaaaattttcttctttggttgtttgagatttagatttccttgccaaggtatttttagagagaggaaatcagtatgtttcaccaaaggggtaaaatatataccttaaggcctaattatgcaattacatttttaataacgagtgtcataaattcttgcttcattgcaatcattaattggaagactgttctgctcagaagcctcatctagttatcatgattatcatcaacatcgtcaaccaaccacaagcatcaagcatttatggagtatccacagattatgcagcacttgccagggttctgggagacttaatctgtgtgtgtgtgtgtgtgtgtgtgtgtgtgtgtgtgtgtgtgtgtacacccttgccttcaaggagtttgtgatctgcagaactggaggaaagacagaaaacttggggaaagacaagtacctcatttttcaatatgtgtaaagcccatactgattcatgtatgtggcattgggggacatggacagcagggagacaaagggatagatcttagaaaggtctagttacaaataaatggaagcacataagtttgctgacatgggaggacataggctgggttgtaataaggtagggtaattggttgaaggagggaggaagaaattggtgaagagttgaaggcagtaattaaatagatttggcataataacagagatgattggagaactgggagaagaaaattacttgctgtagttgattatggcagaaactgacagggcaagagattacagttgggattttttgcaaagaggagctttcaagtttgtgacatctttttttttttttttttttttttgagatagtcttgctctgtcaccctagctggagtgcagtggcgtgatcttggtttactgcaacctctgcctcccaagttcaagcgattctcctgcctcagcttcccaagtagctgggactacaggtatgcgccaccacgcccaactagtttttgtatttttagtagagacggggtttcaccatgttggccaggctggtctcgaactcctgacctcaggtgatccacctgtctcggcctcccaaagtgctggagttacaggcatgagccactgcgcctggcctccaagtttgtgagatcttgcccagatttaaatgaaggatgtggggttcaggattggtacagcagaggaaaaaagtctctctctctccccactcccctctttttgctgtgatctattttttttcccacacttttcacaggtgttgtcctgtgatctatttctatttggtggatctcttttcccctcatgttgagaataatggctgaggtgtggtgtatcctttaattttgaaaggaaacggcatgatggttttgcggtttaatcatgagacacaagaacagcttttgttgtgtggtgataccataccctgaattgagattatcagtgtcagacatatattactgcacttttttatcttcttcgcttaatcaaaatagattttaatggaatttattattcacttactgtacagtaaaattacttttataactttccattgtgtttttcttgtaaattgaggtatttggcctctatttttcaaaacagacaaaagttgtattcaggttaggtttggatctggtatattagcatcttaaattctcaagtctcctataaacctgttctcttaggccagctatggctgcagaagtcagttatagataaacattgagaggggagatcacatcatcctttgttttccatttctgaaataacggcagacacgtggcacatgtcctgagcctggggtggtgccgttccttttgttgctctatctgtatgggagctaaccttttgacaatttttatggcaaatgctagggcagcttgtgagctaattagaagaaactgataagtgaatgctgagtttgtcgattctctttcattttctgcagaggagacagccgttgaaacggcattcttcgtgtggctgataatttagcccaccagacccctatgaaagggaatattgcttctctcttagctttttccacattttagtattctctttaaagccaacatttctccataggttctaatacctaggcatttcatatatagtagccaaattcagttcactttcttcaagaaagttgtccttttcaaactgtggccttttcctgtcatgggtctggtttcttactcaccccgcactgttgtatcagcaggtactaggatttgattgctgatgactgtatgtcccaaagaaaacagtgggagaaatgcagctgtcaaagcaaaaaacaaatagcagttttaaggttgagtctcaacctggccagttgcaagatggctgttcagtagatgttattcctaatgcttccctggttaatagaactcaatcagtcctgcaggttattggtgctggttgcttcctataacagaaaagtactgcattccagctacgttcctgctgtggaacataagtgcttagtgctatttacttaaaacattctaggttgataaattacaagcccttcactctgggtaaagctcataaatccagctcctacaaaaaaaatagcaagctgatagcacttagtcctgtttataaagttcatacacatctatccatgatataggcacaagtatatatctatgaaatagcactgcagcctgttaaagtaatgggtgagcacagccacaaaggcgagaagcatccgacttccagactcctcctattagtctctatgcctgaagggcaccttgaggaggaggtctgtggaagggagcttccaggcattggagtccacatttgtgctcctttctctctttcttcttcccgcaagtcacctttctcacgccctccacctctctctttccttctgcaaaatgagcatctgcctcttagcctccctcttcgtcactaggctgagatgaggcagggaaccgtggtggatccagagcagtttgaacactttggctgcgtggaaagcgatggggttaaatgagcatttaatcagaaccaggagctgttcttttggcaacctgttgaggaaaaatgataaaccctaacaaaaaggccctcaagtggcacgagtgcagggcctgaaagcgttacgtgccatcagttatccaaaaagaacattttttaaccagaaaataaacatgagactcatcccactagtcctaggttcttggagccccacaggtattgttgcaggatgcatcattgcttcgaatcagtgactgaacaacccagttcctaatcagcgtggagagtcagaattgtcacacgcactgggctgaagctgcatattcagtactgcattgaacattcagtactgcagataggataattatgctgtttgtcagatactagaaaagtgcaaagaacattccttcactttgcaacagcttggacccaagtggcagacctgctgttccctcaggctggcgtgacctccctattgtcagccccttcaccacagctcaactacccccctggctttcaagatacagctcaaacagcatctctcctcaggaaagaccttactcccggagacccaggcccgagttgtgttgccactgtaccctgttctgttagcacttaccaggttgcatttttgtgatccatttacctgtcttccctgtcagacatgaacagggacagtgtcttgtcctcaattcatcatttttctcctgttttgagcacaatgaccaggacgtagtggatgctcaataaaggtttgtcaaatgactgatagtatggttagctcagtgagaattgatggtgccctttgtgatctgtcatccatcatccttggtgtgaagcagggctgggaggctttaaacagtgccacttgagaatctaaggagaggtggcagagttacaattaacaataactaccccttactgagtatttatttgctatgggccaagcactctcttagggtttttaaatgaatcaatgcacttaatccttagatcaatctgctaagacgagttctgtttattatcccctttgcaaagcacaaggaagttcagtcacttgcccaaggtcacacagtgacagtgcagagattcataccaatggagacaaccatcacttatctatattccttttagactagttcctggaaagattaagccctcatgtcctgaggcatccatcttaggtaacaatttaacttctctcttgtttctagaatggtattagtgtgttccctacttgggagaatggagaaaatggtcaccagataactttctgtgttttttggttcagatgagataggtagagttagttgacaaagaattgattttatgtatttatttttattttgttttttttgttcttgattttagatggtagtttcggtccttttggaaacatagcattatcctccagccagactgaactatcctactcccatttcctgtaaggacgactgacctcttttttgcctctagacttgtgcatatgctattccctctgcctggaacatacttacctgcttgctcctctttccccaagcccagtcttcacttggttcctcttttctaccatgagccagtttagatgtcatttccctacctgcccaggataggaggttcccacagccgctgggtgtcctgttgtggcactcacaagtgttatagtgctgaaagcccactcctggggtttttatgtgtgcgatgaaggaggtgattatcttttcccagctagttcatatcctagtcctctgagtgtagagacttgtttctttttccccatttgtcccctgcaccttgggcggtgcttggacacaatgtgtgtgttcactaactatttgtggaagaggtgggtgagcgggagttaactggctttaagtctttgagttttgggtttttgaagtagtcaagtccgtccacagtccgtcctgtggacagccattgtttgccatgtcttgtatgtacacacttgcctgggcactgtggggagcagaaagaggactaatactgcccttgtgctgaggcacctacagtctcgggagatgttcagaggacagtgagtcacttcacagcatcagcatggtatagtggatgagtgatgacactgaagatgagcttggtcatattctggcaagttggctgacacctggaagtcccgtccacaccccaagacctcttttcccagggtgtcctgagaaccacccagagcaactgtgaccaatggcgcttgtttttaaagaagtagaaacccaaattaggaagactgagcaaacctcatgcatttggggaagggcttgttggaaagtggaacctgatgtaggtagcaacatgttgaggttagatttaaccaaacagaaagacttcttaattgcttaaagacaaaattttattttataagtggaattagggctttaaatcaaatatgtttgaacgtctttacttggtttcctcaggcaccttcactcatcttgtctaaaacttaattgctggtctatccctgccagatttgctgcttctccttgattccatctctcctttagtggaaccacctggtactcaagccagacacacaggtgtccctcttaattctgtctcctctggtcctgttcaggcacctgttctgtgactctgcctcttttccgtttctcaggctgccttctctcccttctactgccttccttatgtcaggggttggcctactttctggccttcttgatccagggcttcttttgttcaactcatactccaccctgttgtcagagcccatccagattgcagattggagcctatgactcgtctgctcaagggtcttcaaagactttgcagcttttggctgaagttgagccacctggtcccaaatggagccccattcccgccatgccacctcctgtctgtttaagctttacaagatgacttgcagtttcctgtagaaagcatgacttttaaaaaaagacttatttccttctctcctgcatctaactctcacttgctctttaaagccttctctgacctaggtcttgcctgtttctcctgcagaacactgcttccaccattttgtagcatcagtgtctaacattggttggcatgtagggtgtgctctataatccttgttgaaagaataagtgggaggtaacagaggcttaattcacattgagctgtaaacgagcaatatctgactcttctgagaatggattttgtttcaaacactggttacttactggaaaaggtgtctggggagtgctggacagcaagaacaaagggaccccacagaacaggaaaagaggcactctagggtctgcggtttgcctatgttagatcaccgtgaaaaaggccagtgtatgctttggcagctggcaaagaatcctgtgactcagtttccttatttgcacaaaaagggtatgagtctacattaggtaattactcatgctcatttccaactcttgacagtctacgatcctttgtgtcaaagttaaaaatctaagtagggcattctgaattggtgtcagagttgatgcacttctcactgtattgcaagtgccaaggggacaaatacattgtctttttgcattcaacaaagacagttttgcattttaaaaacaaagtagaagggaatacaggaaaactgcattaatacaattttatgctggagaatttaaactcccatgtcaggaaattcactcatcattcccttggcagcttttgtttctctgcactgcacaccccacttacagacagccccttcttgccaaagcccagcccagccatgaccatgagttatggcagattgggaatcgttaccttgatcttctcaacccttgggtgtttaccttttccaagttaatgcctgttctttaatgttacattatcttgtagcaaggtagtcatttataatttatatactagagctgccttaaaatagagacaagaggataatcagcatcctgaaacttctagttttccaaaataacatttcttcagtgaagtctgcctgtaggaattaaaacttttggtgaattaaaaagctttttgtcctattgtcagactgggaaatggatgtgcccattactcagccttaaaaacgaggaaggagatcatctgttaaaaataaaactcatcattttcttttattcttctcaaaataatccctaaagacctcaatctttatagtgttccagtggccccactatagtcagagaggagacagggcagaagttgaaggacagataggagaaacggccctgctaaaagataaaagccagtatgcatctcagctacttgtctgctgtggtcctgatattcttccatctaggttgctgctttgcttgactttgactgcaaacacagagaagggatgggctttcctgttgagtaccttgtagagaacccactgttcattcatatgtgttaaaaatgaaaagcctacttgaaaactcccctgtagaatcaggttttagcaaaaaccaatcaggtatcagaggtctaacttatttttcccttcttggttttatagcaagtctctaaaccctaagattttttgtttgtttgtttgagatggagtcttgctttgtcgccaggctggagtgcagtggcatgatctcggctcactgcaacctccgcctcccggtttcgagtgattcccctgcctcagcctcccgagtagctgggactacaggcatgcgctaccacacctggctaattttttagtattttactagagacagggtttcaccatgttggccaggatggtctcgatctcctgacctcatgattcgcctgcctcagcctcccaaagtgctgggattacaggtgtgaaccaccacgcccggctgcctaagaatttttttcattccttttcattatatacatcttcagtgtgccaagactttgagtggagatttctaatgagggcaggaagggacggatgcttctgcaattgagtggtctcatttttcccatgtctgtcgaaagattactctttcatgaccaccatttctatgatgcatctcatatgatcctaatgcactcgagtttgtatttgaatgtccatctgatatttaggggtggttggggcaaggagggggcaagcagcaactaaggggttgtatgggaacatcctggtggtttaacttgaaagccactaggtggcaacatttactaagttgccagccattctcttcccttaagacattgaacttgcttttccacatagcagatggaatagctgagaaaagagattgccattgcttcaggttcttttgaaagtgaggctataggataaacacactacagtatattgatatctattcgtcacctgggtttagataccaggagtttgaatttgctctgggtgactgggtgagtagcttcccctttggcctcagttaggcatccttgacaggacagacctgtgattggactgtctggtctctcatggttctttttctccatgatttatgactttgattatgatttctttatattaaaaaaaaacttgtagtaaaaccagtcttatttaaaggaatactagccttttatcaaagggcaaagtaatgatttaaaaaaaaaatcaacaacaaaatttcaagggaatgaatgtccctagaagctagccatctccccgagttaacttaagaggctagactctcctaaatgaggatgcttatttaccagctttcctaaattagcagctttggagatgttaaaatccgtaaggaactgtccaagggatgtattgtgtatgctttgcagtgattaagccattaagctctaattggtattttcccactcatgggtttgtaaaggaagctttaaaattatttaggaattcagtcctcatcagctgtcttagtgtcatccccacgttttggaacctgagagtggagagtgcagagaaaaggttttattaatgatttttgctcacagtgtccttccccattggtttgttattgcagatgaagtggaaagggaaggacctctttgatttggtgtgccggactctggggctccgagaaacctggttctttggactgcagtacacaatcaaggacacagtggcctggctcaaaatggacaagaaggttgggctagaactcgatgaaactggtggggctgacgtgagctttccagtttttccctgagcaggcgcctagctcatcactggggcgctgtagctgtatagtagagaagggggcacattcctgaattaagtcatgcagaaagcaggacgtagagatgctaccagtttccttctcctcacaggctctcctgggcaagcagaagttaccaggattagactgctgctggccctggcttctttacccattgttaccagcctgattgcttctggctttatgcctttcagtttatgaataaaaacttcatgaataaaaattactgttatcttcatatacttaaaaataaccaatttgtgtcttttagagagtattggggcttgtgttctttagggaattttttaaagtctttttgaggaacaccatagtctgacatgaagtaatcattaatatgatctaaggaatagagagtgcctggtccccagggtgaaagaatgtccattttgtcctcaggattctctggggcttctgacacatggccaagaaagctgggctcctggcaattttaatgtggcttggaaatgaatattgcctaaaggaactgccctctgcatgggttcatatgttcacacaaggatacacttgcttactgacctgcctacctagccatgaaaggcaggcggggagcaggaccatatgcttttgtcagtaactcctaaaagacacctgaacttcaaagtaagtcaatgtctaattcttaccccaaatgatgccccctccagttgcctacctgagcataataaataatgaaagcttcctattttttttttttttaccagtttgactcaaagcttaagtgttcgaattgtgttcacatatgtacacagtaatctaaataatcacatgggaatccctgctggttgtaagttcaatggtaattcccaatgatcatgagcatctaagtgccactgggggccactgtcagtgagggtgtcgtagaccagattttgaatctccttggcattgccatctagaatttgggcaggagcatggagagttatgtgtcaaagacagcaaaactttttgtatgtttttcatgattcttagcaaagtgaattttaatgatagctgagtgtaggccaaatggatattagactgggggcatcaggagccgtggaacttgctgctcaagggaaatacatcatgacacatgttaatggagccttgtagcctgtcacatggcgtgtttatgtcttgaaattcactctggagagcagatggttcaagctttacaggggtgaatggaattgttagaagatttaaaggcagtggtttacagactgtgcttcaagtattttgtggggcatctctggaggttccttgaaacaaagggttgccatgatggacacattttattctgttgctcagttaatgtttagatgacttcataatgatctagttcatcatctctaagctgtattttttttttttttttttaagacagagttttgctcttgttgcccaggctgcagtacaatgacgcagtctcggctcactgcaacctctacctcctgggttcaagagattctcctgcctcagcctcccgagtagctggaattacaggtgtccaccaccacacctggctaattttttgtatttttagtagagatggggtttcaccatgttggccaggctggtcttgaactcctgacctcaggtgatccacccgctgtggcctcccagcgtgctgggattataggtgtgagccaccacgcccagcgctctaagccgtattctatcacggacctaaatattggcagtaggcaccaagaaaaaagaaataaaggaagattccactacttcagataattaaaaaaccttccacctaccataaaggacagtgtccaagactgctgagtgatacatttctagtttttaactattctgtggccctgagaacatttatgccttaatcctagctctgctcacttcttggggctattgattaatttgtttcagaaacaccataggaagtgaatattacctcttgctataggtgactttgtgaatacttcaaactgtaaaatcacaactttcaggaaatgtgataaatttagtgggaaaaaaatttaatgcacgccttgcaaaggcttctttgagggtagcacaggaggaagtgccaatatagtgtgtttgtcttttgctctgcaattctgcaggtactggatcatgatgtttcaaaggaagaaccagtcacctttcacttcttggccaaattttatcctgagaatgctgaagaggagctggttcaggagatcacacaacatttattcttcttacaggtacatcagtcaaggctaccccccagttctgagagaacttgcccaggagtggttgcagagttggcctcagagttgaccacaaacacctttgtattgcaaaaatattctacctctggaaggtcagcccctttggttctgtaatggaaaaaaggcttcagaacagaactatacttgagtgatgaaaattggtgtcagatgaaattgtgaaggtgtgatggtgaagaatggatacaagtagctacctaacttaaaacctccttgaaaatgggtcctattttcttctagctaacttaaaagtactcaatagtttcaaaggaaggctaaagagagagtcttataaagcagtagttcttccaaaagtttaaaatctgctctcattaagagaggactggccgggcatggtggctcaggcctgtaatcccagcactttaggaggccgaggcgggcagatcacaaggtcaggagatcgagaccatctggctaacatggtgaaaccccgtctctactaaatatacaaaaattagccgggtgtggtggcaggtgcctgtagtcccagctactcgggaggctgaggcaggagaatcacttgaacctggaagatggaggttgcagtgagccaagatcgcgccactgcactccagcttgggcaacagagtgaggttccgtctcaaaaaaaaaaaaaaaaaaaaaaaaaaggacttcagccgggcgggttggctcacccctgtaatcccagcactttgggaggctgaggcgggcagatcacgaggtcaggagttcaagaccagcctgaccaacatggtgaaactccatgtctactaaaaatacaaaaattagccaggcatggtgatgcatgcctgtaatcccagctactcaggaggctgaggcaggagaatcacttgaacccaggaggcggaggttgcagtgagccaaaattgagtcacttcactctagcctgggtgacagagtgagactctgtcttaaaaaaaaaaaaaaaaaaaaaaaaagaggacttcagagctctagtgacacttggtttgtcccccatatgtggtacttcagacatcgtgcttcatgctatgctgtgtctctaattgtcctatttcttccttaattcctcattagattgtaagccccttaaaggcaagcctcattaagtacacagtaggcattccataagtaattgtcccaccgaattgaagaaattaagaaattcacaattacaggttgaccatccagaggcacagggaggggaactggtctgaggatgaaaaccttatcagtttcacttatgttcttactgcaggtcagagtggctccccagtttcatggccagttgcagtgattggcactggggctatttgtgtgctcaaaggtttcagtaatgtaaaagatggcagtaggggcattaattacatgatttcccagagatagttgggtagtctgtcacatagccctcctgtaattaatttcagcctcagtatattgtggtcagcaaatattaagttaaatataataaaaccccctaaattctttttaaaaaaggtctggggggcgtgtgtgtgtgtgtgtgtgtgtgcacgcgcaaaagaggtgacaaatttatttctgatgtttgcagatcaaagggacactcttaggctgggcgtggtggctcatgcctgtaatcccagcaatttgggaggccgaggcgggtggatcacctgaggtcaggagtttgagaccaccctgaccaacatggagaaaccccgtccctactaaaaatacaaaattagccgggcatggtggcacatgcctgtaatcccagctacttgggagactgaggcaggggaatcacttgaacccgggaggtggaggttgcagtgagccgagattgcgccattgcactccagcctgggcaaccagagtgaaactccttctcaaaagaaaagggatgttcttgcagtttttctatagcgttgctttttcccccctctctttggaaatgaaaccaagggattagaaagttgcactgcttgagaaacatctcaggtttcattttctctctaagaatgtaaaatcacttttaaaacctaagaagaatttttgtgtttgaacgtaaacacctaacaatctcctaggtcccagaatgtcctaatgttatagaaatggctttcttgtaagtacttggaagcactgcctgtctcttgtgtgactgacttgattttccccatactgaaatgttaaggcatttttatgactgagcaaggcaaaatttactgcttttatgaatccggtgactgttgacatctgtgagaggagagctggctttcctgctgtgtttatttcagtgtccccctgccacgtcatgcagttgtcttgcttctgtgtctggaacatcccaagttgcaccattctaagaaaattaagtgcaatgaaatatgttaattcaacattatggcttaagaattatatttcctggacctcacgtgtacttaaaagttgaatcgatcaaattttattgcttccttttcccttagagcagcacgttgagagtgatggttttttctgcaatcataactcagtggccttggtgacttttgtcttgtgttaatacttaaaagtagatccatttcctctggggccatgcatattcaaaggggctgaggctgtagtcatccccagagctgctcttgacacttcttgagttcatagcgctctgtcacacagcctctgttgtaactacagagaccgtttttactcttcagcattgatcatgaagagaagagataaggggtttttatgcatagccgtcataccagtaacttctgtgactgaactctccacctgtctgcatcagtaaaaaaaaaattgtaccctttgtcagaaaattattaacaggctgctctggcagccctcattagaacgccgtgaggccatctgttgtgatcagcctacacacctcacttccactcacagagtatcatgtctcccttgttgctcctttcaggtaaagaagcagattttagatgaaaagatctactgccctcctgaggcttctgtgctcctggcttcttacgccgtccaggccaaggtaggctcaaagaagaaaaatgtatttttcctgggcgttaatttgggtcatgggatcactcctatcttctctttctttgggttttctgtacttcagagagacttgccccagaaagtgagatgttatgggacttgtggacttgaagaaccactgtcactgttccagtgtttgtataatcttgtgtgtgtatgtgtgtgtgtgtgtatgtgtgtgtgtggtgtgcagaaattataagtatcgttctaatgaattagaattcattctaagtgaattcattcagaaagatgaatttcctgtgtaatctcattatgtacatgtggtttatgacatttactggaaaaaccttttttcttttttttttttaaaccataaactcaaccatgtggtacaacctttctattagccaggaaaaatgaatttatggtctccaattttagccaaacatggcctttaggtcagaaaggcccaggtcctcactccaaactcatttgcaaacaagctgccttgtgtgtggacactacactacaccttcagagaatgccctgcttcatctgcccctgattgacatgctagctgttcatgtggctaagcactgcaggtgctgtggcccaccaagcccacttgagctgtctggttagctgaaaatcgttcacttccgttaaatcactatagaccttttttttttttttacaagaccgatgagagggttagccacggagtttcatgtccctcagatttttcacttcagtcatatatcaccttctcttggttcccctgatccctgcctttcaccagagcacaagatgttgtccccagaattggggctccttgattacttgtgtgattttattttatttatgttttatttgtatttttatagagatggggtctcactatgttgtccaggctggtcttgaactcctgagctcaagtgatccttccaccttggcctcccaaagtgctgggattacaggtctgagtcaccatgcctggtcttacttgtgtgatttttttttttttttttattgatcattcttgggtgtttctcacagagggggctttggcagggtcataggacaatagtggagggaaggtcagcagataaacaagtgaacaaaggtctctggttttcctaggcagaggaccctgcggacttccgcagcgtttgtgtccctgggtacttgagattagggagtggtgatgactcttaatgagcatgctgccttcaagcatctgtttaacaaagcacatcttgcaccgcccttaatccatttaaccctgagtggacatagcacatgtttcagagagcacagggttgggggtaaggtcacagatcaacaggatcccaaggcagaagaatttttcttagtacagaacaaaatgaaaagtctcccgtgtctacttctttctacacagacacggcaaccatccgatttctcaatcttttccccacctttcccccctttctattccacaaagccgccattgtcatcctggcccgttctcaatgagctgttgggcacacctcccagacggggtggtggccgggcagaggggctccttacttcccagtaggggcggccgggcagaggcgcccctcacctcccggatggggcggctggccgggcggggggctgaccccccaacctccctcccggacggggcggctggcctggcggggggctgacccccccacctccctcccggacggggcggctggcctggccggggggctgacccccccacctccctcccggacggggtggctgccgggcggagacgctcctcacttcccagacggggtggctgccgggcggaggggctcctcacttctcatatggggcggctgcctggcggaggagctcctcacttcacagacggggcggttgccaggcagagggtctcctcacttctcagacggggcggccgggcagagatgctcctcacctcccagacggggtggcggccgggcagaggcgctcctcacatcccagacggggcggcggggcagaggcgctccccacatcccagacgatgggcggccgggcagagacgctcctcacttcctagatgtgatggcggccgggaagaggcgctcctcacttcccagatgggatggcggctgggcagagacgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccggcccggccaacacagcgaaaccccgtctccaccaaaaaaatacgaaaacccgtcaggcgtggtggcgcgcgcctgcaattgcaggcactcggcaggctgaggcaggagaatcaggcagggaggttgcagtgagccgagatggcagcagtatagtccagctttggctcggcatgagagggagaccgtggaaagagagggagagggagaccatggggagagggagaccatggggagagggagagggagagggcacttgtgtgattttaaaacataatcttttcacttatttttctttttaattaaaggtgttcatgaagccatttcccttaaggttagaaaaaataataaaatactcttaactcactttttggggtagattaatgcaatttcagatcaaagccaggaagtaactgtcatttgtggggaaaaaaggctatacatgctagtcagaccaatagaagcaccaaagtcaatttaatcatttgatggctcatgtaatatttgctgagtattcatcaggcccagggtggggagagagcatgagagttgttgaccatctcatagttgcaggcactaaagcaagtatctgccctcagtgatttgcccaagatcattcagacaatcttgggcaaagctaagagcagaagggtagaattcatggctttgagattgcattttgtgcctccaatattctactttcctgaaaaattagtaattgagaaaacagaaaatgggccctcattcaactaaaacatatgcttccttttatgctttgatcaagaatattagtaagaggaaaaatgtgtcctttcaatcagtatcaccccgacagtgatgaagcagtcattggcactttgattaaatccgagcacttcctggcctggagttgagttccttttcgcacgctttctccccagcgagagcagacccagcctctcaaggacaccacctctctttgaagggcttccatctcaaaggctacattttctttccatggatttttgggccacaaattcaaaggccacctgtagaaaaaaattacttttcagtgaaccagcagatgtttgcttaaacaggtttcactgtaggaaagccctgctaatttggatcgtactaatttggagatgaaagtgattcacagacgacatatgtggctcacatggaggaggatgttctagctattttttctggtgtaaattttaaggatcttacaaataaaggtaatctatggcttaaagtcttcatttgggaaactaaggcttactatgacatacttccagtttctaggactgctggttaatagttaaaggatatctgattataatattaataagatcttacatgcccatagtgttttctagttttaccaaagcaatacaaatgaatattttgtgcgacactcagtgtagtctttccagaagccaaggcttgagagtattatgcctgttttgcagatgaggaatttaaggctcagaaagggatttgtgacttgtgcaaactcacaatacttttatgttaagcctatttttatgaaatttttagcccacttctcgatggagaggatttcaggccaaatagaatgagtggagctgggatgggaaccctagtgtccaggctgcctaagttagcacattgcacttgcctgtcactgtctagcttgagggaggtctttgggtagcaaccactgcctttcactaaaggctagtttcatttatatgatcacatttgtctaagttcttcagtaagtcatactggttccttccattatattcagcttgttttcttccacaacctttctgaaacagaaaggaactttagaagtgtggaagggaaagcgaattgagctcattaacacatggaatgtaattatgcacaaatgtattcattacagtatttcagctgttggaatgatatagacacagttaattccaaagcataaagaaacaattaccctcaaagtataaatacaatactaatcacatggttcagttaacaagaaccatatatgagttatacttgaatcaaaagtgtaggcagggactgggcacagtggctcacacctgtaatcctagcactttgggaggccaaggaggatggatcacctgaggtcaggagttctagaccagcctgaccaatgtggtgaaacctaatctctactaaaaatacaaaaattagccaggcgtggtggtgtagtcccagctacttgggaggctgagacaggaggattgcttgaacctgggaggtggaggttacagtgagctgagattgagccattgcactccagcctgggtgacaaagtgagactccatctcaaaaaaaaaaaaaaaaatgtagtcagggtttttttggtgcagtcacatgacacactaaaccatcttgcaatgtttaagtcacctgttggattgtatattgaccatttggtgttggaaatgtgttcttattgaaaatgactttgggagagaatggcatataatttatgaatctcatgttgctgtgtgcagactcctagtgatcagaagagagaaaagaattgtgggaagggaagcttagtttcttagtactctttaatgcaaatcagggacagagtgccaaagtacaattgagttagaaaattgagtgtgtaaagtgtaggtagagagtggcaagagttgaggctggagaggtatgcaaaaaatcagatcttaaaaggtcttaactttatcctgtaggcgatgcagtgaagggtttatattttagatagagcctgtagtggctgtgtgatggacagattggagtgagacaactttggaaacagggagacctattagaaggctgtgatagttgccctggtgagagaatattaggttcacacttcaggtggttggttggatgggggctgactgatttaaaaatatccaggagataaaaagttgattagatggtgctatactctgcatatccctttttttcatatccttttacagaatggtatttttcttcccactcagcatctactttgagatgtatccatgttgtgtgtatagatgtagctcactgattttaattgatttaatatggtaaccactgataaataaacctagtttatttatctgttcctcttctgagggagaggtagtttgtttccactttttccttattatctaaacagtgctcaaatgaagatccttttatgtgattccttatgtacatgtgcaaatgctttttccccttaaggtaggtgcctacgaaaataaataaataaatacatacatacaaaaaatagctgggtgcagtggtgggcgcctgtagtcccagctacttgggagactgaggcagaagaatcgcttgaatccgggaggcagaagttgcagagagccaagatcacaccactgcactccagcctggacgacagagtgagactccatctcaaaataaataaataaataaataaataaataaataaagtaaaaaaattaaaaaaggtaggtgtctagaagaagaattgcatagaattgacagaagaggtgaaccccaatataaaaaaaatcttaagttgataaaaagacaaatgctataaacagggcatgaaacatgcactttatagaagagaaaacaagaatggtcataaatacaaaaagatgtttcatctcacaggtaatcaagaaaaagaaaaaacaacaataaggcaacatttcaaacccataagattggcagggattactagattgggtaactgcattgttggtgctcatttacctgccaaagggattgtgaaattggcataacctctgtagagcaccaagtgtggaagggacgggtggaagtgaggagacacaccgctggctgttccaggtggctactccagaggaatctctgcacacacatccttttcacttaaaactgtcacaacagatagacccacttcattttctttttctttttgagacagcagtctctctctgtcacccaggtggcacaatctccacccactacaacttctgcctcccaggctcaagggatcctcccacctcagcctcagcgtatgccctgctaatttttgtgttttttgtagagacagggtttccccttgttgcccaggcaggtcccaaactccagggcacaaactctatacccgcctcagcctcccaaagtgcagggattacaggcatgaatcactgcacctgaccccagctcattttcatttaactgccgaactatgtttcatagaaaggagggactggattatttaaatatatctttattggtagatatttaggtttgtttttctttctgttgtttttctattggtgaaacagatgcaatggacatccttgaatatgcatctttgggcatatatggataatatctctctataatagatatcaagacatggtataactgggttaaagaataagaacatttaaaatgtaagtaatgtgaagcaaaaaaaaaagccagacacaaaaggccacatattttatgcttccacttacctgtagatgaaatgtccagaacaggcaaatccatagagacagaaagtagatttagtggttgccagggaaagggagaaggaggaaattaggagtgactgatactggccaggcacggtggctcacacctgtaatcccaacactttgggaggctgaagtgggtggatcactggaggccaggagcttgagaccagcttggccacatggcaaaaccctgtctctacttggccgggtgcggtggctcacgcctgtaatcccaactctcagggaggcaagaggtgggaggatagcttgagcccaggagttcgagacctgcctgggcaatatagcgagacccctttctccagaaaaaggcaaaaacaaaacaaaacaaaacaaaacaaaagacaaaaaatatataaaagccagctgtggtggcatatgcctgtaatcccagctactcaggaggctgaggcacgagaatcacttgaacccaggaggcagaggttgcagtgagctgagattgcacccctgcactctagcctggggtgacagagtgagactctgtctgaaaaataaaataaaaataaaaaaggagccactggtacaaaaaaaaaaaagaaaaaatgagtaagacctactatttgatagcacaacagggtgactatagtcaataataattatacacttaaaaataactacaagaacataattggattgtttgtaaaacaaaggataaatgcttgaggggatggacaccccattctccatgatgtgattatttcacattgcacaccgtatcaaaacatctcaggtaccacacaaatatatatatacctactatgtacccacaaacattaaaaattaaaaataaatataacttacaaagattaaaaatgaaattagaagtgatggctagtgggtacaggacttctttttggggtgatggaaatgttctggaattagatagtggtgatggttgcacaagattctgaatatactaaaaaacactgaattgtacacttaatgtaaattttatgtatataaattttatctcaataaaaaatttaaatagatatagccaaatcaccctccaaaactgatgtcataatttaactttcaataacagtgtgtgagaatacctgtttttccacattcttgcgaacagtagatactatcagtctttaaaatttttgctaattgatagaaaaagattttttaaaatttgcatttccttgattgctattgggactgaacgtcttttcataaacttactgtccatttgtatttctttgttctgtgaatcaaccgtttatgacttgcctactactgtattgtttgtttgtttctttctttttctttctttctctttctctttctttctctctctctctccttcctccctccccttccttttctttcctttttcttttctttctcccttcccttcccttctctcccctttgctcccctcccctccccttctgtttctttttcttttctttcttcctttcttcctttcccaggttcaagtgatccatccgcctcagcctccagaggagccgggactataggcatgcgccaccatgccaagctaatttttgtatttttagtacagatgaggtttcaccatgttggccagactggtctggaactcctgacctcaggtgatccatccgcctcggcctctcaaagtgctgggattacaggcatgagccactgcacccaacctgttcatctttttccgattgatttgtagatgctccatgtattatgagttatcaaccttttgtctattttacgtataggactggtcaatctttttctttgtatgttttgagtgacttttagaatgcgtttaccaaccattattatatccatactctgttatgttttgttctggtatttttatggattttcatttataggtttaagaatttattgactggtgtgtgggtatagtagggagggggtctgtcttttttctatatatgtagtaatctaacctttatgtttttgtgaaatcctactcagagcattttatctcatttctcatagttatagacaggaaattatttcatatccagatagagcctccgtttaacctaagtattggctccacaagtcttttaaatggtaaactccttgaatttaaattcaattagtttatgtcacgagtaggtccaggttttctgggtctgaattttaataatttaggggattgtctttaatgcaagagtaccaaattaggtacaggcatatgaaggtgcagagacctgaaatccaagcttccttagcttcccagtaaattcaccctggttacattatcagaatgcatctgttacataaaacgatgaggagcagccatctccatccctggagtggtatgactttcttttgtattcaccagctaccacaacttcaggatttttttcttcccttgttgtttaaagagacatttaagagcagacacatacatcaaggtggctttaatgttggaagcagagttagtccagtggagaagttctttcagcagggtctttgccacctctgcattgctcaaatgtgatgtatttgatcagtggactagctgagaacttggtataataatgggggttgttaatcttgcatgcctttggaacctgaatttacagctttaactttgcatatctgcttgcttttgcattagagcttggtcagcactgttgagagatttgcaaatgcaactaacagggctttcttttagcatcctaccctttcaaaaatccaggaggcaaacaatgatcaatgttgtcataagtaatgcagaggatggcaataataataatacctgactttcaccataagccatgtgctgtgcgaaatgcttacctgtattgttttacttcatcctcatcatcccctataaggcagatgctattatgaccctcactctacagatgaggaagttgaggcttagagagaggatgccttactcaaggcctcagaaggggtacttcagcacccccccacttcccttcaggatcctctaaggccagtgctctcatttgacaaatgaaagacagatttggagagacctgagatcttttggacatcaggtttatgtgtcaagcatagttttatttattttattttattttgttattttttgagatggagttttgctcttgttgcccaggctgtagtgcaatggcatgatcttggctcactgcaacctccgcctcccgggttcaagcgattctcctgcctcagcctcccgaatagctgggattacaggcatgtaccaccacgcctggctgattttgtatttttagtagagacgggtttctccatttggtcaggctgctctcaaactctcaacttcaggtgatctgcccgcctaggcctcccaaaagtgctgggattacaggtgtgagccaccacgcccagccaagcatagttttaaaaactttgctggtcttatttaattaaatccctgtaagagtcctgcaagataaatactattattattcctgttttacagatgagaaagctgagacacaaaaatttccaaggccacatagctactatgtgaaagatgtaggataaaaccttaggcagcctgcctccagagccaggctcctaccctcactctacagctgccttgcagggagtactgttaaagcttagtacagttacgacttactgcatcacatctctgagcctcccagaaatagagagataccaaggcctttcatttataatttctaagttattttttatttttatagacagggtcttccactgtcactcaggctggagtgtagtggcacaatcacagctcactgtagccttaacccgtgggctcaagtgaccctcccattttggcctcccaaagtcctaggattacaggcatgagccatggtgcccaccctatttttttaaatgaagaaatgcctaaactgtgttacaaaaactgtggcatgtttaaaatgtttaaatttgacaaattaggccaggcgcggtggctgacgcctgtaatctcagcactttgggaggctgaggcgggcagatcacaacatcagaagtccgagaccagcctggccaacatggtgaaaccctgtctctactaaaaatacagaaattagcccggggtggtggcgtgcacctgtaatcccagttgctcaggatactgaggcaggagaattgcttgaacctgggaggtggaggttgcggtgagctgagatcacgccattgcactccagcctgggtgacagagcgagactctgtctcaaaaaaaaaaaaaaaaaaaattgacaaattaattctcttaagattcaaaaaaaacaatgcaatacaattctgctatttgaaagataattatgagattcaaaagaaatatgaattcatggggcttttacagttaaggtgatatgggaatgagacatgatttaaagttaatgatgaatatcttctttcactcctgtgtctgtagttttaggccgcttcatttggagaacacaccagaagtcttaacttgaggctctttgagaatgagagaacataacgaaataatgagatttggtggtatatagaaacagcagccttgtgcctgacctttgttttttcactgttggtggctaaaagaataaatgtttatagattatactgaagtactgagctttgttgtttttggtaaaatgaagagccactgtacgctgattgataagagataggctttgattttatattctactgtatgtttcagttagtttctttttaaacattctttaacttttgattatttccttatcagacttgagttttctaggaaaggagtttttttttttaatcagagaataaatttccaagtcattgtccccggagggataaattaaaatgcagggcctatttccaaccgcattagtgacttctctgtagctttaggaagatcaattaaccttttactcacttctttgtctgtacaataggaatggcagtgttgacatcagatttttccaaagtatttttcagaaacttgggtgaaaggtattaaaactactgcctgcattattcctggatccccctagtaatgggctccaattaccagtcacttataagaatttataggtaagactcttatcatatgttgttaatcacaactttcacagttgtgatttggtgttttaattcaaaagctactgttttggaagtgactgctttctttgagggttagaaaacatgcccacatttccatacaagtgtcacattcttgttagcacatcacccatccatctcttacaggattatgcaactcagttcatagatataatcagctttgtattttcattcaaggataacaaactagcaaggttgaaatcttgacttgtcatcggaattgaattgctccctggagctgggagggaatgagattggtccagctctgttcagaaatggcagttatctttagaatctcaatcgcctgctctccctttcttctttccagtatggtgactacgaccccagtgttcacaagcggggatttttggcccaagaggaattgcttccaaaaagggtaagagattaaattcccttttcaggaagacatagcagatatgtggtctaaaagaaagctaaccaaaggacttgaaggaatattggaagtacatagcaatttaattttaataaatattttgtaatctccagtaaacagtgtgggatctctgttaagaatattaaaaagcaaaggtttttggagttagtttggggtcaccaggactagcatggcctgtaaatgttttttctagcgtggttgttttttcagatgcagttgagcatcattgattcccaaagaggaggctggagcagagtgtattcagcttggggaattgagctgtttgcagtggcgaggggcggatagaggagatgaggtaggggtgggcattgtggtttttaatcctcagtgttgttcatcttattcattagccacagaagcaggcccgccctcccttttgctcctgccgattttacagccctcactcatctgtcactgggtaataaaggcccgtttctcacctctcactctctttacctgtccctcgatggcttctgagcatgtgaaggcctgagatgagtgagcattgcttctgactgagctccgctgtcagaggtggtctctgtgatgtatcgcccaggcagggacaggggcactgccagatgagggttgcacctaggtctgagttatcatgcagctttctgagttgctcctccaatagaatggtgccttatttacacgccctctctctgtgtgactatctccctgggtgtagctttttaaaaatagctttactgttttgtaaaaatgatgcataattataaaagtggcaaacaataccaaatttacttcatgtgtaggttttttattttgctctattttttggtaggtaataaatctgtatcagatgactccggaaatgtgggaggagagaattactgcttggtacgcagagcaccgaggccgagccaggtgaggcccattcattgttggtttacattcctttatgggcttttttttttttttttgccttaaagaactgcaaaactaggacatgcttgttaaacaaaatgcagtactgaagtctataaaagaaaaggggagagctggggagctgggagtaacgttggtcttcagttttgtgtgtgtccttttctagtacgtatgacataaagtaggtatgtgtactgcctgtcaagatatatagacctgtactcactggtaattaagtttaagatttttttttttttttgagacagagtcttgctctgttgtccaggctgaaatgcagtggcgccatctcagctcactgcagccttgacctcctgggttcaagcaaacctcctgcctcagcacccccagtagctggcactacaggcacacgccaccatgcccagctagtttttctatttttagtagagatggggtttcaacatgttacccaggctggtcttcaactcctgggctcaaagcaatctgcccacctcggcctcccaaagtgttgggattagaggcgtgagctgagccactgtgcctagcctgaattttaagaattctattgtatggctatcccattgcttttgcatccatccctttattgatggcatttgagtatctgtaggtttttcacttttacaaaaatttctgcagtgcacaatcttttatttttatacaattgtatgagtagttctggggatatattctttttttttttttttttttttttgagacggagtctcactcagtcacccaggctggagtgcagtggcgcgatctcggctcactgcatctccgcctcccaggttcacgccattctcctgcctcagcctcccgagtagctgggactacaggcacccgccaccacgcctaggctaattttttgtgtttttagtagagatggggtttcactgtgttagccgggatggtctcgatctcctgacctcgtgatctgcctgcctcggcctcccaaagtgctgggattacaggcatgagccaccgcgcccagccaatatattctttaaaacaagagttgttgggacaaaggatgtgagcattttgcattttgccaggtaccaccaaattgttctccaaaaaggctgtacctgtttatacatgcctgtcgacaagtgttatgagagtgtcccaccccccacccccagtctatcctcaacaattgtttttatcagtctaatttttgtaatctaaaaagtgaaaagttgtattatgttagaattccattcccttgattaggaattggtcatgttttcattagcctttaacatttttttctcttcttcaaatcagtttcctaacacttttttttttaaacttaagtgcaacatgcatatggaaaagtagacaaattataagtatacaacttgatcaattattgtaaggtgaaaacaccagaggaagaaataacctgtgtctccctacccccaattcccctttcttcctccccaaaggcaaccagtctcctgatttttaattccagattggcgttgcccatcttaaactttgcattctgttttttgtgtctccttttactcagcatcatgttgtcagattggggtttgtggcatgtggcaatagttttctcattttcattgctgtatagacttccactgtattagtatattaaaaattatttattcattctactaatgatggacagttaggttgttgggttgtcccctgagttttgctattacaataatgtcaaacaatttcccaaagtaattgtaccaatttacgtcaatgtgcatgatttctgatttctccaccttttcaccaacacttggcgttctctcaggctgggtttttaaaaattcattgagagcatttggagattggagagagaaggaagaggacaaggtcatagggagacttgagttaaaatatttcagtatgatacctgtttgggagttttctgcaagttattgctacttcaagagcttactttaaattataacttagatgaaggtgatctgacttgggttttacaacccagataactcttgccctaacctccaacaatactcaggaagcttgcagagagagctgtttcatttccagaaccttccaggtaaagaaagtacacaaaggaaaagcaagaacttaaataaaattccaacacccaaatctgtttgagggtagaagataacataccacacactcttgttgaattacttgagatgagtttactgtttaccaagggcaaggtgggaaactaaggccaagaaactccgtgatgagtctgttctctgactatcttttgatggggatgggaaattctgcttgacctcagtgtgtttaatagactcagggccgggcagagctttgctggtgtctgctgtggcttttgtcttctggcagcgacgtggctctagaggaatggcagggtcagaatgcttgatttggtgcccacccgctctccacccatctcacttagctccaatgacagtgtcttccgttctccccacagggatgaagctgaaatggaatatctgaagatagctcaggacctggagatgtacggtgtgaactactttgcaatccgggtgtgttgaaacctctctgagctccttgtgtagtagacagagactgagtgagggccagactgctaaaatggttacttcttcattccaaggcgatagactcttttatggttctgtggtaaagaaggaaagaggaaggaaagagaggtcttagtgcctaactttctatttttggacttcaattagatcataggtaattaagtgtcacttgagccttgggggacttggacctggttctgctctcagcagaaacctgtttgaatgctctgagtgtaagatttgattatttctggctctgtgagatctccgtccacagggagcacttgtaagtacttctccccccaacacacaccccacccccatccccacccccacccccaccccaggcactagtagagtagatctgcctttatagattactgatttgtttgggattctcactatgaggctaattggttttctattcagactattaatagtctgctgtctgctgggaacccactgcttctgcagggagaggcatttgtgtgcagcccagatctgggcctttagaatgtctttctcctgtgggtcagtatctggatgcagtgtataggcagcttcttacaaagggatgcatgcgatttgccaaagcatttcactacggactccaaactgcagatgagtagatgttaaaacaatgaggcgggtccacctttattttcatagtcatgctttgctttcccttattgggttcctacagttgttgtattaaattcaggtaaattgaaacatattttaaatattctaggatagctttctacttcatttgtattttgtaaatacagatttgtatggattacactgcataagaaaataaggcacacttaaagtgcctaaaagatgctccataatagtacaggaagttcttttctaaagttctgtcagtttgtatttgctaattgcttggtttctttaaggtcaaactaatgtaacacatttctgtggttttgtcaactcaactcctcttgccccatgttctggccacctagattctagaaaactaaagttttataatcctcagaaaacagtttttttggtttttaaaaatcttttttgttttttagaggtggagttttgctatatcgcccaggcctgctaggctcaagtgatccttccaccccagccttccaagtagctggggagtatcactgtgcctggctgaaaaggtttcttattagggaatatttctacatcagtcagactaatggatactgttttttgtgtgtgtttcctatattgagcaatagacaaagctactggctatcttagtgtcttttatgttaaatttcctgaaatctcaccattaactaaggaagatgtatgcttaaaacagtttaaaaggggctgcttgagtcctcacctctctctctgtttaatctctaggagtgttggagtcataatggtaggaggcagaaggctgaatctttttttaaaaatttaaactaaatagtcagaaactattttctgactattgaaacacaatgaaacatctcattttccaaaatgtactgcagatgtaaaagtacaaagcctcacttctattaatgcagtagctttcatggctttgctgacgagcagaagagtctctcatggtttggtgatagcacctgacttcaggatgttaggagtaaaaagatttatgctggagtactcactcctcagtctgatatctgctgttagatgggtacttctcttcacagtcccagtaccttctcagtttgcagacctgtttttctgcccttgagtcttggttcagtttccattatcgtcaaggggtcaggagctgtagtatccttgtgcagcgagtttccttccactccaaatgagggctagaccacagcactggcgggtggacctgcacgtgaagatacagccactcagtccgtcgcaggttcagtgctgtgggagcccagggcacccgccgcgggctgctctgactgctggccaggaccgctgtcaggggcagagcataagtacggcttttagacaactttgttgatgaatagaattctttttgatatgtatttcccatcatgcaattattaaaaatttcaaacttacaggaaaactgaaagaatttttcagtgaatacccatatatatgcacaatctagattctacagttaacattttaccagacttgctttatcacatgaagactacattttatcataaaatgagaccatccagccccaggcactgaaaattttcttcctagtagtccaacaatggtttctttaaatataagaaatcattaaacctatgggttttttttgttttgttttttaacgaagtctctctttgtcgaccaggctggagtgccggggcaccatctcagctcactgcagccttctgggttcaaccagttctcctgctcagcctcctgagtagctgggattacaggcgcgtgccaccatgcccggctaatttttttgtgtgtatttttagtagagatggggtttcaccatgctggccaggctggtcttgaactcctgacctcgtgaaccgcccgcctcggcctcccaaagtgctgggattacaggcatgagccactgctccccgcctaaacctatgggctttaattctatacctatgatagcctgcttatttaaccagagggaacaacacttatgttactcttcctttagccatcgagccagtgacagaagccctcagtgattgttctgggggacccagaagtcacaagaatggaacagttttgcttctacctgccccaattcagaaagctgaaatcttcttggtttataagacagctgtgacttctgttgggacctgctgaaacttgtcacatgtgacagtgtgtgccagattctttggaaggttgaataaaattttgagcctcagctggcgcttacagtagctgttcttattggatccacagaataaaaagggcacagagctgctgcttggagtggatgccctggggcttcacatttatgaccctgagaacagactgacccccaagatctccttcccgtggaatgaaatccgaaacatctcgtacagtgacaaggaggtaggacatgtgtgtactgcagatgggtccagcagatctttccctgtctgcccccctcactggagcctccccagccagggcatctccttgttattcatagagtcctttaattcccaggctttgagggtgtggttgttgattttcgaagtctttacagaacagtattggcatcaataaccccactatgactaataggaaactgggaagctcaactggccagggagaaaccccaaagaatagtgaacaaaaacagtaacattttcttattacttggctttctatttttgtcgatacattctctttgtatgttttcttttcttttttagagacaggatttcattatgcatgcccagactggatttgaatcctgggctcaagcaatccttccacctcagcctcctgagtagctactacaggtgtgcgccacagcacctggcttaaattctcttcgtattttaagtgtggtctttattgagctttctttctgtgtccggtgcttgatacatgtggcagagaaatacatatacacacatatacacatatggacatatatgtgttttgtgtgtgtatctctcagtaattatataaataagtatattaggttaatatgcttacaagaattccaaaataattaaggtggaataacttagataaatgctcttagaatttaaatatttccatatagggtggtgacttttaccaaaaaggtcccataatgtataatcttatgtttactcatccatccattcattcattcactcatccattcattcattcttcattcattttattttattattatcattttttgagacaggctctcattctgtcaccgaggctggaatgcagtggcacatgatcacggctcactgcagccttgacctccctgggctcaggtgatcctctcacctcagcctcccaggtaacagactacaggcgtgtgccaccacatctggctaattttttgtagagatggggttttgccacattgcccaccaggctggtcttgaacttctgggcttgagcaatcctcccacctcagcctcccaaagtgctggaattacaggtgtgagccactgtgctcagcagttcttcattaattttaaaggaattattgagcatctgctttgtgttagatttcatgggggaaacaaagatgtagaaaatccagtcttagcattcaaggaagtcaagtaactactcacctgctataataaataagtgccgtggaagagacatgatgacaacaaatgtagtcttccacatacaagcacattcaccctgaccgtctgaatttaatctctataagaacactgctgtaaaggcaggggctgtgttgtcaatatctctgtgtcacatcaggaagcagagacacagaaggatcaagtgacctgtgtctgagtgaagtagcagagattaggagccagagttgctgatgccacagcccccgcctttcagggaggcccagaggctgagtcctgagagcacaggggcactggggagagggaggctccactcagtgacctcctggtacctgcacagccaggacacagactagagagtgaagaacaggaacagcttatgttgctgcctgcagagccccaaacctgagcatatttcctgttttctctttttcatggcaactcaaggaagggaacaccaggcccctggtttccagtatatggttgggatctactcagccatgcttgataagacagactgagccccttaattcaaaacattctgactttgaagtttttgttagtagttagcccaggagataagcagttaggtatttcttttttaaagtacttaaattgaaagttccacatgacataaagctgtatgtgtgccaccgtatggtagtttttcatctcccaatttcataaagtctgtttattgcacgtccacacatttgtgtgctaaaggctccctaaacacccgttcttcaaagaagccaaggattgaaatctcccatactatggcctgacacagtaaactctaatatgccctctccgggggacaggcgccatcatgttccatcatgtcaataactcatgcagtaagcagaccccaagctgacttgacataaaagaagtagtcttggtagttatgcatgacagccatgctgtcaaaacagaaatgttagtttattttaaatgatccattgattctttgtgtacgccctggcatggtgcagagcctgcggtttccccactacttgtggtttcccaatgacagctccagggtttgacagcaaagccaaaaataagctcacaaaattcatgaatagcagcctacacaagagcaacactgcttctaagttaacttggctgaaagctaaacaaaggatcattttctgtcctcagtgtactaaccccttcttgggcaatataacgtgtgaaagaaatatatcttcccaaacatatttatctgcttagcaagtctttcttgggaatggatatccattttgtaagtgcatcttggaaatctaggatctgtttggtcttatcgggagtggttgagagcagcagccatttgttccttgcaggctttcctgctagtggtctaaccctaggttctcctaccaagccaccaccctgtctttatcattcatctttctctccattttgatttcagcatcaagaactgttttcccttctactatagtccattttttccccatttgattctattaacagcttttaccaaattattcccatgttcagaaacctgtggtgagctcaggtatcctgtcacatcaaacctaaacccttcttttttttgagataggggtctgctctgttgcccagcctggagtgcagttgtgcaattacagctcactgcagcctcaaactcttggcctcaagcgatcctcctgctttggccttccaaagtgttgggattacgggtgtgagccaccatatctggccgcctctgacttttattctcactgccagcccctacacccaccccttcctccctctcaggctaaacctattatatcatcttagtcaccaaaaagctaataccacacacacacacacacacacacacacacacacacagctcatttccctgtctctaccttatttctggttttgccctgtgcagaatgccccttcacctgccttttagctaccctgttggattgttcttctaagatcagcttcactctctcttgcttatggtggatctactctgaacctccacatatttgtgatttgtaccacccagtgaagcactaatatttgatgtgatttcttgagtaattggctgttgttagcctagttccaactagatggtgagcttcatgaaggtgggcccatgccctcgactacagtagccctccagtgttggcctcagggttgggcccattaaggatgcttattttaggttgtcaagaatcccttcccacactcatgcctaagatggtctagagagcgtacctttagggtcctgagcttccacagcccgagacttggtgctcctaattccctgaggtttagtgcctggatactgggaagccaggacaaggcataacttcatgctggtctgtggccagtgtggttgcgcatttgtggaatttccaattgctggtaacattccaggctgtcggactgaaactgtgttctgcttcattcttccagtttactattaaaccactggataagaaaattgatgtcttcaagtttaactcctcaaagcttcgtgttaataagctggtaagttgagatcctggttttcattactgataatggtagcttttctgagaattgaatacttctttttaaaggatatcagagtgacatcttgtgaagtatagaatggtatctcacttggcgcatactttctgtttagcttaaagagttaaaactaaattatatcatgaagaagtttttttttttgttttttttttgagacagagtctcgctctgtcgcccaggctggagtgcagtggcagtgccatctcggctcactgcaacgtccgcctcccagattcaagagattctcctggctcagcctcccaagtagctgggattacaggcatgagacaccatgcccagctaatttttgtattttcagtagagacggggtttcaccatattggtaaggctggtctcgaactcctgacctcaggtgacccatccgcctgggcttcccaaagtgctgggattacagtcatgacccactgcgcccagccgatgaggaatttttaaaaaggatttttaatgcagtatttcatacatataaaaggataagtgtaacatatgaattataaagaataacaaaagtgaatagctgtgtacccacaaccccactttaagaaatagcacagtcctggccgggtgcggtggcttacgcctgtaatcccagcactttgggtggccgagacgggtggatcacaaggtcaggaaaaaaaaaaaaaaagaaaaagaaaaaggaaaaaagaaatagcacagtcccaatactgttgagacccttcatgttaacaccctgctggtctctcctttccctctccccaagggtgatcactgttttgagttgagtattcatcatcctcttgcttttcaacagaattttatttcatatatggcaaaagaaaaataccattcaatgtcatatgtttatgaaatttatctaaatgctgtcaagtatatatattcttttgtcattttccttttcctttttcattatttttttgagatatatctttgttgatgcttaaagatagtctgttcattctcacctctgtagcactctgttatatatttttctgattcttctgttaatggataattaagtgctttttacttctatacttttttttttgaaatggggtctcactctgttgcccaggcacaatctcggctcactgcaacctccgcctcccggatttaagcaattctcctgcctcagcctcctgagtagctgggattacaggcggccactaccacgcccggctaatttttgtatttttagtagagatggtgtttcaccatgttggtcaggctggtctcgaactcctgaccttgtgatctgcccaccttggcctcccaaagtgctgggattacaggcgtgagccactgcacccagccacttctatactgttttaacaggctgttatgaaaacttttgtatctgcctcctggtgcacataggcaatagtttctttggagtcttgagtatactgggctaggtggggtggctcacgcctgtaatctcagcacttggagaggtcaaggcaggataactgtttgaggccaggagttcgagaccaacctgggcaacatagcaagaccctgtctccaaaaaaatgaaaataaataaaatttttaaataataaaaaagagggccaggcacagtggctcaactcctgtaatcccagcactttgggaggctgaggcaggcggatcacctgaggtcaggagttcaagaccagcctgaccaacatggagaaatcctgtctctactaaaaatacaaaattagctgggcgtggtggcgcatgcctataaatcccagctacttaggaggctgaggcaggagatcgcttgaacccaggaggtggaggttgcagtgagccgagatcatgccattgcactccagcctgggcaacaagagtaaaacttcgtctccaaaaaaaaaataaatacataaaaataaatcaaaaatagagcttagagtatatacacaggagtagaagtacagggcttggtatatgtttaaatttcaaaattatgacacattgttttctaaagaaggtgaatcgatttttacagacccaacagtagtgggtgaagtttgttttttgctatccttaatacttgtattatcagccttttaaaatttttgccaatcttgtgcatctaaaatggtatctcattatcaaatgaactttttttttttgagattttgagatagggtctcactctgttgcccaggctgaaatgtaatgacacgatcatgtctcactgcagcatggacctgcccaggctcagtgatcctcccacctcaccctccccagtagctgggactacagacacacaccaccatgcccagctaattttttgtattttttttatagagacaaagttttgccatgttgtccaggcttgtcttaaactcctgggctcaagcaatctgcctgcctccccttcccaaagtgctaggattacacttcccaaagtgctgagccaccaggtctggccaaatgttttgagttttttgtggagatggcgtctcactatgtcacccaggctggtcttgaactcctgggctcaaggatcctctcaccttggcctccgaaagtgctgggattacaggtgtgagctactgcacctagcctgttttctttattggctatatcttccagtttgttgctctttttctttttttatgtcttgacaataagaatttttaattttaatgtagacaaatatatacattttttccttaatcactttttgtgtcttacttggcatcttctcttatcctatgatcataaagatattcttctatattgtcttctaaaagtttcaagggcttaatctttgcatttaagtatttaatccttctggagttgatttttgtgtaaggtgtaagggagggatacaacttatttttttccacatgcataacctgttgcctcagcccagcttactgaacgagctttcctatcctccctggtctgcagaaccacatcttgatgtaggagagtaaggtgcacccagaagacatggtgaagtgtcctccagtcctctcttgatttatgatttttacctcctggcatatctgaggcgccttcattttgcatgtttccagagctgacggcactagaggccactagtagggctttggtgtttcactctatgcattcatcttcacgtttactgctacctgcaagagctcaaactgctatggcactagtgggccagtaggcagtgaagtaaatttgtggatattaacctttttgtctgcttctgtggccacagattctccagctatgtatcgggaaccatgatctatttatgaggagaaggaaagccgattctttggaagttcagcagatgaaagcccaggccagggaggagaaggctagaaagcaggtgagcacaaccttgttttaactgatgatgtcactgtgtggtcagtcctggcctgggaggcgaggagtggtcatgggctggcaggagtcttttggccgtggacatacctgctcttgttttataccttttggatcttcatttgccgatgcctacctggtgggatgtcatctctggaaatgaggaataaaccctaatagcatatctaaaagaaacatctctagtaatttctacgcttggagaaattaagtgtgattaacaccagtttgggatgaaatagccaagagtgcatgcatctatccgtccggctagctagcttgctttctttttttgcctgtctgcctccttgtgcagccttctccttttctaattagatggtgatagaatgccaggtggcatttcagtgcttgcggctggaatgctaatttgactctggctgcaattccccactgcaggtcaggccttatggcatgtcacctgccccaggaggtgccaggagcatctatcagcagactggatgatctgcatcattgttttctactcataaaccttctctgctcatggaaatccacacaactaatttgggccttactgctgagaatatcaattgtgtttttggataaactactagatagagtagcagcagctgcagttggctgcccgcaggacttgcaagctcagaagtgtaataattagtctgtgtgcacctttctgatttggatacattggagaggctggtcccagccctaggatttagaatgaaatgcccagtgtgctttcagctctctatctctttgctttctgaggtagtgggccacaaatgtgttctttgggatgctttcagggtgatgggatggatttgttggacaaagaaatcctactgagccagcatggggtcatagtggcagtttcatgaagagctcgtggcagtggctcatccctataactccagcactttgggaggccaaggcaggaggatcacttgcctaggaatttgaggctgcagtgagctatgattgcaccactacattccagcctgggtgaccaagcaagaccctgttttaaaacagaagcagaaacaaaataccaaaataaataaataaataagtaaataaataagaaggaggaggagagctttctttgacctttttcttagcagagcaaagcttagaagtaagaaatctgaaagtgtcagggaatatgcagtctgtgggccctggcagagaatagcaggaacactgcagatcggcactgcttacagcacagcagagccacaaacctggcatctgggcaaccacagatcaggtggacagacactgaccttggagccagatctgaaatttagaatgtgagtaagtcaatgacttaccttccagaccttagttttctcatccatcaggtgaaactaatgatataccttctccatctcagatgaagggacgtatattacaccttacagtctttgtatgcagtaaacttcttttgtgaataggaggtcttttatattggggtagaggtctcagggaaagtacagggccaggaactgaaggagattacctggcttttttttttaataaaagggtcttgttctgtcactgaggctggagtgcagtggtgccatcatagctcactgtaacctcaagctcctgggcttgagcaatccttctgcctcagcccctcaagtagctgggactacaagtgcatgctaccacacctagttaattttaattgtttcgtagagatcaggtcttgctatgttacccaggctgatctcaaactcctgggctcaaacattcctcctacttcagccccccaaagtgctagggttacaggcatgagctgctatgcctgcctggcctgactgggctttttctttctttctttcttagtttctttttttttaaaagaattgtagatatgtagtaagccaccttatggaaattgtaatatgatggaaattagagaacaaattggccaagcttttcattgacttacaaggagaaaattggagaagaactttcactgttttattgcttgtctttgcattatctttttgagcttgtgtgtgtgtgtgtgtgtgtgtgtgtgtgtgtgtatttggcttaggatttagaaaaagcagcagtcttagaaaccttgtatgaccagagtgtgggataagattgaagcaagaagtaattaaatgtgctttaattatttaaggcagaaaatagtgcagtggtcacttctgggttctgctttttgaactcagttagtaccctgggatcacagaggaatggcactgtcttgtgcttgttccccttattaagctcagcatgtggcccaattaatgcagtgatccagaaggcaagggaggtagtggtggctttgtgctgttgccttaaggacacggggctgtgtttcccgcctggctccctcctgtcctaggcctggctcaggagttgtctccacatgaggctgtgcaagtctgtgctgtggctgttgcagctcccccctgtgaaatacaatgtgtgaactattgatgcatcacgtagaatgattccatcttctctgtgggtcagaggcaagagtggagctattgttgatgaaatcagagatgtgagaggggtccatgtggattagaaatggtgagatggcttgcctgcccagatgagaaagctgcttatttctggggctctatctgagggaggaggtcctgcattgcatcccatcggccatggggcagagccacctggggtttcccaacaaaaagcaacattggcaaggtagccatttcagtgcaccgtgtataagaatgcctccttctgccaggcgcggcggctcatgcctgtaatcccagcactttgggaggccaaggtgggtggatcataaggtcaggagttcaagaccagcctggccaatatggtgaaacctgatctctactaaaaatacaaaaattagccaggcatggtggcgggtgcctatagtcccagctactcgggaggctgaggcaggagaattgattgaacctgggaggcggaggttgcagtgagccgagatcgcgccactgcactccagcctgggtgacagagcaaaactctgtcccctccaccaaaaaaaaagaatgcctttttctatccgggtcaagactcaacaggtttttattgtttgttcatttgttcattcaccactagactgtttttcaagtggcacagctttcaactctgcaactggtttagaaggacggggtggggggcaataagaatgaccctggctacctaaaggaaagggaaggaaaaaggtcccaaaaggggagactggagatggggcatctttgggcccttgtggcaccctaggtctcgagccctgtgattcaatgactgtttttcttcacccctcgcagatggagcggcagcgcctcgctcgagagaagcagatgagggaggaggctgaacgcacgagggatgagttggagaggaggctgctgcagatgaaagaagaagcaacaatggccaacgaagcactggtgatttctgaggggctggggttccaggaggctacttggggacttccttggcttttctggagcttggtctcctgaaaaccatgagttagcagcgtttgctttgaaatacttaatttcagctttgaaaaaatcagtgccttttcttttcacctgtgttggcagaagcagatttaggttgagcttatgtgcagccaaactccactttcaccacgaggttgcctttatagcagggcttctcagcctgggcactactgacatttggggctgaccatcctttgctgtaggaactagatcccagtagcagcacctcaccctccatttgtaacaatccaaaacatcttcagacattgccacatgtctcttttttttttttttttttttgagacggagtctcgctctgttgcctaggctggagtgtacagtggcacgatctcagcttactgcaatcttcacctcccaggttcaagcaattctcctgcctcagcctcctgagcagctgggattacaggcatgcatcaccatgcccagctaatttttgtatttttagtagagatggggtttccccatgttggtcaggctggtttcgaactcctgacctcgtgatctgcccgcctcagcctcccaaagtgctgggattataggtgttagccaccgtgcccagctgtacttttattttttttttttgagatggagtttcactcttgttgcccaagctggagtgcaatggcatgatcttggctcactgcaacctccgcctcctgggttcaagcgattctcctgcctcagcctcccaagtagctgggattacaggtgcgcgccaacacatccagcttttttttttttgtatttttagtagaaatgggttttcaccatgttagccaggctggtcttgaactcctgacctcaggtgatctgcccgcctcagcctcccaaaaggctgggattataggcgtgagccaccgtgccccacctgccacatgtctcttgcaggggacaaaaaactcctctggttctaaccactgatttaaagggaaagaacagagtttaagttgtttttctccacgtgaagcataagcctgagctgaggtgggtactcagagaaggtgctcttgttactccccatgggtgcagcccgaagggcccttctgaaaagttggggaatgtggcttgtcatttcttgtcagagggtcatggagggcactcagcagcagggccccaggagtccgagactctggtttgtcccatctcagtgttcaaggcagatctgggcgggagaacagcacatgatcccacttcagctaagagcactgtgccctccagatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggaggtgagggggcaccgggcaccagactggcgaggaggctggcgaagggccgcagaccagcctgccctgaggctgagctctacagcagttgtcctcaagctgcttgcccatcttctgggccgtggggaggctcctccttggctgatggtgactggtgctttatccattttggggctggcgctactggttgggcacaggaactcagttccccctccaggggggcctctctggtcatacttgtgtctctttgataagcccctgtccctctgatggccgtgtgtgcaggaaaacccctgagcatatccacagaccgctttcagctgaagagatgtgaggaggctctttgtgcatttaaaaaaagtgtggttcttttctgctttcattcagtggggctgcaggagaacagcagctgcctacctttaaagggaagctagtgcctgcatcccccagcctttcttggcacatgggggaggagggctaggatgatctctgtgactgggatgtcccactcatggccaggttgaaggatggaactgttgtctgtacttttgaaagactattctaggcctgcaaccttcagataaacactgacacattccccacagcttttggctctgttgatttagagcacttgaatttggcttttagctaccaaggtgcattcactacagttttcctcaccacgctttgcatgtcgttctgggaatatggttcctttttgcctgccctgcttcaggccccttactgtattcgggggtcactccctgtgcatgatgcaggttgggccaggtccctgcaccaggcctcacatgccgtgaccacctgagccccataggatgaggatctgcaccagggtgcgggtgccctcagtgactgggctcatctttctgctggagaaagtgggcacaaggcccactggtgttttatccgggggctgtgaagacgcagttcttgcacattctgccctttgcgatccaatataagaactttgatcctccaggttcttcctttgcccagctcactctcacccaaaaataaagcagagaaagctgctggtgccctctccagctcctctgtctcctggctgcagaaggtctggtttctctcattccccaccagttttcctgctcttccagtttagatttaccaactcaaacaaaagtcctcaggaatgttgtccttgcttggaagttctgatttcatgtaaatatccctgtctcactgtcctttttcacctctttgggtgccatcctcagggttagcccaggtccctcctctgcaggggtggggtggtgtcttttcctgctacctgccctcttctgtgaagctgacatctcatcctttccttgcagggccaaagaggcagatcagctgaagcaggacctgcaggaagcacgcgaggcggagcgaagagccaagcagaagctcctggagattgccaccaagcccacgtacccggtgagcctgggggccaccagctggggctgccttagtcctggtgatgttctctttcctcccggcccttcagttcatctggcggtgccttcagggtgaccattcaggcaaacacatggctggatgagaggtgcagagagcctgcagttagggactgggtagaacatcctggtctgccatttggctttggactagttagttgtctctttggttgcctggataacaggcaacagggccttttccagctctggaatgtttttctttttctaagtaatatagtcccaaattatcctcaagagaatttgctctcttgcctcttaatgctgagctgaatgtaatcttcaactatcagtatataccatatatcataattatagttctgggaagggattggctgtacacctcagagtgaattactgccgtgcaagaacgagcagccactctcagtttggggacagagagtcagacttccattaaatggggtcacaaaatgaatagaagcctctttccttcctttcttctgtgcattcagtttggcatttttttttttttcatatttgttcagtgtccacatagtgccatgcagttggaagtctctatcctgacaggtgttctcagggtgcacaggtgcctagaggaggaggacacagcccaccctggaggagcaggagaggctcagtgtggtgtctacactgatgcttgaagggggagcaggaagtagccaggtggagaagagaacatagggtattcagggtgagggcacagatgcacacatggcccagactcacacacagcacagtcatctacatggcacagacacacacacgtacccatacatacattgatgcacatagcacatccacacacacagcacggacacacacgcacccatacttacattcatgcacatggcacaggcacatacatgacccagatgcacaaagggcaccagaggcacaagctgcccagggtttgaggtggggaaaatgtaagcagtttgctgttgccgtatatcccggttctccgttactgtgtaacaacccacccaagccagctgtgtggctttgttagtacctctggtggcttgttgggttgactgggccagacagagatccttgctggggatctctctggtggtcacagtcagatggtagctgggactggagtcgtctgagcagtcaactgggctgaacacctgagatgtgttatgtttttattttttattttatttattatttttttttttagagagagagagttttatttactctgtcacccaggctggaatgcggtggcagaatctcggctcactgcaaccttagcctcataggctcaagcgatcttcccgccccagtctcctgagtagctgggaccacagacatgcaccaccacgcccagctaatttttttttttatttggtagggacagggttttgccatgttgccacagctggtctcaaactcccgagctcaagtgatctgcctgcctcagcttcccaaagtgctgggattataggcatgagccactgtgcccagcctatatgtgttgtttttaaaatatacactggagcaaagcttatacactgctgtaactgctctttcctcttagcagtcaatcctgaaggagatcatccatatcagctttttaatcatgttttgttgtgtggatggattgtaatttatttaaccagtccctcatggatgagtatttagtctgttttcttttgcaattttgaacaaaatgacactgaacatccctgaacacaaatcttgacacacacacgtggatatattggtagaataaattcttataatagaactgtggggtcaaattttcgattttgatactctccaaagaagtcataccagttcatgctctcactagtggtgcagcaactagtacgcgtttttgctgaaaatttttatgatgtgtaacatacacatagagaagtgcccaaattacaactgtacagtttgaagaattttcacaaactgaacatacccatgtacccagcacccagatcagaaaacaggacatccctggcacccaaggagccttctctcagcacccttgcagacggtctgcctcaggccttgagaatgtctcaaatgaatgttccaagcctctgctctttcccagacactgtcctagactcaatacgggatccaaggatgaaaaagaggcagattgtttgcaggaaacttgcaaatagtagaaagaagatacagccaaaaagaaatcttttacagggtggaatcgcagaagaaccattagagaaccgtaaacacagcgttaagggacagcaaagaaaagggttgccggctggctgggaggggctagaaaggctttggtgagagatcgtggtgtttgagaagggccttgaaagagggatggagcatagggaggagaaatgggataggcaggggtacagagatgggaaggcagtagtccaggggataataaacaatactgtctgtgacttagtagggcaaatagtaggagaagccgggaagctagattggggtcctctttagatgaccctttgtgctgggatgaaagtccaaaaaaaaaaaaaactacaccacccctgcttcaggccctactccggttccattgtccaagcccaagcccctcggtgggccggtggggagccctttgtggtggtgcccatctcccaccccacctctccacactgcatggcagactcctggcaccctcactgggcactgccccacccattgccatacttcccgtccggcagaccttctcctggcactgccttggatcccagcaaaagcagcatctcttctagcctctgttcgctccctggctacagtgtttaccttttttaacagtgatgatctgtgaacacatctatttcctgaacaagactttcagctgctcaaagccaaggatgctgtcttgttttctgcatctccagccccttgcacagggcctgggagtttcctaaatgaaaaagcgagtgggagtttgtgtttgattcagctgagcatgaagaacggttagagatttgagggatgattttcctggatttgtagtctttgatattgtttacctggcagtggcaaatgtggagggagtgaagtggagggatggggactcgtggtggcattgggaggtgggacccgagttgtgcccattgcctctgtggctgctggaggatcggttgtcaacacagtagtgtccttctgtgcttgtatgacccaagctcctaatccgaaatttctcattaacagcccatgaacccaattccagcaccgttgcctcctgacataccaagcttcaacctcattggtgacagcctgtctttcgacttcaaagatactgacatgaagcggctttccatggagatagagaaagaaaagtatgtagccccctgtgccctgctgtgggcagctgtgaactagactgagtgattggggccttgggaagctggggcagaggtgagaggtcgctgcagcagcctgtcattactcctgcaaaggtttgctctgctcttacaccctggaggaagaatttccttaatcagaaattaaggacaacagatcagcattcattctgaacgaataaaaataacaatttttatccaggataaaaataacacttgactggtgagctggagtttttggtggctctaagcctcacctaaagtgtaggactgggttgttagcatctctgagtcagttcaactgctgttatactactggactgtagtcacctcctagttgtgttctccagcaactgggatctgtggtggttcccatgtctagaacaaacaaaggtgagagaagagactcaggctcgaggctaaggaaagctgacagctggtggggccactttgctgcagtgggtggcactgggcagggccccagcatggcctgatcatggcagcaattgctgagctgccctccgtcttccctttattgtgggtagaagtggatcagagatggaaaggaaaggatccccactgcagaggaaatctaagcgagggcccctagttcccagagctagcggtaagttggttaactgctgctgcttgctagaggacaaccacagtagctaccatgcattgagtgcctgtgtgtcaggggttttggcttttgtctcatttaattcctgctaacttacaaacatcaaaatgacatcaaaggtaggttttcatgttcccattttataagtgagaactcagatttagagagtttagtgaactccaccagcatcccacagctgatgcagaggggttgaaacccctcacccatctgactctgcagcccatgtgcttttaccatgggtggtatcctcaggaaaaccctttggggaaagtgtctccatggagtccagtatgggcaaccagaacccaggctgtttttctttgggctctcacactgagggtatagctaagtagccaatgaaccagagcctctagctgtcatatctgctgtccatgttcctttcaccattatccagacatatacatttatgtggttgggatccgggatcagggtgaagctgttctgtgtctgctattttatagtttgtattttgttactatcttagtttgttttggctactgtaacaaaataccagaggctgggtagcttataaacaacagaaatttatttcttggccaggcacagtggctcatgcctgtaattccagcactttgggagtccaaggggggcagatctcttgagccaggagttcaagaccagcctgggcaacatggcaaaaccccatttctactaagaatacaaaaattagctgggtgtggtggcacatgcctgtggtcccagctactcgggaggctgaggtgggaggattgcttgagcctgggaggcagaggttgcagtgagcccagattgcaccactgcactccagcctgggcaacagagagacaccctgtctcaaaaaaaaaaaaaagaaaagaaagaaattgatttctcacagtttgggaggctgagaaggccaagatcaaggcacgggcagaggtggagtctagtgagggcattcttgctggttcataatcagcccctttttgctgcatgctcacccagtggaagggatgaggggtctctctggagtctcttttataagggcactaatcccattcatgaggctctaccctcatgactgcccaaaggccccacctcctgacactttttttttttttgagatggagtctcactccatcgcccaggctggagtgcagtggtgcgatctcggctcactgtaacctccacctcctgggtgcaagcgattctcctgcctcagcctcctgagtagctgggattacaggcgcatgctatcacgcccagctaacttttgtatttttagtagagatggggtttcaccatgttggtcaggctggtctcgaactcctgacctcatgatccgcccaccttggcctcccaaagtgttgggattacaggcgtgagccaccacacccagccggtgattaggtttccacatatgaattttgaagacacgaacattcagaccatagcacttcttacccttgcacatattggcagagtctctatactaaccatggcaatccctatggagtgtttttggtatttgtattgcatggtttttctggccatgccttgtagttggacactttgtgggtggtttccagattttcaccatcatagatgctgtcactcagtgttatctgttctcaggtgagggtggggatcttttcttccttgcgttgggtgagcttctgagtgagcttctgtcatctttagatgaagtctcagaacaagtgggaatgtggatgtggcctatcaaaagagatcacgtgaagctgggcgctgtggcttatgcctataatcccagccctttgagaccaggggttcaaagccagcctgggcagcatagcaagatcctataaaaaaaaaaaagagtttacttgaattactgctccaagaagggttgagacaaggagattgttctgggttcccaggaagcttgtttcacgtatgttttttttttgtacagaacgaaaagctgtccatgagagctggtatttgtagagccccctatgagaatttaccaagggcttttctactctttctttttctttccttttctttttttttttttaaaaatagagacagggtcttgctatgtttcccaagctggtctccaactcctgggctcaagcaatcctcctgcctcagccacccaaagtactgggattacaggtggagccaccgtgcctggcctcctacactgttttatttaatcctaaccacggccctgtgatcattatcccaattttaatgatgaggaaacattcatagcatttaagtgaccagcccaagctcccatggcctgtgagtggccaagtagagacgtgaaccccaggcctcaaaccctagatcgcacaccaagcagcttgtgggccgcagagcacctgagccgtgtctcactgtctgcccaagccctgatgcatgataccctcttgccggcagagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaaggtacccagggtctctttcttgtattttgctgatcaggaccatcattaatgaaatgtgcggttggcatctggtttcctcagtagccaagtcactagactattggcatcttttgtatgtacttagttgaggaaattttttaacttatgccagaaagggaatttaatctgccaatgactatgaacccattggctggatggaagttgagcttgtgttaaaagctctgatgtaatgaacccctgttacagggtggattttgagccctcatttagcagtaaagcataatgcccttttaagccaaggggtgttatacccagggagctgccttactttatgagaaagcagaatgaaatggaggctattgagaatggactttccctctagtcttgtggtgtctttaagtggcaaggactataaaaccaaactgaatttttaacttttttcatacttaaaaggaagtgtctaggaaagaacctctttgttttaaaagagaagactttattactttgcaaatggtttcatatctttctctactggtattttgagctttcagcattgtcgagattcagaagctaaattccatactaattatcagcccaagagcatacctctctcatttgggccaagcagaagggtcctctcataccaaataatgctctgctcttaactgatagcccaggaccaggttaacacctataaaataggtgttattaagataagactgtccattgagtttaggtgatactgatacagttaattttttattctttacctcagtctttaaaataggcttccagttttatggactgtctctgtttttagtggttaagctgtatctgaaaactccaggggatctgtttctgcctgccttcgttgttgggtacagtaggcagccctgacttctacctctcgactccagtcacaactggcaccgggtagagaattccttttaatagtgcaacctagaaggaaaggcatttccacattccacattcttctttcctctggcttctgtaatttactgggcttcccttccaaaacaaaattattaaacagtaaaggggagttcaagggaggcctcggtcattaaggaaagaggtaaaacgatggctgagccagtgagccagtcagcccttaaatgaactgcctcagacaccccatctcaccccttacccccagccttgtcatctgggtcccaggaacagtctcaccatttccactgctgctgcaatgagcagtgccctcagccacagaaacctgcagtgtgagagctggagagaccccgttccaagccattaaaacaaacaaaatcactcatcacgatttcaggcctatccaagcattttgcagatggcacttatggcattgttgatatcacagggtatgtttttgtttttcttcattttattttgctggtttagcctcaagcccaaggcagaagacctatctgcatttgagccctcaaagtaggttgttcccaggtactctctatgtggtgatggtgctgccctctgtgatactaacccgtgcatgagcttgcctgtctctgtcctcgggccacactgagcccttacgagggcaggtggtgcctgggtactggccgcagcatgctttgagtctaaaagtaggcacccaccctgtgaagccagaccagcctccagggccccagaagactgcctcgttccgaagagcatgtcatggggctgtaggaccagccattcttcccatctcgggtcattgttgggctggggaaggttatggcttcttgtccagtcaggtgtgtctaaaagtcctttgtcttggtggcatactcctagcatggaaatggggtcaatctgggcactttggagactggtgtgtttaactcaagatcaagaccttttatgcgttgacagcctctcaagacccatggtcacacctggcagcttctggtagtggggcaaaagggttgcttgtgctggctcattttcctttagagctttccctttctgcacacatcccttttcttttcaaataaagcaaacccagagcacagggtctgatatgtgagtccacggggagtggactgtctgttcatctgtgctcagccacctctgcttcagcttcctctccataggctgagcagagatgtggtcagagtgaactcacattggaacagtacactcacggcaccctggagaggagcggtcactggttgctgagtgaattaaccgaatgtttgctgcttttctcctgcaacagttcattattcctccagcatgcctaggcagtggagagaatgtattttgcccaataataaaatgacatcctgcctctacttctcacctaatccccagtagtacccatgccaacaagccccacaccacctgacagcagcataggatgtgtcctttggagtcttccctgcagtttctgctcatagagtggaataagctcattggaacctttctaacaaaaagagatctggcataagatagatcctacttgtggtcgttatcccatcaagagaggtcagctgttaaagtccctgatagatcttattaaaaggtacacttgagctgtcagtggttccaagaatccatgacatgaaccctgttttgtatgcgacactttcatttagcgggctcctgtttcttcagctttcatatccttgttggcattgataccctgatacagaacagtccgcgctctgagcagggcagttatggccagcattgtcacgggcaggccagctcatggcacccagagcagccaggtggacccaccttggtttactgaactttttgtaaccatgggggcaagcagaaaaccccgctgcatttcagccagtgctgccaggtgttccctccatgggaaggtgctgctcaacctgaatgtgacttcctctttcttctttctataatgatgcagaatgctgaaattcttcagggtcctgattttgactgtcatttctcactgagcttttactgcagacaaaagaagtttcatttttagttaaatttgcactgctcctgggacatacatggatgcatttatttattcatccattttaatgtctcgatgtgaacttgtttttaaagcaggctaccaggcagttaatcaaacactcgggttaatcaagggttaataaaagcagggacttgatgtttaatgggacaggcattctctcagcatcactagattcaataatgctgcactattaaattttgctgcacatgaagttcagtgcatgttccattttctagactttggcagtgcctgtggtcagtgaccgggactgatgagcagccacatgcctgcactagggtggctctggggtggtgcatgctgcagtctggctggcacaagcctagctgaagagaagtactgctttaggcttggatgtggggatacctagatgtcaagggcagaactccatctagaatgcctggggatgagatgcaaaagctgatagtgaatggaacagtttccaatgtccaaaagcttgctaatctgggatcaaaccagcctgtgttgatgttagttttgctttgttttgagacacggtctccctctgtcacccaggctggtacattctcggctcactgcaacctccacctcacaggctcaagtgatcctcctgcctcagcctcccaagtagctgagactagaggtactagccaccacactcaactaatttttgtattttttatagagatggggtttcgccatgttgcccaggctggtctcgaactcctgagctcaaccaatctgcccgcctctgcctcccagagtgctgggattataaaagtgagccactgtgcctggcctgttttgtttttaataaggttttttgtttgttttgttttgtttgagacaggatctcactctgtcacccaccttggtgacagcctcgacctcctgggctcaagcgatcctcccacgtcagcctcccaagtagctgggactacaggcatttgccaccatgcctgactgatttttttatttttatttttgtaaagatgggtttcgccatgtttccaggctggtctcgaactcctgagctcaagtgatcttcctgccacagcctcccaaaatgctgggattacagacatgagccatcttgcctggccattgtatttgtcctcgttttcagtactcttctgcctcactgagaggtctcagagtctgctgtgtggtttcagcagtacccatgggggctgtgtaacattgaagctgattcaaggagtttgcccttaggttaccaggggttaccgcattccctgaggaatgctgagcggccatccagtctgattaaccgaggttcctacttctctgccacttcctttctctataattcttactcgctcgctctctctttttttttttttattatactttaagttctagggtacatgtgcacaacgtgcaggtttgttacatatgtatacatgcagctataaaaaaggatgaattcttactctctcttgaggcacagtgtcctcacctgcaaaaggtggataaaaatagtctttgcccccaggagtgttgtgaggaataaatgagagaatgtgtgtgcaacactcagtgcacagtcagagctcagtaaggggttaaaactctgaaaagggaaaatctgcttgtgatcctgcagcaaagggcgaaggacggcatgtgggccacaccgccacatctaggtacactgcttgtgctgggcatattcattcattgtattaattgctacgtggctgaaagtaaaaacttttaaaaagccataattggccgggcacagtggctcatgcctataatcccagcacgttgggaggccgaggcaggtgaatcacctgaggtcaggagttcgagaccagcctgaccaacatggagaaaccccgtctctaccaaaaatacaaaatttgccaggtgtggtggcgcatgcctgtaaacccagctacttgggaggctgaggcaggagaattgcttgaacctgggaggtgggggttgcagtgagccaagatcgtgccattgcactccagcctgggcaacaagagcaagattccatctcataaataaataaataaatagccataattaacttcactgtttccttgtaatatttcacttgggtttgcaaggatgtatttttctcctcttgctaatcttaacttcctgtatttccatttttcccaattgatgatcagtacaactagtttgccatttgcatctgagtcagagcagtgctagcgatcaaaagccgccctggggaacctggaattgtttcattctcagtgggagcgacacgtgtcctggcatctgagccttccgagtgaggggagtgagtctggccatcaggctggggttgagggacacagggtgccttgagcctggctttcgtgccttcagagccacagtgccaatgatgggagtggtggcttggtgtggcgtaactgtaccaccataccttgatggtagaatgcagtcctggaatatatacattcagggtctttctttcatcgcttctcaagagaggggtttcagtctcccgatcctgagctggtctgagtgccagcaaacaaagtcatcacttttgtgcctgtggtctcccaaggagcacaggatttccaaggaaattgacggatgagaaatcatgggggtggtggagcttagaaagcttatttcattagtaaatggtttgaaccgtcaaggtccagctgtggtttccactgatggaggaacaggaagaagaggagccttgacatttatctcaagcgccagcagcttctcttggatcaggaagacataaaagtccaatgtcatcttcaatttgtgcaggctccccttggagttgcagagccagtgaagtgaagtagaacagttaaaaaaacacccggggaagtgataaatcacagagagagattgcatatgcgggaaaggtgtctcccacaattaaaacaagtggccagagcctccctggcgacctctggtctgcattgccagccctgaagatggctcctaaattacttaagtttaataggtagttaatatagccaaccctccttatgaccccagtgggctgaatggctctgcttgctttaggaactgggcgttgtatggtagagcatcttggccttgacataaaaggtagcatactggctccccagccctgaaccttccctgctagagcaaggcaggggtgagagggggaaggaaagaaaaaggagtggggagtggggtggggagcaaggattaacagggagcagtagcagcaccagatgtgggcatagcacactgggaagaaattgcagtggcgatctgaactcttcctctccgcctcctggctctgtggaagcccagggaaggcattaggaactgcaggctgctcttagtgctcctcccggatgggacaccttgggctcatccctgaaggccactcctaccactctcacacactgagttcctggtgtctcgtaactgttgagagcttagttttcttgcttgtttctggtagctctagatagaagactgtatcggcctcttctaaaagtcaacaagccaatcctgtttttggttaagagactttacctggtcaagcagttgttctttgggaggtgttgaagagcctacaaacctgccttgcctgcctaggtactttaccaccatttggagatgcctgaggatattaccaggccttatttgaggcagtaaaacaccctgttcggcccctcggcactgaagatgtgtttcagtgcagctctcctcggcaccggattcgttgctgcaacagtgggagggaagagccagatgcaaactcgttctgcgagcccgaggttctgttctcatgatccttgctgtgatttctcttttgatgttggcaattttaaaatgacatcagtctatctggacctttttcctaaggctcttgctcagaccactcagtagatagccgccacctgcccagtgaggtgaatcaggcccattaggccatttgtcaggggaaggaacagaggagcagcggagggccccgccggccagtgccacagggcagcctgcaaagcaggtagacaggttttcaggcagcttttgctgctttgggtccctcagggattaatacacaaaaagggccccttgggtattcagtggcagatttctcttgagagcagataaagtcgctaataacaaattggatttgttcattggggtggacttggcctttcgttccacctctgtgtaggataagtgtgtggatagtgctcccactgtgcacatcaccatatggcatttgggtgcagctgtccctagccagactgcagaaaagcttgatctgggccggacgcggtggcttatgcctgtaatcccagcactttgggaggccgaggcaggcggatcacgaagtcaagagattgagaccatcctggccaacatggtgaaaccctgtctctactaaaaatacaaaaattagctgggcgtggtggcatgcgcctgtagttccagctactcaggaggctgaggcaggagaatcacttaaacccaggaggcagaggctgcagtgagcggagatcgcgccactgcagttcagcctggcaacggagtgagactccgtctcaaaaaaaaaaaaaaaaaaaaaaagagaaagtaaagaaaagcttgatctggccacttagtacagccatccccctttactggcccttcctctttgcttatttggaagggggaaggtttcccacaccccaaaccaaagattcttttggaatttgctgctgctggattcagctgtcacctttctgctctgagtctgctttctccctgtggatccggtgccagaggatctgcacgtccttttgtgtctacaccctcccccgctccttcgttttcaatatgtagtagtggagaggaagtgtaacatgattttagggctcacatttcaattccactgcatttttatgggacaagcagagacccagcgcctggagttattaggttagtatctaaaatgggttcagtactgtgagtcttattgtttaaaatgaatgagatggtcccctcctaccttcttttctcctcccctgggatgagtggattgaggcaaggcccccagagactagttgaaggaatcctggtgctctgattagttttgttccccagcttaattgtacagcttcctttctctcaccactgatagccaaagtagctctgtgtctcccccaaccttcccttgctttaggaacaagatgatcacaatgcagccttgtgaatcaattttctgtctgtgctgatgaaagtgtaattcattcttaatcaagcagccttgctgctgcaggctccgtgccggaatacatttagttaccctcccatcactttgggaaacgatcccccaaaagggcttttagaggagagctggaaggagagttggccgtgcgcctcatgctgtggttttccagcagggggcactcaggaacgatgctggcggaggctttgtagctggaagccgtctgctgctggcagggcagcaggagaatgtttgtcacaggtgccttccaggcttgctttctccagaccctggggccatttctcagaagtaccctaatgggccacccaaaatcctcaggtagcagtgaggaggaacagttgaagatgcagattgcatgcctgggttagagagtgccggctgggtaccaggttcttttagccagcctcttctgtctttttaagtagacagatgtgtctcctgaatctgaacttgtttagattgggtggatgtgtctgtttttgtcacaccacacacaatttggggagcgtaaggaggcccagctctgccagaatggaactctcctaagttctcccctgccgtctcacagcctgctggctgtcacaaacagctggcagttttatggacaagtgggcaggggaaaagggaccctgccggggctgagtctcgatgttgggcaggaagtaaaagccaggacccaacaagtggatcagaggggggatgtgaagatgaacagtcagatagcaataaagcctcatagatctgccccagagaaagaaaaggaagttcgtctcctcagaatggaattggattagtgacagacttgagcagccggttcagtcgagagagaacttaattcctcctgtgttattcacacggctgattctaatcagatgtgaagagacagctggaggagagcagcgggtcagcccatgcctggtgcggaggcttcatgttcttgtaggcatcttcagggaactggcaggagcgctttgggttggagactctgagcagggcccttgggtttatagcctgcccaaggaactgggcctggctgcgggactcccatggttggaccttgtctagattcagtgaaagttttgaaggacagtgcatgacagacgtcactggtcaggttcaccagagcttggctcacttgtcttcagaaggattcaaaggcagttgaccagacttggcaagtcccagactggtgcagccactgtcctcgagaccctggttgtacaccctgaggtgcttctgcttcattacctgctgaaatttggagacctcttcttcctggataaccttcaagatactcattgtgcatgcgaggaattccccgccctcctggggggactccactccccaggcaggcaaggttgggcaaggggagggctgttgctggattgccaaagggagcatggacatttttgtttggaattcagggtgggaatgggactcaccagagtggcttcagtgctcaactcacagtgcaacataggacaaggtgaaggccttcttgggaggcctcttctggctctagcaagcaggtgttgctgggcagtgtagagggacccaggccggttgctgagcaggaagatgtacctaacactgatgggcctgcacaccttagggtatgagagcatcgcaggggaaccaggaaacttgttagctggttttcatgtgtttaaaaagaagactcggaggcagagtttattttatgaagggctagctttttgccatttcttctgagcttttgccttttcctttatgaatacttcctgcctatgggtgtactgtaaatgtaacagccagtgagctttctagaagcagcagatggtgaaagatccacaggtgaggagcctgcccactggaggggcgagacagtgcccaggcagggcgtgcaggtggcagagctgtttgcatgctccgcggggtggcttcccaagctctctgtagaaaaactgcctgagggcaaatggctccactgagctgctacctgcaggaaagaagctcaagggctctcctcgtctcactgcctgccttcttcacctgctgggaggagggcattgtggtgtctgagataaaggatacccccaaggtggaagcagagccatgggggtggcctccagcagcagggaggagcattgtgcagtaaattctgactccggggctcctgtggggattggaacccataggaattgcacaatgagggtaaaggatggggcggcagcagccaggtctgtctaaggggcgagcagcagtggccgaaggctcccagggccctcgggcagcagcccttgctgaccagtgcagccaggtcgtggctgcctccagctggtgggtctgccttcccctctgaccgcctcagtgccttctggaggactgtggctctctctcctgcccagtggctgtggtgccttcctacttctgtgtgggcagactgatttccctctctacctttacttgtggctgaggcgaagctcctgctcttgcaagataagaggtggggctgaggcgctgcagtgcagctcaggtggggctcaggaagcaccccacccaccccagagcactctgcatcctaataagcacatgctcgagtcactggaatctggtgctgctggcagtgccagaaccctcccctagcacctcgaggggacagccagcatgctcctcgggtggaggatccaggaattcttggagccaacattgcacaaatgggcaggagcctctcaaggcccccacagcctgggctccctgcctggggaagtggccaggcttcataggggcatcacttggcccgcctggtaggcatggaggccagtgccatacgtgaccttgttgttgcctgcaccccttcctaacgagcaccctgctccccactggaaggagaggggccagggctcctccctccccagggaggggagaaacgtgatgttgctattagcaataacagctgccgagttcccaccatgcgccaggtgcagtgttgagtgcatcacacgcggttcccaattcctctgcctgtcaccccacgaggaaggggctgccatcacgcccgcttcacagtgaggaactgaggctagaggggagcaagtgacctgcccagggccacacagctggtcagtggcccagctgggccttgcaccaggcagctgactgtgcctgtatctgactcaaagtggctgttcttttcagaaacctgagcggagatactgggctcacatgctttcatttaaaccctctctcatttttgccccagtagttatctggcagctaaatctcttcctcctttcttccccagtgaccattctggttcccatcatcacagggcacataactcctggcccttctcctctgattacatttagggagaagcccatcctgatgcagctcccttctagagggagttccatttaggcaaaaaagcgctctccattcccatcagaaccgggctttccaaagggctctgaaattggttccactgaagaaggcagctgagctgcctccccacattccgcttgttagtcgggaacttcaaggccaaaagatttggcaggatttaaagagttgctctcaagctgtctcattctgagcacactaatgctgtctgtcttctgatggtgaagtggtgggtttggagtctccctcccctgccctttatggagccgccgatagtaccgaggactcttcacatgcagactcgaggggtccagagaatgggccagaccatcttgcctgccccatggcaacctccagaggaaagaggctcagagaggtcaggggtgtctgcagtgagctgctgatggcagagagtgagctctcggaccttctcagccgggtgtggagctcttgcctctcccgcgaacctcagtttagttatcttcatagcccacgtcctggtcgcttaacaaacattgagctcctgatcggcacataacactaagccagatatttgggggatatgaagatgaatggtacagactccctcccctccacccccgcactcctgtgggaagtcccggagctggaaatggaacacagtcacacccaaggcattgatttcaggagtcagcagagagcagggagtagggagagtgctggctccagatgcttctatccagggagatgctgggaagtggcccagagtcaagggcttaggaggttgcaaacctcactatgccaagagctcggtccctgatccaccccatccccttccacatctccctgactgtccttctttacatttgctgggcagagtgccacctgtgtgcaccagccctccctgcctgcacaagccacactgagaaagccgttgcctccagctcatggagagaaacaccttctcagctgccacgtcatgagcaagtttgcttcgggaccacctgggaaaccaggagtagaaggggtaaactcttcctcatctgccacaggcctgccttgcctcaggccacgtcaccttaccccagccatgttgccagggcatgaggactaagatgcttgccctgccaagcccggaggggatgagcagcctcagctggtgccgccacagacagcacaccacagaggtggctcagggaccttggtagatgggaatgtgagaatctattaaaataggcagggatctccggtcctctgtcaagaggcaatgctgacggctttttcctgctggcgtgcctctgcccaccagccttccccttgcacatcctcatttgtcacctcctaatttgaattattgggcaaatctggccgcttatttgggactgacagccaacttcttgagcatctatttgaacagccttccctttcgctcccagccacctttgaggtgagtccaagtggcaggacaggaccctgtgtgacagagcggaggtcttgtgccctctcagcttcttctctgctttcttacagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaata

SEQ ID NO: 6291 - DNA, 58571 bp, Homo sapiens
atggacggccccggggccagcgccgtggtcgtgcgcgtcggcatcccggacctgcagcagacggtgagccccgccgccctgggcccggccgtgcccctgcgctccccgcccgggattcccccacccccgccgggcgcgcccggcgcccgggacccccggcccacggctactcacccctcccccgccgcctccgccgggaccctccccatcgccagggcggggccccgggaagcccggcccctggggcggggcttcggccgcggttcgcggaggcgcggggtcccgggcgccggcacccgagccccggactccttcggcgggggcccggggctcggcaccccgcatggggccggcggggcgggtccgcgctcccgggacctgagctcacgagcccgctccgctgcagaagtgcctgcgcctggacccggccgcgcccgtgtgggccgccaagcagcgcgtgctctgcgccctcaaccacagcctccaggacgcgctcaactatgggcttttccagccgccctcccggggccgcgccggcaagttcctggatgaggagcggctcctgcaggagtacccgcccaacctggacacgcccctgccctacctggaggtaagtggccggcgcgggggtgagctgaggagcgcgcagggtggatcaccaagccccgtggcgggaccagtgaagggcacggcagtggggaaacacaagtgggaggggtgaggggtggaggctgtgtgtgtgtgtgtgtgtgtgtgtgtgtggtgctgtgtgcagagtgcagtgagcgtgtacagggtgcagcgagcggacacagtgtatgcgatgagtaggcgcggtgtgtgcagtgagcgggcagggcgagcagtaaggatgtacagtgtgggcagtgtgcgagcatgtgtagtgagcaggcagtgtgtgcagttagcaggcacagtgtgtgcagtgagtgggcagtgtgcacagcatgtacagtgtgagtggtgtgtgctgtgtgccgtgagcatgtgtagtgagtgggcacagtgcagtcagtgtgcacaaagtatgcagtgggcacgtaccgtgtgtgcagtgagtggtgtgcagtgtgtagtgtgcagtgagcagtgtgtacagcattgcagtgtggggcagtgagtacagtgtgagtgttgtgattgtggtaagcaggatgcgcagtatacagtgaacagtgtgcacagtgtgtgcagtgtgggctgtgtgccacagagtcagtgtggtgtgtgtagtttgaacagtgtgtgcattgagcagcatggatggtgtggacgctgagcattgttctccagggaggagtgtgagcacgagagagtgccagaggggtgtgtggtgtgagcagggctatctgtgtgcacgtttgttcctttctccagctgtgaagtcttgtgaaggccaaccaagtcccctcctttactcacccatgcatggtgtgaagatgtattgagtgccttgctaggcatggggacgtagacggggtcagtcctgtggaaggtcttggagtttggcagggtggaggggggtgcccaactgcagtgggcattgaataaagattttgtgagctgagctcaaagttgggcgggcctccgtggtggcacaggaaagtggggtcagttctacctggagagtggagggggatgtctaggatggtaagcctggaatcaggccttcagagaggagtgggattttgccgagaatcctggggatgggaaggcgacgggacagtgcaggctgcgggcagctaggcacgtgccttccatcgggctgcatcatgcctgagtgtggtgggtgcatggcagctgttagctctgtccactgtggtagtatgactgatggtgtgtacaggagggcagtgaggggtgcggtgtggccagcatgagcgggacggggtttgtgcatggactcacttgctcagccggggtgggggcattttctctaccttttctttatctgagcagtttcgatacaagcggcgagtttatgcccagaacctcatcgatgataagcagtttgcaaagcttcacacaaaggtaaaggatcacggggagggggctcctgaggttccctcctgcctccctgtggctgctgtcccccaccccagcttggggctgaccacagtcccccagctttagctcagtccatttccccatcatcaggggcccagagcctgtactgggtgtggctgaagggctgggcacagattcctggccccatggttggggtcaggtggtacagtgatgtgttccagttagatcagactcttgccgacccccctggcttaggggctggagtgtcctgtgagaagctgggtggagagggagtggacaagcatctgatgtgatggctgtcgggacaaggcacccagcatcgagtggtcgaccagtgctaggcatttgtgattagacctctcattaatcctcttccagagggactattataaccctgtttcacagatggggacacagagtacccgactgtgtagacagtgaagctggggctgaacccagatctgtctgattccaggccctgtgcccaggcatgcctttgaggtgtctactgctgggtgccacccccaactgggcctgaccccaaatgctcttgaggggggcaccttactatttcccgctgaatgtcagaggggcagggtgggtgccacagcccctccccaggggcttccacccgcagctcacagtccagcaggcacttgtttgctggatactttatgggcggtctcgagctcaggagaggggtcagaatggagggtctctggagcccaggagaggaatcagaactgtcagccctgtgtcctaatggtcccatcagtgactttggagcctcaggcttctgtgccaggcttttctgctgccccagggcaggcggtggtcaacggccttggcactatggctgggcagagtccactgtggaaaggtccccctctcctgccactggccctcacttgaccttgtcagcctgggttcctaccccatggccacctctccctccggatctctcttcagtgaccaacaagacatgagtgactcactctgaagtaggtctcgtttgtttttaggatgagcctgaacttcttacatagcccgtgtttctgcttgcctgggctccagctggcctttccctctcccctggtagtgagcacttcctcctctttcactgcctggcccgcctgaggaggttgcctcccaaggcaggggtccctatggcaccctcccctatttctgaggtacactgggtgtttatggaagggccccggcctttggccagggcaccttgccttgtgtgtgtggtgtccgtagtgccggctggggaagtgaggccttgtggggtgagtgaataaactgggtgaatgagtacaaggccatcaaagtcatgtcacaggatgggtccctggggtgggggtctgcggtggggtgagctggagaggaagatgggccgaagaaggagcaggttgtctcagggtgctgaggattcagggctgctgtggggctggttcctgcctgggtggacctcgggctcttctaggccaggcaggtcggggcagcagggccggagagacggagccagggcagtgactgggcctggagtgggggacttgcttggggccccaccagggtgacctggccttggtgaggggctacttgggtacaagctgacagtcgtgactggtttggctatcagggcgcaaggaagggctttgagccgtgcatgggcccacccgagtgggaattggggccgtggtgggagtgcaggaccgtggttgacaattgtgatgtcaggtgacaggtcagactggtagggatgtggcgggggttgcctgaaggtggcctgaggcttgccggaggaaggcgggtgatgttcagatgatggaggccttggtgccaggctgactgacggccggtgttccaggcgaacctgaagaagttcatggactacgtccagctgcatagcacggacaaggtggcacgcctgttggacaaggggctggaccccaacttccatgaccctgactcaggaggtgaggagtggagtcggggaggggcatggcctttgcgcggctgggagcctgacccttatctgtctgtgaacccagagtgccccctgagcctcgcagcccagctggacaacgccacggacctgctaaaggtgctgaagaatggtggtgcccacctggacttccgcactcgcgatgggctcactgccgtgcactgtgccacacgccagcggaatgcggcagcactgacggtcagtgagggcggggcctggcctggaggggctcttgcctggtgatggggctgggggcagctgggcctggtgtggatactgaggctgctcaccctcagaccctgctggacctgggggcttcacctgactacaaggacagccgcggcttgacacccctctaccacagcgccctggggggtggggatgccctctgctgtgagctgcttctccacgaccacgctcagctggggatcaccgacgagaatggctggcaggagatccaccaggtgtgcagggagccgaggtggggtcccggcctctgtgtgctgggttgggggtcctggctctgtctgtaggggtgggggccctagcctctgcccagggaccctacagcaccttgctcttcccccaggcctgccgctttgggcacgtgcagcatctggagcacctgctgttctatggggcagacatgggggcccagaacgcctcggggaacacagccctgcacatctgtgccctctacaaccaggtgcgactgtgtgtcctgcacatgcctgcaccagcgagtgtgcatatacttgcctcttctgggggtgtatgtgtgtgtgggcacacaggtgaccctgtacggtgattgcatgtgtgcaccgagtgtggatatacttgcctgttctgggggtgtacgtgtgtttgtgtgcacacaggtgaccctgtacagtgattgcatgcgtgcaccagggagtgtggatatacttgcctgttctggggttgtacatgtgtgtgcacacagatgaccctgtacagtgattgtatgcgtgcaccagtgagtgtggatatacttgcctgttctgggggtgtacgtgtgtttgtgtgcacacaggtgaccctgtacagtgattgcatgtgtgcaccagggagtgtggatatacttgcctgttctgggggtgtacacgtgtgtttgcacacagatgaccctgtacagtgattgcatgcgtgcaccagggagtgtggatatacttgcctgttctgggggtgtacacgtgtgtgtgcacacagatgaccctgtacagtgattgcatgcgtgcaccaggtagtgtggatatacttgcctgttctgggggtgtacacgtgtgtttgcacacagatgaccttgtacagtgattgcatgcgtgcaccagggagtgtggatatacttgtctgttctgggggtgtacacgtgtgtttgcacacagatgaccctgtacagtgattgcatgcgtgcaccagggagtgtggatatacttgcctgttctgggggtgtacacgtgtgtttgcacacaggtgaccctgtacagtgatcgtacacgtgtaccagggagtgtggatatacttgcctgttctggggttgtacgtgtgtgtgtgcacacagatgactctgtacagtgattgcatgcgtgcaccaggtagtgtggatatacttgtctgttctgggggtgtacacgtgtgtttgcacacagatgaccttgtacagtgattgcatgcgtgcaccagggagtgtggatatacttgcctgttctgggggtgtacatgtgtgtgcacacagatgaccctgtacagtgattgcatgcgtgcaccagggagtgtggatatacttgcctgttctgggggtgtacacgtgtgtttgcacacaggtgaccctgtacagtgattgtacacgtgtaccagggagtgtggatatacttgcctgttctggggttgtacgtgtgtgtgtgcacacagatgactctgtacagtgattgcatgcgtgcaccaggtagtgtggatatacttgtctgttctgggggtgtacacgtgtgtttgcacacagatgaccttgtacagtgattgcatgcgtgcaccagggagtgtggatatacttgcctgttctgggggtgtacatgtgtgtgcacacagatgaccctgtacactgattgcatgcgtgcaccagggagtgtggatatacttgcctgttctgggggtgtacatgtgtgtgcacacagatgaccctgtacagtgattgcatgcgtgcaccagggagtgtggatatacttgcctgttctgggggtgtacatgtgtgtgcacacagatgaccctgtacactgattgcatgcgtgcaccagggagtgtggatatacttgcctgttctggtgttgtacatgtgtgtgtgtgcacacagatgactctacagtgattgtatgcgtgcagcaggtagtgtggatatacttgcctgttctgggggtgtacacgtgtgtttgcacacagatgaccctgtacagtgattgtatgcgtgtaccagggagtgtggatatacttgcctgttctgggggtgtacatgtgtgtgcacacagatgaccctgtacagtgattgtatgcgtgcaccaggtagtgtggatatacttgcctgttctgggggtgtacacgtgtgtttgcacacagatgaccctgtacagtgattgcatgcgtgcaccagggagtgtggatatacttgcctgttctggggttgtacatgtgtctgtgtgcacacagatgactctgtacagtgattgtatgcatgtaccagtgagtgtggatatacttgtctgttctgggggtgtacgtgtgtttgtgtgcacacaggtgaccctgtacagtgattgtacacgtgtaccagggagtgtggatatacttgcctgttctgggggtgtacgtgtgtttgtgtgcacacaggtgaccctgtacagtgattgcatgcgtgcaccagggagtgtggatatacttgcctgttctgggggtgtacacgtgtgtgcacacagatgaccctgtacagtgattgtacacgtgtaccagggagtgtggatatacttgcctgttctgggggtgtacacgtgtgtttgcacacagatgaccctgtacagtgattgtacacgtgtaccagggagtgtggatatacttgcctgttctgggggtgtacacgtgtgtgcacacagatgaccctgtacagtgattgtacacgtgtaccagggagtgtggatatacttgcctgttctgggggtgtacacgtgtgtttgcacacagatgaccctgtacagtgattgtacacgtgtaccagggagtgtggatatacttgcctgttctgggggtgtacatgtgtgtgcacacagatgaccctgtacagtgattgcatgcgtgcactagggagtgtggatatacttgcctgttctgggggtgtacacatgtgtttgcacacagatgaccctgtacagtgattgtacacgtgtatcagggagtgtggatatacttgcctgttctgggggtgtacacgtgtgtttgcacacagatgaccctgtacagtgattgtacacgtgtaccagggagtgtggatatacttgcctgttctgggggtgtacatgtgtgtgcacacagatgaccctgtacagtgattgcatgcgtgcaccagggagtgtggatatacttgcctgttctgggggtgtacacgtgtgtgtgcacacaggtgaccctgtacagtgattgcatgcgtgcaccagggagtgtggatatacttgcctgttctgggggtgtacacgtgtgtgtgcacacaggtgatcctgtacagtgattgcatgcgtgcaccagggagtgtggatatacttgcctgttctgggggtgtacacatgtgtttgcacacagatgaccctgtacagtgattgcatgcgtgcaccagggagtgtggatatacttgcctgttctgggggtgtacacgtgtgtgtgcacacaggtgaccctgtacagtgattgcatgcgtgcaccagggagtgtggatatacttgcctgttctgggggtgtacacgtgtgtgtgcacacaggtgaccctgtacagtgattgcatgcgtgcaccagggagtgtggatatacttgcctgttctgggggtgtacatgtgtgtgcacacaggtgaccctgtacagtgattgcatgcgtgcaccagggagtgtggaaatacttgcctgttctgggggtgtacacgtgtgtgtgcacacagatgaccctgtacagtgattgtgtatgtgcatccctgcctctgtgccatggtatatatatgtgctctgtgtcctgcagtgagttgtggctgcagcacagcctcataggcatatgtgtgcacatttgttctctgaacacacaggggcttcacatgtgtgcacgtgtgttctgaataaccaggtatgaattgggtacatctaggccctctgggccaggtgagacctgagcgtgtatacctactggcttgtctctgcaactcaggtgtacatggaacaaataggtgtgagtccgtgtgtgtgagcctgtgccctgcgcacgccatgtgtgcattcctgtgtgcgcatgtgctgttgtgctcggatggtctctccagccacccagctgtgattccctcttccccgcaacaggagagctgtgctcgtgtcctgctcttccgtggagctaacagggatgtccgcaactacaacagccagacagccttccaggtacaccggtggtttacaggagctcaaggctgccccagaggtgtctgtctctgtgtccatgtgacttgacttctctgaaccttggttcttccctggaaggccctaagggagcacctcccccaggactgcccacaggaggtgttgggggacgagcccagcacgcgaggggtatttggtgttgatgttcccttcgtcccctcgccagggagagaggagggtcagcagggctctggggcaggggtatggggaaaatgagaagactggggtgacaggtgtgggtctgaccccccaaccccgagagaccagcaggggtgcagaagccaaactgcagagggggtggagaggggggtggtggaggggggtggtggagaggggggtggtggagggggatggtggaggggggatggtggaggggggtggtggagagggggtggtggagaggggggtggtggagaggggtgtgatcctagccgctgatgtaattcaggggaggtttccgggccctttctctggccaggttggttggcactgatgaccaggtggacgtggtctctgacttggagtttgttggggagtcgggaatattgtgggggtttgcggaccaggaacagagccagaactcctctattttcagtaggagtgagatgtgggaagagtggtcaggctgctgaggttgtgtggtcatagaaggtggaggcagcagtgggctgccagatgggtttgggcacactgggaagcagatacgcccgggcctgttggatgactgggtgcagggtcacaggaaggggaggatgagcttggcagcttgggcagctgcggggccttggctgagatgggaaacatggctgcatgttgggacagaccagtgtgcccgtttgcttgggactgctggttttagctctgaacttctgtccaggcagcccctcagtcccaggcagacagagggtgggtcactccagttatagggtgtgcctgtggcatcccagttacagacaagagtgtgtgtcagtagagaagaggaatgggctggggtctccggggcccccaaccaaggaagactccacacacgaactggagaaggagcagctggggctggctggcgaggcaaagctggtgctgctcagcccctccctgctcctcaaggccttgacctcccctttccctcaggtggccatcatcgcagggaactttgagcttgcagaggttatcaagacccacaaagactcggatgttggtgagttctgcccacctgggcgaccctgctgaatgtagattcgtgtggttttctggggcccagcagatgtgggggtcagtggtgacataaaggggccccacaccccacatctacactgtgtggccagtggtctctgagtggccactgcgggcatgaggaacgggccacagggcctgtgttgagtgaacattgtttttggtctgggagaagagcatggtgaggtttgggctgtgggccggggctagcattcagcttagggggcagcataggttgagagtggggttgaagttagggtcagagtccctgtttcccgttaaatcctaggaagagccagcaggagacatgggggtggtggacctcacttcaccctggagcaagcatgagtcttggtggtccgtagcaagctctcagcatggaaagatcatgtaaacgacacataaggaaaacaacagtgatgggaaagcagaatggggctgggaatagtgccatagccatcctcagggcaaggagctctgagccccctgctgcctgcgagtagaggaaagcctggtgtgtgcgtgactcacggtcctggaaggaaaaccaggagacacacacgtggcctcagccaggatacccgagcctcttggaggtctctggtgggtgtggggccaggctgggaccgtcctgttgtagctgccggagtcccctctgggagagttgtagctgccggagtcccctctgggagagttgctgctggccaggctgggaccgtcctgttgtagctgccggagtcccctctgggagagttgtagctgccggagtcccctctgggagagttgctgctggccaggctgggacggtcctgttgtagctgccggagtcccctctgggagagttgctgctggccaggctgggaccgtcctgttgtagctgccggagtcccctctgggagagttgtagctgccggagtcccctctgggagagttgctgctggccaggctgggacggtcctgttgtagctgccggagtcccctctgggagagttgtagctggccaggctgggaccgtcctgttgtagctgccggagtcccctctgggagagttgtagctgccggagtcccctctgggagagttgctgctggccaggctgggatggtcctgttgtagctgccggagtcccctctgggagagttgctgctggccaggctgggaccgtcctgttgtagctgctggagtcccctctgggagagttgtagctgccggagtcccctctgggagagttgctgctggccaggctgggaccgtcctgttgtagctgccggagtcccctctgggagagttgctgctggccaggctgggacggtcctgttgtagctgccggagtcccctctgggagagttgctgttggccaggctgggaccgtcctgttgtagctgccggagtcccctctgggagagttgtagctgccggagtcccctctgggagagttgctgctggccaggctgggaccgtcctgttgtagctgccggagtcccctctgggagagttgctgctggccaggctgggaccatcctgttgtagctgccggagtcccctctgggagagttgtagctggccaggctgggaccgtcctgttgtagctgccggagtcccctctgggagagttgctgctggccaggctgggactgtcctgttgtagctgccggagtcccctctgggagagttgctgctggccaggctgggaccgtcctgttgtagctgccggagtcccctctgggagagttgctgctggccaggctgggactgtcctgttgtagctgccggagtcccctctgggagagttgtagctgccggagtcccctctgggagagttgctgctggccaggctgggacggtcctgttgtagctgccggagtcccctctgggagagttgctgctggccaggctgggacggtcctgttgtagctgccggagtcccctctgggagagttgtagctggccaggctgggaccgtcctgttgtagctgccggagtcccctctgggagagttgctgctggccaggctgggaccgtcctgttgtagctgccggagtcccctctgggagagttgtagctgccggagtcccctctgggagagttgctgctggccaggctgggaccgtcctgttgtagctgccggagtcccctctgggcgagttgctgctggccaggctgggacggtcctgttgtagctgccggagtcccctctgggagagttgctgctggccaggctgggaccatcctgttgtagctgccggagtcccctctggtgcctgtgcctctctctggtatatggactcccaggacccccttcctgccatgagtgtttactcgtgggtgtccccattttttgtttttgttttaatttgaagtgacagcgggcagcaaacgtctggagcagatgttagggttggactctcacttggttctaatgtgaggtcatggtcagggctggagttgaattttggactggggttaagattaaggtcggtttcatgtttaagggcccttcttctgtagagttccccctgaacatccccctgtaaggcttggttatgagcccctccaccccaggctgtgtcagttgaaccatctgaggctgtggcagaccctcggtgaatgccacagctgctctcaaggccactgcagggaagtgtgtgttgaggaagtaactgggccagtgggatgggtaggatcggagtccagggtcaggtcaggggagaactgtggtaaggtttgggtttgcataaggggcagcagatagttacttctggtttgggctggtgttttggaggtggcccttagtgttggaaggccctggtttgtgcatgtgtggggcctcttcctctttttttttttttttttgagatggagtctgcctatgtagcccaggcaggagtgcagtggcgcgatcttggctcactgcaagctccgcctcctgggttctcaccattctcctgcctcagcctcccgagtagctgggattacaggtgcccaccatcatgcctggctaattttctgtatttttagtagagacggggtttcaccgtgttagccaggatggtcttgatctcctgacctcgtgatccacccgcctcggcttcccaaagtgctgggattacaggcatgagccactgtgcccggccagggcctcctcttctgcctataattgtctaaccgtgggaaagctgtctgggacctctgcgcctcagtttctcttaagtgaaacatggtctcttatggtcatttgcatccccttccccctgtggtgtcctgtggcgtttgatcctgggtggggctggactcttgccggtggccttggtctagttgcttggagggagggcgggaaggccccatctgcccctcatctgtgcgttgtggacagataccccagggctcttggagtcaccatggttgcgacttactggctatccaacctaggtgtgcttgcttggttggagttagacacacgtccctcagtggtaaggagcaggcacctgtgtcagttcatcctgatgtggtcgtcggctccatgggccaacaacacccttacctgatcaggtgccacacacagacactagggtgacaccgccagatttccctgagtacaggcagcatatttgtcaggatttaatacaagccccttatctcaatttgccctctcaacaaccccccaaggagtgattagactgttttacggagaaggaaactgaggcacagagggggttaattcagacctgattgattcagggtctgcctttgtcactcccatgccctccgtacacatttgctccaaggacaggacagtcatgacttgctacatcctatgcccactggggtcccagagtggggcctgtacacagaagaggaactggaaggaggtgccgccttctctggtgggcaggtgccacccggtgggatctggtagactgggacctgtgtaacccttcaggcaacaggatagcttgctgcctctcgacagccttgcttgccccctctagactgacaggccttgggtggggtccctggcctgggcgtggaatgggcatcccacagtgcttttgatgagtaccttggggaaatgcttctccagggtgctgtcatgcccatgagaacacacctgtgcctgggagtgtgtgcctgagagagggtaagagacaatgtggacccaaagagtgacccgacgtgacagaggcaaggaagcagaggtgaccacttctaggccagaatgattcagtagcgttctgtatattcacggtgttgtgcagccgattctattgaattcaaaacattttcatcaccacaaaagaagaccctggacacattaagcaataattctgcatcaattaccctctccctccaactctgtcagccattaacacactttcgtctctgtggactatagatttacctattcttgatatttcatgtcaatggaatcatataataagtgacacttagtgtctggctgcttttactcaacatgtttttgagcttcaccttgtaggatatatcactgcttcattccttcttatggctgaataatatttcactgttggtataaatgacattttgtttatgcattcatctgtcaatggatatgtgggtttctaccttttgactgttttgaatattgctgctgtcaacatgtgtgtacatgtacttgtttgaatatctattttcaatctcttaggtatatacctaagaatggaattttggaatcatatgataattctatgtttaacttcttgaggaactgccaaactgttttccaccattttgcattcccaccagtgatgtatgaggcttccggttttttcacatcttcaccaacagttgttactatcttttttttttgaccgtagccatcctagtaagtgtgaaatggtatttcattgtgattttgacttgtatttccctagtgactaatgatgttttgcatcttttcatgtgcttattgggcatttgtatatcttctttggagaaaagtcaagtcctttgtccatttttaaattgggtcatttatttttgttgttgagttgtaagggttctttatatattctgaatactaaacttgtgtggaatatgtgatttgtaaatattttctctgtagaataggagatccttgtcacttttttgataatgtcctttgatgtacaagaatttttaattttgataaagttcaaggtatctatttttttcttttgttgttcatgcttttggtgtcataggtcacgagggtttatcctctaggttttcttctaagaattttacggttttcactcttaggtcactgatccattttaagttttaacttctgtttatggtgtgaggtagggagccatcttcattattttgcatatgaatatccaattgtccagcaccatttgttgaagagactattcttttcccattgaatggtcttggcacccttgttgaaaatgaattgatcctagatatgtgggtttatttggactctcaattctatcccagtggtctacatgtatattcttatgccaggaccacatggtttgattactgcagctttgtagtaactttttatttttatttttttggagatggagttttgctcttgtcacccaggctggagtgcaatggcgcagtctcagctcactgcaacctccgcctcccaggttcaagcaattctcctgcctcagcctccaaagtagctgggattacaggtgtgtgccaccatgcccagctaagttttgtattattagtagagatggggttttaccatgttgggcaggctggtctcgaactcttgacctcaggtgatccacccgcctctgtctcccaaagtgttgggattacaggcatgagccactgcacccggagtgtagtaacttttgaaatcaggaggtttgagtgcttcaacttgttcttatttgttatcgttttggctaatcagggcccctggcaattccatatagacttgaacattgcttttctatttgtgcaaaaagggacattggaattttgcattgaatctgtcatcactctgggtgacattaacattttaacaccattgtcttccaattaatgaacatgggatgtccttttatttatttaggtcatctctaagcagtgttttgtcattttcagtatatagatttttttacttccttagttaaatttattcttgattattttcttcttctggatgctattataaatggaattattttcttaatttcctttttggattgttcattgctggtgtgtaaaaacaagtgatttttgtgtgctgatcttgtgccctacaactttgctgaatttgtttattagctctagtagctcttttggtgtattctttgggattttctacatataggatcatgccatctgcaaatagagatagttttacttcttccttcccaatttgggtgccttttttttaatttttatttttgcctgtctagaactttcagtacggtgttgaataccagtagtaaaagcaggcatctttgccttgttcctgatcttagggggaaagcattcaatctttcaccattgtgtatggtgctatctatgtgtgttttttttgtttgtttgttttttgttttttaaatatggaatgcttcattaatttgcatgtcatccttgtgcaggggacatgctaatctctgaatcattctaattttagtatatgtgctgcagaagcaagcacttcggatttttaataaatttcctttattatgttgaggaagttactagcttctattactagtttcctgagtgtttttataatgaaagagtgttggattatggcagatgctttttatgcatcaattgaaatgatcatttttccccctttgttctattaatgtgatgtattatattgattacattagtctgtagatttcttttcctgcaatgcccttatctggctttggtagcagggtaatactggcctcgtgaaatgagggagtgttccctcctcttctgttttttggaagagtttgagaatttgtgtcaattctttaaatttctagtagagtgcaccagtgatgccatctggtggtggacttttcttcgttgggaggcttgtggttaaggattcaatctctttgcttgttataggtctgtttaaattttctgtttcttcttgagtcagttttggtaatttgtgtttttctagaaatttgtctacctcatctagcttttctatttgttggcatgtaattgttcatagtgttatattcctttttaacttctgtaacactgatagtaagtccccaaatttcatttgtgattttagttatttctgtccatcttctctccttactagtcaatctagccaaaggtttgtcaattatgttgatattgtcaaagaaacaaccttttatttccttgattctccgctgtttttctcttttgtttatctctgctctaatcttactgtttccttccttctgctagcttttctttcttttgctagtttggtttgctcttctttctcttgtttttttgtttgtttctttttggtctttctctagtctgtccgtccctccgtccctccctctcttgcttccttcctctttattttgtttgctcttctttctctagtttcttcttttcttctctctctttttttttttggagatggagtttcgctcttgttgcccaggctgtagtgcaatggtgtgatctcagctcaccacaacctccgccaactgggttcaagcgattctcctgcctcagcctcccgagtagctgggattacagggacccaccaccatgcctggctaattttgtattttttagaggcagagtttcttcatgttggtcaggctggtctcgaactcccaacctcaggtgatctgcctgcctcggcctcccaagtgctgggattacaggcatgagccactgtgcccggcctcttttcttttcttttattggttcattcatacagacaaggtctcactatgttgctaggctggtcttgagctcctgggctgaagtgatgctcccgctttggcctcccaaagtgctgggattacaggcatgagccactgagcctcgccttctcgtttcttttttgtttcttttttttcgtgagatggagtttcactcttggtgcccaggcggtagtgcaatggcgcaatcttggctcaccaccacctccgcctcctgggttcaagcaattctcatgcctcagcctcctgagtagctgggattacaggcatgcactgccacacccggccaatttttgtattattagtagagacggggtttctccatgttggtcaggctggtttcgaactcccgacctcaagtgatctacctgccttggcctcccaaagtgctaggattacaggcgtgagccactgaacccggccttctcttgtttcttaagatgtataattaggttattgatttgagattgttttcctttttaaaagtaagtgtttacagcgttgtttccctttaagtactgcttttgctccatatgttgtatttttgttcttgtttgtcttaaagtgttttctaattttccttatgattgatttcttttttctctttctttcttttttttttttaagagatgggatctcactctatggcccaggctggagtgccctggcttgattttggctcactgcagcctcaacctcctagtctcaagccatcctcccacctcagcttcctgagtagctgtaactacagggtgcagcaccacacctggctttttctattttttatagagatgggggtgtcactatgttgtccaggctggtctcaaactcctgacttcaagtgatcctcctgccttgacctcccaaagtgctgggattataggcttgagccaccatttcttttttgagcctggtttcttttttgacacattggttgcttaggagtatggtgtttaatttccacatatttgtgaattttccagttttctttcacttctcgatttctagctttgtttcgttgtggttgaaaaagatactttgtatgatttcagtcttttaaaactttatcaagacttgttttgcggccaaacatacagtctgtctgggagaatgttccatgtgtactcgagaagaattcttgaatatattctgctcttgttgggtggcatgttctgtacgtatcgttgagtctaattggtttaagtcttctatgtccttattgatctctccagatgttctacccattattgaaagtaaggtattaaagtttcttactattattgtggaactgtctatttctctcttaaattgtgttgtttgtatcatattttgatgttctgttgttcggtgtgtatatgttagtaattgttaatcaacatataatgtccttctctgtctcttgttacagtttttatcttaaagtttattttgtatgatgttaatataaccacccagctctcttttggttactatttacattagattgctttttttatcctttcactttgaacctatttgtgtctttggatttaaagtgattattttgtaagtagcatatagttggataatactttttaatcactatctgctttttaagtaaaattctattggaacacaaacacacctatctgcttgtatgttgtttgtggtggttttcatgctgcggtggcagagttgagtcattgcaacacagactatatagcttgcaaagccttaagtagttactgtccaattctttccagaaaaggtttgctgatccctggtctagaatgtcttttatagtttccctggttatagttaactgcaaatggtcctgttcagcagtagtctggtgagattcgtcacatgtagcctgttttgtctctcctgaagcttgtgaaatgcagttcttagagcatatctgagcaccctcaaggcccctttcggctgagaggagaagcaggcttctacctctgaagctagggtgagaggcagtttgactgggatgtggccccttaatggtagcttcatttgtagggtggccaactcttttggtttgcctggaaccaaggcagttcctggaacataggatttagttttaacatctggaaagcctgggcaaactggacaagttggtcacccagctggctgttcagagtcttacctatgcccccttaccccagtaccattcagggaaacccccagctatgcgaagcggcggcgactggctggccccagtggcttggcatcccctcggcctctgcagcgctcagccagcgatatcaacctgaagggggaggcacagccagcagcttctcctggaccctcgctgagaagcctcccccaccagctgctgctccagcggctgcaagaggagaaagatcgtgaccgggatgccgaccaggagagcaacatcagtggccctttagcaggcagggccggccaaagcaagatcaggtaggagggggctggcaggccctggaggggttgggagggtggggtgccgggacctgagccaggaggagccagcaccgggaggcagagagaggcctggtggtgcctagcacctgtgtagtgatgggctagggcttcctggttggggaagggaagaaggcatctctggaggtggggacaggcacatgcacgctgatttccggttggagctgggcttgccatgaggacagtgggcagttgagggagcgtgttaggtggagagggtatgctcctacctgtgatttagaaaacacactgcattgtcaggcatggctgggaagagtcagggctggtggcctgtggtaagggggacagggatggagttgccactccagtagggcccaaaacctacaggtaagccccagccctgtccccagggtatactcatggtttcccccagccctggcacacctacaggactctgtggcttctattctttaccctcaccctgaggcctgggtccctgaggcagggatgcctggaccggagcccactggcctctctgggctgtgcattgggtgctgaggtgggcgcactggctctcagccactttgtgcctgggcttctcatcagtaagtgggaatagtcctacctaagtcattgtctttgggaagccttccagaatgccctgggcaggtgagggatcacctggcagagtctggcaactgccggtaaaagcacctgccctccctgtgccttgaaggcaggcaccgtctttgtcgtttcctagtttcatcagagccaggcactgaggagggtgtttggcagacattgttgagtggaagagttacataaacagtatgttgttgtcaggatggccgccggcctttacagttctgtcagtccaggcccgctgttgggctgaatggcatgtgtatactagctcctttaaccttgacgaacgtacatgttcatgctctattaataccatgttacagatgagcgtcctggtacgcaggtggggcctgtgacgggtccagagtcacagagctacggatcagcttcactgggccccaggtagacccaatccccaactttctaagcctgagtgttcagcagagggctcagggtgcagcagggcctatggaaggcgccccttcctgtgctgccgcccctgctctgcagcctggtctcagcgatgtctccgtgtctgtctttgcctgggcttgttggactcgcaaggctggctgtactgccccaaatctcaattctcccctgaagctttcttatagacccgcggattttctaagggctgggcggcccagtggctgaaagaacacattctgcattccggatgtttccatcccgcagaaaggctgctcctgagttggaggcacgcgttgccacaggctcctccctgcattcattttttgtacgtgttcattcatcctttcagcagacacaaaactaagacctgctgtgtgaggggctccagctcacctgctctgtggggatggcagaattctgttttttccttcctcgcaaacatttattgggtgcctggtgcgtcagaggtggtgggtctcaggaagttgacagccgagggcccgggctaagcagcagttaggtgggcagtgatccccttatggggctgccctggtgagtggacaagggtctgcagctctcgggaggggctgaggaagttcggtgccccgaggagagaagtcaccccctgggggaggcgaggctgggccctgcaccgcgcgggtcgctgcgccctctgtcggttgagccggaccgggacccgacccccatcagccccccagtatcacacggggcacggcgggggagtttgggctgagagcccgtcacttaacagctggcccaggggtcaggatgttagagtagttcaggtgttggcaactgcgtgacggacagcccacaggaggggaaggagaggtgccccgtgtgactagagcgtagcaaactgccaagcccgagggagcctggctcttggaaaagcgggtggctctggcctgcctgggtactagggagccactgcaggcttctgagcagagccccagtggaggagtgagagctcaggctctaccccagtctgggagtggtctggggaaggtgggcatcacgcagtgggcgtgggcaggggccggtgtccaggacgaggggacccaggcctagagggggactgggcacccagcgatccgggccctggacctggaggggtggggggggcgcccctccctcccgttcaccggctccaggcggctttgctggtgcccgaagcccccgccccatcccccgctcccactaggctgccctgaccaccgtcccgcgtccgcgtccgaactccccctcccgggggtcggcggcgaggggagggcgggagggagggcgcgagggccgccaccaccgcccgcagagggaggagcccggccgtggaggaggcggggcgcggggcggccgcggcatggagcgagcctggcgcgcccaggagctgtattcgaattcgagctcggttccccgcgccccctgcgccccccgcaccgccgccccggggcccgaagcggaaactttacagcgccgtccccggccgcaagttcatcgccgtgaaggcgcacagcccgcagggtgaaggcgagatcccgctgcaccgcggcgaggccgtgaagggtgaggggcgcgggggggcgcgggggggcgggcccggcgcggggagggggcggcgccgcgcgcggtgctggccgggccggggcagtggctctggggtctcctctgccggggcggccctgggcccttgtgggatccctggtgtcacggtgaagggctctgcctggggaaggttcctgccgtgcgggtccctccggtgctctgtcgttccgggctccctgtgtcaccacggaggctcctctctcgccacgggcgtttctgtgtccccgggggtctctgcctgaaggaccctgtcccattacagagcttccttgcattgcggggttcccgtggcacttctgcagcttctccattggaggcccctgcgatgtgggggacccttgccgtcgtggggtgtctgtgaccgtcatgtgggtgtttgtgttatgcaggcttctgtcaccggggcttcctgtgttctggggggatcgcgtgccatgacaaacccctctcattctgggggtctcggggccatcactgggctcctagcctcagggccggctgaggtggaaacagcccagctggtgcatcacgtggcctcacccactggccacagcacgatgaccccgagctctcggcagtgacccctgggtgggtgacagagccaggatgggggtcggttgaaggggctgggggagcatggtcagctgggggtgggggcagcagcaggagtgtggcccctgcccctgcctgcgcccctccccgagtgtgtccatctgtgtgtctctctgtcccccacatgcccaccctgtgccgagcccatctgttcctttctctcttctgcgtggatcccaaaatcttcccagggaaaaagctgggagaaagtgggaagggaaggagggaaagggcagggggtgggtgggcagaacctgctcctgaggtggggtaggcgcccagctctgctccccactgacggcctgtctggcttcttcctccagtgctcagcattggggagggcggtttctgggagggaaccgtgaaaggccgcacgggctggttcccggccgactgcgtggaggaagtgcagatgaggcagcatgacacacggcctggtgagtgaccccacggctccccgggcagctcccaaggggaccaccccttccagtttccctttgttctctcttggtgctaaatccacatggatattcatagagaaaagactagaggtaaactcaaacaaacactcaaagtagatgcaaacttgtgtacatgacacagacacgtgtgcacacactctgcatatacttgggaacatgcgtgtatgtaacctgacgcttcacgtgcagtggagacacataggacgtgtgtgacggggcctctgtctgtgtgatcccacattgactcccagtgacttgcaccccaccagcacagtccttcagaaacaccaggtgtgtggaacgcatgattcctgcgtagctggcagacatgtaaggaggtcagtgtgagaaaagaggcgtttttccaaagtggacagattgtccaagtgggcagagcaggcaggcccggagcagccaagaggaaatgaggccagttgggcctggaggtgccctggtgagtgccctggggcagggatggtctgagggcagcaggtgaggctgggctggtcctcagcctgcagggaggatgtgaaggtgaaggctgcagctcctgggttggtgagtggctgctgtccagccctgctgaccatctggtcctttgggggcccccgggctggagctgggtgcgtgtcttgggggtgcccttgcaaggaaccctcaggggtcccgggaggcccccagatccatgcatgtgcttctgtcctggagagctggtgggccaagcaaacctctcctgagtgatggtcactgggggccatcggtggtgtgtctggatcaagggtgcatgcaccctccctctgcatgtgaagggctcaggcctggggttactgtgtccccatctctgtgtccccacctctgagagtttcccagcgactccacccctgtacggcctggacccctgccctgtgctgagctcagcagaggcccagggaggcaggagcttcgccactgaccttttcctgggccggtgccctttcctccttccttggccttgttctgccttgctctgactggtggcttagagtgtggaagggacttggccccctgttctcagcccgcggagggtggatagggcagggtccagatgggaaatggtttcagagatttgggccctggttcagacagtatgggagaggggaggggaaggagaggtagggggatccacacctgtggcgggagcgggtcttgagctcccccacgtggtggtgaggaaggttctggtttgaggactgtgtggagtgaggggcatttggacctacgtctgaagctgacggggagggaggggggtttaggctggagtcagaattggagagcagcaaatgttttttaggtgtttgtcatgtgctgggccctgtgctgggagccgggatcacggaggctcagctggaagccttgtgggagcagtggctgtgacgggggccgtgtgagcgtgggagctccctgggctggcctgaaggagtcagagagggcctcaaaacagaggcattgtctgagctgagtcctctaggtggtcagcggctggggctgaggggacagccgtgtgtgcagggtccgtgtggcgctctacagctgtgtgtcagcacggcctgctctgagtgcctggcacagttttagcacttctacacgtataagtcgttgactcatcccagcagtcccaagaggtggggccacttgttgttattccatttctagggggtcacatggccctgaggggcaaagtcttgtttgcaacacaggcagcaagttctatgtgagtgaaacgcctgcatggggtgaggggcgaggctggtgtggggaccacggggtggtcaggtggcatggagtcaagtgacagtgtggcatcatggcggagggaacccagccgcagtgtctgattgtgcaggttgtgtaggatcaaagcccgggctgggcagagcagagcaatggagaggagggttcaggtctgggctccagccagcagccatggtgtgtgtgacctggggagtgagtgtcagaggtcccggggtagacgggagtatttcatgagtgggcagcgggagagggacctgcggaggctgcctgcgaagggcagggagtgggagcagtgacagtgccctctgaccttggctgcaggccctgctggccacactgcgcagagcctctgctctgggatcccggggccgagttctgccagaggccagagtgcagcccaggaacaggaacctgcttccaacaggcccagatctgctccccccaccccccaaaaaaatccatttccgggactggagtggggacagaaaaggacttaaaggttagggaggggacatagtccctgtgcgtgcaggggctggtgcccagagccggtgcctgctgtgggatcgggaggcgagtcctggtcacttacccagcagagagcagtctcccacggcacctcctggcaggcagagggtggagctgtgagggagggaatggagaagcgaggtcaggtgtgttctggaggcccagcaggagcaggccctgtgccttccctcccctccctccttccctttctttgcagtaaggtcagcacttgggtgggtagtaggagatggctgtgttgggcattttctcttcagctggcttttatgtgtcttattaacaaaactggaaaaatgagtttgtgttatgtaatccatacaatttgtttggttgacaacatctgaaaacaggaggctggtcaagtgcaagtgtggcgggttcttcagcaggcagcaccatgacacttccgtgcctctgtcgacgtggagaagggtgtgatggaggaaaggaggggtctgatgccccacctgagtggtgatgaggcttggcctgagctggccttaggttcagcgggatgaggggtgcaggtgtggttggggaatgccaggataagatataggtcatcagaaccaaggggatcctccaagttggatttctctattctatatgggcgggcttagagggggctgttgacttactgagagtcacacaacgtagtagctgggacctggaatccagcccgatacttttttgatatctgtgccttctgatagaaataggcactctttcctctttccgtccggccactgctccacctatgtttacagccatctatcctttgactcacccacccatcccaccatcatcttcttaaccgttgactcaccagccaacccaatccaccacccctcccttcctccatccatccacctctccacctacctgtctacacacccagtccatccatccatctacccatgtatctgtctgctctttgacctatctacccatggccctctccttccctccctccatccactggtccagtgcctttcaatccacccttctgtccgtctatctcagatgcacctgtccaccatttactctcctagtcagcatcccttctgtccgtctatctcagatgcacctgtccaccatttactctcctagtcagcatgcagaatgcctgtgacgtgccaggtgctgtgctgggtgctaggatcacagagataaagaacatgtggcccttaccctcaaggagctcacaattagtgggggaaacaggtcatcgaaagctgcaggttatctttctgatctcatttcctgccactctctctagctccctctgctccagctgcacaggctctgaactctctcaaatgctgcaggctgatgcctgccgtgggcttcccctgaccacccccgctcctgggaagccctttgcccacatatccacaggctgctccccatcctcagcctctgctcagccctcccgtgggggtgaggcctttgcgtgcctttctctgccctccctgatctgctcgctggtctcctgagcacttgccagcattcgcatgctatgtctttatcctctgtttatcctgtctcccagaacagattataaaccccacgagtgcagagactttgttctcttctctgctgtatttgcagagctggtacacagtaggagctcaataaatacttgctgaaggaaaacatggatcttgagaaatgctaccaagagaggaaatgaggaaggtgctgagggatgaaagcgaggcagtggtggtgctgcctgtggggcctttgcggtcctggagagtggagctgcggggctgggaaggctggtgggtggggctcgcaggcagctggaggagctcgtgggagcagagaggtcatggctggaggtgtggctcgaaccttcaggtcagtgagggtggagtggtgggcagacagctggctagcttggtgctggccatgtgggacttgagatcaagaggacagttggggaccaagctctgtgggatgcatcgaggtcagggcaggggacccagcccacacacctagatcccctgccccactcacagttagtctgaagcaagggaccccatgaggttgagcatcaaggagctattgtgaagaagttggtgaagacagaacgctgcttccatgccagcgcctataggcacatagcacggcatttgtacatgagtgtgggtaatgcagattcagatgtgcacacacacatgcatgaacacacctcacacgcacatgacggcaggtcacacagacacatgagcacggcacttgcacacagtgggctcatatagagacacgtgcatgagcacagcatctacacatgaccacggatctctcacacacacacgtatgtgcacacccccctctttgctcgcagccttggggctcacttacgctctgtggacggctctggccttgtttggactcctggttcagcagctacttaggaaagagatgagctgctgccccctcttgggccctgacccacggaggtcagaattccctacatcatcccctcagccttcttacctctggacccaggactccaggatttggggccccctacttccatctggacacaaccaggccaagggggtgtgtgtgggcagagactggtgaccagcatgggtgagggcagttgaggcaggccagctggaggccacgactgtccatcagctcccgatactcccttcagaaacgcgggaggaccggacgaagcggctctttcggcactacacagtgggctcctacgacagcctcacctcacacaggtacgtgcagggaccctggctggcgggagcatgcatgtgggacgtggggcaggacctgcagtgtagagggaggccaggtatgaagaggtcagaggagggcaagggaatgtgcctggccgacctctcttctgctgcccggcctgtcagtcccggggtgactgcagggtggactgtggccggccaacctcgaggcagggcttacctcactcctccctgctttccttcatcagcgattatgtcattgatgacaaagtggctgtcctgcagaaacgggaccacgagggctttggttttgtgctccggggagccaaaggtaatggggagtgggtgcccgggggtcaggcaggcaggggctgcacaccgctcagggatgtcttcagcttcttgcttctgcccccaactctgctctgccccacactccctccctgccttgcccctgcggctcccgcttttggccccggctttcctggttcctctgctcggtcgcgaccgtcgtggtttgcaacgtcccggcccaggcggcaattccttcccttcgttgttttccactgtctttgctctagagtctaaccgagtgggggcttttctggcatgggcaaagggagttttgcagagggtcatgtctaggatccttgggccggctcgtccctgcgctgtggctccccgtggccctcccccagccccgggtcactgccccccgcagtcatctctttcctgtgctgagccactcggaggttgctgtgtggcagccgcccccacccgaacctagctggtgaagcgccttcctaattgccccccgcagcagagacccccatcgaggagttcacgcccacgccagccttcccggcgctgcagtatctcgagtcggtggacgtggagggtgtggcctggagggccgggctgcgcacgggagacttcctcatcgaggtgaggtcgttctggccggtgctgcccagtgggatgctgagccctgagccctgtggtggacgtgcctggggcgtccccacccagctgcctgtctatcccaggtgaacggggtgaacgtggtgaaggtcggacacaagcaggtggtggctctgattcgccagggtggcaaccgcctcgtcatgaaggttgtgtctgtgacaaggaagccagaagaggacggggctcggcgcagaggtgaggggtcacgcttcaggcctctgtgcccaaactttcccctgaccttagacctttgacttcaggcccacattcctcttcccatccctgacccccaactgctgacatcagattcctgaacctcaatgaaccacccacacgtgtgggctgggacccctcccgatccctggtgctagactgccagtcctgtcccctggcctgaggcctttgacccctgacccctgacctcaggctgcccctcctcagatccctgccccctccttcccggcgttcccccagcccctggcgtggcagagccctccttccctacaccgccagcagctgcctggaggccggggttgccatagcaactgtgaggttgacgctgccgcgctgcttattgtcggagggaagggggaggcggcacctgagggaagaggaaaagcgtcttctccccgcgacgacgcggcacagcctgggcccaggaggctttgccggccaggcccagcccaggcccgtggcttggctgaccacaccctggccccacaaggggcagtggccacccgggcctggggggagccctggagcagcaggagccccgcccgcaaggagacccctcccagcccccaccccatggctctggtgcccccttgcttagccctcgaagcctgcagggtgggtgctcaggccagagccagccggcaccgtgacccccgccagcacccttgatcgtctcctgaggccctgattctgggggttcccagggcccctgaggccctgaccgcccgcccccccccccccgcactccctgagctccttgagccatgaagaagtttgcgtccagccgtaacctgaacaagatcctggcacagtgcgactcatcctcgcgggagtacgaggagatccaggcggtggagcgcaagtggcacctgcacctggccacgccgcgccgcctgctgctggacaggaggtccaaggcctccctcttctttgcagccccaccgccccccaagagggcccccagcaccacactgaccctgcgctccaagtccatgacagctgagctcgaggaacttggtgagtggcgggggtggcggtggaggtggacgcaggtggacggtccatgatgggcagacagggccgggagacacaggtggtacgggagggcaggcggtccagccagagggtaggaaggacaggtgggtacaagagcaggtcagaggtgaatgggtgggtgctggcgcgatggggaaatttggtgcttgtggggtgaggagagggtggcatgtggaaggggtgagatgtgagaggctggggatggacagtggggtgtccaggacagatgacggggagcagggcctggcccaccagtatgtttgcatgtgtgtgcatgtgtgtgcgtgtgctgcctctggttttccacgtctccactttgactttactcctgcatttcatccaagtgaggagagagcggtagtgaggtgaccagggtctgctgctggctctgccaggcactggctgtgtcagctctgtgtttattttaccctcttggtgactgtgcactcattgacaggtggccctgctgaccccacaggccacaggagtactgtcggtgggatgatggggcagggcctcgagcgcggcaggaggggagcaggagtgtgttggggtttgatggggcatgttctgggcacaagccctggttgaccatcaacagcctcttcatgggcaggtcttatatatgtgtccattaacaaccttgtcatgtgcacgtccagatatacttgatcatgtcctgacgtgacagtcagtagcctcttcatgggactgtcccattacgtgtgaccgttgtcctcactgtgggtatgtgctatacatgtggccatcaacagcctcgtcatgggcatgtcccactgtacgtgacagttgacaggctctttctttctttttttttttctttttttttttttttgagacagtttcactcttgttgcccaggctggagtgcaatgacacgttctcggctcactgcaacctccacttcttgggttcaagtgattctcctgcctcagcctcccaagtagctgggattacaggcacccgccaccatgcacggctaatttttttttttttttttttgtatttttagtagaggcggggtgtcaccatgttggccgggctggtctcgaactcctgacctcaggtaatctgcctgcctcggcctcccaaagtgctgggattacaggcgtgaggctctttctttctgtgatctgagcccagttctgttcccagacttaactctgcctctggtcatagaaggaaccccaactttggtcctaaactgaaccctgaagtcctggccacaggaagggaccccattctggttctaggctgagccctatccctggcttcagtcttggttctaccccagccatagaaggaacccttttcctggtccccagaattatccctgacctcactcatgaaccaagccctgaccctgtccttgccacaggctgagctgccccatgccaagcaggtggtcttaactgcagtttagttcagggtggagaacagctaccaacgtccattgggctgacgtggtcagaattttcaccatagctattccaaataaaataaaacccaaagaaaaaaacaaaaaaccccatgtagataattcagaatgaaaaggagagaaaccaaagccagaggcttccatagctcgttatctagtacgcaggggcaaggggttggggtcctgaggcccccacaaggctgggagacgtggctggacctgtgagaagcgggaaggttaaaaaccaagcccaaccactggaattagcttcgaaagaactggaaatcagagaagaatatgaaaaacattaaaataaagtaaattgtcacaaagattaaaagaactaacagaactaatgagagaataggacagaacaaacaagcaaaaaaagaataagcacattttagaatgattcttttttttttttttttttttttagactgagtctcgttctattaccagctggagtgcagtggcgcgatctcggctcactgcatcctccgcctcccgggttcaagtgattctcttggctcagcctcctgagtagctgggattacaggcgcacaacaccacacccagctaattttttgtatttttagtagagatggggtttcaccatgttggccaggctggtctcgaactgctgaccttgtgattcacctgcctcggcctcccaaagtgctgggattacaggcgtgagccactgcgcccagccagaaggattcttaaagaactgttattgaaacaaaaagtgtagtcactgagataaaaaagaaagccatgcctgggataaacagtacactagacccaggtgaagaaagaaacagcaagttagaagataaatctgaggttacccagaatatagcacagaaatataaggagatagaaaatatcaaagagcagttaggacacacacacacaaaaatcacatagataattcaatgggactattgggaaaatcccagcatctacctaatgcaaggcgtggaagcaaaaataaaatgttgcctggaggcaatatttggagatgagatggcttaagaatttccgaaagttgaacaaagacatgagtcttcagtttaaagaaatataagtctcagcaaggaaataaaaacaaatctgtatccacatctttcatagtaaaactgtagaatgctgtgagcaagcagaaatctttaaaacaatgagagaggctgggtgcggtggctcatgcctgtactctcagcactctgggaggccaagacaggtggatcacttgagtctaggagtttgagaccagcctggggaacatggcgaaaccctatctctactaaaaatacaaaaattatcctggcatggtggtgtgtgcctgtggtcccagctactcaggaggctgaggtgggaggattgcttaagcctgggacgtggaggttgcagtgagccaagatcatgccagtgcactccagcctgggcaacagagcgagaccctgtctcaaaacaaaacaaagcaaaaaatgatgagagagagagagagatgggctgctggatgtcttagacgggagcagtggtccaactgacaacagacttctcatcagcagtggcagatgacagtagatgatggaagaagagcttcaaagtgtggagtcaaaattcttttccacctagaattctataccccgctaatcctgctcattcaggagtgaggcagagaggctaatcctagacctctggcactcgggtcatgagggtccaaggtcagtcacggggagctgacctgtcaattgaagatccaaactgatcaataagccagcaccagtaggcagctgggtcccaggattctcctgccagaggctgtcacatagccacagtcagctgcatgttcagaagggactcttctattcagcaccacggggcttttgggcagcctgagatccgtaatcctgggacccagggactctgccctatggaaacggaaggactgcgctttgctctctgggcttttctgcctgaagaaactggtgaatgaagacgctcctttccctcccctctgggctgagtgttccctcttctgcaacaagcctcaggacaggttgctggagtcactttgcagagcccggtcttccagaggagttgctcacagcttcaggccaccataattttccaggcttttttctgagcagagtctgggggaggatgaagggacagcttagcgcagagcctctacccacacttctggagctcaggaagccaccctgtccccagaagacagctgtcctgggaagccagcagggcttctggaagtcccctctggaaatgcctgatttgaggacgccatgccagcatcagggtttccccaggtacctaagggaccatcccacaacccagtgtttttgctttcagaagatagaaatgaggcctgttggtcactgctggcatgaacacatcagaactgcctcacactgtcaagagctattagagccctttaggatccatagtctatcgagaaggtgcctggacacctaaaaagaaaagaaagtgaggtgtcagagaaagcaggtgcaagtcggaggctcctgtccaggtggctgtttgctgctcggaggatgtgggagaggcatggccctgttggaggaaggggagggaaggggtatcctgtgggggaatggggtgagcaaaggctggtgcctggaaaatggagggttgcagagctgggagtgagaggaaggggctgggtggggaccctcctgagataggtggtgagagagagaagagggcagaacacccctcctcccctcagcactgggggctcctcatggtcgccacatgcatgtctgctcggtttgtaccaggaatgtgctggggccacaggtcagtggagacccaggccagggaaggccctgtggcgggtccaagcccttcctgtgtattcacgttcccgggagaactctggacttccctgtaatttctgggcccctttttcttttgtgatgagaacatcagggtaggtgccacacccagcatctatgtgagtggccttgtcctggaaaaggtttctgtgccaaacacacttgccctgccttttaagaccgactttgaacagaacacagaggtgaccaccttaattttcagcgacacctgaacttgttttctatggggttttgccttttttctgaacaaacgtttgactgagccaagcatgatggagttgtgcatatctgtgtgtgtgtgcgtgtctgtgcgttggtgagcggacacgcgctgtctgcacctgcgtgcatgcggcacacatgtctgtgcgtgggtgagtggacacgtgctgtgtgcacctgcatgcgtgtggcacacgtgtgtgcatgggtgagcggatacgcactgtgtgcgcctgcatgcgtgtggcacacatgtctgtgcgtgggtgagcagacgcgctgtgtgcacctgcatgcgtgtggcacacgtgtgtgcgtgggtgagcggatacgcgctgtatgcacctgcgtgcatgcagcacacgtctgtgcgtgggtgagcggatacgcgctgtgtgcgcctgcatgcgtgtggcacacgtctgtgcgtgggtgagcggatatgcagtgtgcgcctgcatgcgtgtggcacacgtgtgtgcgtgggtgagcggatacgcgctgtgtgcccctgcgtgcatgcagcacacatgtctgtgcgtgggtgagtggacatgcgctgtgtgcacctgcatgcatgtggcacacacacacaagtccctgcttgtggttgtttcctccttggctttcaaggcatgtaccaactgactccagagttgggcagatttgctattcacggtctgataaagaggtgtaggctgggggcagatttgggaggtcatggtttttgggggaggtggtggtgagagggatggggtggggaaatgagtgtggataatggggcccgggtgccgagcctgcctcttactccctttactctgtttcttgattccaagcctccattcggagaagaaaagggggtgagtcatctgcctgtgtccccagggccttggctttgcctgacccctgtctgggggagtgctggtgtgtgaggaggttccagcgcaagtcagggtggcctggaagcctgggctgcaccctcctgttggccttctccctgggcatctggtaggggcatgagagaagggcctgcaaggatggatggggagttcccaggggtgtgaccctctgagactgtgatggccttgggggctcaggtgagcctggggcctgtgagctgtgcagatagcctgatggaggcagcccgtggggaggagctgggagagccccgtggaggccactgcatgcaccatggcccggacagcaggagggaaagggctccgagggtcccagagggggagctctagggagcagggagactgggccgtgttggcgtgcacgttgcttctttctgctggtcctctcggggcctgtgcttgggttgtgggacctactcccgtgctggttggttgtagggccaagcccagagctgatggtcccttcagagcaggggtctgagtcccacagcactggggaaggagcttggagctcccctggccaaagaccccaggctgttgactaccctcctgaacccccgttcaggcctccctctaccctttggggctgctccctgtatgtcctttatgttcagcctggttgcaggggagggcgcattcaggtggggacagtcacctgggcctgggtactgaggtccactgtctggtgaagtcctgggacccggcttccggcagcctcctctgcctctcgggtggatgggaatcagggcccagacagaggcttgaggtggctttctccacccaggcctgtatatttgctccacgtccgtgtacctgatgcccatccctccctctctctcgacccactgggctttccctgggtgaggacacatctgccaggcccttggcccagccctcttgaggtccccttgctgcctcttgccccagcccaggtgaagggcttccccagtgtcttctcaggtattaaaaacaggtgacaaggtctcctccagtgaccttttctgcatgcctttggggcagacatacaagctatttctggaatcttctggctctgccctctagctcgttagtggggctcccagggtgctgtgttgcagcccaggtgctgctccagttgtggaagaagtgatggctggttgatcatcccgcaggctggggccctgttgatcaaacagctgcaaacccagctgtgtcctgctgtgcacccagagggccctgggagtgagcgggtccacttggttcctgatgggctttgtttcccttaattatctaaaattatttatttaagaatatatcctctaatattggggggagatttatgtcaacctcatcagtttgtaatttgcagaattcttgatgaatcctttcccttttgaaaacacttctcacccggctccagcaccatcgccggatgaccagaaacagctgctcactaaacgttatgtgcgtcccgctgtgggtctctgggatgggtcttccagacctagagagacagcctctcctagcccgtggctcaggcggcaacgtgtctcccatgatgctgagccgtgtgtgcctcacggagttttctctccattcatatctttacttctgcagtttccggggagtatggtgcttaagtctcatctcttacttcctagtcagagatttatggcaatttcgcttcagtttgctcctgggttggataagggtgatgataaaatcctcgtgtagttgtgggatgagaggagtggtttgcataaagtcccgcatactctagaaatcaccaagaacttaacagatggtggcaatggtgacttcaactcccaaaaagaaatcattcacttcatgacaaaagcaaatgagaagtcccctcaaaccagcagcccctggtctgtacctgggcccctgtcacctggtggcactgggagctgtgcacaggcccagatatctgcagttggagcctgttttgctggtaaactcttgtatcgttcaggacacaggctgggcgctgatggaacacagagaacagtatttgctctgttctgcagacccggaagctgtctggggagatggggcacacagacatgaattgtactgaattgtgtccagtgccagcacagttgtaagcctttcttctgtgctaattctcactagagacacgtgagcgagcactgtttttatgcctgttttatcaatgaggacacagaggtcacaaagaggttatgtcaggacagagtcagtgtacagggtgggtctggtctgggttgggtacaggacagtcttggggagttccttccttccagcaatgctaagcttggggagttccttccttccttccagcaatgctaagcagattgcagaggtagaatcagcaggtgctgtgaacagctgcagattggagttggaaggagtaggaggtgtccagtctgaccgttgaaattctccaacaaggggccaagacaagagtgaaaggtgccaagacaagtgtggccagacagtggtccctctagggttggcatagccccaaagagtggagaagggcttggggttgggtgcagcctgagtgatgggtggggtgcagtggggctgctgaatgagagggccggtgcagcagccaggtggacatgagtgctgccccagcccttgctgcatgctgcacgcactggtcctcagtggacccacagggggcgagagctgcttatgtcctgggggagccatccaaccagggctctgatggtcctgagatacacgtattagtttaacagtttccaagtcactttgatcttctgtggaaacctgcttgtacatcagggtctgtcctcgggctgtgacccgctgtgaacagcttcccttccagtgcggtacagatagccaagagtggcctgtatgtgctgagaacagtgacaggacgaagggaaatggagggaaatccagggagactgtggtctctgaatcgtttgtctgtcctgtgccctggtcttctccctcatggtcagagtggcctttccttaagtgaggtccacagggtcacctggagtctccttgaggctagagaggctgcctggggtggggtctgagttctggggtgagggccttgtcttgggagcctggggtgggagctcaaggagggaggggagcggtggcctctgtcagcatcacgggtggccgggttggggaggacatggcagtggggcaggaggtggcccaggcagctgagatggagcctccttgctgtgcagagaagctggacgagatgctggcagccgccgcagagccaacgctgcggccagacatcgcagacgcagactccagagccgccaccgtcaaacagaggcccaccagtcggaggatcacacccgccgagattagcgtaagggccacgggcggctgggagcgctgggtcgggcaggcatgggggtcagactgtcctgggccctcttgacggaggtgagagcctatcatgtggacccctctccagaggggtgtgtgcaccccatggcctctctcagagactcttggggctgtctctgccccctaaatggccacagctcagcacctgctgggtttgctcttgtagcttttggtgcctctgccttcaggcagtccctgtctcacgcctgagaccaccaaggtaccccagctccgctgagaacacgacaaagcatgtctctgttccctgcccacttgccaacccggcgccttctaggctcctcccccaccctcacccagggtcggccagggtctgcacccaccctgcccaacaccgtctacactgtaccaccatctgcactgcccacacagcccaggctccaatgggctgcatcctctgctccctgagggcagagtccagacgtgattcctgggtccaggcacccacaggcactagtgccattggagtgagagcgtggggtgtctcacctctggcttaggaggaggactgggggcccccagtgccctggaacctccatattcccctccctgacccccacagtcattgtttgaacgccagggcctcccaggcccagagaagctgccgggctccttgcggaaggggattccacggaccaagtctgtaggtatggctgcgctgtggggctgcatggggtggggaggaacggggctggggccggcagggtggacttgggtttgaaggacactgcctctctctgcccataactggggtttccagtttccctctcagtcctgtctcttcctggccccagctaaaggatctcatacgttgatggacatgtggggattaggccttccccaacccagagctttcccccggcagccgacactccctgtccagtgggcaccgccccccatcgcctcatccctcccatgggcagtctcatccctgtccccagctgccactccctgtccactgggcacccccacctccccatcacctctcatccctcccatgggcagcctcatccctgtccccagctgccactccctgtccactgggcacccccacctccccatcacctctcatccttcccatgggcagcctcatccctgtccccagctcagctgcctccatcgcggttgctcccttgcagcccaagtgcatgtgaagtttctgaccctcaaaccccctgaacttgcctctcccctacttctccatgtattgctgtctccccccttcacagccagttttccccaaaaagtcacctctactgtccatcttgtctcccgtcccccaccggctcctcagcctgcggcagacttcctctctccatacccaaattgaaactgctcccaccagggtcaccggcggcctccagggccttcctccccatggatgcatggccagcactcctgctgacctcagctggcatttggtttctttgctccttcttccgtgaaacgctcctccccaaagctttaggacaacacttactggttttcccctcctttctcagatggcacctatttcaaccctgccgccccagcctcccaaatatgggaccttttcaaggctgtgtcttcagcctccttcccctctgtgcctcaccactccccagccaccatcacactccacactcaccgtctcctttcctgacccagatggggacatgtaacaagccctgcccactgtgcatccctccagacatccactctcccgtcccctgcccacctgtgcatctgtccacccacacacctgcccacttgaccgtccgttgtccatacaaaccccagcacacctcccatctgttacacataggagtaaacctctcagcacttactacgggctggacactgagcatttaatacttagaataaccatattgaggttgagaccactagtacctccattttacagatgagaaaactgaagcaaggagggtaaatgacctgcccaagatcacacagctgcccaaactcggattcctcacctgcctcaggaccctgccaatttgtgttcacacaaggccgatcctgggccaagtctggggcttggttagggaatgtgacgtgtgcagagagctcagcgggcacattgtgggtgccagggctcacggaccaatggagcccactggggggctccaagcacacctggtgtcacagaaggctgtgtgtgtcggggtgggggtacttttgagctaagatgtgcaagataaatgggagtttctgggcgataatggggtgaactgacagagcagtgtggaaaaggcatatgggtgtgtgacctggtccctcagagactgccaagagttatttctgtaggtgggattgtggggaagaaggctggtgaggctgcagctactttggagctgagaagcgctctcccctgctctccctggcctaaacactgagtgtcttccatggtttctttcttatcctctgcctcacctgatgtgtcggggtgggtggcctcacagccctgccctgcacaggtctcatcaccttgcagctggaccatggctttgttctcatgactgcctgccctggctctgccctctggtccatccctctggccaaatcaggctttccgcagagctgctatcaccccatatccgtccagcttgaccctctgtgcactcctcattgcctcagggccctggagatcggccccagtgctctcctgcttcatctggaaacatttgtctctgcctcccttgacctgggtcttctgactcttgctgttcctgggcccgaccctgcaggtctaggtccatgcacctgccctgcaggccttgagccactctcctaggactgccagttctgcactggtccctcaggcaccctcttgtactcggttgatggatgggtggacaggtgctcctttttggctcctcttggcctgctgggcctcagctgccagcatgcacattggttgggttgtcagactccccaggcccctgccccatgccctggctctgttgctctgggcacacgatgcagcccttgaaacatcaggattttgatccataaacatggagaccacctattacccacctccaaggaccactctgagtctcccccggtagatggcactcacagaccgcgtggcatgctgggagtgctcagcagctgccagtgttagtagacgtagatgctgcctcttgaggttggcacacagtgggtgctcgagaaatgctctctgctatgacctaggcagacaaagagggtctgcctctgcccccaaggggtcccacccccgccccagatggtatcagaacagattccccattccatgctgaggcaagtgacttttctttaccctaagtcagaacttggcatgctattagcattaagtttccccttatttcatctttgcacgtcactcccgccttctgcatcctcaaggtgcgctcattctgcgtcgctccatctaacacataggctgtgggtgttcactgcgtgttcatacacagtgcagggaatgcagcaggagacccaggacgaactgggcacaatttctctgtccagcggttggggatggggggaaggcagacctaaaaatcacgatgatgatgacctcggcccccttcccccattcccaggatactgctgcagttcagccctgcactgtaaaggtgaaatcgccccacaatagttgcaggctgtcctcttgacatgaggaaactgaagttcctagaggcttctgaagttcctggcagatctaaaattcaagcctaggtctgtacacaaaagcccacccttggtaccttggctacaaagagatattatgcccagcaagaagcagtgtagtactggaggcctcattagcactgcggtggctggaggaggatgcgatcaggaacaggcagtctgtattttagcgagttcataaaaatgttgaccaatctcagagtgaggctgggaacaggagcaccacgagacctgggtgtgtgggtgtggggccgtccgccccctgcagcctcactgaacacacctgcagcacgtgtgtccgcatcatgatgtccacaggggtgttcaggaggttgtgtcaggttctgctggacagcaggagcatgagggccctgagcactccagcccctgcacaggaccctaacaatgatgtctgagcaaggcatgcagaggggggttactgaagctcaaaggggctcagggcctggcctggggtcacgctgccagtaggggttaaaatgaaacatgctgggtgctcagcctgcagttccattttgattgatccgtccgttcttcccttcacccactcacccatgcgggtctctgggaggagcctctcaaggcttcctccacagggcacctccttacctgggtgggcattaggtctttctctgctggaggcctggctccagtggccacagccctgctgcccctcaccctgccagtgtgtcactcctgctcatttccgactatcttcctctcacctctggttgcctccagggctggtacttctgcgtcggccttgttgattctggggtggggagccctgtactggcccctccaagcccctcagcagttctgtccccatgtcttgcggggctgtccctgcctttctgggatatcttctcagggcctgcttgatgaccctgggtttgggcaggtcttggccccaacccaggccgtcagagtttgtgtcctttctcaggggtccccggtggggccctcctccatcctgtaactgaacgcacacctctctcctgtcctcttcacaagagccctccccgtgcagccctgggcctggggcacagagcttgggcatccagggaccagcccagaccagggtcttgctcggagcccgggctctgggctccctgtttctcccctgccctccattccccgcccaccacgggtcccaaccccatcttcccgagcattctagctcctcgcgccgggttctgccgcgggcgtccattgtgtccggacggtggcttccccggggtggagtcgggtcaaggctggcctctgtgggagggggttgccggggtccccaggaacctctccgaaggcagcaccaccccccgcccagcgccctggctggtctcaccggcccttccgtccgcaggggaggacgagaagctggcgtccctgctggaagggcgcttcccgcggagcacctcgatgcaagacccggtgcgcgagggtcgcggcatcccgcccccgccgcagaccgcgccgcctcccccgcccgcgccctactacttcgactcggggccgcccccggccttctcgccgccgcccccgccgggccgcgcctacgacacggtgcgctccagcttcaagcccggcctggaggcgcgcctgggcgcgggcgctgccggcctgtacgagccgggcgcggccctcggcccgctgccgtatcccgagcggcagaagcgcgcgcgctccatgatcatcctgcaggactcggcgcccgagtcgggcgacgcccctcgacccccgcccgcggccaccccgcccgagcgacccaagcgccggccgcggccgcccggccccgacagcccctacgccaacctgggcgccttcagcgccagcctcttcgctccgtccaagccgcagcgccgcaagagccccctggtgaagcagctgcaggtggaggacgcgcaggagcgcgcggccctggccgtgggcagccccggtcccggcggcggcagcttcgcccgcgagccctccccgacccaccgcggtccgcgcccgggtggcctcgactacggcgcgggcgatggcccggggctcgcgttcggcggcccgggcccggccaaggaccggcggctggaggagcggcgccgctccactgtgttcctgtccgtgggggccatcgagggcagcgcccccggcgcggatctgccatccctacagccctcccgctccatcgacgagcgcctcctggggaccggccccaccgccggccgcgacctgctgctgccctccccggtgtctgccctgaagccgttggtcagcggcccgagcctggggccctcgggttccaccttcatccacccactcaccggcaaacccctggaccccagctcacccctggcccttgccctggctgcccgagagcgagctctggcctcccaggcgccctcccggtcccccacacccgtgcacagtcccgacgccgaccgccccggacccctgtttgtggatgtacaggcccgggacccagagcgagggtccctggcttccccggctttctccccacggagcccagcctggattcctgtgcctgctcgcagggaggcagagaaggtcccccgggaggagcggaagtcacccgaggacaagaagtccatgatcctcagcgtcctggacacatccctgcagcggccagctggcctcatcgttgtgcacgccaccagcaacgggcaggagcccagcaggctggggggggccgaagaggagcgcccgggcaccccggagttggccccggcccccatgcagtcagcggctgtggcagagcccctgcccagcccccgggcccagccccctggtggcaccccggcagacgccgggccaggccagggcagctcagaggaagagccagagctggtgtttgctgtgaacctgccacctgcccagctgtcgtccagcgatgaggagaccagggaggagctggcccgaattgggttggtgccaccccctgaagagtttgccaacggggtcctgctggccaccccactcgctggcccgggcccctcgcccaccacggtgcccagcccggcctcagggaagcccagcagtgagccaccccctgcccctgagtctgcagccgactctggggtggaggaggctgacacacgcagctccagcgacccccacctggagaccacaagcaccatctccacggtgtccagcatgtccaccttgagctcggagagcggggaactcactgacacccacacctccttcgctgacggacacacttttctactcgagaagccaccagtgcctcccaagcccaagctcaagtccccgctggggaaggggccggtgaccttcagggacccgctgctgaagcagtcctcggacagcgagctcatggcccagcagcaccacgccgcctctgccgggctggcctctgccgccgggcctgcccgccctcgctacctcttccagagaaggtccaagctatggggggaccccgtggagagccgggggctccctgggcctgaagacgacaaaccaactgtgatcagtgagctcagctcccgcctgcagcagctgaacaaggacacgcgttccctgggggaggaaccagttggtggcctgggcagcctgctggaccctgccaagaagtcgcccatcgcagcagctcggtgagcagggcggtgcggggagggatccgtgccttgtccgtggccccgtctgtcattcctcttgtctgttctctggctctcctgttcctccttgttctgttccattccttctgtggcaacccccaacccgcccccgccatccacctctgaatccggtcttgcttggcctgcccgagagaggaggttcttctgggcgtctgacacgtcagggttgctgctcactgtgtccctgttggtgccagaagtgggagctgggctcccctcagagactcaggttgggcatgaggcgcctccatggccctcctggaggctcttggccccagggattcctgtgagttctctctctccctcccgacacaggctgtctttaccattaagggttgttttgtgttttactttggaggtacgcctccctcctcccatcctctctgtggccatgtggctgcccagtgtggctgataccctctgccttacagctgcctcctgccttgcttcctctggcggcttggagcacactgactccttttcttttgggggatctgccactaactccctatttcccatcccagaaacatttgtctcttggcaccaccttagaatcccttaaacatggattcccgtgtgtcatttctaaagtgcagtaagaagatagatggaagtcacgccatctccctgcactccatctgccctcttgccttctccccaccacttccccgtctgtcctgcccctgcccagaaggatctgagcaggggcctggcttgctgctgaggctgtcacagctgccagagccctgggctgatcccataggtctttccttgaggacccgactcccaaggctccttccaaagaggagcccttcgggcccgtgggctgcatggatgctggcggcagagctggtcatcccccacccgcccccttgtctgcctttttaaagctgcttttgccttctgtgcccctaggtctcccctctcctctttgggtctgggggggtggtatgtggatgccacctcttgactcctgcttcttgctgcctggaagaccaacctagtgggccccgtactgtcagccttggaggacagagttcacagcgtagcaacgtgttcagaacttaaggactttgcaggtcttacaaaggcctggccattctaccttctttagttcaggattcaaaagacaggtaggagcttgggaagctcatgaggcctctcctaaggtcccgggatgctgcctccagctcctgtcatcctggggaattgctctggggtcctctccccttttagccttttccaactctcagccaaactggaaagccctcttcccagcagtgcagtgttgaaggtgcccgtagaatgggtgttataatcagagtgagcagcctggtcctaggcctctgtacaggaccagacccctgaggctggggtctcctgacccacacctgaccagcccccatcttccctctctgcttctccctccgctcttctctgcctcttggtcttgatgaaaatcaaagccattttaaaaagtgcatagcacagtgcctggcctggttcgggccctcaataaacatttcttaaatggatgaaagaacaaagcaaaatgcaaatgctgtgttttgtgatttgagatctagggaggtggcttaggacaaaaacccacagaaggacttactcagcgttcagactcatcaggtgtcgatcccccatggtcgggctcaggtgggcccaggtctcgtcattggctctgtcctctcctgtgaggcagctgcagcagttgcagggcagggtcaggggattcctcagccggaacctctggcacttccccttctctgagttcatcctcccacggtgctctttagcattctgtcttgatcagggtacggttctcttagcccttggctctggctttcaccaggaccctgtttgtttttctttctcagatgtgggatggggaaggacaagaccagcagccctgacccttacgtgacgtctgttcttttactcagtagttcctgcaaaattctgatctctgattgggttcatgtgggtcctctgcttttccctgactgatcactggggtctggggacatagggctgtcatcggccaagcttgagtcctctgttctcccaggagccagggggatgggtccgcccacctagcaagcaggtgctgagagtgaggggagggggctctccagatggaagtccagtgctgtcccttgagtaagtagatgctggacagcctgtagcaaccaatgttctgtgacacggcccccactggcatcagcaactcacttccttgccggtcattggcttggagccatcagagggccctgatgtcggtgctcaggaggtcacagcttagtgctgtatccctcccctgtgaagtgtatttacagcgagccaactgcacaggctatcgcgaggctgcacacggcatcacctgtgaagcacctggtaggcccagggctggggcctgtggacccctcactggtgtgagctgccattgtctttgctgtcactgacgacacctaggtgaggtcttagagtcctttgtgggaaaacaagcctgttggatgcagcactggagacggtcctgccgtatcagtttgtcttcacaccgttctgttagacggacactaacagaatcctcatgttccagacaatgaaactgaggtaccagagagcttccttgcagacagaaaacggtggtctgcctgaccatgagccctgctctctggctgccgtaaccagggccgctgttgttaagccccttctgatgacacacaatgggcttttgcccagtaacgcccctccacagaagtggcaggtgtgtgcatggcacagactcacccccgctgtttactggtcatgtttgtcataagtagcacctggtgccacctgagtggcctacccgggcctgcttttccttctcagtttgcctctgtgttaccttctgttccagctcactcttcctttcaccctcttgcgctccttctcgccctcagacctgggctgaactacagccatctggaggggcccctgcccaccctgggcccttaacttccggtgcttctggctgcaggcagcggagcggagcacaggacacttggtgatgtctgagtccagtcctgtttcagatctggtccttgtgtgcccaccgtggctgttgtcagctcttgtcctgcggcccctaatggctggagtccggtactcactgctcacttagggataaaactgctggtggaactgcctaaagtgtgggaggttctgacatccaggtatggctgcttccttcccagggccagtcgtggcagaggcgctaggtcaccctcagggccataccctgagctgtgtctccagccccttgtgttccacagtgtttgtctcccaggcccatccttctcctccctgaccgacaccatgaggaagggaatgcccacccaccttttccagagatggctcattcctgatgtgctttagccacaaggtgttctgtggcctgagagctttctggacaagttaagctgtcctgtatgtcgtggaaccaaagctcggtaacctgtggaaaaatgatgagctctggggccacctttgattttcaggggaacctggaggatgtggcactctcatgctgcctctggaaggtccaggaccttcggccttttgaatcctcgatcccagattgtccacctgctctgtgctcccagctccaagtctagctctgctggacagaccattcatctgcccagagcccctcctcggtctctgggccccacacctgactctgaggctacatttgggcatgattcagacctgactccgagccccacaactggccacaggcaccccatctgtctgaggctctcacttgtctctgagaccctggcttcacacctggctctaaactccatttgtcttccaggccccgtgctcggatctgaatcccatgtggggtctgaggtccatagtaaggctcacgtctgccttggcacttagctttacatgggactctcacatctggttttgtaggtaaagttcatggcaaagtagctttggaaacacaaaaagaggttctttgctgcagtacttctggtgcctttgacaagcttgtgtggaggagggcactgtgtgccgtggtctccagacctgctagagtcagttcctaggtctcccagaagacccatgttcctcaaaatggtcaagaagccctgccctggtggcctgctgcagaccctgcctgctaatatatttgtcagggctctggacaaagcactgtgtgcttggtggatcacactggtaagcagggccaaggccagcagggcctgctcttttgaaacccagactgaatgtgtcacatacctgccagtgggggcccctgcaggccacatgcagctggggcaggtgtgttcccaggatccctgaaccctgttcggggagtaggaaggaggtacagaggaggggtcataggacactggggcccatcagagctggagctgggaacaggcggggtgccgaggagcaagacgtgttaccgcagaggatgcactggaagcttccgagcccatgtctggttttgtgctcctctgagaattagttcccttaatgaggcccctagtttgcaaaaggccacaggcctagaccggccccacgtgagtgcagtggcagaaggcccgaggcagtatcccgggcccgagtgtggacattttcctgcctgttggccctagtgggctgactgagttgggcacgcctggcagggacatgtcatacatactatttttgcattttgttagtgcatctcgtattcctggctttgtgctaggtaccaggaggcaaggagaactggtaagaagtggggtgaagggcctgagaccatgaacggtctggatccagaaatggcaaggggtaaagagaaggtctgggttgatattaggagttagccattggctgtagggtaaaaagaggagctgatggtggctcccaggctctgtgtgtggcaatgacagggtgccgttcactgagttggggatggagggacatgtgtggataccccagtagaggtgttggactcatcagaggctgtctgggtctcacatgtagcattcctgggcacactggccatagcaaagggtgtgagtggataatgttgcccaggagaaactgcaaactaagaggggagctctccgaaaatccatctaggaaggaagaggcctgggaaagaatgtctcgaagggaaacatgaacaggtcagcagcggggtcttgctgaccgcctggccaactgtggggcagagggcggagtggggagggtgtggcaaggccagacctctctcactggctgagagtcactgggaaacagtgagacggtgcaggattcaaatgtaggtggaaagacgtggggccgtgggggcctcagtgtgatctggactcagcctcttcagcgtggctgctggaggtgttcgtgggtgacggtgcctggtgaagtatcatgtgttagagggtgggtggcccagaagctctctgggaggctggcaggtgctgtgatgtggctgtttggcggccggagcctggccagggaggtggccagacggctgagagtgacagtgggtgtgcagagaggccatggaaacatggaagtcagacatggacactgctcgggtttgtgccctggggatggtgtgggcagtaccctcttccccaagagaaagaggagaagcagacacctgggccatgggtgaccccaggcccctccctcctgtgccctggggcctttggcaggcacagccttccttgggcgttttctcttggcctcctgacatctccagcatgctctgggaggcgggagcaatgtgaatggctctcctcacatctcttgccctcgggcccctggctccgtgggtgcctctggagccagcctgccctctgcccaggtctccagctcagcccctgccagtactacccagacaggcacaactctgctctgcccagctcggacctcctggagcccagaccctgctctgggctccggccgagcctcctggctgcgctgcccgcgcctgccctgtgcctctgccttcactgctgtggtcctgcaactcatcagtgtgcttcagtcacacctgagactccaggtacacctgccatcacaactccactgaaagctaagccttggggcaggggcagggccagggtaggtgtccatcctgtgatacaggtccccaggccagggccactttgttggggctggtgggtggaggccaggtgcatattcctggtcctgcccctctctgggtgtccacagtcaggtccctctgagtgattctctcggagtctcctctggcaagcccctccagcagtcaccaccacctgggcacccacccccaggggaccccccgacccaacaccacctggcacctccccttgggaatccccccaaccttggctgcctccccactttggcccactgtgcaggtggatccatggaggccaggtccaatgggagcaaagacagcttattctggtggttggtgcctgtgctgaggcccacctcaggtgttcttgaagcccctttctgtttgggggcacagtgtggcctcttcaggaagttctgctctggatctgagcagctgggaggaggcagtagggacagaggctgaggagaggacagaaatgaggtcccatgggagagacagagctcagatctccacagagggctgacctctcacaggtgggagacaaaagacgaaacctgctttaaggggagccccatgcgtgtgtggggcaggcactggtgatgctgtgtggtgaggacagcctttaaggggagccccatgcctgtatggggcagggactggtgatgctgtgtggtgaggacagcacagaggttggggtggggggactcagcctgggcaggggcagggagagggggtgggagggccactggagaggggcccggccaaagaggatgtcaggggctcagcacccccaggcggccaggcacctgccgagcactgcagccacgcttgtggttcacctgcacttggagactctcgcacaggcgcctctcctccaccagcagctccagctttgtccctcccacagcagctgggccctctgcacctgagttcctccctccacacctggctgcccattgtgtggttgcagctgtgggtcgcgtgggcctggccggctaactctctctctcattgctctctcctgcccatctgcatgtggctgctctgtcgagctgcgccgtggtcccgagcgccggctgtgtaagtgagcatgcccatcccatgcctcttgccgtccacacgctgtgcctgtctgcctgggtctctgctctgcgtggctgtgagaggctctggtgccactgacagccccttgaggcttcccctgacacagtggggatagggatgggaatgggaggacatgggagtgggttttctctggagctatcaccccaggtaggcctcccaccacggcagagccaaggaggggctagagctctagggtcctgtcaggtgaggctgggaagtgagctgccatcggttcttgtgtgtgtgcgtgcgtgcatgtgtgcgtgttgcgtgtctgcgtgtgtgtgctgctgccaccgcagcatgtctgtaacgcgtgtgggcaccgttgctgctgttgtgtgccgtctgtgcaggaggctgcctttgtgttgagggtgtgcacggcctcacacctgccctgcatgtgctgctgctccatacgggtacgagccctgcctagtgtctgtctcctgtgtcacggacctgttcaacctcgtgctgctgccagcctttatcgcgactcagctgtccctggaacctgcccaggatcccctgggtcttctcatgagagcagagctgtgtggggggtgggcggtgaagggtactgcccaagtctcagcgtcccgggtatctgtggatcccgccatgcccagagccggtgtcggaggctggcaggagggagaagcccgccctttgccatgagaggctgtcttttctttggttgggctgcacttggagcctggatggagtggagggggccaccagtcattcctcatattccagccagtcgctggctctggtcccaggggccaaagaaaagggccagggtaaccgtaggatcccaccctttatttcttcctctggccgggctactcccgccagccgcagccccagcccgtttcctcctggaccctgcccgctcccctccgcccgtccccccttggctgtgcgcccctcacctggcgctgacccctctccctccgcaggctcttcagcagcctcggtgagctgagctccatttcagcgcagcgcagccccgggggcccgggcggcggggcctcgtactcggtgaggcccagtggccgctaccccgtggcgagacgcgccccgagcccggtgaagcccgcgtcgctggagcgggtggaggggctgggggcgggcgcggggggcgcagggcggcccttcggcctcacgccccccaccatcctcaagtcgtccagcctctccatcccgcacgagcccaaggaggtgcgcttcgtggtgcgcagcgtgagcgcgcgcagtcgctccccctcgccgtcgccgctgccctcgcccgcgtccggccccggccccggcgcccccggcccacgccgacccttccagcagaagccgctgcagctctggagcaagttcgacgtgggcgactggctggagagcatccacctaggcgagcaccgcgaccgcttcgaggaccatgagatagaaggcgcgcacctacccgcgcttaccaaggacgacttcgtggagctgggcgtcacgcgcgtgggccaccgcatgaacatcgagcgcgcgctcaggcagctggacggcagctgacgccccacccccactcccgccccggccgtgccctgccggcagggccccccacccccaccccgggccgcgggctcggcctgccccttacgacggcgcccgggccaggaatgttgcatgaatcgtcctgtttgctgttgctcggagactcgccctgtacattgcttagtgccctcaccggccgcccagcccacccagcgcacagtcaggaagggcgtggaccagggaggctggggcgggaggtgccgggggtggggtgccctagcgtgaccacctccttcgcagctcctggtggccattctcccagagggggaacctagtccagcatgcgaggtcaggacccgccttggtgactcggggggaggggggagacattgggattctcgatgggggccaaggagcccccctgttttgcatattttaatccactctatatttggaacgagaaaaggaacaaatatctctgtccgtaatagtttcctctcccctcccttctacttccactggtcccactgcagctgcccagtcttccatctccggcccctcactgccactgccaccccacaacggggcaggggacgctccagctggtctggggttggccagggccctagtggcccgccctggggccccagctcggcccctcgcctcgctgagctctagtgtgccccaccgacccttcaggtgctgctcgtggtgggaggggcggcaggccgcgggtcctgctgtgcacccgcgggaccagccggcctgggagaccatcggccgggggggatgagggcagggccctgccgctccaccgcagccatcttcctcacagggtctctccccaaggagggggctagcttggtccccatgctcttgggcaactacagcagagaagcctccctgccttggaccccaaagtctcctgtcctgccctttatgtgtgtgggtgaaactgggtgcgtctgagcacgtgggagccgtgtgtgtgcctgattactgagtggccaccaggggccgctctggactagcgcggggccgtggaggcgtgcaccgtgtgcatgcgtggggtgtacctgtgagagcaccctgtctcctcttccaaagaaagtcagaggccatcctgcaccctgggtccagctgtttgcccagcctgtccttccagagcctcacccagcctgagcggggttccctggtgaatccctgctgcttggggaggccccaagggccccttggaggcagcgcccccaccttgggcttctgagggcatcatagggggacccctagagtcagttcaccacaggccctggggagagtcaaagacccccgagggtgcccagccccccacactgtgactcctcacactcagcgatgacctgtggggtggggggccctgggacgtttttaaacctagggtttggagtctggactaagctccatccacgtcactcacaagtttctgtttatatttctagctttttttaataaaataaaaaaaaaaagaaaacagaagttttcacaacccaggggcctggcacgccggtctgtgcctgcccgccccgccctggcccaccggccccactccctgggcacagagtcacacccactcatccttccgccaacagtccaggtcacacagcagcagtcactgtaacagactgccacatacacactcggtctcacactcacctgtgggttttggttccgttcaatttgggtttttaactttacagggtcagttccgcttcacctccttttgtatggagttccatccggggggtttcaccccctgctccagtcctgaggcctcctgaccctgacgttgtgatacgccccacagagatctatgtttcttatattattattattgataataattattataatattattatgtaataaatttataagaaatgaa

SEQ ID NO: 6292 - DNA, 5420 bp, Homo sapiens
cacaggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcagggtcggggagtatttgggtccggggtctcagggaagggcggcgcctgggtctgcggtatcggaaagagcctgctggagccaagtagccctccctctcttgggacagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctaggtaaagagggggccgcgcctcttccccgccccgaccctccatccctttcctcccaatggattgcaggggggcgggaaaaacgtctgtctctctctctagggaaggccacatttctgtctgtctcagggactctgtgacttgtcccgcagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccaggtaggaaccacccgggccctcagccaccctcccacctcccaaagtcccccagcccttgatgctcccgcagccccacctgccagcccagccctcacggcagctgcccgcctcagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcacgtaagtgatcttggcccaaccccctggctgcccgtgacccctacccagtgctaactccagtctttgcccccagcacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatgggtatgccagcagggcagctgggtgctccggccctgtcacgggccagggccctggaggccttgcagttcagctgcttgccaagaacatagtgggtgagggggtgccaggagatgctggccacgttgcaggggcccaaggtgtagtcaggagacacagtgcacagagagctggtcttggtaggcctgggaggtgccgggctcatgctgggcacctccgggcaagctttgtgacttagaggtgtggggccactggtcaccctcggtggctcagaggctgtggctccatggctcatgagcgcctcctgtgtcccagacctgagaccatgcgtatgtcccgaggcggctgctccggtctcttgcggtgtggaaagggaacgacctacgagggcggtgtccgagagcctgccttggccttctggccaggtcatatcgctcccggtcagtccgcaggccctctccttggaaccctggccccaccaccccaaccttgatggcgaactgagtgactgaccagcctcctgcccccaggcgtgacccacgagctggccagctccctggacctgctgcctaccctggcagccctggctggggccccactgcccaatgtcaccttggatggctttgacctcagccccctgctgctgggcacaggcaaggtagggccggtgacccctgatcccagatccttggcccctgtcctggccttcccctggggtgagtgtgggcagtgcctgagagtctgtgcctcagtgcctcctgcactgagtggcatccaagtggcgccacctctcaggttcctgggtgggcaagaagcggtgcacgtccagggcctcccaccagggctggcagccccaggtatgtgcagtgcttggggcctgccccgccccgtgacccctgactctgcccccagagccctcggcagtctctcttcttctacccgtcctacccagacgaggtccgtggggtttttgctgtgcggactggaaagtacaaggctcacttcttcacccagggtaacccctccccgtggatccctccccccgacctgctgacccctccccggagccctagatccctggcccctcctctcgcccttgccctgtgcacagaattggccccctccccaggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtgacaattcgtccaatcctggggtaatgctgtgtgctggtgccggtcccctgtggtacgaatgaggaaactgaggtgcagagaggttcaggacttgtacaagatcacccagccagaaagaggttgggctgggatttgaaccctggtgtcgtggctctggaagctgccctggcgccttggtgatctgcgtgggtcagtgcacacaggcacacgtcagcctcaaggacatgggcacatctgttcacaggagcagcgccacgtgcctttgagtgccaggaacggggtgggagggtgggagggtgtgagggccagaagactcagaagatgcaaagtgcctgagagagacgggatattcccccagaagaagcattcttagagacacaggcactggacctccttggttcttataagaaacctgtctgaagctgggtgatgagttgcacactccaggtggggctaaggggcctggagcccctgctggctcctaggaaggcacagcagcaggccctgagacggctcctctggggcccctccaccctcccaggcctctgcatttcacctgtgcccacacttctgtctcctgccttcaccttttgacccactactaacgattctccacccagcagacaaagtgatctcttaaaaatatctgttggctgggcacggtggctcacgcctgtaatcccagcactttaggaagccgaggcgggtggatcacctgaggtcgggagttcgagaccagcctgaccaacatggagaaaccccatctctactaaaaatacaaaattagccaggtgtagtggtgcatccctgtaatcccagctacttgggagtctgaggctggagaatcacttgaacctgggaggcggtggttgcagtgagccgagatcgcaccattgcactccagcctgggcaacaagagaaaaactctgtctcaaaaaacaaaaaatctgttaggctgcacacggcgattcactcctgtattcccagtgctttgggaggctgaggtgagaggatgcctgaggccaggaattcagaccagcctgggcaacatagtgagaccccagctctaaagatttgtttttgttttttttttttttttttttttttttttttttttttttttgagacggagtctcgctctgtcgcccaggctagagtgcagtggtaccatctccgctcactgcaacctccgcctcccgggttccagggattctcctgcctcagcctccctagtagctggaactacaggtgtgtgctgccatgcccagctaatttttttttatttaatagagacaagatttcaccatgttggccaggctggtctcaaactcctgacctcaggtgatccacccgcctcagcctcccaaagtgctgggattacaggtgtgaaccaccacacctggccaacaatatttgttttaattagccaggcgtggtagcatttgtcctagcaatttgggaggttgaggtgggagaatcacttcagcccactaggtcgaggctgtagtgagctataattgtaccactgcactccagcctcggggacagagtgagaccctgtctgcaaataaacaaataaaacatcaggctgggcttgagcatctattcctgctcaaaatttcgcaggcttctcagaagaaaatccaaaccccttacagtgacccagtttgcccttgaggcctccacccacacccccttccccccagtcttagggggtggcctggctgttcccttcaacggcaacgctctgcctccattgttggcctcctctgcagggagggactgtctgagcacctgcccgtgtctgtgcagcatggcacactgacgtcaggcccacgtgcatgcccaggtggccagtcacacgccaggtgctccctcagtgttggccaagtgagaggagcacaccttccgggcgttcagacacctccccgtggcagacaccgttcgttgctaccaaacagccacctccttcctaatgggctcccatttttcagtgctgggcaaaggtcccttgatcttggagttgcagcctctttctctccaaggagggcggtgaccagcctgagccagtcaatccagtgattggttcaggagtagcctgtgaccaggagtcctggtagtgaacgactggggcagccctgggggtgaggaccttgcgcagccgtcacaggccctgattggacactgggcagctgctaacccagtgtctccagctgcctacctggagagctccaagcgtaagaaaataaaccctgcctgttgaagcca

SEQ ID NO: 6293 - RNA, 24243 nt, Homo sapiens
cagcacuuugggaggccgaggagggcggaucaggagaucgacaccauccuggccagcauggugaaaccccaucucuacuaaaaauacaaaaauuagcugggugugguggcgugcgccuguaaucccagcuacuccggaggcugaggcaggagaaucacuugaacccgggaggcggagauugcagugagcugagaucacacugcacuccagccugauugcagugagccgagaucaugccacugcacuccagcuuggcaacagagcgagacuccgucucacaagaaaaaaaauaaccgugugaguacuauuccauagaaugaauguuucauaauuuaauucuucuauagacagacauuaaaauauuuuccagauuugggccaagaguagcaguuuaaaaaacauuuagcuuuuaacugacucuagccacuuugaaacacaauuuuuuuuucccaaggucacucaaagagcuaauaggagaaccccuaagucccauaauucagcucugggagccagcacucacucuguacacacauuugccucugucccuagcaauauggugggcgugagggugcagcaagaggaacaagaaagaaaugauugcuugcauaguggcgucuuguucaugcagucauuaauucaacaaauguuuguugagaaucagcuuugugccaagugcuagagagguugagaugauugaagcauaguccuugacccccaagagcucaccauggaaucaacugaagccccucaucaguacuguguugggaauauugagaguggagaguugaguauaacuuauaggacaccuaauguuaauuaccuuucagacacugcaaugugugugugccauaaaaaaaaaaaaaauccaguagcucugauacgagggaaaguaaaugguuuaacaggugcugaguaggagaagcucaaggagaggaaaccccaagggcugaagaaggugggagucaggagucuccugaagcaaguggcauuuaaggagcucuauaaggaaagggucagaguugugauagguggcuguggagggagaugugccaccuggauuggcauguagagggauagaaagauuauaggccuuugcaauggcccaguaagagguaaugaggggcuggaacuggaagaaaacacauuuaagacacaguacagagguggcagacaaggugggacuuggcaacuaccugaugagauccaggagaugaggccaggaggcgggcagcaaagaugacgcagguuucuagccuuaauaggcuaggaggagagugaugccauuagcaauaagaacuacaggagaaggagcugaguuugagggaacuauuaauuugguucagaauaugugcuguuugaguuauggcaggauauuuaaguggacagacugucgacauaguuggaaauucagaucuuaagcucccacacaagguaguggcuggacauaguagauuugagugcucuugcuucagagggcuaguuuagguuggggcagugauuaaagcaaccuaggaaauaaauuauaaaggaagaagagguccuuaaaaccuuggagacugauuauauaaaggguggauccguuaauacaguagcuauuaaaaaauuauaaggggugggaaaaagggacaaagaagaaaaaagaggugaaagaccuuugcugugucaccaaacccugggaggagaauuuuuuaaaagaagaguacucaauccacagugaacuaaggcauguuuguuaaacacaauugaccaccacacagcgaagacccaaaugagguucaagagaaggaauuuuuauggacccuguuagcacaagucaagguccuucuccaguaccacugggaagcuuuggagaagaaaagggggacagugggccuuggguggagaagggaacugaccaugagauccagguggggugaggaggugugugaagucagaguggggaagaaucaggguggcuuacuggcagcuucaccggggucaugcgaggagcagguuccaccagaguaaggagugaaguuguagaaacacagggaagucaccaucagaaaagagcaggagucaagaaacuauggcccacagguacaaacuaccuguuuuuauaaauaaagcuucaugguaaaugaauuguaaauaaaguuuugcauauugugugaggcuguuuuugugcuacaguggcagagcugucuggcccuuuauagaaaaaguuuaucagccacuggaaaagaguugcaggauuugaggucuuggugugauggccuagguuagagucauagugagauugaaggaguagcuagacaagccaauuguguggcagaaagguagggauggagaucacuggguuaaggauccuuguagccaggacaccaugagagugauugacaagaaugcugaaauccccuaagugugucaggauguggaagaguagaaggcuagaguuauggaagaaagggucccaccucuaccugugcagccuccaggagagucugaggagggggcggugagugugaguaaauguugucagaaucccuccucccagucuacaagccccagggaaaggaagcaagguguuuacugacacccccaggcuuauaaguacuuccuggcuccaucacccuccagugaacagcccuggggagaagacaguacugguuugcagguggguggguggggaaaggggucacaggugcuugguguucugguaaaugugcauaugagaacaugggguugcuugugcccuguccgucaggguucagaagaacgugcaguggaagcagcuauggggaaguagcuagggaagguaggacuggucugagguggugaggagcagaugcugccagcuccacacauccaggagagccugggugguuugggcaaaagucucuggcaucccuucugagccuggguaccacacugaagagugaggacagugugccauuuuuaucaggaaacccuccagcucccugaagaccaaauucugauccuccugggauggcagugaagagccacagagaugacucugaggucccguggccuuuucccaccuggagauuguuuucguuacugcgcuguuacagccuuggaggacugggguucaguuucauccaaucacauuucuucuuuugucauagucaucuaaacgauagaucuuagagacaggugggcaaggggugcacuggugagccugacuuaaggagaggucaucucgucccuucccuagucccaucucccuugguuauuguuauuucaugugauuguucugguuauuucagguuauucuguuuuuguuuucaaaacaauaacauauauuuguuguucugauuuuaaagggguaauuguuuugguaacuagaaaauuaccuucucaacucccuuaaauucugucaaagggaaaaguaaguuagguugcuggagaggcuaugcugaggccucagaaccucuguauuccuggaaguucugcgugcuuugccuccugcuccccucucuguguuccuguuggcaggccccuaggcaggauuuaggagguaggcaagucacccuagccaagucauaagcccauggcucaauugccuucucagcccuucaagggcuguuccacaggcagcaaagggaggggccuccacagguucaccacugcagcccuaauucauuuucuuuuuccacugucuuauucugcagggguauucccucagcggauacuacacccauccauuucaaggcuaugagcacagacagcucagguaccagcagccugggccaggaucuucccccaguaguuuccugcuuaagcaaauagaauuucucaaggggcagcucccagaagcaccggugauuggaaagcagacaccgucacugccaccuucccucccaggacuccggccaagguuuccaguacuacuugccuccaguaccagaggcaggcaaguggacaucagggguguccccaggggcgugcaucucagaagucaggggcuccagagaggguuccagcauccuucaccacguggcaggagucugccacagagagguguugauugccuuuccucacauuuccaggaacugaguaucuaccaagaucaggaacaaaggaucuuaaaguuccuggaagagcuuggggaagggaaggccaccacagcacaugaucugucugggaaacuugggacuccgaagaaagaaaucaaucgaguuuuauacucccuggcaaagaagggcaagcuacagaaagaggcaggaacacccccuuuguggaaaaucgcggucuccacucaggcuuggaaccagcacagcggagugguaagaccagacggucauagccaaggagccccaaacucagacccgaguuuggaaccggaagacagaaacuccacaucugucucagaagaucuucuugagccuuuuauugcagucucagcucaggcuuggaaccagcacagcggagugguaagaccagacagucauagccaaggauccccaaacucagacccagguuuggaaccugaagacagcaacuccacaucugccuuggaagauccucuugaguuuuuagacauggccgagaucaaggagaaaaucugcgacuaucucuucaaugugucugacuccucugcccugaauuuggcuaaaaauauuggccuuaccaaggcccgagauauaaaugcugugcuaauugacauggaaaggcagggggaugucuauagacaagggacaaccccucccauauggcauuugacagacaagaagcgagagaggaugcaaaucaagagaaauacgaacaguguuccugaaaccgcuccagcugcaaucccugagaccaaaagaaacgcagaguuccucaccuguaauauacccacaucaaaugccucaaauaacaugguaaccacagaaaaaguggagaaugggcaggaaccugucauaaaguuagaaaacaggcaagaggccagaccagaaccagcaagacugaaaccaccuguucauuacaauggccccucaaaagcaggguauguugacuuugaaaauggccagugggccacagaugacaucccagaugacuugaauaguauccgcgcagcaccaggugaguuucgagccaucauggagaugcccuccuucuacagucauggcuugccacgguguucacccuacaagaaacugacagagugccagcugaagaaccccaucagcgggcuguuagaauaugcccaguucgcuagucaaaccugugaguucaacaugauagagcagaguggaccaccccaugaaccucgguaagagaccacccaggaacuguaccuaggguuggggucaggugcuuuugcuccugacgcagucuuggcugauuugugagcagugcuguuugguggcgccuaucuuuuccuccuucccuucugccuuuuagcuaaauuccccuugauuggcccuuucuccagauauugagcagggaauauagaccuuggaccagccagaaucuuggcugaacaagggggagguugacucuguuggcuguaaugaagcuucuuuagaaaugauugguuuuggccguacgcgguggcucaugccuguaaucccagcacuuuuugaggccgaggcaggcauaucacgaggucaggaguuugagaccagccuggccaacauggugaaacccugucucuacuaaaaauacaaaaauuagcugggcgugguggcgugcaccuguagucccagcuacucaggaagcugagacaggagaaucacuugaacccaggaggcagagguugcagugaacugagauugcgccacugcacuccagccugggccacagagcaagacuccaucucaaaaaaaaaaaagaaagaaaugauuggucuugggggccggggcgguggcuuacgacuguaaucccagcacuuugggaggccaaggcaggcagaucaugaggugaggaauucgagaccagccuggccaacauggugaaaccccaucucuacuaaaaauacaaaaauuagcugggggugguggugcuugccuguaaucccagcuacucgggaggcugaggcaggagaaucacuugaacccaggagguggagguuguagugagccgagauuggcgccacugcacuccagccugggcgacagagugagacuccaucuuggaaaaagaaagaaaaaagaaaaacaugauugaucuccaugcaucaauaucaugccugccuccuaaggcagagguaaugaagacuuaauucccuucuguaggccuuccccuccucccuaagccguuuucugagagaggugcaggagcagguggguuggggcaggcugcauacacaguggggguggguugugcugcuaagcagcagcagguccacaauccccccucugcauagcuccuggggggaaaggauggaggagcgugugcacggcugccugccuguugaagguggugguucuaauuuuauaaaccuccucugcacagauggguaggcuagcacuugcugccacuccugagcugugaagucagccuuuaccucacucagauagcuggucaggcccugcacuguagguccuaauaggccaguggacagauugaggaaaacaggagcuucugaagggcauaacagagagcaaaaccacugaagcugaguggcugcagcugcagccagggaaagagccaguaggaugggggagaauuccacugaccuuuauguuuaccuagccugguuucuagggguguagauuccuggcuagggcccuuauuccuugucuugacugucuucaugacaccaauuuggcauuucaggagagcgguuaagaaaaggaguugugucuguccaaaagcuggcaaggccagagcuggauuguuugggguagagacuggauggccgucauucucuuuugccuccaucccuccuccccagaguuggaggaaagcaguggauuuugugguuagucauucuuuggacucacacuaaaagaaacauuggugccauguucaaauauaucagaagaccuaggaaauaagaaauuugaccuacuuuucuaaaugaaaucccagacugagcaaagagcucaccacauuugaaagcuugaacaaagggggccuaggcuaaguccagaggccuagaacaaaugcuuuuuuauuuucuacauaacaaggggaaauuccuuguuauguagaaaauagcuggagacaaauggugcuauagagugacucauaacaaacuacggugauauaggucuagggacaaaagcaggccacugauaaguggcagaugccugaucccccuagguaguggggagugugagacuggguuauaagaagccuucacuaucuuuuaggacccucccuugaggaggccagucuaccacaauugcuuuagaaugaaggucuuuugguugcucacaagacuauaaugguaauuuuuggcucaucauuuuuguguguguggguuuuaucuuaauucauuguuaaagagauaguggguuuccccugagcuaguuuccuaucaucugugccuauguuugcuucacugagcuauggggaaagagucacuggcugcuuuguuuacaaaaagaaaggacaggcugagccuuaaggaguaggaaggaguuccuuggccuacccuucaucuccacaagugaaaagccccuuagcguagcagaaaauuccagguugaaggucucuuuggagaaggcagaaggagugaccuagacuccuguucacacaucuaaucacuuuccgucaagauuuaaauuccagguugucaucaauggccgagaguuucccccagcugaagcuggaagcaagaaaguggccaagcaggaugcagcuaugaaagccaugacaauucugcuagaggaagccaaagccaaggacaguggaaaaucagaagaaucaucccacuauuccacagagaaagaaucagagaagguagguguccuccugccaucugggaggaucaguucccugucagugucuggauuguaacugacucccuugaggcaaucccagccuaaacaacugacaccaucucggagucagcuucccacucuucccucuacccuaucucgccagcccaccuuuccuccucucauacccagcuccucugucugcuccugucccaacauaauuggauuuacagaauuucggacuugaaagagaccugaaaguuuauugaggccaaucuccucucuuggaagaugcggaaugagagcuccagcagccccuuuaacuuugggaagccaaccccuugacagguggugggaauaaagucccccauccccaucccuucuucugugauggacuaaccaguguuuucuuaguuuuguuuucuucuugucucucauuuucucuagacugcagagucccagacccccaccccuucagccacauccuucuuuucugggaagagccccgucaccacacugcuugaguguaugcacaaauuggggaacuccugcgaauuccgucuccuguccaaagaaggcccugcccaugaacccaaguauguccuacguguccucuguccagcugagguuuucucagaaagaaaaagagacacauuuucuuccuugccuccucagggauggcagauugaccaauuucuccuguuucaaaauggggaaaggagggcucugagguccugguugcugcuugugaggcagacaauuagggauuaggaauucaaagggaauuccuggcccacccucuaucuccucuauaagcacuagggagguucacggcuuggaggucacucacuguuggugggacagaaagguacaggaccugagaagcucucugccugugggucuauagacucacauguucaagagaaguguuccuggaagaggugaaacuagguugaugcuuaaauguugaaaggggucagccaggcuaagagacacuggcuguucaaggcagaagugacugcaugagaugugacugcacagaggugauguguucaaggaaauuaccaguaguggaggauggcagccuggcagaggcuaggucaggcuccucagucaaaaccauuuuaauccuucuacgugcuucaucuccugucagguuccaauacuguguugcagugggagcccaaacuuuccccagugugagugcucccagcaagaaaguggcaaagcagauggccgcagaggaagccaugaaggcccugcauggggaggcgaccaacuccauggcuucugauaaccagguagggcguuuuccuacucaaaagauacaggucauuuuuagcaacugagugguuuaagauugccagugacucccucaacauuuccugaaguguuuauggcuccucuguuugauggauucuccuuuagccugaagguaugaucucagagucacuugauaacuuggaauccaugaugcccaacaaggucaggaagauuggcgagcucgugagauaccugaacaccaacccuguggguggccuuuuggaguacgcccgcucccauggcuuugcugcugaauucaaguuggucgaccaguccggaccuccucacgagcccaagugaguguccuaguccuggcuaaugcaugugucaccaguuggggauggucuguaacccagggaaaacaagggugugcuuuagcuguguaggacagaaggggcgaguugagggaaacaaguccagcccugucuccacggccucuuagaagacaauagaccugccaagagugaaugcguucacucuuccaguaagcaugauccuuuuuaauuuuuugacuaguuuuaauuuuuaaagaaauguauagguacauuaaaaaaucauucaggccagacaugguggcucacgccuguaaucccagcacuuugggaaguugaggcagguagauuaccugaggucgggaguucaagaccagccggaccauaugaggaaacccugucucuacuaaaaauacaaaaauuagcugggcguggcagcgggugccuguaaucccagcuacucgggaggcagacaggagaauugauugaagcugggaggcggagguugcagugagcugagaucgcaccacugcacuccagccugagcaacagagcaagacuccaucuugaaaaaaaucauucaagcugauugaaaaaguagucauuucaaugaaaagucucauuuccgucucagacuucuaguuucccucccuagacccauauauuacuauagcccugcauuagcaacugggaugcggucugagaagcaugguuuuguuguugugagaacaucaguguguauuuacauaaaccuagauggcaugggcuccuacacacguacaggcuguaugguauggccgguugcuccuaggcuacaaaccuguacagcauguaacuguagugaauacugugggcagcugcaacacacugguaaguauuggugucuaucuaaacagcaaaaagauacaguaaaaagacagcauaaaggauuaaaaaaauacuacaccuguauagggcgccugccaugaauggagcuugcaggacuagaaguugcugugggugagucagccagugaguggagaaugaauaugagggccuaggacaugacuguacacuaauguaggcuuuguaaacacuguucacuuaggcuaacuacauuuauuuaaaauauuuuucuuuaauaaauuaaccuuagcuuacuguaacuuuuuuacuuuauuuuuacuuuauuuuuuacuuuauuaacuuuuuuauuuuuuguuccuuuuguaauaauacuuagcuuaaaacacaaacauguuguacugcuauccaaaaauauuuccuuuguuuauauccuuaauucuauagucuuuuuucuguuuguaaauuuuuuuauuuuuuuaacuuuuuaaacuuuuuuguugaaagcuaagaugaaaauacauuagcuguuagccuaggccuacacagggucaggauccucaguaucacugucuuccaccuccacgucuugucccacuguaagguguucaggggcaauaacaugcaugggggccgucaucuccuaugguaacagugcuuucuggaauaccugccugaggcuuuuuuuaguuacuuauuuuucuagaaguagaaggaguauacgcugaaauaaugauaaaaauauaguaaacacauaaggagcguguagccuagaucccucgcauucacaguucacagucgaguucacacuccuacaagaaucucaugcugcugcugaucccacaggaggcggagcucggaccagaaugcuuucuugcucgccacucaccucuuccugugugcccagguuccuaacagguuacagagcccugcacuuggugauaagaauuuuucagcuccaucauaaucuuacggggccccugucauaugugugauuuaucauugaacaaaacacuguuaugcaguacaugacuauaccaguuucuugaguccuucuagaaauugcugugcauaacuagcacauuuucccuuuugucuuuuuaaacaaguauaucuucuguuuuauacguugacuccuuuacuuaccagacuucuugcauagcugcauaguauuucauugaauagaagcugacaaauucaguuucucagaaguaaacauuuaauagggacuuaggaacagaaaugaugucuuggguggcugcaagaugguggaucccugcacuuacccuccagaaaguaugcuuucuauagaggcuuuuuugguuaaacaugcagcuggucacacauuauacuuucuugugaaacuuaugagcacuagcugguggggaggcuugguagacaucuuuguguggaauuauuuaugcuacccaacacuuugggaugcgggagucagauauugguggucauagugguuuugcaucaagauggcaucacucuugccaugcaaccggcauguuuucuuaaucucuaaggucuaucacaaaguggaaaagcaagguguaaagugaggggagaggugaagauugucuguauaugucuagaauauuuucuugaaggaucgaaaaaacuggcaacuguguuugcuucuggggaaggagggacacuuuuauuguacacucuuaacuguuugaauuuucacauguuuggcauccaacuuguccauuuuaaagucauuaaggaaaaaagcuuauaaaaaugcuaucuuguuacuuuaaauuugucucuccuuaauagaaguaaugucagccgggcgcaguggcuuacgccuauaaucccagcacuuugggaggccgagguggguggaucauuugagcucaguaauuugagaccagccuggccaacaugguaaaaccccaucucuacuaaaaauacaaaaaauagcugagcauggugguaugccccuguaugccagcuacuccggaggcugagcaggagaauuacuugaacccaggaggcggaaguugcagugaccugagauugugccacugcacuccagccugggugauggagugagacuccgucucaaaaaaaaaaacaaaaaaaucagaaguaauggcauuucauuuauucauauuuauguguuauuugcauuuccuuuucugugaaccaccuguucuuguccuuuuccaguuuucuuucagauuguuacucucauggauauguaagaacuuuuaacauaauuuuuaaaaguagcccuuugcccaacaugacccaauuuagaacacacaucugcccacuguuuaagccaucuggaaaaggagaggcccagucucccuccagcugcucuucuacuaauucauauccuucaucucaauaagcaccuccuuaucuuuaagcacaguccuucagaugauagguucagugcauuuccucuuucucuucugugaaaucuucugugaaauccuuucuaggacuucaagucagccauucauugagaauguaagaacuuacuaugaacuagauggaagauacaaaaaauugcugccccugaguguguagcagacauauagccauagcaguauugaaaugugccauuggaggugaaugcagagugcuguggggacacagaggacacugcugccacugucugccagggagcugaggaagguugcauagagaggggaaaugcuaauugaguaacuacguuuauuaacuaucucguacaauaauauacuuuaguugcuucuuaaugugaauuaugcugggucuuuuuuuccuuucugucuacuguggcuggugacguuaacuaauuuuaugacuucuuuucuguuuuuuuuuuuuuuuuuuuuuggagauggagucucacucugucacccaggcuggagugcaguggcgcagucucagcucacugcaaccuccgccuccuggguucaaacaauucucuugccucagcuccucgaguagcugggauuacaggcaucugccaccacaucugacuauuuuuguauuuuuaguagagacagaguuucaccauguuggccaggcuggucuucaacuccugaccucagaugauccacccgccucagccucccaaagugcugggauuacaggcaugaaccaccgcgacagccaugaccuuuaauaucuaaaugcuggagaccacucagagcucccgauuccuccaucuaguugcuuacuugucaccucuguuuggauuaacaucccuaauaugacauguccaaagcagaacucuuggguuuugcccccuucgcuucauuucccccaagucuuucccagcuuaguaagugauaccacugucuacccaguggcucaagucagaaaccugaggaucaucuuuuccucuaucuccuuuaccuccuucgucaacucauccuuaaguccuauugguuauacuuagaauuucuaucccaaaucccuuccucuucuuuccaccuccagcgucagcacucuaauccaagccacugucucaucuagacugucacaauagccuccuaacugaucuuuauacuuuauuuacucaacacuuauuuauggaguaucuucuauuuuuuuuagaacaggaaccaaacauuaaccaauagucaccuaaagaaauguaagaucucauauuugauaaguauuccaaagggcuggaguugcagcgagaaucaauuauagcacaguuugacuuaggaaggagagggggaagggcuuccccaagaaguacugccugagcugagacuuuaaggaugaugaagagagaaagacugaggguucuaggcgaaggacacuguuaaauccuguggugggagaagcgcagagcuggcaaagaggcugagaggaggcacuuauggcaauagccccauuuggcuaguggcuaccauauuggauagcacagcucuaaaggauucuaguugcauaauuaacaaacuuuaucauauauguaaauauaucaguauaaaacuuugcacguaagaguucauauucuuuucaaacacauggggcagucaugaaauucuccuggaucccugagguaaagauacuacacaaucugucccuccugaccgccuucaccaucuucuuuucaugccacugucccucucauucugaacuuaagcccacuggccugcacgggccugccagcauggacaaagaaaagagugaaggcauuuaguugcuucggaucaucaaggaacagugagaaacuccaugugguugaacauaaacguugauuccuuuuacugccugagcugcuaagucuugaaacugaagccucuguuauaugcaguuagaguauccaaagcuggguucucagccaguagauuaggaucugguugaaagcuaggauucuugaugccuugucugguacauuuccaagcuguuuugcuccaccaugcucuucccucuguguuuggaaauuaccagccggagcgguagaagccaccucccugcuccacuugggcacuuuauugucagcgcagcucaugcgcccaagauccauuccuuaccccagaguuagcuuaagccugccaggagucaaaaaaacaacucccagcaaaaccugggucccuggccuaaggccgaccuugaccuaaugaccucuccaggucaaguccccuugagcuaauaggaaguaaaugagggaauggaguugggcgcuuuaaaaaucagacaguguaugaaguaacagugacuuguggggagaaagguagucccuucugauuucugcuuaagaagagaguccaaguuggugcuagcauuucguuaagccuuccucauacuucauaaucuuccuuuauaguaaggacaggcucagagccuuugcagguaacaguaucuagucagaauuuuauaacaugauuuuaucauauucuguuuuacagccaccuucaauauguggcaagugauacugguuuuccauuuacaguagugaaacaaaguuuccuauuucaguguguuuacauuuuuaucucuuuuuucauaccuaguauuacggauauuuacauuuuuagagucuguuuguuuauuuuagagauggggaucuugcugucucgcgcaggcuggagugcagugauauggucauagcucacugcagccuugaccuccagggcucaagugauccucucaccccagccucccaaguagcugagacuauaggcacagaccaccgugcccagcuaaauuuuuuuuuuuuuuuuuaagagacaggggucucgcuauguugccugggggauuacuauguugcccaggcuggucuugaacuccuggccucaagugaucucccaccuuagcuccucaaguugcugggauuacaggugugagccacaauggcuggcucuaagaagucaauuuagagaaaaauauuaauuaauaguccaaguaauaccuggauguggcacaaaucauguggugauucaugaaugaccaaaaucuaggaaaugcugccuuagaaacagcuucuguuugacggguccauauguuugcaagacuggccacaucuucagcaaaacuaacccuuccuuggaacaaugucagggucuggcacuugucuucauucucuguuucucaucccaaagguucguuuaccaagcaaaaguugggggucgcugguucccagccgucugcgcacacagcaagaagcaaggcaagcaggaagcagcagaugcggcucuccgugucuugauuggggagaacgagaaggcagaacgcauggguuucacagagguaaccccagugacaggggccagucucagaagaacuaugcuccuccucucaagguccccagaagcacagccaaagacaguuaagacgucuacuuuuggugccuuuuuuggggcggggggguccuccuaacuccuaaguggagguggcucuugcugucaugcgaguuauuccuaggcuuuacucuuagccucgagagagcaguaacugggacacuagauguaagaaggaaaagaugacucacacgacaaguagagcuugaucucccugcccacggugaauaugguggacacagccucagcuuuguggugcugacacagccucuuuuccccacagcucccucucacuggcagcaccuuccaugaccagauagccaugcugagccaccggugcuucaacacucugacuaacagcuuccagcccuccuugcucggccgcaagauucuggccgccaucauuaugaaaaaagacucugaggacaugggugucgucgucagcuugggaacaggugagugaggcucugagacaugccgccucccauggcgccugaaagcgggugccucucauccuccccuggaguccaugcauguaaguccaaggcagggagaagagacuucauuuuagcuacagucaauucagagugaggaaugaguucuuaguuccuagaggagagaauaugggagucuaggaucugagaaacugaggcuguuucugccuugaagcuuucagaacaaauagccuucauccuguuuuccaucgguuuccuuccauuauucuauuucuguuuuaaacaccuuccuagggaaucgcugugugaaaggagauucucucagccuaaaaggagaaacugucaaugacugccaugcagaaauaaucucccggagaggcuucaucaggugagcgaggucagagcuguggcccggcugcccggcuguggagagcuccaguucccugccccacauggcucugacacggccucugaaucccccucagacagacgggucaugauguggcaguggcagccuuugcuuuucacccguccauuugaaccugucugauggaauccauccccucugugagcugagcugccucccacugcucggccuguuuuuaaaugcuguccuuuuuucugcuaacucugcugcuucauguucuuuucuaaaaacacaaaaugaccuuuuaguccucagggccuugaggaugaggcagcuuuccauuuccguuugaggaccuacacaaccuugaugccccugccagcuuucuccucuagcucaccuuuucuuuaauuuaugaagggagagacuuagaaaggagcaacagcuuccuguaguccuugaaucaguuugcucugcucuagaaucccuguagccgccauagcgaggagcccucagcagaaaugaaggagacccaaaaggcuaacuaugcuuuaugaaaugcugaggucuccccuggagaauuuccaccugauaaacugugaaacgucugcaacauugagacuuuuccuuacuuucucauuuggaggucagauuauagaaacaacugcuuuucccagaauugaaccugccuuccuaaccagacuuucuuuuuguagguuucucuacagugaguuaaugaaauacaacucccagacugcgaaggauaguauauuugaaccugcuaagggaggagaaaagcuccaaauaaaaaagacugugucauuccaucuguauaucaggucuguacaguuccuguugcugccagggugggcccugccaggcuguuagaauuggguauccaaaugcucuccuggccuguaaaucgaaccugauacaauaagccacacuccacuguggguuugagguccauauucagguguagaugacucacauguacugcuguccaccuccagucucccaugguaggccuuagaaaacaucccuugcuucugucacaucugacuguuuuggagccccacgaaauugcagauuucccacaggugaguuuuaacagccaccccuguuuuucagcacugcuccguguggagauggcgcccucuuugacaaguccugcagcgaccgugcuauggaaagcacagaaucccgccacuacccugucuucgagaaucccaaacaaggaaagcuccgcaccaagguggagaacggugagugauacaugcccccgccuccuuuccucaaaaggcucugcaagguccagggaccccaagucucuacaaggcugcuaggauuuuaccauuagucacugggcacagaggugcuguuuacaggaaagggaagaccugggucagggagcugugugguaagaucaggguucuauuuugaauguguuaguuugggagaucugggagauccccaagucaaauaggagguggggguucccauguggagcucagaggagggagcuuggcuggaaauagaaauaugggagucaucccccuauagggucuucauggccaugagaaugcauaggauuaccucaagaaagcggggaggaaaugaagagugcggcacaaccaagcccugaggaguugacagaugaggaugccaaaugcugggguccccuccugucuagcuggcaguugacucugccuuguccacuggcuccuucucuccuauccucuccugucuccuuacugucucuucgcauccacuccauugcguucaggccacgucagcagucaucauggugguccugaaaccuugcuaaauacccuaaaguauagacacaguuaccauggagccggugcuccacuccuagguauaugcugcagagagauggagaucuguguccacacggaaacuaauaugugaauguucauggcagcauuacucacaagagccaaaaaaguggaaacaacccagacguccaucagcugauggauucauaaauaaaacaucaaauauauccauaaauugaauauuauuuuggccauaaaaagaagugaagugcugauacaugcuuacaauauggaugcacuugaaaacuugaugccaaaugaaaaaagccagucacaaaagaucacauauuguaugauuccauuuauaugaaauguccagaauagacaaauccauagagacagaaaguagaugagugguugccagggccaggagugggagaguuggagagaugaggagugacugcgccaauggguagaagguuucuuuuuggagcgaugaaauguucuaaaauugacuguggugacaguugcagaacucugugaauauacuaaaaaugacugaauuguaugcuuuaaaugggugaacuguauggcauaugaacuauaucucaguaaagcauuuuuuuuuguuuuuuuuuaaacccgauagugguuucccacugcacugcauauacaagcaaaaccugcugugaucacccggccuccucucaugccacuuuccccaucccucgcauaugcucuguccacacuggcucucugucaggcgccugaacagccaauccgcuggcugccuuggggccuuugcuuuuguccugugugccugaaacacuuacuccagcuguccuccuccaugucugggcuccccugcugcugcugucccaggagguguccccugugguccuccgucauagcugccucagagccuucagagcacugucagcaucuggaauucuuccguauguacuggcuacugguuuagugucuauucucuucccuuucaaucuccucaccaccauagauguuuuaagagcacaaagaucuuacuugguuuugcucaccguucuuucccagcaccaagcauagugccuggcgcauagcaggggcugugaaauaugugaagaaugaaugaauguagccuguggcccaagcuuaaggaggauagaaaccacgccagggagugguuugguccauuggcgccugugggucugacccaagucucucacacaggagaaggcacaaucccuguggaauccagugacauugugccuacgugggauggcauucggcucggggagagacuccguaccauguccuguagugacaaaauccuacgcuggaacgugcugggccugcaaggggcacuguugacccacuuccugcagcccauuuaucucaaaucugucacauuggguaaggggccugccuugggaucuggaacuggucuguccuucuugugcccagaucccaaacugcaugcuuuauugccagguguuuugucucccuuaucaaagugagcaugauucacuccucaguaauugauugaguguccagucugcugugguaggaagauccugguagccccagucagaaggugcuuccuaacaaggcagcuguuucucuuucuugacaacuauaucuuguaccuccaaaauccccacaugcuucugccucuuaacagcauuuggugcaaacacagguauauauguuucucuuuuuuguacucagguuaccuuuucagccaagggcaucugacccgugcuauuugcugucgugugacaagagaugggagugcauuugaggauggacuacgacaucccuuuauugucaaccaccccaaggugcuauaacccccuucuauuuucccugacauuuuccuccuuuucaagcagucauguaaacagaggaaaaauguacacugugggcaaggggaacauugcccacagugguagcccacaagggaacauugcccacaguggcccaccaccaacauugguuggucucccaagaacuuaaacuuucuuccuuuuggaugccaagggcuuuucuucucuuagucuggaauuaaucugaaucgagguggaguuaguaugucuagagggugcucagucuuagccaaacagaacccuaaauacaggggaaagaucaugaccccacacuuccucucuccuaugagucuugagucccugcuucagaaucuuauuccugaaagguuuccaucuuucucccguugcuucugggauuccuagguuggcagagucagcauauaugauuccaaaaggcaauccgggaagacuaaggagacaagcgucaacuggugucuggcugauggcuaugaccuggagauccuggacgguaccagaggcacuguggauggguaaggagacaggagagcgcagugaggaccaagccucugcccugacuugcaagggugcaucauaccucugcagucucagggcuugagagccgccuccccucccacggugucuccacugugagcuccuuaucuuacaggucccaggugaauaaugagugcuuuuguuucucuaggccacggaaugaauugucccgggucuccaaaaagaacauuuuucuucuauuuaagaagcucugcuccuuccguuaccgcagggaucuacugagacucuccuauggugaggccaagaaagcugcccgugacuacgagacggccaagaacuacuucaaaaaaggccugaaggauaugggcuaugggaacuggauuagcaaaccccaggaggaaaagaacuuuuaucucugcccaguauaguaugcuccagugacagauggauuagggugugucauacuagggugugagagagguaggucguagcauuccucaucacauggucaggggauuuuuuuuucuccuuuuuuuuucuuuuuaagccauaauuggugauacugaaaacuuuggguucccauuuauccugcuuucuuugggauugcuaggcaaggucuggccaggccccccuuuuuucccccaagugaagaggcagaaaccuaagaaguuaucuuuucuuucuacccaaagcauacauagucacugagcaccugcgguccauuuccucuuaaaaguuuuguuuugauuuguuuccauuuccuuucccuuuguguuugcuacacugaccucuugcggucuugauuagguuucagucaacucuggaucaugucagggacugauaauuucauuuguggauuacgcagaccccucuacuuccccucuuucccuucugagauucuuuccuugugaucugaaugucuccuuuucccccucagagggcaaagaggugaacauaaaggauuuggugaaacauuuguaaggguaggaguugaaaacugcaguucccagugccacggaagugugauuggagccugcagauaaugcccagccauccucccauccugcacuuuagccagcugcagggcgggcaaggcaaggaaagcugcuucccuggaaguguaucacuuucuccggcagcugggaagucuagaaccagccagacuggguuaagggagcugcucaagcaauagcagagguuucacccggcaggaugacacagaccacuucccagggagcacgggcaugccuuggaauauugccaagcuuccagcugccucuucuccuaaagcauuccuaggaauauuuuccccgccaaugcugggcguacacccuagccaacgggacaaauccuagaggguauaaaaucaucucugcucagauaaucaugacuuagcaagaauaagggcaaaaaauccuguuggcuuaacgucacuguuccacccgguguaauaucucucaugacagugacaccaagggaaguugacuaagucacauguaaauuaggaguguuuuaaagaaugccauagauguugauucuuaacugcuacagauaaccuguaauugagcagauuuaaaauucaggcauacuuuuccauuuauccaagugcuuucauuuuuccagauggcuucagaaguaggcucgugggcagggcgcagaccugaucuuuauaggguugacauagaaagcaguaguugugggugaaagggcagguugucuucaaacucugugagguagaauccuuugucuauaccuccaugaacauugacucguguguucagagccuuuggccucucuguggagucuggcucucuggcuccugugcauucuuugaauagucacucguaaaaacugucagugcuugaaacuguuuccuuuacucauguugaagggacuuuguuggcuuuuagaguguuggucaugacuccaagagcagagcagggaagagcccaagcauagacuuggugccguggugauggcugcaguccaguuuugugaugcugcuuuuacgugucccucgauaacagucagcuagacacacucaggaggacuacugaggcucugcgaccuucaggagcugagccugccucucuccuuuagaugacagaccuucaucugggaacgugcugagccagcacccucagaugauuucccuccaaacugcugacuaggucauccucugucugguagagacauucacaucuuugcuuuuauucuaugcucucuguacuuuugaccaaaaauugaccaaaguaagaaaaugcaaguucuaaaaauagacuaaggaugccuuugcagaacaccaaagcaucccaaggaacugguagggaaguggcgccugucuccuggaguggaagaggccugcucccuggcucugggucugcugggggcacaguaaaucagucuuggcacccacauccagggcagagaggucugugguucucagcaucagaaggcagcgcagccccucuccucuucaggcuacaggguugucaccugcugaguccucagguuguuuggccucucugguccaucuugggcauuagguucuccagcagagcucuggccagcugccucuucuuuaacugggaacacaggcucucacaagaucagaacccccacucacccccaagaucuuaucuagcaagccuguaguauucaguuucuguuguaggaagagagcgaggcaucccugaauuccacgcaucugcuggaaacgagccgugucagaucgcacaucccugcgcccccaugccccucugagucacacaggacagaggaggcagagcuucugcccacuguuaucuucacuuucuuuguccagucuuuuguuuuuaauaagcagugacccucccuacucuucuuuuuaaugauuuuuguaguugauuugucugaacuguggcuacugugcauuccuugaauaaucacuuguaaaaauugucagugcuugaagcuguuuccuuuacucacauugaagggacuucguugguuuuuuggagucuugguugugacuccaagagcagagugaggaagacccccaagcauagacucggguacugugaugauggcugcaguccaguuuuaugauucugcuuuuaugugucccuugauaacagugacuuaacaauauacauuccucauaaauaaaaaaaaaacaagaaucugaauucuuagaa

SEQ ID NO: 6294 - RNA, 26191 nt, Homo sapiens
gccccuccucuuggccaaacuuuccggaggggaaggcuuuccgaggaaacgaaagcgaaauugaaccggagccaucuugggcccggcgcgcagacccgcggaguuucccgugccgacgccccggggccacuuccagugcggaguagcggaggcgugggggccucgaggggcuggcgcggcccagcggucgggccagggucgugccgccggcgggucgggccgggcaaugccucgcgggcgcaaugaauccgcggcagguaagccgggccggccuuggaccuucgccgccgucuggguucguuuacaaccucacaggcuuuguguugcagugcguagcgugugcgucuugugaguguuagagugugugugugugugucgucuugccaagcagcauugcugguuuaggaauuugugcgucuugugagugugugugugugggugugugucgucuugccaagcagcauugcugguuuaggaauuugugcgucuugugagagugugugugugugugugugcguguguguguagucuugccaagcagcauugcugguuuaggaauuugugaauuuguauccugcucauuaauucugcagaauggagcagugcgugaagagggcuugggggaaaaugcgcccccgucugaguaggaaggccugagcccaugucaaggcagacacaucgucucccuuucugcuagggccccuuguggaacccccuacccccgcuuuagccccacuugaacaacguucggacuuugagcagcgcacacuauccucagcucaccuuauccaccuccugaaggccuucugggaguuaaaaauggcacuuaagcuguaggagaaagcuuguuaaccacuuuauagcuaaaaacugggaaaacacaaauggccuucagcagguuaacagauaaacugaaauacauccacauaaugggauacugcuuaguagugaagaggaaauacuguuacaaguaacaacacgggugacucgcaagugcguuaugcuaagcacgagaagccagacucaaaaggcugcauacuguaugaguccauuuauaugacauucuggaaaaaaaaaaccacaguuauagggauggaaaguggauccgugggugccagggacuggguaucguggaagaaauugauuguugaguggcaugaaaaagcuuuuuagggaaauagaaauguucuauaucuugauugugguggcgauugucgaaauucauagauuuauacacuuaaaaggauaaauuuuacuguaucuaaauuauauaccucaauuuuguuaagauauauauauauuuuuuuuuuuuuaagcacuccuuugaaaggauuaaggacgccuaacuugaaggaaaagcauuucugcacaggugucaguguauugcacuguggaaccugugugguaaaggcaaaggggguagugcuuaucucuugauccuaaauaugugagaccagauuaaagugaaaucugggaggcaaugaauguuaaaugaguuguuauguaauuugcauagaggugaugcugagagauuuagaaaggaucacuguggguugcuugcucacuuucuugcucuccuauuccguagcuuuccaaauggcuguacucaacgguggcuugguguuuaggggauuuaaggggggcaaaaagaaagauuaauaaucuccuccucucccucuaacccuacugcccuaagauauccuuagcaaacuuacaucuccuuucuuuucucuguguucauuccauugugcgcacacauacacauucauggauuuucucuuuuuguuuagggaaaaaaauuauaauguacauacuauucuacaacuuuuuguuguuuuauugaacauuauaugauuccuaaauuauccccaggugaauacaaauagauaugacacauuuuaaaaaaauaaaauaacuggccgggcgugguagcucaugccuguaaucccagcacuuugggaggccgaggagggcggaucaggagaucgacaccauccuggccagcauggugaaaccccaucucuacuaaaaauacaaaaauuagcugggugugguggcgugcgccuguaaucccagcuacuccggaggcugaggcaggagaaucacuugaacccgggaggcggagauugcagugagcugagaucacacugcacuccagccugauugcagugagccgagaucaugccacugcacuccagcuuggcaacagagcgagacuccgucucacaagaaaaaaaauaaccgugugaguacuauuccauagaaugaauguuucauaauuuaauucuucuauagacagacauuaaaauauuuuccagauuugggccaagaguagcaguuuaaaaaacauuuagcuuuuaacugacucuagccacuuugaaacacaauuuuuuuuucccaaggucacucaaagagcuaauaggagaaccccuaagucccauaauucagcucugggagccagcacucacucuguacacacauuugccucugucccuagcaauauggugggcgugagggugcagcaagaggaacaagaaagaaaugauugcuugcauaguggcgucuuguucaugcagucauuaauucaacaaauguuuguugagaaucagcuuugugccaagugcuagagagguugagaugauugaagcauaguccuugacccccaagagcucaccauggaaucaacugaagccccucaucaguacuguguugggaauauugagaguggagaguugaguauaacuuauaggacaccuaauguuaauuaccuuucagacacugcaaugugugugugccauaaaaaaaaaaaaaauccaguagcucugauacgagggaaaguaaaugguuuaacaggugcugaguaggagaagcucaaggagaggaaaccccaagggcugaagaaggugggagucaggagucuccugaagcaaguggcauuuaaggagcucuauaaggaaagggucagaguugugauagguggcuguggagggagaugugccaccuggauuggcauguagagggauagaaagauuauaggccuuugcaauggcccaguaagagguaaugaggggcuggaacuggaagaaaacacauuuaagacacaguacagagguggcagacaaggugggacuuggcaacuaccugaugagauccaggagaugaggccaggaggcgggcagcaaagaugacgcagguuucuagccuuaauaggcuaggaggagagugaugccauuagcaauaagaacuacaggagaaggagcugaguuugagggaacuauuaauuugguucagaauaugugcuguuugaguuauggcaggauauuuaaguggacagacugucgacauaguuggaaauucagaucuuaagcucccacacaagguaguggcuggacauaguagauuugagugcucuugcuucagagggcuaguuuagguuggggcagugauuaaagcaaccuaggaaauaaauuauaaaggaagaagagguccuuaaaaccuuggagacugauuauauaaaggguggauccguuaauacaguagcuauuaaaaaauuauaaggggugggaaaaagggacaaagaagaaaaaagaggugaaagaccuuugcugugucaccaaacccugggaggagaauuuuuuaaaagaagaguacucaauccacagugaacuaaggcauguuuguuaaacacaauugaccaccacacagcgaagacccaaaugagguucaagagaaggaauuuuuauggacccuguuagcacaagucaagguccuucuccaguaccacugggaagcuuuggagaagaaaagggggacagugggccuuggguggagaagggaacugaccaugagauccagguggggugaggaggugugugaagucagaguggggaagaaucaggguggcuuacuggcagcuucaccggggucaugcgaggagcagguuccaccagaguaaggagugaaguuguagaaacacagggaagucaccaucagaaaagagcaggagucaagaaacuauggcccacagguacaaacuaccuguuuuuauaaauaaagcuucaugguaaaugaauuguaaauaaaguuuugcauauugugugaggcuguuuuugugcuacaguggcagagcugucuggcccuuuauagaaaaaguuuaucagccacuggaaaagaguugcaggauuugaggucuuggugugauggccuagguuagagucauagugagauugaaggaguagcuagacaagccaauuguguggcagaaagguagggauggagaucacuggguuaaggauccuuguagccaggacaccaugagagugauugacaagaaugcugaaauccccuaagugugucaggauguggaagaguagaaggcuagaguuauggaagaaagggucccaccucuaccugugcagccuccaggagagucugaggagggggcggugagugugaguaaauguugucagaaucccuccucccagucuacaagccccagggaaaggaagcaagguguuuacugacacccccaggcuuauaaguacuuccuggcuccaucacccuccagugaacagcccuggggagaagacaguacugguuugcagguggguggguggggaaaggggucacaggugcuugguguucugguaaaugugcauaugagaacaugggguugcuugugcccuguccgucaggguucagaagaacgugcaguggaagcagcuauggggaaguagcuagggaagguaggacuggucugagguggugaggagcagaugcugccagcuccacacauccaggagagccugggugguuugggcaaaagucucuggcaucccuucugagccuggguaccacacugaagagugaggacagugugccauuuuuaucaggaaacccuccagcucccugaagaccaaauucugauccuccugggauggcagugaagagccacagagaugacucugaggucccguggccuuuucccaccuggagauuguuuucguuacugcgcuguuacagccuuggaggacugggguucaguuucauccaaucacauuucuucuuuugucauagucaucuaaacgauagaucuuagagacaggugggcaaggggugcacuggugagccugacuuaaggagaggucaucucgucccuucccuagucccaucucccuugguuauuguuauuucaugugauuguucugguuauuucagguuauucuguuuuuguuuucaaaacaauaacauauauuuguuguucugauuuuaaagggguaauuguuuugguaacuagaaaauuaccuucucaacucccuuaaauucugucaaagggaaaaguaaguuagguugcuggagaggcuaugcugaggccucagaaccucuguauuccuggaaguucugcgugcuuugccuccugcuccccucucuguguuccuguuggcaggccccuaggcaggauuuaggagguaggcaagucacccuagccaagucauaagcccauggcucaauugccuucucagcccuucaagggcuguuccacaggcagcaaagggaggggccuccacagguucaccacugcagcccuaauucauuuucuuuuuccacugucuuauucugcagggguauucccucagcggauacuacacccauccauuucaaggcuaugagcacagacagcucagguaccagcagccugggccaggaucuucccccaguaguuuccugcuuaagcaaauagaauuucucaaggggcagcucccagaagcaccggugauuggaaagcagacaccgucacugccaccuucccucccaggacuccggccaagguuuccaguacuacuugccuccaguaccagaggcaggcaaguggacaucagggguguccccaggggcgugcaucucagaagucaggggcuccagagaggguuccagcauccuucaccacguggcaggagucugccacagagagguguugauugccuuuccucacauuuccaggaacugaguaucuaccaagaucaggaacaaaggaucuuaaaguuccuggaagagcuuggggaagggaaggccaccacagcacaugaucugucugggaaacuugggacuccgaagaaagaaaucaaucgaguuuuauacucccuggcaaagaagggcaagcuacagaaagaggcaggaacacccccuuuguggaaaaucgcggucuccacucaggcuuggaaccagcacagcggagugguaagaccagacggucauagccaaggagccccaaacucagacccgaguuuggaaccggaagacagaaacuccacaucugucucagaagaucuucuugagccuuuuauugcagucucagcucaggcuuggaaccagcacagcggagugguaagaccagacagucauagccaaggauccccaaacucagacccagguuuggaaccugaagacagcaacuccacaucugccuuggaagauccucuugaguuuuuagacauggccgagaucaaggagaaaaucugcgacuaucucuucaaugugucugacuccucugcccugaauuuggcuaaaaauauuggccuuaccaaggcccgagauauaaaugcugugcuaauugacauggaaaggcagggggaugucuauagacaagggacaaccccucccauauggcauuugacagacaagaagcgagagaggaugcaaaucaagagaaauacgaacaguguuccugaaaccgcuccagcugcaaucccugagaccaaaagaaacgcagaguuccucaccuguaauauacccacaucaaaugccucaaauaacaugguaaccacagaaaaaguggagaaugggcaggaaccugucauaaaguuagaaaacaggcaagaggccagaccagaaccagcaagacugaaaccaccuguucauuacaauggccccucaaaagcaggguauguugacuuugaaaauggccagugggccacagaugacaucccagaugacuugaauaguauccgcgcagcaccaggugaguuucgagccaucauggagaugcccuccuucuacagucauggcuugccacgguguucacccuacaagaaacugacagagugccagcugaagaaccccaucagcgggcuguuagaauaugcccaguucgcuagucaaaccugugaguucaacaugauagagcagaguggaccaccccaugaaccucgguaagagaccacccaggaacuguaccuaggguuggggucaggugcuuuugcuccugacgcagucuuggcugauuugugagcagugcuguuugguggcgccuaucuuuuccuccuucccuucugccuuuuagcuaaauuccccuugauuggcccuuucuccagauauugagcagggaauauagaccuuggaccagccagaaucuuggcugaacaagggggagguugacucuguuggcuguaaugaagcuucuuuagaaaugauugguuuuggccguacgcgguggcucaugccuguaaucccagcacuuuuugaggccgaggcaggcauaucacgaggucaggaguuugagaccagccuggccaacauggugaaacccugucucuacuaaaaauacaaaaauuagcugggcgugguggcgugcaccuguagucccagcuacucaggaagcugagacaggagaaucacuugaacccaggaggcagagguugcagugaacugagauugcgccacugcacuccagccugggccacagagcaagacuccaucucaaaaaaaaaaaagaaagaaaugauuggucuugggggccggggcgguggcuuacgacuguaaucccagcacuuugggaggccaaggcaggcagaucaugaggugaggaauucgagaccagccuggccaacauggugaaaccccaucucuacuaaaaauacaaaaauuagcugggggugguggugcuugccuguaaucccagcuacucgggaggcugaggcaggagaaucacuugaacccaggagguggagguuguagugagccgagauuggcgccacugcacuccagccugggcgacagagugagacuccaucuuggaaaaagaaagaaaaaagaaaaacaugauugaucuccaugcaucaauaucaugccugccuccuaaggcagagguaaugaagacuuaauucccuucuguaggccuuccccuccucccuaagccguuuucugagagaggugcaggagcagguggguuggggcaggcugcauacacaguggggguggguugugcugcuaagcagcagcagguccacaauccccccucugcauagcuccuggggggaaaggauggaggagcgugugcacggcugccugccuguugaagguggugguucuaauuuuauaaaccuccucugcacagauggguaggcuagcacuugcugccacuccugagcugugaagucagccuuuaccucacucagauagcuggucaggcccugcacuguagguccuaauaggccaguggacagauugaggaaaacaggagcuucugaagggcauaacagagagcaaaaccacugaagcugaguggcugcagcugcagccagggaaagagccaguaggaugggggagaauuccacugaccuuuauguuuaccuagccugguuucuagggguguagauuccuggcuagggcccuuauuccuugucuugacugucuucaugacaccaauuuggcauuucaggagagcgguuaagaaaaggaguugugucuguccaaaagcuggcaaggccagagcuggauuguuugggguagagacuggauggccgucauucucuuuugccuccaucccuccuccccagaguuggaggaaagcaguggauuuugugguuagucauucuuuggacucacacuaaaagaaacauuggugccauguucaaauauaucagaagaccuaggaaauaagaaauuugaccuacuuuucuaaaugaaaucccagacugagcaaagagcucaccacauuugaaagcuugaacaaagggggccuaggcuaaguccagaggccuagaacaaaugcuuuuuuauuuucuacauaacaaggggaaauuccuuguuauguagaaaauagcuggagacaaauggugcuauagagugacucauaacaaacuacggugauauaggucuagggacaaaagcaggccacugauaaguggcagaugccugaucccccuagguaguggggagugugagacuggguuauaagaagccuucacuaucuuuuaggacccucccuugaggaggccagucuaccacaauugcuuuagaaugaaggucuuuugguugcucacaagacuauaaugguaauuuuuggcucaucauuuuuguguguguggguuuuaucuuaauucauuguuaaagagauaguggguuuccccugagcuaguuuccuaucaucugugccuauguuugcuucacugagcuauggggaaagagucacuggcugcuuuguuuacaaaaagaaaggacaggcugagccuuaaggaguaggaaggaguuccuuggccuacccuucaucuccacaagugaaaagccccuuagcguagcagaaaauuccagguugaaggucucuuuggagaaggcagaaggagugaccuagacuccuguucacacaucuaaucacuuuccgucaagauuuaaauuccagguugucaucaauggccgagaguuucccccagcugaagcuggaagcaagaaaguggccaagcaggaugcagcuaugaaagccaugacaauucugcuagaggaagccaaagccaaggacaguggaaaaucagaagaaucaucccacuauuccacagagaaagaaucagagaagguagguguccuccugccaucugggaggaucaguucccugucagugucuggauuguaacugacucccuugaggcaaucccagccuaaacaacugacaccaucucggagucagcuucccacucuucccucuacccuaucucgccagcccaccuuuccuccucucauacccagcuccucugucugcuccugucccaacauaauuggauuuacagaauuucggacuugaaagagaccugaaaguuuauugaggccaaucuccucucuuggaagaugcggaaugagagcuccagcagccccuuuaacuuugggaagccaaccccuugacagguggugggaauaaagucccccauccccaucccuucuucugugauggacuaaccaguguuuucuuaguuuuguuuucuucuugucucucauuuucucuagacugcagagucccagacccccaccccuucagccacauccuucuuuucugggaagagccccgucaccacacugcuugaguguaugcacaaauuggggaacuccugcgaauuccgucuccuguccaaagaaggcccugcccaugaacccaaguauguccuacguguccucuguccagcugagguuuucucagaaagaaaaagagacacauuuucuuccuugccuccucagggauggcagauugaccaauuucuccuguuucaaaauggggaaaggagggcucugagguccugguugcugcuugugaggcagacaauuagggauuaggaauucaaagggaauuccuggcccacccucuaucuccucuauaagcacuagggagguucacggcuuggaggucacucacuguuggugggacagaaagguacaggaccugagaagcucucugccugugggucuauagacucacauguucaagagaaguguuccuggaagaggugaaacuagguugaugcuuaaauguugaaaggggucagccaggcuaagagacacuggcuguucaaggcagaagugacugcaugagaugugacugcacagaggugauguguucaaggaaauuaccaguaguggaggauggcagccuggcagaggcuaggucaggcuccucagucaaaaccauuuuaauccuucuacgugcuucaucuccugucagguuccaauacuguguugcagugggagcccaaacuuuccccagugugagugcucccagcaagaaaguggcaaagcagauggccgcagaggaagccaugaaggcccugcauggggaggcgaccaacuccauggcuucugauaaccagguagggcguuuuccuacucaaaagauacaggucauuuuuagcaacugagugguuuaagauugccagugacucccucaacauuuccugaaguguuuauggcuccucuguuugauggauucuccuuuagccugaagguaugaucucagagucacuugauaacuuggaauccaugaugcccaacaaggucaggaagauuggcgagcucgugagauaccugaacaccaacccuguggguggccuuuuggaguacgcccgcucccauggcuuugcugcugaauucaaguuggucgaccaguccggaccuccucacgagcccaagugaguguccuaguccuggcuaaugcaugugucaccaguuggggauggucuguaacccagggaaaacaagggugugcuuuagcuguguaggacagaaggggcgaguugagggaaacaaguccagcccugucuccacggccucuuagaagacaauagaccugccaagagugaaugcguucacucuuccaguaagcaugauccuuuuuaauuuuuugacuaguuuuaauuuuuaaagaaauguauagguacauuaaaaaaucauucaggccagacaugguggcucacgccuguaaucccagcacuuugggaaguugaggcagguagauuaccugaggucgggaguucaagaccagccggaccauaugaggaaacccugucucuacuaaaaauacaaaaauuagcugggcguggcagcgggugccuguaaucccagcuacucgggaggcagacaggagaauugauugaagcugggaggcggagguugcagugagcugagaucgcaccacugcacuccagccugagcaacagagcaagacuccaucuugaaaaaaaucauucaagcugauugaaaaaguagucauuucaaugaaaagucucauuuccgucucagacuucuaguuucccucccuagacccauauauuacuauagcccugcauuagcaacugggaugcggucugagaagcaugguuuuguuguugugagaacaucaguguguauuuacauaaaccuagauggcaugggcuccuacacacguacaggcuguaugguauggccgguugcuccuaggcuacaaaccuguacagcauguaacuguagugaauacugugggcagcugcaacacacugguaaguauuggugucuaucuaaacagcaaaaagauacaguaaaaagacagcauaaaggauuaaaaaaauacuacaccuguauagggcgccugccaugaauggagcuugcaggacuagaaguugcugugggugagucagccagugaguggagaaugaauaugagggccuaggacaugacuguacacuaauguaggcuuuguaaacacuguucacuuaggcuaacuacauuuauuuaaaauauuuuucuuuaauaaauuaaccuuagcuuacuguaacuuuuuuacuuuauuuuuacuuuauuuuuuacuuuauuaacuuuuuuauuuuuuguuccuuuuguaauaauacuuagcuuaaaacacaaacauguuguacugcuauccaaaaauauuuccuuuguuuauauccuuaauucuauagucuuuuuucuguuuguaaauuuuuuuauuuuuuuaacuuuuuaaacuuuuuuguugaaagcuaagaugaaaauacauuagcuguuagccuaggccuacacagggucaggauccucaguaucacugucuuccaccuccacgucuugucccacuguaagguguucaggggcaauaacaugcaugggggccgucaucuccuaugguaacagugcuuucuggaauaccugccugaggcuuuuuuuaguuacuuauuuuucuagaaguagaaggaguauacgcugaaauaaugauaaaaauauaguaaacacauaaggagcguguagccuagaucccucgcauucacaguucacagucgaguucacacuccuacaagaaucucaugcugcugcugaucccacaggaggcggagcucggaccagaaugcuuucuugcucgccacucaccucuuccugugugcccagguuccuaacagguuacagagcccugcacuuggugauaagaauuuuucagcuccaucauaaucuuacggggccccugucauaugugugauuuaucauugaacaaaacacuguuaugcaguacaugacuauaccaguuucuugaguccuucuagaaauugcugugcauaacuagcacauuuucccuuuugucuuuuuaaacaaguauaucuucuguuuuauacguugacuccuuuacuuaccagacuucuugcauagcugcauaguauuucauugaauagaagcugacaaauucaguuucucagaaguaaacauuuaauagggacuuaggaacagaaaugaugucuuggguggcugcaagaugguggaucccugcacuuacccuccagaaaguaugcuuucuauagaggcuuuuuugguuaaacaugcagcuggucacacauuauacuuucuugugaaacuuaugagcacuagcugguggggaggcuugguagacaucuuuguguggaauuauuuaugcuacccaacacuuugggaugcgggagucagauauugguggucauagugguuuugcaucaagauggcaucacucuugccaugcaaccggcauguuuucuuaaucucuaaggucuaucacaaaguggaaaagcaagguguaaagugaggggagaggugaagauugucuguauaugucuagaauauuuucuugaaggaucgaaaaaacuggcaacuguguuugcuucuggggaaggagggacacuuuuauuguacacucuuaacuguuugaauuuucacauguuuggcauccaacuuguccauuuuaaagucauuaaggaaaaaagcuuauaaaaaugcuaucuuguuacuuuaaauuugucucuccuuaauagaaguaaugucagccgggcgcaguggcuuacgccuauaaucccagcacuuugggaggccgagguggguggaucauuugagcucaguaauuugagaccagccuggccaacaugguaaaaccccaucucuacuaaaaauacaaaaaauagcugagcauggugguaugccccuguaugccagcuacuccggaggcugagcaggagaauuacuugaacccaggaggcggaaguugcagugaccugagauugugccacugcacuccagccugggugauggagugagacuccgucucaaaaaaaaaaacaaaaaaaucagaaguaauggcauuucauuuauucauauuuauguguuauuugcauuuccuuuucugugaaccaccuguucuuguccuuuuccaguuuucuuucagauuguuacucucauggauauguaagaacuuuuaacauaauuuuuaaaaguagcccuuugcccaacaugacccaauuuagaacacacaucugcccacuguuuaagccaucuggaaaaggagaggcccagucucccuccagcugcucuucuacuaauucauauccuucaucucaauaagcaccuccuuaucuuuaagcacaguccuucagaugauagguucagugcauuuccucuuucucuucugugaaaucuucugugaaauccuuucuaggacuucaagucagccauucauugagaauguaagaacuuacuaugaacuagauggaagauacaaaaaauugcugccccugaguguguagcagacauauagccauagcaguauugaaaugugccauuggaggugaaugcagagugcuguggggacacagaggacacugcugccacugucugccagggagcugaggaagguugcauagagaggggaaaugcuaauugaguaacuacguuuauuaacuaucucguacaauaauauacuuuaguugcuucuuaaugugaauuaugcugggucuuuuuuuccuuucugucuacuguggcuggugacguuaacuaauuuuaugacuucuuuucuguuuuuuuuuuuuuuuuuuuuuggagauggagucucacucugucacccaggcuggagugcaguggcgcagucucagcucacugcaaccuccgccuccuggguucaaacaauucucuugccucagcuccucgaguagcugggauuacaggcaucugccaccacaucugacuauuuuuguauuuuuaguagagacagaguuucaccauguuggccaggcuggucuucaacuccugaccucagaugauccacccgccucagccucccaaagugcugggauuacaggcaugaaccaccgcgacagccaugaccuuuaauaucuaaaugcuggagaccacucagagcucccgauuccuccaucuaguugcuuacuugucaccucuguuuggauuaacaucccuaauaugacauguccaaagcagaacucuuggguuuugcccccuucgcuucauuucccccaagucuuucccagcuuaguaagugauaccacugucuacccaguggcucaagucagaaaccugaggaucaucuuuuccucuaucuccuuuaccuccuucgucaacucauccuuaaguccuauugguuauacuuagaauuucuaucccaaaucccuuccucuucuuuccaccuccagcgucagcacucuaauccaagccacugucucaucuagacugucacaauagccuccuaacugaucuuuauacuuuauuuacucaacacuuauuuauggaguaucuucuauuuuuuuuagaacaggaaccaaacauuaaccaauagucaccuaaagaaauguaagaucucauauuugauaaguauuccaaagggcuggaguugcagcgagaaucaauuauagcacaguuugacuuaggaaggagagggggaagggcuuccccaagaaguacugccugagcugagacuuuaaggaugaugaagagagaaagacugaggguucuaggcgaaggacacuguuaaauccuguggugggagaagcgcagagcuggcaaagaggcugagaggaggcacuuauggcaauagccccauuuggcuaguggcuaccauauuggauagcacagcucuaaaggauucuaguugcauaauuaacaaacuuuaucauauauguaaauauaucaguauaaaacuuugcacguaagaguucauauucuuuucaaacacauggggcagucaugaaauucuccuggaucccugagguaaagauacuacacaaucugucccuccugaccgccuucaccaucuucuuuucaugccacugucccucucauucugaacuuaagcccacuggccugcacgggccugccagcauggacaaagaaaagagugaaggcauuuaguugcuucggaucaucaaggaacagugagaaacuccaugugguugaacauaaacguugauuccuuuuacugccugagcugcuaagucuugaaacugaagccucuguuauaugcaguuagaguauccaaagcuggguucucagccaguagauuaggaucugguugaaagcuaggauucuugaugccuugucugguacauuuccaagcuguuuugcuccaccaugcucuucccucuguguuuggaaauuaccagccggagcgguagaagccaccucccugcuccacuugggcacuuuauugucagcgcagcucaugcgcccaagauccauuccuuaccccagaguuagcuuaagccugccaggagucaaaaaaacaacucccagcaaaaccugggucccuggccuaaggccgaccuugaccuaaugaccucuccaggucaaguccccuugagcuaauaggaaguaaaugagggaauggaguugggcgcuuuaaaaaucagacaguguaugaaguaacagugacuuguggggagaaagguagucccuucugauuucugcuuaagaagagaguccaaguuggugcuagcauuucguuaagccuuccucauacuucauaaucuuccuuuauaguaaggacaggcucagagccuuugcagguaacaguaucuagucagaauuuuauaacaugauuuuaucauauucuguuuuacagccaccuucaauauguggcaagugauacugguuuuccauuuacaguagugaaacaaaguuuccuauuucaguguguuuacauuuuuaucucuuuuuucauaccuaguauuacggauauuuacauuuuuagagucuguuuguuuauuuuagagauggggaucuugcugucucgcgcaggcuggagugcagugauauggucauagcucacugcagccuugaccuccagggcucaagugauccucucaccccagccucccaaguagcugagacuauaggcacagaccaccgugcccagcuaaauuuuuuuuuuuuuuuuuaagagacaggggucucgcuauguugccugggggauuacuauguugcccaggcuggucuugaacuccuggccucaagugaucucccaccuuagcuccucaaguugcugggauuacaggugugagccacaauggcuggcucuaagaagucaauuuagagaaaaauauuaauuaauaguccaaguaauaccuggauguggcacaaaucauguggugauucaugaaugaccaaaaucuaggaaaugcugccuuagaaacagcuucuguuugacggguccauauguuugcaagacuggccacaucuucagcaaaacuaacccuuccuuggaacaaugucagggucuggcacuugucuucauucucuguuucucaucccaaagguucguuuaccaagcaaaaguugggggucgcugguucccagccgucugcgcacacagcaagaagcaaggcaagcaggaagcagcagaugcggcucuccgugucuugauuggggagaacgagaaggcagaacgcauggguuucacagagguaaccccagugacaggggccagucucagaagaacuaugcuccuccucucaagguccccagaagcacagccaaagacaguuaagacgucuacuuuuggugccuuuuuuggggcggggggguccuccuaacuccuaaguggagguggcucuugcugucaugcgaguuauuccuaggcuuuacucuuagccucgagagagcaguaacugggacacuagauguaagaaggaaaagaugacucacacgacaaguagagcuugaucucccugcccacggugaauaugguggacacagccucagcuuuguggugcugacacagccucuuuuccccacagcucccucucacuggcagcaccuuccaugaccagauagccaugcugagccaccggugcuucaacacucugacuaacagcuuccagcccuccuugcucggccgcaagauucuggccgccaucauuaugaaaaaagacucugaggacaugggugucgucgucagcuugggaacaggugagugaggcucugagacaugccgccucccauggcgccugaaagcgggugccucucauccuccccuggaguccaugcauguaaguccaaggcagggagaagagacuucauuuuagcuacagucaauucagagugaggaaugaguucuuaguuccuagaggagagaauaugggagucuaggaucugagaaacugaggcuguuucugccuugaagcuuucagaacaaauagccuucauccuguuuuccaucgguuuccuuccauuauucuauuucuguuuuaaacaccuuccuagggaaucgcugugugaaaggagauucucucagccuaaaaggagaaacugucaaugacugccaugcagaaauaaucucccggagaggcuucaucaggugagcgaggucagagcuguggcccggcugcccggcuguggagagcuccaguucccugccccacauggcucugacacggccucugaaucccccucagacagacgggucaugauguggcaguggcagccuuugcuuuucacccguccauuugaaccugucugauggaauccauccccucugugagcugagcugccucccacugcucggccuguuuuuaaaugcuguccuuuuuucugcuaacucugcugcuucauguucuuuucuaaaaacacaaaaugaccuuuuaguccucagggccuugaggaugaggcagcuuuccauuuccguuugaggaccuacacaaccuugaugccccugccagcuuucuccucuagcucaccuuuucuuuaauuuaugaagggagagacuuagaaaggagcaacagcuuccuguaguccuugaaucaguuugcucugcucuagaaucccuguagccgccauagcgaggagcccucagcagaaaugaaggagacccaaaaggcuaacuaugcuuuaugaaaugcugaggucuccccuggagaauuuccaccugauaaacugugaaacgucugcaacauugagacuuuuccuuacuuucucauuuggaggucagauuauagaaacaacugcuuuucccagaauugaaccugccuuccuaaccagacuuucuuuuuguagguuucucuacagugaguuaaugaaauacaacucccagacugcgaaggauaguauauuugaaccugcuaagggaggagaaaagcuccaaauaaaaaagacugugucauuccaucuguauaucaggucuguacaguuccuguugcugccagggugggcccugccaggcuguuagaauuggguauccaaaugcucuccuggccuguaaaucgaaccugauacaauaagccacacuccacuguggguuugagguccauauucagguguagaugacucacauguacugcuguccaccuccagucucccaugguaggccuuagaaaacaucccuugcuucugucacaucugacuguuuuggagccccacgaaauugcagauuucccacaggugaguuuuaacagccaccccuguuuuucagcacugcuccguguggagauggcgcccucuuugacaaguccugcagcgaccgugcuauggaaagcacagaaucccgccacuacccugucuucgagaaucccaaacaaggaaagcuccgcaccaagguggagaacggugagugauacaugcccccgccuccuuuccucaaaaggcucugcaagguccagggaccccaagucucuacaaggcugcuaggauuuuaccauuagucacugggcacagaggugcuguuuacaggaaagggaagaccugggucagggagcugugugguaagaucaggguucuauuuugaauguguuaguuugggagaucugggagauccccaagucaaauaggagguggggguucccauguggagcucagaggagggagcuuggcuggaaauagaaauaugggagucaucccccuauagggucuucauggccaugagaaugcauaggauuaccucaagaaagcggggaggaaaugaagagugcggcacaaccaagcccugaggaguugacagaugaggaugccaaaugcugggguccccuccugucuagcuggcaguugacucugccuuguccacuggcuccuucucuccuauccucuccugucuccuuacugucucuucgcauccacuccauugcguucaggccacgucagcagucaucauggugguccugaaaccuugcuaaauacccuaaaguauagacacaguuaccauggagccggugcuccacuccuagguauaugcugcagagagauggagaucuguguccacacggaaacuaauaugugaauguucauggcagcauuacucacaagagccaaaaaaguggaaacaacccagacguccaucagcugauggauucauaaauaaaacaucaaauauauccauaaauugaauauuauuuuggccauaaaaagaagugaagugcugauacaugcuuacaauauggaugcacuugaaaacuugaugccaaaugaaaaaagccagucacaaaagaucacauauuguaugauuccauuuauaugaaauguccagaauagacaaauccauagagacagaaaguagaugagugguugccagggccaggagugggagaguuggagagaugaggagugacugcgccaauggguagaagguuucuuuuuggagcgaugaaauguucuaaaauugacuguggugacaguugcagaacucugugaauauacuaaaaaugacugaauuguaugcuuuaaaugggugaacuguauggcauaugaacuauaucucaguaaagcauuuuuuuuuguuuuuuuuuaaacccgauagugguuucccacugcacugcauauacaagcaaaaccugcugugaucacccggccuccucucaugccacuuuccccaucccucgcauaugcucuguccacacuggcucucugucaggcgccugaacagccaauccgcuggcugccuuggggccuuugcuuuuguccugugugccugaaacacuuacuccagcuguccuccuccaugucugggcuccccugcugcugcugucccaggagguguccccugugguccuccgucauagcugccucagagccuucagagcacugucagcaucuggaauucuuccguauguacuggcuacugguuuagugucuauucucuucccuuucaaucuccucaccaccauagauguuuuaagagcacaaagaucuuacuugguuuugcucaccguucuuucccagcaccaagcauagugccuggcgcauagcaggggcugugaaauaugugaagaaugaaugaauguagccuguggcccaagcuuaaggaggauagaaaccacgccagggagugguuugguccauuggcgccugugggucugacccaagucucucacacaggagaaggcacaaucccuguggaauccagugacauugugccuacgugggauggcauucggcucggggagagacuccguaccauguccuguagugacaaaauccuacgcuggaacgugcugggccugcaaggggcacuguugacccacuuccugcagcccauuuaucucaaaucugucacauuggguaaggggccugccuugggaucuggaacuggucuguccuucuugugcccagaucccaaacugcaugcuuuauugccagguguuuugucucccuuaucaaagugagcaugauucacuccucaguaauugauugaguguccagucugcugugguaggaagauccugguagccccagucagaaggugcuuccuaacaaggcagcuguuucucuuucuugacaacuauaucuuguaccuccaaaauccccacaugcuucugccucuuaacagcauuuggugcaaacacagguauauauguuucucuuuuuuguacucagguuaccuuuucagccaagggcaucugacccgugcuauuugcugucgugugacaagagaugggagugcauuugaggauggacuacgacaucccuuuauugucaaccaccccaaggugcuauaacccccuucuauuuucccugacauuuuccuccuuuucaagcagucauguaaacagaggaaaaauguacacugugggcaaggggaacauugcccacagugguagcccacaagggaacauugcccacaguggcccaccaccaacauugguuggucucccaagaacuuaaacuuucuuccuuuuggaugccaagggcuuuucuucucuuagucuggaauuaaucugaaucgagguggaguuaguaugucuagagggugcucagucuuagccaaacagaacccuaaauacaggggaaagaucaugaccccacacuuccucucuccuaugagucuugagucccugcuucagaaucuuauuccugaaagguuuccaucuuucucccguugcuucugggauuccuagguuggcagagucagcauauaugauuccaaaaggcaauccgggaagacuaaggagacaagcgucaacuggugucuggcugauggcuaugaccuggagauccuggacgguaccagaggcacuguggauggguaaggagacaggagagcgcagugaggaccaagccucugcccugacuugcaagggugcaucauaccucugcagucucagggcuugagagccgccuccccucccacggugucuccacugugagcuccuuaucuuacaggucccaggugaauaaugagugcuuuuguuucucuaggccacggaaugaauugucccgggucuccaaaaagaacauuuuucuucuauuuaagaagcucugcuccuuccguuaccgcagggaucuacugagacucuccuauggugaggccaagaaagcugcccgugacuacgagacggccaagaacuacuucaaaaaaggccugaaggauaugggcuaugggaacuggauuagcaaaccccaggaggaaaagaacuuuuaucucugcccaguauaguaugcuccagugacagauggauuagggugugucauacuagggugugagagagguaggucguagcauuccucaucacauggucaggggauuuuuuuuucuccuuuuuuuuucuuuuuaagccauaauuggugauacugaaaacuuuggguucccauuuauccugcuuucuuugggauugcuaggcaaggucuggccaggccccccuuuuuucccccaagugaagaggcagaaaccuaagaaguuaucuuuucuuucuacccaaagcauacauagucacugagcaccugcgguccauuuccucuuaaaaguuuuguuuugauuuguuuccauuuccuuucccuuuguguuugcuacacugaccucuugcggucuugauuagguuucagucaacucuggaucaugucagggacugauaauuucauuuguggauuacgcagaccccucuacuuccccucuuucccuucugagauucuuuccuugugaucugaaugucuccuuuucccccucagagggcaaagaggugaacauaaaggauuuggugaaacauuuguaaggguaggaguugaaaacugcaguucccagugccacggaagugugauuggagccugcagauaaugcccagccauccucccauccugcacuuuagccagcugcagggcgggcaaggcaaggaaagcugcuucccuggaaguguaucacuuucuccggcagcugggaagucuagaaccagccagacuggguuaagggagcugcucaagcaauagcagagguuucacccggcaggaugacacagaccacuucccagggagcacgggcaugccuuggaauauugccaagcuuccagcugccucuucuccuaaagcauuccuaggaauauuuuccccgccaaugcugggcguacacccuagccaacgggacaaauccuagaggguauaaaaucaucucugcucagauaaucaugacuuagcaagaauaagggcaaaaaauccuguuggcuuaacgucacuguuccacccgguguaauaucucucaugacagugacaccaagggaaguugacuaagucacauguaaauuaggaguguuuuaaagaaugccauagauguugauucuuaacugcuacagauaaccuguaauugagcagauuuaaaauucaggcauacuuuuccauuuauccaagugcuuucauuuuuccagauggcuucagaaguaggcucgugggcagggcgcagaccugaucuuuauaggguugacauagaaagcaguaguugugggugaaagggcagguugucuucaaacucugugagguagaauccuuugucuauaccuccaugaacauugacucguguguucagagccuuuggccucucuguggagucuggcucucuggcuccugugcauucuuugaauagucacucguaaaaacugucagugcuugaaacuguuuccuuuacucauguugaagggacuuuguuggcuuuuagaguguuggucaugacuccaagagcagagcagggaagagcccaagcauagacuuggugccguggugauggcugcaguccaguuuugugaugcugcuuuuacgugucccucgauaacagucagcuagacacacucaggaggacuacugaggcucugcgaccuucaggagcugagccugccucucuccuuuagaugacagaccuucaucugggaacgugcugagccagcacccucagaugauuucccuccaaacugcugacuaggucauccucugucugguagagacauucacaucuuugcuuuuauucuaugcucucuguacuuuugaccaaaaauugaccaaaguaagaaaaugcaaguucuaaaaauagacuaaggaugccuuugcagaacaccaaagcaucccaaggaacugguagggaaguggcgccugucuccuggaguggaagaggccugcucccuggcucugggucugcugggggcacaguaaaucagucuuggcacccacauccagggcagagaggucugugguucucagcaucagaaggcagcgcagccccucuccucuucaggcuacaggguugucaccugcugaguccucagguuguuuggccucucugguccaucuugggcauuagguucuccagcagagcucuggccagcugccucuucuuuaacugggaacacaggcucucacaagaucagaacccccacucacccccaagaucuuaucuagcaagccuguaguauucaguuucuguuguaggaagagagcgaggcaucccugaauuccacgcaucugcuggaaacgagccgugucagaucgcacaucccugcgcccccaugccccucugagucacacaggacagaggaggcagagcuucugcccacuguuaucuucacuuucuuuguccagucuuuuguuuuuaauaagcagugacccucccuacucuucuuuuuaaugauuuuuguaguugauuugucugaacuguggcuacugugcauuccuugaauaaucacuuguaaaaauugucagugcuugaagcuguuuccuuuacucacauugaagggacuucguugguuuuuuggagucuugguugugacuccaagagcagagugaggaagacccccaagcauagacucggguacugugaugauggcugcaguccaguuuuaugauucugcuuuuaugugucccuugauaacagugacuuaacaauauacauuccucauaaauaaaaaaaaaacaagaaucugaauucuuagaa

SEQ ID NO: 6295 - RNA, 26191 nt, Homo sapiens; identical to SEQ ID NO: 6294

SEQ ID NO: 6296 - RNA, 26191 nt, Homo sapiens; identical to SEQ ID NO: 6294

SEQ ID NO: 6297 - RNA, 45923 nt, Homo sapiens
gaccagaccauugauucccgacugaagguagagaaggcuacguggugggggaggguggggggagggucgcggccgcacuggcagucuccggguguccggccgugucccgaggaagugcaagacccgguaagagccucuguccuucucggcuacaccugccugggcuggaacgcgcggcccaugcggccucuccagucucuggcguugauguuagaggaagcgugggggcgccccggcagggcacugaggguggccgcagggcuggguggggacgcagcugguaggggcacaguggccggucucggcagccuuccaggaggcggacgcccgggccgguguacuuuugugcgugugugcgcgcccgugugugcgcgagugugggcggcagaggcugcgcacggaugcuccggcgcucgugccagccggagcccagcagcuggguaccaaaggcccaacagcuggguaccaaaggcccuuguuucccucucgccggcucccccgccucggagagugacuggagagugagcugccugggacucgccgcgguaggcgcuuuugcugcgccuucuaccacaaacugcguuaggaccggcccuuuaucccagagauaacaucgccgcccuggcgugccuuccacagggaaggcguaggaggccacuguggaaagcucacugcggggucacggccgccgcgcucagccugucuggccuggugcaggaggccuaguugcgucaccuccucuuccuucucuguuuagcuugauuugggggccccacuagaggguaauccggccccagguguuucguguugguaucagaguuugggaaacuugccuuccaaaaagggauaccugucauuggauuuugaauguuguguggaggagcccaaguaugcaauuagcggagggagcagagucuaggcugccacgggaggagacuugcaaacagaggccuacacagugucuuguugcuagagagggaggcaggauugcuagagcgggucauugggggcagagaaggcaggggcgucaaacugucagcaguugugaugccaacuucuuucuccaccagagaagccuuguucccauccuuuuaaagaucucuugaaauaucuuggucguuauuuacaaacaguuagugcuugcuauaugggaaaaagggaaauagaguggaaaggggacaugaacuuuggagucaggucugccacuuugcagcuguuugacauugaaugaguuauuuaaccucuccacuccuacuugggcuuaucuacaaaaugaagauaauuauaucuaccuugcccgaggugucagaauucgaagugucuagcuauuauuaguaagggcccaguacccaggagcuuggacuugcucccuugcugaagguuuccuauugguacagcugcuugagaagcaggggaacuuuuugcuauuuuagauguuugcuauucugccagauaugauaugcagacuugggggugguaguggaggggaaaucucaaaauccauaaucucucugcuguacacuucauuaaauucuagaacugcaaagaggugaagaucucacuuuaggccgggugcaguggcucaugccuguaaucccagcacuuugggaggccgaggcagguggaucaugugaggucaggaguucgagaccagccuggccaacauggugaaaccccgucucuacuaaaaauacaaaaauuagaccagcaugauggugcacaucugugaucccagcuacuugggaggcugaggcaggacaaucucucaaacccaggugguggagguugcagugagccaauauccaccauugcaccccagccuggacgacagcgaaacuguaucucaaaaaaaaaaaaacucacuuuauuaauuauagcuucucauuuuauuuuauuauuuuucaauuuuaucccgaguagcugggaucacagaugugcaccaccaugccuggcuaauuuuuuuuuuuuuuuuuuuuugagacagagucucacuccaucgcgcaggcuggagugcaaugaugcgaucucagcucacugcaaacucuaccucccggguucaagugagucucccuccucagccucccgaguagcugggauuacaggagcaugccaccaugccuggcuaauuuuuguauuuuuaguaagacaggguuucaccauguuggccaggcuggucucgaacuccugaccucaggugauccaccugccucggccucccaaacugcugggauuacagguaugagccaccgugccuggccuaugcccggcuaauuuuuguauuuuuaguagagaugggguuucaccauguuggccaggcuggucucgaacuccugaccucaagugaucugcgcacuuaggccucccagagugaugggauuacaggcaugagccaccgcgccaggccuuucgcuucucuuuagcacuugcuauguaccugacacgguguugagcacuuuacauauacuaacuuauuucaucccucuaacaacugagugcacuaaauauuauccccauuuuauagaugcagaagugaaucuuggcuaagguccugacauuaauuaacggcaaagcuggaacuugaagccagcugugugguuugagucuugcucuuucucagugucuagcaagucuugcucuugcccuugcucaucaggcuaugugguuugagucuugcucuuucucagugacuaguaucccagcaauguaaaccuggugcagugggggaaaggaggcccagacagaguuuagugggccaggauuggcugcaagaauaacaucucaaauugucuaaugauacauuaucuuuuauuuuacauuuuuuacucagcauuguccagauaugaaccaagguuuggccuuuucacccagagaaaaaggacaggcucauggguacacugugcugggaugacgggcacaaaguagguauucggaaaaugcuuguggaaaaaagaaauccugaggcauuguuauuucugccagaaggaggcccagugcuuauuacacacaggcuccuuaagccagcuauuuuuauacuauaacacacuguaauaugagcauuuuucugauucauggauuuaaagauuugaagcccuguuucagaccaagauugguaguauuaucugugaccaacugauuagaguucucaaauaugugaacaacagaaucugagcuuuugggcuucuguaguaaucucuugagauagagcaauuuguuuugcuauaacaucuguuagacuuggaccuuaauggguacaacugcuugaguuuucuggagaacacuggaugauuguuugacaucagggauaaagaguucaaaauauuaaguuugucucaaaauuaaauauuugggaaagaccugugauugaugugcauucauuguaggaauaguacacuaguuuuaaacagaugauauuccugguauuuuugaugagcuauucugugucuuaaagauguuuaaagaugacuuguaguuguauagugaacuauuaggaacauacaaaauuuauauaacccauccauauagacugugacuuacaccccccucaguuccuccacccaaggaggucuaguugcugcuucuauacccucugguuaccuugaagcuaccuauuucaccaucuuuaucagacuuuaucagacuuaauaggugagacccucugacaucagccucccuuuccuucuguaccaccccuugccacaugcacacagaaugaagcucuucuccaaaaggacuguauauuaaucuacuugcaaguggcacaaacccaguguaaauuaacuuaagcaaaaaaagguuuuuuccucccuuugauuauuuaacuagaaaguccaaaggcaagcuucaggcauggcuggauccuggggcuaaaaugaugucaugagggcuuucuuggcccuuccuuuuucggcuccguuuucuuuauugacuucauucucucuugcugcuuucuuuuucuuuuuuuuuuuuugagauggagucuugcucgucuugcucugucgcccccaggcuggagugcaguggcacgaucuuggcuggcggcaaccuccaccucccagguucaagugauucuccugccucagccucccggguagcuaggauuacaggagcccgucacuacccccggcuaauuuuuguauuuuuaguagaaaugggguuucacuauguuggccaggcuggucuugaacuccugaccucaggugauccacccgccucagccucccaaagugcugggauuacaggcaugagcuacugugcccggccuucuugcugcuuucucuaugcauacugaaaaagcucccugucagcaaccccaagccuaugaccugauggcugucuuuuagcguuguaaauuaaccauugcugacaaggaaauagggagaccacaauuggagaggucuacaucauaggcucacucuugggaugaggaaguaaacugcccguccauaaccuuaugggauggggaaguucagagguccuaggcaggcagaaacagcacaugacuacugcagggguguguguaugcacacaugugugcuuacaugugugcucuuaucucacuucuuugggguccuucuagagccuuccaacuggaaugaauccaguggguuguguuuguccaucaaacuuugacucccacuguggcauccauuaugugcucuccguccuuucuguaccuuugcaucugcuguuuggguugcccuuccccauugcuucaucuggcugauccuucuagauucaggucaugcuucucccagaagccuuccuugacaccuuccuuaaugagcuaggcaucccuucucucugcucccauaaacaccugagcacaacccccuuguagauguuauuucuguuugauaauuaucuguuuauuggucaugucuccacuagacggagagccccuugaggacagaguguccuuugcuuuguauuccuuaucuccuacccuuagcuaguauuauuugucuucauagcacucauaacugacauuguauauuuauuuguuuauuuauugccugucucuccucauugacugucuuucauuagcuucaugagaacaauguggaaaggaauuuucuuugaucaaagcaaaacaaaacuaccuugaggccuaggacagugccucauacuggcauauaguauauguucaguaaauguuuauuaaaugaaugaauggaaaucuucccacaggaagaaaacacuggcauuauguugaugaacauuccagucugcaugauagauacacuucucacuguaaagaucugaaacuugaguaccauggcaucccaggaagguagcacaccucuucccauauguguuugaaccugcagaggucaggcccaaggagccuccagcuggaaauucuacccugugugauguuucacuccucucaaacuuuucugaacuuugauagguuguauauuaaggccuucuccauauuuuggggcccuuuccuuggaguauuuauuuuuaaaacauuuauuuaagcacuuacaaggugacaggcacuguucuuaguccuuuauaaauagcaacucacucuuggacuggaguuuggggaccaaggguugucaacuuuaaaacuuuuuucuuuuuaaguaccaaaacacucaagaacagaaauaagacuacucugcaucuaguccaucuugcccuccagaaguagagcuaucuaacagccugauacaggucuugucccugcccuuuccucagguuuuuacagccauagcuaguaaauauaacauacugcaucucaucgccuuuguuuggucuucacccaaacgcagccacgcucugccgcaggauauguggcagagccagguggggaaucaguggcucagagcccacucugcuuuucaggacauaggcugcucaagcaucugucuucagcccucucccagggagggccuaaacccacauccucaggccccugcagagcacauccaucuuccugguuacauguuaugccuuaucugugggaacccuagccacgccacacccacaccucaacacaugaagaaagggaaaaaauaccccuuucuuucuuuugacaacaacaaaaaaguacuucuccuacaaauagagacuugaaaugacaggguuauuauuuaaccccgcucuuacuccaaacauccaagcggcaguuucagccuagcugcaguacucuguuguagugcuuaguccugauuugcuuccuaagaagugaauaccaguuuccacugccaucagcaaugccugaguacuuacugugccucucccucacccuacccuccucuccagaacugaguauuuuacuaaaaaaggaaaaucuuagcuaaauuugaaauagcaucucauuuuaauuugcauuuuuuauuauaauuguuugagcccuuuuuacccauacugagccauuuuuauuucuacuuuuuaaauuuuugguuaauguuuugucuauucacuuauuguguuuaagugauuuuuaaaauauacaaauauucugaaaaacaugaguuuauccucaugguaaaaagcaaacaauuuuauuugcaguuaauucuuuuuaguuuauuguuugccaucuaauuuuggcuuuaucauuaaaaauacaaaucuauuuuucauucuuuuuuagacaaauuuuauucuuuuugauuucuuuugcuugugagcauaaaaagguuuuuuuccuuauucuauauucuaguuuuuuuuaugguuugcauuuuuacauaugacuuuuaaaaagcuagcauucaguuuuauuucagauuuuaauaagauauuugaugaaaauaguguaauauuuuaaauaaaaucaguuuuaauuaaaggucuauguuuuguuuuaaggauguuuauauuacuguacuuauauuuuuucuuuuuaaauaauuuaucagaauagcgaacagcuugcuugacaaaacuaagauucacauauauagauaaucauaauuuuaguguucuuagcguuuccauaaauugcugcaugaaaagauauuuauguguggcugucugguuuaaagaggcacucgugcuuggcaacagcuuuucagcauguagccaagaugacaaauucagccucuuccaguuccucuuccucacuauuucccuaagauuuuuuucaugggagcauaacuauguguaucucugugcacagauuuuauguguaccuuucaauguauuuuaacaaaaauauauccauuuaacuauccaaaucaagaaauaaaacauuuucauuaccucagaaagcuccccugugguagucaccacuacccccaaaggccaacacuauugaugucugauaucuaucacuauagauuagauuaguuuugccuguucuaaaauuucaugucaguaugugcuuuuguuuguggcuucuuucagugaggaucaaccauguugcaugugucaguauccauugugugaauaugcaucaaguuauuuauucauuaguugauugacauuuggguuauuccaguuuggggcuauuaagaagaauaaagcucuaugaacaguuuuuuuuccuguuuuuuauuguaguaaaauacacaacauaaaauuuaccaucuuaaaccauuguuuguuuuuuuuuuugagacggagccuugcucuguuacccaggcuggagugcaguggcacgaucuuggcucccugcaaccuccaccucccagguucaagcaauucucugccuuagccucccaaguagcugggauuacaggcacccaccaccaugcccagcuaauguuuguauuuuuaauagagacggaguuucaucaccuuggccaggcuggucuugaacuccugaccuugugguccacccgccuuggccucccaaagugcugggauuacaggcaugagccaccgcgccuggcccguaaaccauuuuuaaguguauaguucaguaguguuagguauagucacauuguugugcaacaaaucuccagaacuuuuucaucuugcagaucuaaaacuauauucauuaacaacuccucuuuucccccauccuccagccccugguucuauggacauucuuguacaagucuuuuuguggccauuuuucuuggguaaguacccaggaguauaaaugcugggucuagccuuagaagaaacugccuuacaguuuucucgaauaguuagucguaccauuuuauguucccacaguauacaaaaaugcuaguuugcuucauauccucaccaacauuagguauugugagucuuuuuuuauuuuagccauucuguagcugugaagcggcaucccauugugguuuuauuacauguucuagucaguuauuuacaugucuguucccauuacuagacugugaacuucauaagggaagguucaugcaguaaguaguuuuguuuuuuuuguuguuguucuuauuaaccuuccucuucuuauuuugagggugauacaugcuuuauuauuaaaaagaacuuaaaaauuauagaaagcuauuaaaaagccaauaaaaucacagguuagcccaccucucagacaucaucaggaguauuuuggucuuucaggcagugcuguguugguucguacagacagaacaguucccaugaugguugauucagcaacccagcauuguuccagcccacugccuugcuauccucuggacaucacuuauucccagcgaggagcccuuuucucagacagccccagacagauuguuuuugugguuugcuggccacaaauguaucacauguaucacugacaaaagaaguagaauccucaauacuggauuaaauuagauuaauuaacauccuuccucuggggcuggggagggaaccuggccuucuuaggaaaguggacagaaucagggcacucucagaaagggaggcauaguucuagcguaggccacuaacauuaucugccucuuuuuuuuugagauggagucucacucuguugcccaggcuggagugcaguggcacaaucucagcucacugcaaccucugcuucccagguucaagcgauccuccugccucugccccacuaguagcugggauuacaaguaccugccaccacgcccggcuaauguuuguauuuuuaguagagacgggguuucgccauguuggccaggcuggucucaaacucgugaccucaggugauccaccugccucggacuuccaaagugcugagauuacaggcauaagccaccacggccggccugcuucuugguguuuuuauuuaauuuuuuuacacuuagucugucaauacauuugcaauuuguuuuggcuuauuaauauaaggcuagacucuagacuuuuuuuuuuuccaaauagccauucaguuggcccagcuccaucuguugaauaacgcuuuuucucacugcuguuuuugguuccucaucaugcauuggauuucugcacauacuaggcucuguuuggagggaggugguucuuuucuguuagucugaagcucuacccuugcuuuauaccagugcugccuugguuuaauuagcguagcugucuucuuuuuaaaaaacuguuuuguuuguucuuguacuugaacuuuauuuauucccauccaaugaccuauuaauugcaucugaacuuuagaguaaucauuuugucagguauccacuccuuacugccccaaccucauaguauuugcaguaaaucguuauuuaauuugauauuaauuaguauucauaaaguauucugccaucacauuugagacugguauguccuucuauuuaagacauauauuccucagcagaguuuuguaauuuuccacauguaagcucuucacauuucuuaggguuaguccuagauacuucuuuuuuuuaauuuaauguuuuauuugcuauuaagaauaugguauucuuaauagcaaauaaaacauuaaaguauauaaagaauauauacuuacuauaugaagaagguauacuuauauauuacuauaguaauguauauauuacuauauaaagaauauauacuuuagaugcauauauacauaugcauauaaagaagcuauuguguuuuauauguuucucuuauauucaaccauauuccuugacugguauugguucuaagaguuuuucaguugauccucuugaaucaacuaggguuaugaugauaucaucugcaaauaaucuauuuuucuuuuuaauaguuuaucucuuauuuuuguuucauaauguagaauauguaagaauuuccauagguagaaaagauauuaaauauauauauuuaacauguguuaaauaccauauuuguuuuaagaccacugagcauaaagacuugcuauugauuuaauaacagauuuggggggcacuauauuaaauguauacuuacacuguaauucauauuccaauaucagaaauguuaggauguaaaaagcagugcaucuuagaauuaaggaaaauaacaaugguaaugguagcccuccuuuuucucguuugagugguagugucuaacuguuccauucuacauaugauauuggcuguugauuuaugauagacagucuuuauuauuaagggguccucacacaucuuccuguuuggaagagguuuuguguugguuuaaucagcuuaggagggaaaggugaucaucagggucacuuucgugcagaaucccaccucugcccacaauuccugccuucuuugaacuuucuuuguuaaaguaagaaucuagacucuggcaucaaagauugauaugcuaagcagaaguuuacugcccagcagagaaccaguugagugcaaaaguuaggcucugagaucuaagccuugaggguggcaaugagggaugagguagguuuuuaaaacucauggucuccaucccauauuaggaaaucaaagucuccaaaugcuacuuauuggccaguguuaucuggacuaggcauugucuaagcaacaagcaggacaggacgcuugcagggguuuuugauaaguuaucucucacuaugucuaugagucaggauaauagugccccagucauuguuuugguagaaguccaguccacuggcuaggcagccauguugggauucaucacuuuguaguuucuaacuuuuuacuguauuccauauuggaaaguucagcccuccucugagauacccauuguccacuagaacuccagacagaagugcuggagagggcagugggccaggucaggaagacauaagccagaguugaaguacaacaguggaaagaacaaagucuuuggagcagugccucuuaaccuucguucuggguacacagaucuaucugggagucugaaagcuaugggcugucucuugagggaaaugcgcauguugcguuuuucaguaaauauuuuugagcacgcugaaagcaaaacacuuguauagcccuagcuucuuggaacuuguaguaagagagacagauauuuaccaaaaaaccacaugaagaaauguaaaauuacaaguguaaauaugcuccaaaagagaggagggggucuugaaaucaugcgaugggaggggguagggguuagagcucaagcucuuccuccagaaguguugacuacccugagaucugaagggcaaaucauaggauaguggaaaggaggagaaauaauccagagagaggggcaaguauguggcaggagggagcauggcaaucuagagggaggaaaagaaggcucagggaggcugggggacagagagauggggcaugguccaacagaagggagaaggauggcagggcuaggccacguaaggcuuuggagccaucguguaaagauguuugccuuuaucuuaagagcauuaggaagccaucaaaguauuuuuuguuaauaauguaaauauuugauaugcauaaaagauuccugcagcauauauguaucacugaaauacaacaaugaaacgaaugcacgugaaccuaacaccuuccccugaaugagaaccuuaucuguauugcugaagccucccuugucgccucuuggaucccaucugccuguguucccccuccccccuuaauugcuagguuagaauuuucuugaauuccaugcaugacaugaucagauuuugguuuucagagaucacacaagcugugucgagaagacuggauagaaaagaggccaaaguacaugcggggaaaccaguuuggagguuguaaucacaaaacacaaucuuacuaaaaguuugucugcauuuuauuuuauugccuuggaaauuuauuucuuucacagaugauuuauuuucaucauuuuaaaaauauaaauuaaugguaucuuccuagaaaaaaauaaaaucagauaaaacuaaaagcucuaauucuguuggacaauaaugagaaggcuguacuguuuggcuuaacuaaaaaauguggugaggcaugguggcucacgccuguaauuccagcacucagggaggccaaggcaggcagauugcuugagcccaggaguucgugacuggccugggcaacauagugcggcccuauuucuacgaaaaaaaauuuuuuuaauuagccaagcauggugguaugugccuguagucccagcugcuuaagaagcugaggcaggaggauugcuugagcccaggaguuugagauugcagugagacaugacuguaccacugcacucuggccugggugacagagaccuugucuuuuaaaaaauaaauaaaggacaucauggcugugcauaaguacaucuaugacagcuagucuguuuuggccuuuucccuuugauguacccaaaugcagaaacuccuaucucgccuagcaaagccucuggcagcccuggacuuggagcucccugguuuguauuguccagcaaagaugcuguaguaguuucccguggcugucugcuguaaaaaaauaaccacaaacuagguggcuuaaaacaauggaaauuuauuaucugacagugcuggaggccagaaaucugaaaucaguaucacugggccauguuggcagggcugugcucccuccagaggcuguaggggagaauccauuccuugccucucccaaccucuggugggugcuggcaucgcuuguguugcggcugcgucgcucuagucuucaaggcuagcaucuucgaaucauucucuacucugucuucacauggccuuuuccucuguguguguagguggaaauuuuuuugaacuugccaacacuaaaagaaacacuuuuaaagaccaguguucacuugaaaauggcucucugucaaauuccaagaaaaccaguucacugaaagucaguucuacaaaagccccuccauccuaccccuuugccuccucaguuuccuccucaaucuucugcucuacagcagcagggagacagcagagcauauuuccucuaaauucuauuaagaagacagaauaaaaacuggucaauuaagacuagggagauuuaagaaaaaaguaaaugcaacauauugguuguuucguaaauugguuauccaaggaauugaccauuuggcaaacugacuuucggcaaauuggcuguuggugaaaucagccuauuucccugagaaacacugcagaaggcagggcaguggcugccuugagccugcccaggacaggacugugacuguccccuccugcuuucuacaagccauggagauaggggcauugcucuugcaugaggcuggggcugagagcagcccccuacaggcuggaucuggauccuagggaagaagaagaugggagaucucccccuuuggguccugacucaauagaacccaaauguaggccaguagcggaaccucugugcuagccagagucaggccagaagucagucaggugcugcauccaagaacaaucuagcaucggagaagcggcuuaagggugucagaauauaauguauaaaaccacaaguuguauagggucaccccgugggguaguuauccgacugaauguacauuuauuaguuauacauacuugcaaaagauugcacacaggccuguuagucauuauuauuaguauuauuuuacauauguaauauuauugcaaauguuauaucuuuauuauauaauacuuaagccuggcacauauagcuaguugauaaauaccacuuuuuuucuuuguuacuagauaacuuacuggaguggauaaaugcacuuaauagcuuuuggagaccucuuuuucuucuggggguaccugaggcauuucuugcuuucuuuuuuuuuuuuuuugagauggaguuucgcucuuguugcucaggguggagugcaguggugcgaucucggcucacugcaaccuccgccucccagguucaagugauucuccugccucagccucccuaguagcuaggauuacaggcaugugccaccacacccggcuaauuuuguauuuuuaguaaagacggaguuucucuauguuagucaggcgggucucgaacucccgaccucaggugauccacccaccucggugucccaaagugcugggauuacaggcaugagccaccgcgccuggccacauuucuugcuuucuuguaacuucaaaagccaguuuuagcugggagcaaugguucacgccuguaaucccagcauuuuuggaggccgaggcaggcggaucaccugagaucaggaguuugcgaccagccuggccaacauggugagaccccaccucuacuaaaaauauaaaaauuagccaggcaugauagcgcgugccuguagucccagcuacuugggaggcugaggcaggagaaucacuuguaccugggagguggagguugcagugagccgagaucaugccacugcacuccagccuggauaacagagugagauucuggcucaaaaaaaaaaaaaaaaaaaaagccauuugugaucauuaacaucaauagaauauaugucagcauaaauacugccacagagcacuacucagccaguugggcaacucacucuucucuaccaaaagcuuuacagguuaucaaagcaaguggguuuacugugggaggcuacugugaauuuuggaaauuaauguugagggacuagcgcaguggcucacaccuguaaucccaacauuuugggaggccgaggcaggcggaucacgaagucaggagauugagaccauccuggcuaacacggugaaacgccgucucuacuaaaaauacaaaaaauuacccaggcaugguggcaugugccuguagucccagcuacucgggaggcugagacaggagaaucacuugaaccugggagguggagguugcagugagcugagaucgcaccacugcacuccaaccugggcaacagagcgagacucuaucucaaaaaaagaaagaaagaaagaaaauuaauguuguuaggaacuguuguaguggaauaaaaacucagugauaaagaauugaggagaaacaacgauaacaaaaaaggagggcaauaaauuugugccuagcaacucugaauugcuuacuauacauuuccuaagaguuauucuaaaaugaugcccugguacuuaaaaauaacugagcaggcugggcgugguggcucacaccuguaaucccagcacuuugggaggccaagaccggcagaugacgaggucaggagaucgagaccauccuggcuaacacagugaaaccccgucucuaauaaaaauacaaaaaaauagccgggugugguggcaggcaccuguagucccagccacucgggaggcugaggcaggagaauggcgugaacccaggaggcggagcuugcagugagccaagauugcaccacugcacuccagccugggugacagagccagacuccaucucaaaaaaaaaaaaaaaaaaaaaaaaaaacugaguaauuuauuacuuucuuugauaauauguugcaaauuguuuagaauacauucacaggcaguacauuucugucccaguaucacuguaugagcaaauacugaaggaguuugcagacaucugcuuuacaguagacaggagauagauguuccaauuggauauagcccauguguguaguaaagucugguuauaggaaauuacagauuaaaaaagacuguuguuguaaacauguaucccugcacgcaguaagguuaaacagaagauccacaacaaaccaaauuaacaauuacuaagucagacuaacaguuacuuauaguuaaaaagcaagaauagcagggauuggaaaacaaaaccaacucaggagcccugauaauagcauguccuuuccuauagguggggaagucucacccccugaaugcaccuauagagcuagagcuuggcacugcuauguggaagccagacuucugagaauacugaguuucugaguacuucauuuuuagacaguaacucuuaaucauuuaggugguuuuuaauaaguagaccuaggugguauagauacaucuggggucauuucacaggccccuggggaggugagccauucuuuauaggaagagcuccucccuugagaggacugaccacccauguguuggcagugccguuacgcacggggaaguuacgcacagggaaaaugcucgaaggguaggcacggaugaaugaugaauuaacaaugggugauuuuuauuguguuugcuugucuguauuuucugaaauaaaccuauuauuuuugguuaauuuuuuuaaagacuuucauccaacucgucaaguuccuacaauagaacaguuaaaaaaaaaaagacaucaucaccucacaaccaugggggaguuaaaacaauuacugagggggaggagaugaaacguuuaugaauaagacugucugcaguuacuugagcugcuaagauuaaaugacaauaggaguuguuguucuuucaaggcauaaacugaccuucuguugaggaaaguucacugcuuugccacuguguccuauguuagauuaaaagggguggggggagcagcggugcagcuucccucgcacaguaguugugauuaaagcuuuucuggaucauuucugaagaaggguaaaggcuuucagauugucuugccugaagacaagaaagcagagguaagauauaacuccuguuacuuaaacggaggaaaaaaaacauggggaaguggacuggaauugcaacagcaagaguuuguugugguucuuguuuguuuuuaccuuuuaaauuugugaaauacagcauauauauacagaaacaugaauaaaacguaaauguauaaugaaauuauuggaaagcaaacauauguagccacuacccaagucaagagcuagaacaucaccgguacccaaaagauuucuucccagucaaaacucccaccuuucucccuagaagugauuaaccacaauuuugucuuuuuuuuuuuuuuuuucuuuuuuuuuuuuuuugagacggugucuugcucugucuccaggcuggagugcaauggcacaaucuuggcucacugcaaccuccgacucccugcuucaagcguuucuaccacgucagccuccccaguagcugggacuacaggcacacgccaccaugcccagcuaauuuuuuguacuuuuaguagagaugggguuucacuauguuggccaggauggucucgauccccugaccucgugauccgcccaccucggccucccaaagugcugggauuacaggcaugagccacugcgcccggccucauuuugucuuuuaugcagagcauacuauaguuugguuuugccuggcuugggacuuucuguaagugggaucauauaguauacauauggcuuuucccacucaguaucauauuuagauaauuagcuaccuuguugcaugcguagaucuuucauuuuuguugcuguauuguauuccaucaugggcauaugccaccauuuauccauuuuacuuuugauggacauuuggguuguuuccaguuugggggcuauuaauuacaaauaaugcaaccaugaacuucuugggguuuaccauuaccuuucuagauaaugguaaacugguuuccuguagugacuaagagcugcucugcauccuugcugccaccuggucuaaucagauggcuaaugcugucugucuggugaauggacaguagcucacuguagcuauacugugcauuucucugaugugaugggguugagaaccuuuucauauguuugauauuuuuuaucuccugugaaguugucuuucgauuguuuuugcccauuguuauaccuacugaggggucuguuauucuuucaacuaaccagcccucugaaggcgaauauaaggauacaaaacaugcuuccugcccccgaggagaugacuugacaauucuagaggcagauauaugaacaagaaguacaugauaauugugauuacugaggcauccaucuucccuagcagacuagcuaaaggauggcgcucuuauuugugucauauccugggugcuuaacacaguaucugccacauaauuaggugcuuaguaaaguuuuguuaaaugaucgaauggggcguuuuuagcgcagugugcaagugcccuauuagggguaggcgcccaguaacucgagaagcauggaguaggaaaccacaaacagcaccugcucccccuccucucccccuaccugcuguggggaaggccucccuuguaaauuugaaagguugauucacgggaagccguggaggaggugcaugcuaggccaacgaauagaaugugcaaaggcccagaaggaagacagagcccagccugcaagggaauguuaauuuggagugacuaacaccaugaaagggcaucagcuggagauacugcuauaaagggacugccuuguaauuucauaagcauggggguaaaauuaagauuaaacacagggaaagaacauucucacaggugaggaugguguugaacccuagaauaaucguuucccagauaccuugaacaaaaauccagcaguuagagaagccugaccaugaagcaaauuugacuuuugucccucuagauaacaaaaguuaucuuuuugaaaguaaugguguaauuugaaugaguguagagaagcgcugaagacugagcuuuacuaaagccuucagaccuggauuuggcagcagcguggccuuagucaagccucgguuucuacaccugcaaagugggaauaaugccuaccuuggagggcuguugugaagauuaagggagauaauacauguaaaguacuuaaccauuugccuggugggguaguuuuuaugaccuagauccuaaauuguucacugcugcuguugcuacucuugguacuuuuuacuggcuggcaucugcuugcuuaaguuuauaacauaguaggagcauuaacaaggucccacgguggggaccuuggucguuugacgagaucugcgcucccgcccauccccuccccccccccuccacauuggagacgcggccaccaccgcgcuggcgcggagagagggaggaccgggcgucaugcuguuucuggccugagguuuugugugccuuuguuuuccuuuugcucuauucguguauuccugccuacggccugugcggggaauuaggagcucaguacugaaacggcgguuuuccuaaacaguaccggacgggcgcgggggcugacgccuguaaucccaacacuuugggaggccgaggugggcggaucucuugaagccgggaguucgagaccacccuggcuaacguggugaaacccuguucuuacuaaaaauacaaaaaaaaaaaaaaaaaaaaagccaggagugauggcgcucgccuguaaucccagcuacuccguaggcugaggcaggagaaucgcuugaacccggggggcagagguugcagugagccgagauugcgccauugcacuccagccugggcaaaaagagcgagacuccgccucaaaaaaaaaaaaaaaaguaccuuccguaguucucaugcagcggagggguucgacuuguaaccggccugaaaccaagcguggcgcaagauuugcucaagccccuccucuuggccaaacuuuccggaggggaaggcuuuccgaggaaacgaaagcgaaauugaaccggagccaucuugggcccggcgcgcagacccgcggaguuucccgugccgacgccccggggccacuuccagugcggaguagcggaggcgugggggccucgaggggcuggcgcggcccagcggucgggccagggucgugccgccggcgggucgggccgggcaaugccucgcgggcgcaaugaauccgcggcagguaagccgggccggccuuggaccuucgccgccgucuggguucguuuacaaccucacaggcuuuguguugcagugcguagcgugugcgucuugugaguguuagagugugugugugugugucgucuugccaagcagcauugcugguuuaggaauuugugcgucuugugagugugugugugugggugugugucgucuugccaagcagcauugcugguuuaggaauuugugcgucuugugagagugugugugugugugugugcguguguguguagucuugccaagcagcauugcugguuuaggaauuugugaauuuguauccugcucauuaauucugcagaauggagcagugcgugaagagggcuugggggaaaaugcgcccccgucugaguaggaaggccugagcccaugucaaggcagacacaucgucucccuuucugcuagggccccuuguggaacccccuacccccgcuuuagccccacuugaacaacguucggacuuugagcagcgcacacuauccucagcucaccuuauccaccuccugaaggccuucugggaguuaaaaauggcacuuaagcuguaggagaaagcuuguuaaccacuuuauagcuaaaaacugggaaaacacaaauggccuucagcagguuaacagauaaacugaaauacauccacauaaugggauacugcuuaguagugaagaggaaauacuguuacaaguaacaacacgggugacucgcaagugcguuaugcuaagcacgagaagccagacucaaaaggcugcauacuguaugaguccauuuauaugacauucuggaaaaaaaaaaccacaguuauagggauggaaaguggauccgugggugccagggacuggguaucguggaagaaauugauuguugaguggcaugaaaaagcuuuuuagggaaauagaaauguucuauaucuugauugugguggcgauugucgaaauucauagauuuauacacuuaaaaggauaaauuuuacuguaucuaaauuauauaccucaauuuuguuaagauauauauauauuuuuuuuuuuuuaagcacuccuuugaaaggauuaaggacgccuaacuugaaggaaaagcauuucugcacaggugucaguguauugcacuguggaaccugugugguaaaggcaaaggggguagugcuuaucucuugauccuaaauaugugagaccagauuaaagugaaaucugggaggcaaugaauguuaaaugaguuguuauguaauuugcauagaggugaugcugagagauuuagaaaggaucacuguggguugcuugcucacuuucuugcucuccuauuccguagcuuuccaaauggcuguacucaacgguggcuugguguuuaggggauuuaaggggggcaaaaagaaagauuaauaaucuccuccucucccucuaacccuacugcccuaagauauccuuagcaaacuuacaucuccuuucuuuucucuguguucauuccauugugcgcacacauacacauucauggauuuucucuuuuuguuuagggaaaaaaauuauaauguacauacuauucuacaacuuuuuguuguuuuauugaacauuauaugauuccuaaauuauccccaggugaauacaaauagauaugacacauuuuaaaaaaauaaaauaacuggccgggcgugguagcucaugccuguaaucccagcacuuugggaggccgaggagggcggaucaggagaucgacaccauccuggccagcauggugaaaccccaucucuacuaaaaauacaaaaauuagcugggugugguggcgugcgccuguaaucccagcuacuccggaggcugaggcaggagaaucacuugaacccgggaggcggagauugcagugagcugagaucacacugcacuccagccugauugcagugagccgagaucaugccacugcacuccagcuuggcaacagagcgagacuccgucucacaagaaaaaaaauaaccgugugaguacuauuccauagaaugaauguuucauaauuuaauucuucuauagacagacauuaaaauauuuuccagauuugggccaagaguagcaguuuaaaaaacauuuagcuuuuaacugacucuagccacuuugaaacacaauuuuuuuuucccaaggucacucaaagagcuaauaggagaaccccuaagucccauaauucagcucugggagccagcacucacucuguacacacauuugccucugucccuagcaauauggugggcgugagggugcagcaagaggaacaagaaagaaaugauugcuugcauaguggcgucuuguucaugcagucauuaauucaacaaauguuuguugagaaucagcuuugugccaagugcuagagagguugagaugauugaagcauaguccuugacccccaagagcucaccauggaaucaacugaagccccucaucaguacuguguugggaauauugagaguggagaguugaguauaacuuauaggacaccuaauguuaauuaccuuucagacacugcaaugugugugugccauaaaaaaaaaaaaaauccaguagcucugauacgagggaaaguaaaugguuuaacaggugcugaguaggagaagcucaaggagaggaaaccccaagggcugaagaaggugggagucaggagucuccugaagcaaguggcauuuaaggagcucuauaaggaaagggucagaguugugauagguggcuguggagggagaugugccaccuggauuggcauguagagggauagaaagauuauaggccuuugcaauggcccaguaagagguaaugaggggcuggaacuggaagaaaacacauuuaagacacaguacagagguggcagacaaggugggacuuggcaacuaccugaugagauccaggagaugaggccaggaggcgggcagcaaagaugacgcagguuucuagccuuaauaggcuaggaggagagugaugccauuagcaauaagaacuacaggagaaggagcugaguuugagggaacuauuaauuugguucagaauaugugcuguuugaguuauggcaggauauuuaaguggacagacugucgacauaguuggaaauucagaucuuaagcucccacacaagguaguggcuggacauaguagauuugagugcucuugcuucagagggcuaguuuagguuggggcagugauuaaagcaaccuaggaaauaaauuauaaaggaagaagagguccuuaaaaccuuggagacugauuauauaaaggguggauccguuaauacaguagcuauuaaaaaauuauaaggggugggaaaaagggacaaagaagaaaaaagaggugaaagaccuuugcugugucaccaaacccugggaggagaauuuuuuaaaagaagaguacucaauccacagugaacuaaggcauguuuguuaaacacaauugaccaccacacagcgaagacccaaaugagguucaagagaaggaauuuuuauggacccuguuagcacaagucaagguccuucuccaguaccacugggaagcuuuggagaagaaaagggggacagugggccuuggguggagaagggaacugaccaugagauccagguggggugaggaggugugugaagucagaguggggaagaaucaggguggcuuacuggcagcuucaccggggucaugcgaggagcagguuccaccagaguaaggagugaaguuguagaaacacagggaagucaccaucagaaaagagcaggagucaagaaacuauggcccacagguacaaacuaccuguuuuuauaaauaaagcuucaugguaaaugaauuguaaauaaaguuuugcauauugugugaggcuguuuuugugcuacaguggcagagcugucuggcccuuuauagaaaaaguuuaucagccacuggaaaagaguugcaggauuugaggucuuggugugauggccuagguuagagucauagugagauugaaggaguagcuagacaagccaauuguguggcagaaagguagggauggagaucacuggguuaaggauccuuguagccaggacaccaugagagugauugacaagaaugcugaaauccccuaagugugucaggauguggaagaguagaaggcuagaguuauggaagaaagggucccaccucuaccugugcagccuccaggagagucugaggagggggcggugagugugaguaaauguugucagaaucccuccucccagucuacaagccccagggaaaggaagcaagguguuuacugacacccccaggcuuauaaguacuuccuggcuccaucacccuccagugaacagcccuggggagaagacaguacugguuugcagguggguggguggggaaaggggucacaggugcuugguguucugguaaaugugcauaugagaacaugggguugcuugugcccuguccgucaggguucagaagaacgugcaguggaagcagcuauggggaaguagcuagggaagguaggacuggucugagguggugaggagcagaugcugccagcuccacacauccaggagagccugggugguuugggcaaaagucucuggcaucccuucugagccuggguaccacacugaagagugaggacagugugccauuuuuaucaggaaacccuccagcucccugaagaccaaauucugauccuccugggauggcagugaagagccacagagaugacucugaggucccguggccuuuucccaccuggagauuguuuucguuacugcgcuguuacagccuuggaggacugggguucaguuucauccaaucacauuucuucuuuugucauagucaucuaaacgauagaucuuagagacaggugggcaaggggugcacuggugagccugacuuaaggagaggucaucucgucccuucccuagucccaucucccuugguuauuguuauuucaugugauuguucugguuauuucagguuauucuguuuuuguuuucaaaacaauaacauauauuuguuguucugauuuuaaagggguaauuguuuugguaacuagaaaauuaccuucucaacucccuuaaauucugucaaagggaaaaguaaguuagguugcuggagaggcuaugcugaggccucagaaccucuguauuccuggaaguucugcgugcuuugccuccugcuccccucucuguguuccuguuggcaggccccuaggcaggauuuaggagguaggcaagucacccuagccaagucauaagcccauggcucaauugccuucucagcccuucaagggcuguuccacaggcagcaaagggaggggccuccacagguucaccacugcagcccuaauucauuuucuuuuuccacugucuuauucugcagggguauucccucagcggauacuacacccauccauuucaaggcuaugagcacagacagcucagguaccagcagccugggccaggaucuucccccaguaguuuccugcuuaagcaaauagaauuucucaaggggcagcucccagaagcaccggugauuggaaagcagacaccgucacugccaccuucccucccaggacuccggccaagguuuccaguacuacuugccuccaguaccagaggcaggcaaguggacaucagggguguccccaggggcgugcaucucagaagucaggggcuccagagaggguuccagcauccuucaccacguggcaggagucugccacagagagguguugauugccuuuccucacauuuccaggaacugaguaucuaccaagaucaggaacaaaggaucuuaaaguuccuggaagagcuuggggaagggaaggccaccacagcacaugaucugucugggaaacuugggacuccgaagaaagaaaucaaucgaguuuuauacucccuggcaaagaagggcaagcuacagaaagaggcaggaacacccccuuuguggaaaaucgcggucuccacucaggcuuggaaccagcacagcggagugguaagaccagacggucauagccaaggagccccaaacucagacccgaguuuggaaccggaagacagaaacuccacaucugucucagaagaucuucuugagccuuuuauugcagucucagcucaggcuuggaaccagcacagcggagugguaagaccagacagucauagccaaggauccccaaacucagacccagguuuggaaccugaagacagcaacuccacaucugccuuggaagauccucuugaguuuuuagacauggccgagaucaaggagaaaaucugcgacuaucucuucaaugugucugacuccucugcccugaauuuggcuaaaaauauuggccuuaccaaggcccgagauauaaaugcugugcuaauugacauggaaaggcagggggaugucuauagacaagggacaaccccucccauauggcauuugacagacaagaagcgagagaggaugcaaaucaagagaaauacgaacaguguuccugaaaccgcuccagcugcaaucccugagaccaaaagaaacgcagaguuccucaccuguaauauacccacaucaaaugccucaaauaacaugguaaccacagaaaaaguggagaaugggcaggaaccugucauaaaguuagaaaacaggcaagaggccagaccagaaccagcaagacugaaaccaccuguucauuacaauggccccucaaaagcaggguauguugacuuugaaaauggccagugggccacagaugacaucccagaugacuugaauaguauccgcgcagcaccaggugaguuucgagccaucauggagaugcccuccuucuacagucauggcuugccacgguguucacccuacaagaaacugacagagugccagcugaagaaccccaucagcgggcuguuagaauaugcccaguucgcuagucaaaccugugaguucaacaugauagagcagaguggaccaccccaugaaccucgguaagagaccacccaggaacuguaccuaggguuggggucaggugcuuuugcuccugacgcagucuuggcugauuugugagcagugcuguuugguggcgccuaucuuuuccuccuucccuucugccuuuuagcuaaauuccccuugauuggcccuuucuccagauauugagcagggaauauagaccuuggaccagccagaaucuuggcugaacaagggggagguugacucuguuggcuguaaugaagcuucuuuagaaaugauugguuuuggccguacgcgguggcucaugccuguaaucccagcacuuuuugaggccgaggcaggcauaucacgaggucaggaguuugagaccagccuggccaacauggugaaacccugucucuacuaaaaauacaaaaauuagcugggcgugguggcgugcaccuguagucccagcuacucaggaagcugagacaggagaaucacuugaacccaggaggcagagguugcagugaacugagauugcgccacugcacuccagccugggccacagagcaagacuccaucucaaaaaaaaaaaagaaagaaaugauuggucuugggggccggggcgguggcuuacgacuguaaucccagcacuuugggaggccaaggcaggcagaucaugaggugaggaauucgagaccagccuggccaacauggugaaaccccaucucuacuaaaaauacaaaaauuagcugggggugguggugcuugccuguaaucccagcuacucgggaggcugaggcaggagaaucacuugaacccaggagguggagguuguagugagccgagauuggcgccacugcacuccagccugggcgacagagugagacuccaucuuggaaaaagaaagaaaaaagaaaaacaugauugaucuccaugcaucaauaucaugccugccuccuaaggcagagguaaugaagacuuaauucccuucuguaggccuuccccuccucccuaagccguuuucugagagaggugcaggagcagguggguuggggcaggcugcauacacaguggggguggguugugcugcuaagcagcagcagguccacaauccccccucugcauagcuccuggggggaaaggauggaggagcgugugcacggcugccugccuguugaagguggugguucuaauuuuauaaaccuccucugcacagauggguaggcuagcacuugcugccacuccugagcugugaagucagccuuuaccucacucagauagcuggucaggcccugcacuguagguccuaauaggccaguggacagauugaggaaaacaggagcuucugaagggcauaacagagagcaaaaccacugaagcugaguggcugcagcugcagccagggaaagagccaguaggaugggggagaauuccacugaccuuuauguuuaccuagccugguuucuagggguguagauuccuggcuagggcccuuauuccuugucuugacugucuucaugacaccaauuuggcauuucaggagagcgguuaagaaaaggaguugugucuguccaaaagcuggcaaggccagagcuggauuguuugggguagagacuggauggccgucauucucuuuugccuccaucccuccuccccagaguuggaggaaagcaguggauuuugugguuagucauucuuuggacucacacuaaaagaaacauuggugccauguucaaauauaucagaagaccuaggaaauaagaaauuugaccuacuuuucuaaaugaaaucccagacugagcaaagagcucaccacauuugaaagcuugaacaaagggggccuaggcuaaguccagaggccuagaacaaaugcuuuuuuauuuucuacauaacaaggggaaauuccuuguuauguagaaaauagcuggagacaaauggugcuauagagugacucauaacaaacuacggugauauaggucuagggacaaaagcaggccacugauaaguggcagaugccugaucccccuagguaguggggagugugagacuggguuauaagaagccuucacuaucuuuuaggacccucccuugaggaggccagucuaccacaauugcuuuagaaugaaggucuuuugguugcucacaagacuauaaugguaauuuuuggcucaucauuuuuguguguguggguuuuaucuuaauucauuguuaaagagauaguggguuuccccugagcuaguuuccuaucaucugugccuauguuugcuucacugagcuauggggaaagagucacuggcugcuuuguuuacaaaaagaaaggacaggcugagccuuaaggaguaggaaggaguuccuuggccuacccuucaucuccacaagugaaaagccccuuagcguagcagaaaauuccagguugaaggucucuuuggagaaggcagaaggagugaccuagacuccuguucacacaucuaaucacuuuccgucaagauuuaaauuccagguugucaucaauggccgagaguuucccccagcugaagcuggaagcaagaaaguggccaagcaggaugcagcuaugaaagccaugacaauucugcuagaggaagccaaagccaaggacaguggaaaaucagaagaaucaucccacuauuccacagagaaagaaucagagaagguagguguccuccugccaucugggaggaucaguucccugucagugucuggauuguaacugacucccuugaggcaaucccagccuaaacaacugacaccaucucggagucagcuucccacucuucccucuacccuaucucgccagcccaccuuuccuccucucauacccagcuccucugucugcuccugucccaacauaauuggauuuacagaauuucggacuugaaagagaccugaaaguuuauugaggccaaucuccucucuuggaagaugcggaaugagagcuccagcagccccuuuaacuuugggaagccaaccccuugacagguggugggaauaaagucccccauccccaucccuucuucugugauggacuaaccaguguuuucuuaguuuuguuuucuucuugucucucauuuucucuagacugcagagucccagacccccaccccuucagccacauccuucuuuucugggaagagccccgucaccacacugcuugaguguaugcacaaauuggggaacuccugcgaauuccgucuccuguccaaagaaggcccugcccaugaacccaaguauguccuacguguccucuguccagcugagguuuucucagaaagaaaaagagacacauuuucuuccuugccuccucagggauggcagauugaccaauuucuccuguuucaaaauggggaaaggagggcucugagguccugguugcugcuugugaggcagacaauuagggauuaggaauucaaagggaauuccuggcccacccucuaucuccucuauaagcacuagggagguucacggcuuggaggucacucacuguuggugggacagaaagguacaggaccugagaagcucucugccugugggucuauagacucacauguucaagagaaguguuccuggaagaggugaaacuagguugaugcuuaaauguugaaaggggucagccaggcuaagagacacuggcuguucaaggcagaagugacugcaugagaugugacugcacagaggugauguguucaaggaaauuaccaguaguggaggauggcagccuggcagaggcuaggucaggcuccucagucaaaaccauuuuaauccuucuacgugcuucaucuccugucagguuccaauacuguguugcagugggagcccaaacuuuccccagugugagugcucccagcaagaaaguggcaaagcagauggccgcagaggaagccaugaaggcccugcauggggaggcgaccaacuccauggcuucugauaaccagguagggcguuuuccuacucaaaagauacaggucauuuuuagcaacugagugguuuaagauugccagugacucccucaacauuuccugaaguguuuauggcuccucuguuugauggauucuccuuuagccugaagguaugaucucagagucacuugauaacuuggaauccaugaugcccaacaaggucaggaagauuggcgagcucgugagauaccugaacaccaacccuguggguggccuuuuggaguacgcccgcucccauggcuuugcugcugaauucaaguuggucgaccaguccggaccuccucacgagcccaagugaguguccuaguccuggcuaaugcaugugucaccaguuggggauggucuguaacccagggaaaacaagggugugcuuuagcuguguaggacagaaggggcgaguugagggaaacaaguccagcccugucuccacggccucuuagaagacaauagaccugccaagagugaaugcguucacucuuccaguaagcaugauccuuuuuaauuuuuugacuaguuuuaauuuuuaaagaaauguauagguacauuaaaaaaucauucaggccagacaugguggcucacgccuguaaucccagcacuuugggaaguugaggcagguagauuaccugaggucgggaguucaagaccagccggaccauaugaggaaacccugucucuacuaaaaauacaaaaauuagcugggcguggcagcgggugccuguaaucccagcuacucgggaggcagacaggagaauugauugaagcugggaggcggagguugcagugagcugagaucgcaccacugcacuccagccugagcaacagagcaagacuccaucuugaaaaaaaucauucaagcugauugaaaaaguagucauuucaaugaaaagucucauuuccgucucagacuucuaguuucccucccuagacccauauauuacuauagcccugcauuagcaacugggaugcggucugagaagcaugguuuuguuguugugagaacaucaguguguauuuacauaaaccuagauggcaugggcuccuacacacguacaggcuguaugguauggccgguugcuccuaggcuacaaaccuguacagcauguaacuguagugaauacugugggcagcugcaacacacugguaaguauuggugucuaucuaaacagcaaaaagauacaguaaaaagacagcauaaaggauuaaaaaaauacuacaccuguauagggcgccugccaugaauggagcuugcaggacuagaaguugcugugggugagucagccagugaguggagaaugaauaugagggccuaggacaugacuguacacuaauguaggcuuuguaaacacuguucacuuaggcuaacuacauuuauuuaaaauauuuuucuuuaauaaauuaaccuuagcuuacuguaacuuuuuuacuuuauuuuuacuuuauuuuuuacuuuauuaacuuuuuuauuuuuuguuccuuuuguaauaauacuuagcuuaaaacacaaacauguuguacugcuauccaaaaauauuuccuuuguuuauauccuuaauucuauagucuuuuuucuguuuguaaauuuuuuuauuuuuuuaacuuuuuaaacuuuuuuguugaaagcuaagaugaaaauacauuagcuguuagccuaggccuacacagggucaggauccucaguaucacugucuuccaccuccacgucuugucccacuguaagguguucaggggcaauaacaugcaugggggccgucaucuccuaugguaacagugcuuucuggaauaccugccugaggcuuuuuuuaguuacuuauuuuucuagaaguagaaggaguauacgcugaaauaaugauaaaaauauaguaaacacauaaggagcguguagccuagaucccucgcauucacaguucacagucgaguucacacuccuacaagaaucucaugcugcugcugaucccacaggaggcggagcucggaccagaaugcuuucuugcucgccacucaccucuuccugugugcccagguuccuaacagguuacagagcccugcacuuggugauaagaauuuuucagcuccaucauaaucuuacggggccccugucauaugugugauuuaucauugaacaaaacacuguuaugcaguacaugacuauaccaguuucuugaguccuucuagaaauugcugugcauaacuagcacauuuucccuuuugucuuuuuaaacaaguauaucuucuguuuuauacguugacuccuuuacuuaccagacuucuugcauagcugcauaguauuucauugaauagaagcugacaaauucaguuucucagaaguaaacauuuaauagggacuuaggaacagaaaugaugucuuggguggcugcaagaugguggaucccugcacuuacccuccagaaaguaugcuuucuauagaggcuuuuuugguuaaacaugcagcuggucacacauuauacuuucuugugaaacuuaugagcacuagcugguggggaggcuugguagacaucuuuguguggaauuauuuaugcuacccaacacuuugggaugcgggagucagauauugguggucauagugguuuugcaucaagauggcaucacucuugccaugcaaccggcauguuuucuuaaucucuaaggucuaucacaaaguggaaaagcaagguguaaagugaggggagaggugaagauugucuguauaugucuagaauauuuucuugaaggaucgaaaaaacuggcaacuguguuugcuucuggggaaggagggacacuuuuauuguacacucuuaacuguuugaauuuucacauguuuggcauccaacuuguccauuuuaaagucauuaaggaaaaaagcuuauaaaaaugcuaucuuguuacuuuaaauuugucucuccuuaauagaaguaaugucagccgggcgcaguggcuuacgccuauaaucccagcacuuugggaggccgagguggguggaucauuugagcucaguaauuugagaccagccuggccaacaugguaaaaccccaucucuacuaaaaauacaaaaaauagcugagcauggugguaugccccuguaugccagcuacuccggaggcugagcaggagaauuacuugaacccaggaggcggaaguugcagugaccugagauugugccacugcacuccagccugggugauggagugagacuccgucucaaaaaaaaaaacaaaaaaaucagaaguaauggcauuucauuuauucauauuuauguguuauuugcauuuccuuuucugugaaccaccuguucuuguccuuuuccaguuuucuuucagauuguuacucucauggauauguaagaacuuuuaacauaauuuuuaaaaguagcccuuugcccaacaugacccaauuuagaacacacaucugcccacuguuuaagccaucuggaaaaggagaggcccagucucccuccagcugcucuucuacuaauucauauccuucaucucaauaagcaccuccuuaucuuuaagcacaguccuucagaugauagguucagugcauuuccucuuucucuucugugaaaucuucugugaaauccuuucuaggacuucaagucagccauucauugagaauguaagaacuuacuaugaacuagauggaagauacaaaaaauugcugccccugaguguguagcagacauauagccauagcaguauugaaaugugccauuggaggugaaugcagagugcuguggggacacagaggacacugcugccacugucugccagggagcugaggaagguugcauagagaggggaaaugcuaauugaguaacuacguuuauuaacuaucucguacaauaauauacuuuaguugcuucuuaaugugaauuaugcugggucuuuuuuuccuuucugucuacuguggcuggugacguuaacuaauuuuaugacuucuuuucuguuuuuuuuuuuuuuuuuuuuuggagauggagucucacucugucacccaggcuggagugcaguggcgcagucucagcucacugcaaccuccgccuccuggguucaaacaauucucuugccucagcuccucgaguagcugggauuacaggcaucugccaccacaucugacuauuuuuguauuuuuaguagagacagaguuucaccauguuggccaggcuggucuucaacuccugaccucagaugauccacccgccucagccucccaaagugcugggauuacaggcaugaaccaccgcgacagccaugaccuuuaauaucuaaaugcuggagaccacucagagcucccgauuccuccaucuaguugcuuacuugucaccucuguuuggauuaacaucccuaauaugacauguccaaagcagaacucuuggguuuugcccccuucgcuucauuucccccaagucuuucccagcuuaguaagugauaccacugucuacccaguggcucaagucagaaaccugaggaucaucuuuuccucuaucuccuuuaccuccuucgucaacucauccuuaaguccuauugguuauacuuagaauuucuaucccaaaucccuuccucuucuuuccaccuccagcgucagcacucuaauccaagccacugucucaucuagacugucacaauagccuccuaacugaucuuuauacuuuauuuacucaacacuuauuuauggaguaucuucuauuuuuuuuagaacaggaaccaaacauuaaccaauagucaccuaaagaaauguaagaucucauauuugauaaguauuccaaagggcuggaguugcagcgagaaucaauuauagcacaguuugacuuaggaaggagagggggaagggcuuccccaagaaguacugccugagcugagacuuuaaggaugaugaagagagaaagacugaggguucuaggcgaaggacacuguuaaauccuguggugggagaagcgcagagcuggcaaagaggcugagaggaggcacuuauggcaauagccccauuuggcuaguggcuaccauauuggauagcacagcucuaaaggauucuaguugcauaauuaacaaacuuuaucauauauguaaauauaucaguauaaaacuuugcacguaagaguucauauucuuuucaaacacauggggcagucaugaaauucuccuggaucccugagguaaagauacuacacaaucugucccuccugaccgccuucaccaucuucuuuucaugccacugucccucucauucugaacuuaagcccacuggccugcacgggccugccagcauggacaaagaaaagagugaaggcauuuaguugcuucggaucaucaaggaacagugagaaacuccaugugguugaacauaaacguugauuccuuuuacugccugagcugcuaagucuugaaacugaagccucuguuauaugcaguuagaguauccaaagcuggguucucagccaguagauuaggaucugguugaaagcuaggauucuugaugccuugucugguacauuuccaagcuguuuugcuccaccaugcucuucccucuguguuuggaaauuaccagccggagcgguagaagccaccucccugcuccacuugggcacuuuauugucagcgcagcucaugcgcccaagauccauuccuuaccccagaguuagcuuaagccugccaggagucaaaaaaacaacucccagcaaaaccugggucccuggccuaaggccgaccuugaccuaaugaccucuccaggucaaguccccuugagcuaauaggaaguaaaugagggaauggaguugggcgcuuuaaaaaucagacaguguaugaaguaacagugacuuguggggagaaagguagucccuucugauuucugcuuaagaagagaguccaaguuggugcuagcauuucguuaagccuuccucauacuucauaaucuuccuuuauaguaaggacaggcucagagccuuugcagguaacaguaucuagucagaauuuuauaacaugauuuuaucauauucuguuuuacagccaccuucaauauguggcaagugauacugguuuuccauuuacaguagugaaacaaaguuuccuauuucaguguguuuacauuuuuaucucuuuuuucauaccuaguauuacggauauuuacauuuuuagagucuguuuguuuauuuuagagauggggaucuugcugucucgcgcaggcuggagugcagugauauggucauagcucacugcagccuugaccuccagggcucaagugauccucucaccccagccucccaaguagcugagacuauaggcacagaccaccgugcccagcuaaauuuuuuuuuuuuuuuuuaagagacaggggucucgcuauguugccugggggauuacuauguugcccaggcuggucuugaacuccuggccucaagugaucucccaccuuagcuccucaaguugcugggauuacaggugugagccacaauggcuggcucuaagaagucaauuuagagaaaaauauuaauuaauaguccaaguaauaccuggauguggcacaaaucauguggugauucaugaaugaccaaaaucuaggaaaugcugccuuagaaacagcuucuguuugacggguccauauguuugcaagacuggccacaucuucagcaaaacuaacccuuccuuggaacaaugucagggucuggcacuugucuucauucucuguuucucaucccaaagguucguuuaccaagcaaaaguugggggucgcugguucccagccgucugcgcacacagcaagaagcaaggcaagcaggaagcagcagaugcggcucuccgugucuugauuggggagaacgagaaggcagaacgcauggguuucacagagguaaccccagugacaggggccagucucagaagaacuaugcuccuccucucaagguccccagaagcacagccaaagacaguuaagacgucuacuuuuggugccuuuuuuggggcggggggguccuccuaacuccuaaguggagguggcucuugcugucaugcgaguuauuccuaggcuuuacucuuagccucgagagagcaguaacugggacacuagauguaagaaggaaaagaugacucacacgacaaguagagcuugaucucccugcccacggugaauaugguggacacagccucagcuuuguggugcugacacagccucuuuuccccacagcucccucucacuggcagcaccuuccaugaccagauagccaugcugagccaccggugcuucaacacucugacuaacagcuuccagcccuccuugcucggccgcaagauucuggccgccaucauuaugaaaaaagacucugaggacaugggugucgucgucagcuugggaacaggugagugaggcucugagacaugccgccucccauggcgccugaaagcgggugccucucauccuccccuggaguccaugcauguaaguccaaggcagggagaagagacuucauuuuagcuacagucaauucagagugaggaaugaguucuuaguuccuagaggagagaauaugggagucuaggaucugagaaacugaggcuguuucugccuugaagcuuucagaacaaauagccuucauccuguuuuccaucgguuuccuuccauuauucuauuucuguuuuaaacaccuuccuagggaaucgcugugugaaaggagauucucucagccuaaaaggagaaacugucaaugacugccaugcagaaauaaucucccggagaggcuucaucaggugagcgaggucagagcuguggcccggcugcccggcuguggagagcuccaguucccugccccacauggcucugacacggccucugaaucccccucagacagacgggucaugauguggcaguggcagccuuugcuuuucacccguccauuugaaccugucugauggaauccauccccucugugagcugagcugccucccacugcucggccuguuuuuaaaugcuguccuuuuuucugcuaacucugcugcuucauguucuuuucuaaaaacacaaaaugaccuuuuaguccucagggccuugaggaugaggcagcuuuccauuuccguuugaggaccuacacaaccuugaugccccugccagcuuucuccucuagcucaccuuuucuuuaauuuaugaagggagagacuuagaaaggagcaacagcuuccuguaguccuugaaucaguuugcucugcucuagaaucccuguagccgccauagcgaggagcccucagcagaaaugaaggagacccaaaaggcuaacuaugcuuuaugaaaugcugaggucuccccuggagaauuuccaccugauaaacugugaaacgucugcaacauugagacuuuuccuuacuuucucauuuggaggucagauuauagaaacaacugcuuuucccagaauugaaccugccuuccuaaccagacuuucuuuuuguagguuucucuacagugaguuaaugaaauacaacucccagacugcgaaggauaguauauuugaaccugcuaagggaggagaaaagcuccaaauaaaaaagacugugucauuccaucuguauaucaggucuguacaguuccuguugcugccagggugggcccugccaggcuguuagaauuggguauccaaaugcucuccuggccuguaaaucgaaccugauacaauaagccacacuccacuguggguuugagguccauauucagguguagaugacucacauguacugcuguccaccuccagucucccaugguaggccuuagaaaacaucccuugcuucugucacaucugacuguuuuggagccccacgaaauugcagauuucccacaggugaguuuuaacagccaccccuguuuuucagcacugcuccguguggagauggcgcccucuuugacaaguccugcagcgaccgugcuauggaaagcacagaaucccgccacuacccugucuucgagaaucccaaacaaggaaagcuccgcaccaagguggagaacggugagugauacaugcccccgccuccuuuccucaaaaggcucugcaagguccagggaccccaagucucuacaaggcugcuaggauuuuaccauuagucacugggcacagaggugcuguuuacaggaaagggaagaccugggucagggagcugugugguaagaucaggguucuauuuugaauguguuaguuugggagaucugggagauccccaagucaaauaggagguggggguucccauguggagcucagaggagggagcuuggcuggaaauagaaauaugggagucaucccccuauagggucuucauggccaugagaaugcauaggauuaccucaagaaagcggggaggaaaugaagagugcggcacaaccaagcccugaggaguugacagaugaggaugccaaaugcugggguccccuccugucuagcuggcaguugacucugccuuguccacuggcuccuucucuccuauccucuccugucuccuuacugucucuucgcauccacuccauugcguucaggccacgucagcagucaucauggugguccugaaaccuugcuaaauacccuaaaguauagacacaguuaccauggagccggugcuccacuccuagguauaugcugcagagagauggagaucuguguccacacggaaacuaauaugugaauguucauggcagcauuacucacaagagccaaaaaaguggaaacaacccagacguccaucagcugauggauucauaaauaaaacaucaaauauauccauaaauugaauauuauuuuggccauaaaaagaagugaagugcugauacaugcuuacaauauggaugcacuugaaaacuugaugccaaaugaaaaaagccagucacaaaagaucacauauuguaugauuccauuuauaugaaauguccagaauagacaaauccauagagacagaaaguagaugagugguugccagggccaggagugggagaguuggagagaugaggagugacugcgccaauggguagaagguuucuuuuuggagcgaugaaauguucuaaaauugacuguggugacaguugcagaacucugugaauauacuaaaaaugacugaauuguaugcuuuaaaugggugaacuguauggcauaugaacuauaucucaguaaagcauuuuuuuuuguuuuuuuuuaaacccgauagugguuucccacugcacugcauauacaagcaaaaccugcugugaucacccggccuccucucaugccacuuuccccaucccucgcauaugcucuguccacacuggcucucugucaggcgccugaacagccaauccgcuggcugccuuggggccuuugcuuuuguccugugugccugaaacacuuacuccagcuguccuccuccaugucugggcuccccugcugcugcugucccaggagguguccccugugguccuccgucauagcugccucagagccuucagagcacugucagcaucuggaauucuuccguauguacuggcuacugguuuagugucuauucucuucccuuucaaucuccucaccaccauagauguuuuaagagcacaaagaucuuacuugguuuugcucaccguucuuucccagcaccaagcauagugccuggcgcauagcaggggcugugaaauaugugaagaaugaaugaauguagccuguggcccaagcuuaaggaggauagaaaccacgccagggagugguuugguccauuggcgccugugggucugacccaagucucucacacaggagaaggcacaaucccuguggaauccagugacauugugccuacgugggauggcauucggcucggggagagacuccguaccauguccuguagugacaaaauccuacgcuggaacgugcugggccugcaaggggcacuguugacccacuuccugcagcccauuuaucucaaaucugucacauuggguaaggggccugccuugggaucuggaacuggucuguccuucuugugcccagaucccaaacugcaugcuuuauugccagguguuuugucucccuuaucaaagugagcaugauucacuccucaguaauugauugaguguccagucugcugugguaggaagauccugguagccccagucagaaggugcuuccuaacaaggcagcuguuucucuuucuugacaacuauaucuuguaccuccaaaauccccacaugcuucugccucuuaacagcauuuggugcaaacacagguauauauguuucucuuuuuuguacucagguuaccuuuucagccaagggcaucugacccgugcuauuugcugucgugugacaagagaugggagugcauuugaggauggacuacgacaucccuuuauugucaaccaccccaaggugcuauaacccccuucuauuuucccugacauuuuccuccuuuucaagcagucauguaaacagaggaaaaauguacacugugggcaaggggaacauugcccacagugguagcccacaagggaacauugcccacaguggcccaccaccaacauugguuggucucccaagaacuuaaacuuucuuccuuuuggaugccaagggcuuuucuucucuuagucuggaauuaaucugaaucgagguggaguuaguaugucuagagggugcucagucuuagccaaacagaacccuaaauacaggggaaagaucaugaccccacacuuccucucuccuaugagucuugagucccugcuucagaaucuuauuccugaaagguuuccaucuuucucccguugcuucugggauuccuagguuggcagagucagcauauaugauuccaaaaggcaauccgggaagacuaaggagacaagcgucaacuggugucuggcugauggcuaugaccuggagauccuggacgguaccagaggcacuguggauggguaaggagacaggagagcgcagugaggaccaagccucugcccugacuugcaagggugcaucauaccucugcagucucagggcuugagagccgccuccccucccacggugucuccacugugagcuccuuaucuuacaggucccaggugaauaaugagugcuuuuguuucucuaggccacggaaugaauugucccgggucuccaaaaagaacauuuuucuucuauuuaagaagcucugcuccuuccguuaccgcagggaucuacugagacucuccuauggugaggccaagaaagcugcccgugacuacgagacggccaagaacuacuucaaaaaaggccugaaggauaugggcuaugggaacuggauuagcaaaccccaggaggaaaagaacuuuuaucucugcccaguauaguaugcuccagugacagauggauuagggugugucauacuagggugugagagagguaggucguagcauuccucaucacauggucaggggauuuuuuuuucuccuuuuuuuuucuuuuuaagccauaauuggugauacugaaaacuuuggguucccauuuauccugcuuucuuugggauugcuaggcaaggucuggccaggccccccuuuuuucccccaagugaagaggcagaaaccuaagaaguuaucuuuucuuucuacccaaagcauacauagucacugagcaccugcgguccauuuccucuuaaaaguuuuguuuugauuuguuuccauuuccuuucccuuuguguuugcuacacugaccucuugcggucuugauuagguuucagucaacucuggaucaugucagggacugauaauuucauuuguggauuacgcagaccccucuacuuccccucuuucccuucugagauucuuuccuugugaucugaaugucuccuuuucccccucagagggcaaagaggugaacauaaaggauuuggugaaacauuuguaaggguaggaguugaaaacugcaguucccagugccacggaagugugauuggagccugcagauaaugcccagccauccucccauccugcacuuuagccagcugcagggcgggcaaggcaaggaaagcugcuucccuggaaguguaucacuuucuccggcagcugggaagucuagaaccagccagacuggguuaagggagcugcucaagcaauagcagagguuucacccggcaggaugacacagaccacuucccagggagcacgggcaugccuuggaauauugccaagcuuccagcugccucuucuccuaaagcauuccuaggaauauuuuccccgccaaugcugggcguacacccuagccaacgggacaaauccuagaggguauaaaaucaucucugcucagauaaucaugacuuagcaagaauaagggcaaaaaauccuguuggcuuaacgucacuguuccacccgguguaauaucucucaugacagugacaccaagggaaguugacuaagucacauguaaauuaggaguguuuuaaagaaugccauagauguugauucuuaacugcuacagauaaccuguaauugagcagauuuaaaauucaggcauacuuuuccauuuauccaagugcuuucauuuuuccagauggcuucagaaguaggcucgugggcagggcgcagaccugaucuuuauaggguugacauagaaagcaguaguugugggugaaagggcagguugucuucaaacucugugagguagaauccuuugucuauaccuccaugaacauugacucguguguucagagccuuuggccucucuguggagucuggcucucuggcuccugugcauucuuugaauagucacucguaaaaacugucagugcuugaaacuguuuccuuuacucauguugaagggacuuuguuggcuuuuagaguguuggucaugacuccaagagcagagcagggaagagcccaagcauagacuuggugccguggugauggcugcaguccaguuuugugaugcugcuuuuacgugucccucgauaacagucagcuagacacacucaggaggacuacugaggcucugcgaccuucaggagcugagccugccucucuccuuuagaugacagaccuucaucugggaacgugcugagccagcacccucagaugauuucccuccaaacugcugacuaggucauccucugucugguagagacauucacaucuuugcuuuuauucuaugcucucuguacuuuugaccaaaaauugaccaaaguaagaaaaugcaaguucuaaaaauagacuaaggaugccuuugcagaacaccaaagcaucccaaggaacugguagggaaguggcgccugucuccuggaguggaagaggccugcucccuggcucugggucugcugggggcacaguaaaucagucuuggcacccacauccagggcagagaggucugugguucucagcaucagaaggcagcgcagccccucuccucuucaggcuacaggguugucaccugcugaguccucagguuguuuggccucucugguccaucuugggcauuagguucuccagcagagcucuggccagcugccucuucuuuaacugggaacacaggcucucacaagaucagaacccccacucacccccaagaucuuaucuagcaagccuguaguauucaguuucuguuguaggaagagagcgaggcaucccugaauuccacgcaucugcuggaaacgagccgugucagaucgcacaucccugcgcccccaugccccucugagucacacaggacagaggaggcagagcuucugcccacuguuaucuucacuuucuuuguccagucuuuuguuuuuaauaagcagugacccucccuacucuucuuuuuaaugauuuuuguaguugauuugucugaacuguggcuacugugcauuccuugaauaaucacuuguaaaaauugucagugcuugaagcuguuuccuuuacucacauugaagggacuucguugguuuuuuggagucuugguugugacuccaagagcagagugaggaagacccccaagcauagacucggguacugugaugauggcugcaguccaguuuuaugauucugcuuuuaugugucccuugauaacagugacuuaacaauauacauuccucauaaauaaaaaaaaaacaagaaucugaauucuuagaa

SEQ ID NO: 6298 - RNA, 27855 nt, Homo sapiens
auuuaaagcuacccuguugcuuuggcuuucucugucugccagggucuccgacugucccagacgggcuggugugggcuugggauccuccuggugaccucucccgcuaaggucccucagccacucugccccaagaugggccguggggugaguaucccuaaagagcaggggucgcagucuagagggugagggaggcugcugaggaaggaugaagugggaaugggauguggaaggagcgggagagaggagcugagugggauacuuggaacuugaaacuaacagucuccaaacuaccaauguguguacagaucccacggcggucacauacccuagugcucuccucuccucugcacgccccagcccccugcccacaguuagacccacagcccaccacacaugcccccuccaucucucccuccaccccacucccacaucucuaguccuucccugcagcagucccuccucucacugcaucucccggccucccagcugaaaggauguuuggcacugugaguccuccugucuuugccaccuccugaaaauauccauuccucugggaguccuagccugagaggcuggggguccauuuugagguuagagaggggcaguagagcauccggcucccagagucaccaaguaguuccggacaccagcuccaggggcccugagugccaaggacagcugggcgggguguggggaggaagaaugaugacccagcccccaccccagcaccccuccggaugucccgagcagcauuguccguggguuccaagccaugggcuuugaggacuuucccagaggcuggugacaggugaccccccccccaguccacccguccauggcauucugcagcaauggcuacaccaagaggaagauuaacaacaauggggcgggcagggagagggcuuugaauucuuggaaaugaaauucccauauggagaagaguggcccaauccuuuuacaugcugugccuggcugcuuuccuuuuguggaauacuggcaaaagaggacacagagggaaagggcaugcugcggaacaggaggguaugaggaagacugugccuagggggagccguggguguuucugggcccaggaggagucaggcaaggacauguuauugcaccuaguugagcagcugggaaauccugagccuggacaccaggguuccugagcuaggguuggagccauaaauagaauuggagugcaugcauguaucugugugucugugucugugugugugugaguguguguccuugaccacguguucuccauaggcggggaguccugcaguuacucauggaugaguaccuguguuugugucucagcaggcaaauuuguaaauguacaagccuucaagccugcacaagcauaaaugucacugugugggggugcuugagagucugugagccugcccuuaggagcugugagguaugggcuucacggaggaagaggucauagcugcaggaagauauacugucuugggaccuucagcugcaucuugacaucucuggcuccccauggaaagggcaucccuagcugagaugcaggaccucugagaagaggcagggguuaaaggaucagauaagcccuccauuucccccauccaagugaagagagaaggaggggagguagcccccuacccugcuccaucuuagagcaagguagacccagcucaggaggucuugcuugggaagugaugagaccuugacuuuuccagucugucuuuuuccccuagcacccccaaacuccccuuaaucaccauccuaaguugcugugggugaugcaauagcaagaugaggagcagaucugggcuguuuaaacuaagaggcugggugagguggggguauuuagggccuggagcuuagaguucaaccuaccaacgaccccugaagagggaaggcaucugacacccacaaccuguucuagggaugauuuuuccuccaaucccuucuccccugcaucuccacugcagaggcaggcuucacuguccccccauuacccaguggcugugaagggcagcgugggaguugggggaagggacgacacuggugggagggagcccagccugcuccagcuaccacggagaggcugagauggggggagcguuggcggauucccagcugcccccacucugucccagccucuggcuuucucaaaaaggacucucuguucuccuucagcauucaagacccagagagggggacuugugguugggggagggaggaguggagggagguuggggggguccuugcuuccucucuuucuuucuugccugggcagccgcuggccccaaaucucugcaggcuccuggcugcagagccugagaucuuugccaggacaggaggagggggaaggggcagugugucucaagcucuaagccugcuggagagcagggcgggagcuugggaaaaggaggcacugcguggagcugcuuagcucagccacaauccagcaugccaaagugcauggaccagcaaguuuuuaaaaagcaugcauuuuauuccaauuuuuaugaaauuuauuucacaucugaauauacagaaauuccucugcacccugcucuucugcccacagacccagcccugcuccucuguguaugccugggcccccuucugucccugaaguuccugagggucacacugaagcucagccagccugaucucuugccucuguucccuugauugcauuucuuccuuuucucagcucugucccaccacagacaguuagugaauguaaagcauuucaauccacucaauuaaaugaauccucuuaggucaccugagaaaggcagaggcagaaccacucacaagccuuuccccaccccuuccauugggcugcucggucuccccaagaagaucugccuuuaggaggccaaaauuauaccagauucauagaugcuucagguggagacaaacccacgauuuuacuggucaccuuuucugagaagagcacuucugagcaacacagccuccaaaagcucauaucuuuuuaaaucauugguaucuugggaacaacaguguugacuucuccuugcaucccccaccccuacccuugcuucugauuguacuggucagacuucuaccucucaagaugcugaauuggcgaccucuuaugaacaaggcagcugccauacuucugggauugcuccugacucugauaaguaaaaaaggcauuacccuggagcacaaaagucuuagggcagugaagcuauuccauaugauaccacaauggcggauacacgucaguauacauuugcccaaacccauagaauguacaccaagagugaacucaaacuuaaacuaugggcuuuggacgauaaagauguaucaaugcagguucaugauugcagcaaauguaacacucugaugcaggguguugauagugggugaggcugugcaugugugggggcaggagauauaugagaacuuucucuacuucccacucaauuuugcugugaaccagaaaauugcuccaaaaaaaguauauuuuuuaaaaugcaaacaaaacccccaaaacugcauuauccugcaaaaaaaaaaaaaaaaaaaaaaaaaaagcaaacaccuuggcuguggacccuacccagguauccacucuuuaugggaaacaaaaguuaacaucauagugugggaaaacuaauuccugaaagccuagugcagacuuugcagaauccaguggagaaauaggcaccagguggaaacugagcagccccucuaugacaaggacucuauuuccugagggaagugggaggagagaagacuggggcagaagaggaaguaagaagguaccuuuuugggaacuuuucauggcuacccaggccuuccucagccucuauccuauucuaucaccccaagagggccuccucuuagaaggaaagauuucccacccuguccccaagaaguucccugugagacccuggaaggcugguaguggugagcccacaggcccuggaguggaagggaaaucaggagccucauaagacuacaauuaaaauguccaucugcucaggcgcaguggcucacaccuauaaucccagcauucugggaggccaaggugggaggaucacuugagcccaggcaauauagugagaccuuauaucuaaaaaaaaaaaaaaaaaagaaagaaagaaagaaaauuguuuuaaauuagcugagcgugguggugcaugcuuguggccccagcuacuugagaggcugaggugggaguauugcuugagcccuagaagcggagggugcagugagcugaaauugcacacugcauuccauccugggugacagagugagacccugucucaagaaaaaaaaaaaggccaucugauucaccagaugacccaggaaugucuagacuuaaaaacuauauaaaauguaguuuuagauuuacucucagauacaauuucuuauguuuugggacaaauggggcucaguucccauguuacccaauugugcuuuggggguccaguccugugaguugccucccgucuaguaacgggcaggccugcccagcaggauggagagggcucccagcacaccccaugucuccacuuccuggacaugcccugacucuccagcuacugccuccucucaguccaucaggccugcucuuuccaucccuaccauuccaccaccagaccuggcucuccucuggacacguuccugccuaauccccuggcuccccaaagacucuugcucccccaaguuccugaguauuucuaccccucucuaaguaaaauugccaugguguugggcuaagacauuccuacagagugauucuacucccucaacaaccccccacaaaacccuguccacucccuuccagaauuuucccaaauaguguaggauacagguuuucaaaauuuuuguuuuguuuuguauuuagcagcaggguccuuucaacaaacaaaaucuuagcagaagcccaagcauuaaaccacucaaguggugcuuuucaguccugagccccucacccuucucugaaacucacaugggagccccugguucugccaauagucuacaaacugagggccuagggucccucacccuccauccccccuaucucccccaaggcagccgcugcuuuugaacacacacccccacugccugggcucccuggcugaguggugggaauggaggccccagccccucucuucccugacucucuggcucucccuuccucccucaggcuggccgugaguacucaccugccgccaccacggcagagaaugggggcggcaagaagaaacagaaggagaaggaacuggaugagcugaagaaggagguggcaauggugagggaacugcugggccauggaggaggggccccaugcugggagagcugucccugcagcccauugcacucagagaaacuccgugucccccaugcugcucaacucaccccugugcccugcaguacccucauaugcaucuuagauaccuccuccccaaaguaacucacccucccuuccccaggaugaccacaagcuguccuuggaugagcugggccgcaaauaccaaguggaccuguccaaggugaguggaggggcuucuagggaaggaacaaaagaggcaagaaaaccaugcagcaucaagguggcaggagccuuaaaacuguaauccagccuucuuuacagaugaggaaacugaggcccagaaacaaggacuggcccaaggacaugcagcuaguugguggcacagccagaacuagaauuuggauccccugcauccuagcccaaagcucucucccuguauacccuagaagccaggacucccuaugacccaggccccagagggccuccaggcagggcccuucccuauaccccaagcaacuucaguugcacacagccuuccacagagcugacagcugaugcacaugggcugacagcccauuccugugguuacagugauuugcugggccccugcuacauaugugacauugugauagaugcguuacauacauuucucuaaucuuuacaacaacccuuugagauagguauugcagaccuguuuauuaaacaaaggagacucagagagggagaguaacuucccaaggucacaugaacaguaacugguacagucaauugcuaagcccuucaauuaaaaauuuguuuaaaaaucauuaaucaaaaaaugcugggugugguggcucaugccuauaauuuuaccacuuugggaggccaaggcaggcagaucacuuaaggucagcgguuugagagcagccugggcaacauggcaaaaccccaucuccacuaaaaauacaaaaauuagcuuggcacagugaugggcaccuguaaucccaccuacucgagaggcugaagcaggagaauggcuugaacccaggaggcggagguuucagugagccgagaucauaccacuguacuccagacugggcgauagagugagacuccaucuugaaacaagcaaacaaacagacaaauauuuaguggguguauaucuccuuuaugggccuucccugacugcucuuucuaaaauucuaugccccuauuccuuuaccuuacuuuauuuuccuuaguaacacuuuucuaucuggcacuaauauguauuuguuuauugugugucaccucuccagaucauaagcuccucaagggcagggacuuuguuggucuuguccaucucugcauccgcagagugacaauugugccuggcacuggauauacauuuauuaaaugaaugaaugaaugaaaaaaaaaaaaaaagaaacggucccugcuuuaaaggagcucaaagucuaguagcagaaaaaaugcaauccuaggauuccaaugcaauauggugagugcagcucuagaaucaaguauagaacaccauggggaaccagaaagaagcaucugaaccagccuggggcugagggaauagggccaggcaaggcuuucuguggaaagugacaggugauugccaaaguugugugacacugacggucaauaauguaggacuugagcaggguguggaggugcccaccuguagucucagcuacuugggaggcugagguggaaggauugcuuuagcccaggguucaaggaugcagugagcuauaauugcaccacugcgcuccagccugggcaacauagcaagaauccaucucuuaaaaaaaaaucuaggacucuccuagaauccuugauaaaauaaucugaaggaagagagauggggaaaaaacaguugaggugucuuuccagggagcuuauccagacugccuccaggggagauguuauggcccuaaccauagguguugucucaauccaauauaauuaggggucaagcccagucaaacccuucucagcccucaagcccuccaaguugcaucacaaaugccaccuccuccauguggucucuccugauggucccccaccccuuccaaccaggugggacuuuccuucugggcauucuucccaugcccgggagcugaagggaugggcauggugacuggcuggguuggcuccggaugcgugccccuacgccucuccuugcucccucagggccucaccaaccagcgggcucaggacguucuggcucgagaugggcccaacgcccucacaccaccucccacaaccccugagugggucaaguucugccgucagcuuuucgggggguucuccauccugcuguggauuggggcuauccucugcuuccuggccuacggcauccaggcugccauggaggaugaaccauccaacgacaaugugagcccacacgcccgacccgggaacagcccgugacuguccuccaacccugaacccccaacacaguggggggugggcagggaacaaggcccucacauaacaguccuacagaugccccugcaucuuaggcuggaaaggggagaggcuucuauauauaucuguaaaguacuccuccgccaacagugcauacacauucacauacucauuaauuaaugaaacaaucucucccuguuccuccccgcuuaagugagccugucugugugccugggucuucauccccuagcaaaguccuaacccugggaacuuccuaagacuuucccucccauuucuagucuuaacaggcuugagguuggcagaucaagggggagguuagugagaagggcuuuccccuaccaucaucacucucagucacagacaaaggucugggcugucaucuuggauggcacugccugcucaucccaaguggcagcugccccuuuaggguuggggggaaggucaggucccugaaacucuuucuccuuaccagcuauaucuggguguggugcuggcagcuguggucauugucacuggcugcuucuccuacuaccaggaggccaagagcuccaagaucauggauuccuucaagaacaugguaccucagguaagauggcagggcugggcucugggcuaggcuguaagguuuuggcaagaguccagcucaucuuuugucagcucccaggcucuaagauagagauggacagaaaagauccuccagcuuuccaugccagcaccuaauuguuuauggggcuucuccuucugcuugacggugugggagaccagcaggagaagaaggcaggggcagagacaagcauuucaugagcugccuguggcuccccacagcaagcccuugugauccgggagggagagaagaugcagaucaacgcagaggaagugguggugggagaccugguggaggugaaggguggagaccgcgucccugcugaccuccggaucaucucuucucauggcuguaaggugaggaggucauaccagagcaagcaguugagucuaaggagaaggcugugugcagagcugagaggggcccagugagguuuaaagguggagagacccagguccaaaugucaacaccaugccuaugccccugcuaaaccuucucucaguguggggugcuugugcagugccuccuugcaucuguguguuaugaaugcucuaugccccagguauuucuuuguuguccacuuuuuagcaaucauguauugaauaccaauuaugugucagcugcuuuauauauguucgaugugcuaucugauguaauucugaaagagugguguaaucaugcagggcugcugaauguggccacacacguugcauccugaaugaccccaggaggugcauuuucauaacuacaguguuagugucucccccugugguugugcaaggcagagauucuguuuacauucaccauuuuacaguugaguacauggaggcucucuugguuaagcaaguaacccgaggucacauaagaagucaggaggagucagaauuccaaaccagggcaggggcaauagaugaguaaugccauaaauaugugaugagggcaagugugacuuuguuccucgugucaugaagauugagugugguuggaggugguucaggagacagcugugugcauacaaguggcucugccagucugaugacuaugcacuccuuccuccucagguggauaacucauccuuaacaggagagucggagccccagacccgcucccccgaguucacccaugagaacccccuggagacccgcaauaucuguuucuucuccaccaacuguguugaaggugagaagccaggcugcccccuguaggaaagagucugaauccugaauccauagucaggaugaagggcucugguaguacuuaccuggcaaaagcucugccauugguggggcaauugaggggucagggggcccugaauauuauggaaacacccuccacagagcaggguauugacugagggcagccugacuccaugggaaauguaucucccuuccccagggagaucucuguucuguccaccccaagacugaguggauuucaaagcuuucagguauuggguuaagaaccccuuacgcaugcgcacacacagaugcacauacgcucagaaccaaccuggauucuuaggagucuuuggauuugauugaugcuucuauuccuugugguucugggccucgcugcccccuucgauaaccuuugcuuuggccagggccccagggucugggagggccaagaaggcauucuggccaggugaacacuuggggccuacuucaggcugcuucuaaccuuuguuacaucaaaagacauguuucaccaugcacagacuacccaguuugccccaucccuguucuggguucuagagauaaacaaaggucaauaagaacucccagagcugccaucacuuaauggcagggguccaagcacaacugaaaccugugcccucugugguaaagccagugagcagagucagggcugcaucagagaaggaguaggagggaagagacagaaagaggccucacuagaccaguggccucugaaaauagggcaaaggaggccucauaucccaauccacacuuccccuguccauuacucauuucuccucaguguauuauguuucucugugguuuuuuucccuucuucgacaaguuggaauuccacugcuuggaauccaugagggauugguuccaggacccccuucguuaccaaaaucuaaggauccucaaaggcccugauaugaaaucgcauaauauuugcauauaaucugcgcacauccucccauauacuuugaaucaacucuagauuacuuauaauaccgagugcaauguaauuuuuauacuguuuuguuuuuaaauuuguauuauuuuuauuguuguauuguuauuuuuauuuagcuccaaauauuuucgaucugagguugguugaaucuauggacauggaaucugugaauauggagggccaacuguacaaauaaaaaucaccacacauuacauuuccuaaguuuguuuuuuguuuugcuuuugagacaagaucuugcuuugucacccagacuggagugcaguggugcaaucacagcucacugcagccuugaccucccaggcucaagcgaucucccaccucagccuccagaguauuugggacuacaggcgcgugauaccacacccagcuaauauauauauauguauauuagagauggggucucacuauguuacccaggcuggccucaaacuccugggcucaagugauccuccugccucagccucccaaagugcugggauuacaggcaugagccaccgagccuggccaaauuuccuaaauuuuuaauguacugagauuuugaaauuuacauuucccacaauugauuuauucagaaaugccuaguaauacauuccuauugcuuacucugcaauuggcuuugaaaagaggaaaggaaauaaaugagauauuuguugagcacccgcuauguuccaggcacuggccuaaguauauuaaagcacaaucucaucuaaauauuaaaacagcaccgagauaggaauucaaauaaggauucaaacccaaauuuggcuggcuccaaugugcaugcuuuuuucaauacaccacccuuccuucccagaagaccccuguaaugucacacaaggguuagcaauugccuggcuuccucuauagagauucaugccuaauguugagaaagaaaaucuuaagacuggauggaaaauccauaaugagugcuuuacuuuguguucauaauauacuuuuggaugguaucaaguaugggaaugauuuuaccaaaaugccacaggcaauuuuuauuuauugaaucuugucuauuugaacuuugagauuauuugcaagcuucuccccaggcucgaguacaagagaaaauaauuugcuguuguauugauucaaggauuggcgaucuauccagggaaaggaaggccaaguggggacaaccuacugaauguggccuccagaucugcggcuuuggcucaccuauccugugaugauuuuccuugcucaggaaauaggaugggacugcagucccugggagccacaaggcacccaaccugaugccccaccauguugcaggcacugccaggggcauugugauugccacaggagaccggacggugaugggccgcauagcuacucucgccucaggccuggagguugggcggacacccauagcaauggagauugaacacuucauccagcugaucacaggggucgcuguauuccugggggucuccuucuucgugcucucccucauccugggcuacagcuggcuggaggcagucaucuuccucaucggcaucauaguggccaacgugccugaggggcuucuggccacugucacugugagugggucaggcugaggugccaccaggggagggucucacuacucuuuccucagagugauagaggcacaguugcuuguagcuucucacuacuuuuucccccuagagucacuuauuggaugcgauacucagagaucacuuaauacauggcuuaggguaugaguugagaaaucucagguggggcuauucuuaggcacucaguuucucuuuuggagcuugucacggcugccuuuucucacgaucugccagcagucugggucucauuccguccaagucuccuguagaggcugucucaaaggucaccagucacuaacuagcaaauccagggaccuuuucucagcucuccucccuaacucugcugcugaaacagauacugcuguccacccuccuaccauucucucuuuugucgauugcugugaugugucacuauccugguucgccucuccucugucccuuccugcucccccuacacugauucucaggccucagcugucuguucuuccuacacccugagcaagagccaaucuccucccaguuugcagugucccuucuguguugaugacucagacaucccuaugcucagcucugcucuggcccucucuggagcucuagucaaacgucuuaaacccccuaaugggcauuucaucuuaacagauacucaugaucucaacacaucuaaaauugaacauucauuauuuacagcuaagucccacccauucaaguuaguggaguagaaucaggggaggaggaauggagccacggucuaggguaagguuauggccaucuccggcuucagccuuaaccuuuuuuauucuccucuuucucuaccaggugugccugacccugacagccaagcgcauggcacggaagaacugccuggugaagaaccuggaggcgguggagacgcugggcuccacguccaccaucugcucggacaagacgggcacccucacccagaaccgcaugaccgucgcccacaugugguucgacaaccaaauccaugaggcugacaccaccgaagaucagucuggugauugggugcuccagaggggguggauaggauuagaggaggcugagggcaguggcgugguggggugagugguugagauaaaggcucuaaagggagccacgcuccugguucccccucauuuccucccaggggccacuuuugacaaacgauccccuacguggacggcccugucucgaauugcuggucucugcaaccgcgccgucuucaaggcaggacaggagaacaucuccgugucuaagguagggggucaggacacacaccagguauguuuugggggugucuccaaagccucuugcuggccccagcuuuccuucucacaugauguggcugccuuggggguuucagugccgccuucaccugauccuccacucccuucccucccaugcugacacugaauucuugucucuucuggcagcgggacacagcuggugaugccucugagucagcucugcucaagugcauugagcucuccuguggcucagugaggaaaaugagagacagaaaccccaagguggcagagauuccuuucaacucuaccaacaaguaccaggucugcuuggguugccaggacagaggaagagagagggauauaaaugggugaggguggacaaagccaaggggaaucaucacuagcaggagugggggugucugagggucauguucccucccccugcuaagucccccaggacagcucauaugacugcaugucugauugcaacuagccccagcucccaaaccuuacuccaucccuuacuacaaucugucacucucucaacucuucuucccauagcuccgcauccucuggccuagccuuccaacucuucuaccccagucagugaaaccauaauucuguaauuccuuuauggugccccuuagccuuuaggcaccuguuaaaugccaagaaugcaaucucagcauuccuuauuauccauagagguaaagcccccugaggccagguggugguggggaugcugaggagggagccguucagccccuagcacagugccugucuuaaccugaccucaauaaauauuuguugaaugaaagacuguccuacggagguggcucucagguuacaaguguuggaacugugaggucuaaacaccccccugcacaaggagauucucuuuguugacaaucuuugauggguuggggcuacuuuucuaaggugguuuccuuaccagcugcugcucuaugccgcgcuaccaagacaaguauggcccucucuguaacuaccuguugucucuccagcugucuauccacgagcgagaagacagcccccagagccacgugcuggugaugaagggggccccagagcgcauucuggaccggugcuccaccauccuggugcagggcaaggagaucccgcucgacaaggagaugcaagaugccuuucaaaaugccuacauggagcuggggggacuuggggagcgugugcugggugagaggccagaaacaggaggcucagaaggggauucccaagccucugcggcaucccuggggugggggacugugggggcguccaggaagccacucugcggaucucacugaucccuucugccccccuuuaggauucugucaacugaaucugccaucuggaaaguuuccucggggcuucaaauucgacacggaugagcugaacuuucccacggagaagcuuugcuuuguggggcucaugucuaugauugacccuccccgggcugcugugccagaugcugugggcaagugccgaagcgcaggcaucaagguacuggccucccauccuccccuccauucuagccucccccaugccagaguucaaggagcugcaguggcugcugcccuggaaaggcccaggccacgguggccuccuucccacugacucagagaagaagcuguccaucugcaaggaaaggcccaccccugccuuggggcacucacccuuaucccuuuugcucagagaggccagugucccaugccccuccucucccucccuggcacagcucuuugucccaucugcauguguacccuuccauucugauuugaagcauaaucuggcacuccuaucuugaagaccuaguuguccuacccuucccaacuacugcccacccucucugucaacuuaggaugggauuagcaggcucuuguaugcucccaguggcucagcccauaaccccacagaaugccucccacucaagguucucuuguucaacuacaauugcuucucacugaccacucccuccucugugcuauguuuguucuucauucaacaaauauuuacuguuuacuauguuucagacacugugcaaggugcaaacucuagcaccuugcacagugccugauacauaguaaacaauuugugucacaugacacaucuagaugggacaaugagcugugccagggaggacacauauaaaucaggcacuauucuaagcacuaaaccucuaugauuucauuuaaucuacgcaacaacccugugaauaagcaccaguauuuuuccuuuuuuacaaagagggaaacugaggcacaaaguaacaugccaaggccacacagcuaguguaagucauagagcagguacuugaaccaaggcagucugcuauuucuuaacuaucauaccaggagacuuguuucuguggguguaugugguuucugaaccccauaaccacucugucuccgaggcaggcaucauuaucccuguuaaaaguaaaacaaggcugggcacaguggcucaugccuguaaucccagcacuuuggggggguccaaggcugguggaucaccugagauaaggaguccaagaccagccuggccaacauggugaaaccccgucucuacugaaaaaaaaauacaaaaauuagccacguguaguggcaggugccuguaaucccagcuccuugggaggcugaggcaggagaaucacuugaacccgggaggcagagguugcagugagccgagauuaggccacugcacuccagccuaggcgacaagagcaagacuccaucucaaaaaaaaaaaaaaaguaaaacaaauggaaacugcaaguggguaagucuuuuccccaaaauaaaaccaccaguaagugauggacugggacuaugaagcaugaucugcuugaccggaaagccugagcuccugcugcuuggccaggugccucucucugugaucagaaccaucacggaggccugggcagaggaccucuaugggaagucagcucagggaagcauuaauucugccucagagaacuggacgauguuugacaaaaggaaugauauuugagcugggcuuuggaggucaaagaguauucugcaaagcagugagggagaggaaggcaugucaagaucagggaacaguguguacccuggcguggcuagacuguacggagcguguguagggguuggcaggggagagguggcaaggaguacuggggguugagacuggaacacugggucagagccaguuggaaggacuuggcuuaaaugccagacuugggcuuuauccugcaggccacagagagccaucagugucacgggggagguugagcuuuuaggagacuaccugguuugaggagggacuggauuuggggaagaacuggagucagggagagacagguuaagaggccauugccauaguucaggcaaagaaugaugaccugaacuagggcagaaacaaagggaauggagaggaauagccaugucugagaaauguuuugagaacuuggugaccaaacuggauauggaaggugaggaagauacaggagagaaggggacaggaugaauagagaggacaacaucuaagguagggagcaguagcaggcuuggugggguggcaggaguagagaaaaggaguucaauguugaccuuaagcuuaaagagucuauaagauaccccaggaaagacagauguuccagugaacauuggaguaugguuuagagcucaugaaagauggucaggacuggagauuugaaucucauuagcacaagggugcaaacuaaaggcuuauaguauguuguauuauauugcccagaaagagcagacaggucaagugaagggaggagaaugaaauccugugccaaaccaacauuuaggcacaagaggaaccagugaggaggggagagggugguaggaaccaaugccauuuaaucuucaugaccaccuagaaaggcaggaaucaucucugcauugugcugagaccucagugcuucacuugccuaaggugcuguagcuggagaaggucgguguuuaaacuugagccccucauucaacuccaaagccacugcuucuuccauccuacuaggcugccacccugagaggcugggaaagagcaugcagaggaguggagggaaaacaggaauggaggaguauguggaagccaggggagggcaggguuucaaggagaagaggucaacggugccaaaugccucagaggggucaaguaggaugaggacggcaaagacacuuuucauuuuucaauugagaggccccuguggccuuuggguggcaguuucagugaaguggugggaguggaagauaaggcaguggggaccauggaggcuuccuuuucaguauccauaggacuugcccugcaagcccacacaugcaaaugcuauccuaacccaacucugcucaccucauagccucuuagcccaucagaugccagccacccuccccaucccaacuccauucacucugcaacaauagcaaugaacauuauggugaagguagggaccaccgugcucaccagggaggaugucagaggcagaugcucaaggugguggaggcagggguguugucuccaucuuauuccuguucuguccauuacauugcugcagugaucaauauuugacacuaagaaccucauguccuauauccaggucccugugcauuugagcaaauuguagccccucucuaagccuugguuuccucauguguaaaauaaaggaguuguuaaaggguccuuccagcucugacugccuugaaucccaugaaauccaaaauccuaaaauaucuccuaaauaauccuaaagauuugaggcuucucuuccaggggauccucaugaacuuguuacucuguuauggauacuuuccugcacuuaagcaaacuaucucucucuaacccucugaacauaacucaacuugccauuaucuuuccuccucacccacccacucaaauucacacagacacacacaaauccccaccucacauacacacacaucccacacacacacauagacacacacaauccccaccccccacacacacaucucacacacacgcacacauacacaaauccccaccccacauacacacacacacacauaccccacacacacacacacaucccacacacacacauucccucucacacacacacacaauccccacccccucacacacacacaauccccacccacacacacacacacacauccuacacacacauacacacaccccacacacacacacauacacacacacacauacaccccaccccagccacuccccugcccacagacgcacacacacaugcccuuauuucgguugggaucugccauccccagacaucucgcuaucuagcuuucucuuacuuugggagaggaacaggagggggauaaacccuuaauacuacuuuccuguugucuccucuccuucccacuaggugaucaugguaaccggggaucacccuaucacagccaaggccauugccaaaggcgugggcaucauaucagaggguaacgagacuguggaggacauugcagcccggcucaacauucccaugagucaagucaaccccaggugaggccucugcaggaagccccugugcccuaaucaacacguccucuugcacagaaggcuuggguguccccugggaguauuuggauagcauuucugggaccuuuauaggccuuaccucugacacuauugugacugguuccucagcccugagcuuguauccaggcugugccacugaauacccauguaaccuuggagaugucacauucccuuccugagccuccauuuucucaccacaaaauuaggaugccaucuccacugcuguaggagugggaugugaguaaagaaacuagcccagggccuagcaaacugcacuuacaacugcgaugaucccauggugaggauuuagacucacauucucaaagagaaaugggggaagugaguacugaggagaggagaacugaagcaacaggggaagcaggcucagcagggagccugcaggcugcgguggugaagagaggcagggggcaggaggggcugguacaggugccaggggucagcugucucuguccccacccacccuccagagaagccaaggcaugcguggugcacggcucugaccugaaggacaugacaucggagcagcucgaugagauccucaagaaccacacagagaucgucuuugcucgaacgucuccccagcagaagcucaucauuguggagggaugucagaggcaggugagcacagccacgggaggcagaugacaggcagggaccggggaggcagggacagggccaagacaagcauggagugagaggcgaggagccaggcuugggaagggguuucguccucaaguguggccgucuucccuccagggagccauuguggccgugacgggugacggggugaacgacuccccugcauugaagaaggcugacauuggcauugccaugggcaucucuggcucugacgucucuaagcaggcagccgacaugauccugcuggaugacaacuuugccuccaucgucacggggguggaggagggugaggaggcugcauggguugggaugguuugcaggauacugaagccggcaccucuguucccugucccuuuaccccaguugaagaaucauuccacaacucuaggcagcccagcccacuuuagcuucccuugaacacaaaaucuuccucucuugggaagacaggcagccaugcuucaggggcuggggguggggaagagucccucugaccucccugaugcccucagaaucuccccacaggccgccugaucuuugacaacuugaagaaauccaucgccuacacccugaccagcaacauccccgagaucacccccuuccugcuguucaucauugccaacaucccccuaccucugggcacugugaccauccuuugcauugaccugggcacagauauggugagcgcaggagguggaggaggggacaggcaaggcaaucgugauggcacaguggcagggaggagaggugcacuggggcaguggccccagcuguggggguuacaggagacaggcacaggccuggaagacaauggggucugaauacacgcuuuuuuaacugugucaacgaucgucacugucgaagaucaauugcuucugucaucuccuacgucccuucaaaugcccucccugccccauuuccuaccccacacaggucccugccaucuccuuggccuaugaggcagcugagagugauaucaugaagcggcagccacgaaacucccagacggacaagcuggugaaugagaggcucaucagcauggccuacggacagaucggugcgccaagccccgggccucgggagggaaccccaacaggguucuuuucccagcuuucagaggaaugagccccaagcaaaauuccaggacagaggccagcuacccaagggucagggaccuccaucucuggcccugaggggcugugccccuucugcuuccugcucugacccugccccugccuuuggcccucuacccacagggaugauccaggcacuggguggcuucuucaccuacuuugugauccuggcagagaacgguuuccugccaucacggcuacugggaauccgccucgacugggaugaccggaccaugaaugaucuggaggacagcuauggacaggagugggugaguggugcuguguaaacacagcgcacaugugugaagguacgggaagcugaaugccuggcaggaguggccagugguggccaacugggacuggggcuagggguggaucaggagaaaccaugcuaccuucugguccuacccuuuccuccgacacucucaucugucucugcccacccucccuccagaccuaugagcagcggaaggugguggaguucacgugccacacggcauucuuugccagcaucgugguggugcagugggcugaccucaucaucugcaagacccgccgcaacucagucuuccagcagggcaugaagugagugcccacccccauggcaccuacccacccaggcucugggcacacucaccaacccacacaggccaagcuuccaacucagcccuggaccagagcuguaaggagggcaucagauuuuaaucuuccaucuguauauccauagauagguuucauauagaagagagaagccaugcuucaggcuccuaauuuugcauuuuguuauugucucucuccaccuuucuucucuccuucucucccucccuucuuucccccaucuccuacuugagugccaccugcuccuauccuuugcccagcccuaaauccagugucuucugugcccaccccuccccuggccuuccgcaggcagucuaguuuauagcacuugcacugugguucuggaggccacgugcugccgagggucggguucagcgcuucuugcagugugaguuccagcgugccaggcacugugcuaagugccuaacacauuguuuagccccacgauagcucuaugagguggguauuacuguuuacauuucauggauaagaggccccaaacagguuaaaugaugugcccaaggucaccaagaugguaaggguucaccagaucugucucuaaaacccagcccuggcuacuacccaacauuucugugcucacaccaucuggcacuguuuggaacucaguaaugacugugauucuauuauggguggugguugagcgcugaagguuucaugcugguuccuuuuauuuucuccuaccauaaacaauggccacaauuccucacaugagguuguuacaguuucuuaguuuggggcuggggaggguggggagaagaugccaaagugaaguuaauaacacuuaagauccaagggagaauaaagugaaaagccuguuagauaaauaaagguaacaugaaggaaggagauuccaguaagcuaaaaauacuaauggaaaaaaaaugcaauuugaagagaacaaggagcagagagucuaagaaauuggguauaauucuggggccugggacuugcuaugcacugcagggaugacacacgaaggugggaacauggccauaguggcugcauccagcccaucuuagaggcaaaugggaaaaauggcaaaugaaaaucaggcuggguacagaggaagaguacuaauaccaccacaggccucaccuuaggucccugggccacuggggauccucagagaugcuauuugccuuauuuugaaaagcuuuaugaaaauaaagcacucaccuaugcgaaggcaaccaggcuuacuaaugugucauucuuaggcaaaagccaagagcgcauaucaugacguggugaucggaugcugauucacaguucugucuggaagccauggauaguucuaauuaauuuuaaauggggaaauguauucaauacuuauucacaaauguagcuugagagacaaacaauuaaauguggccuuuacagaagaaaauaaggagguccuuagugagugaaaauuuggaaaucacuggcuugaaccaaaaagagguaccuuguguaagaauacaaaagauggaguagccggggacagugguucacaccuguaaucccagcacuuugggaggcugagacaggagaaucaauugagcccaagaguuugguacuagccugggcacauggugaaacucuaucucuacaaaaaauauaaaaauuagcagggcgugguggcacacaccuguaauuccagcuacuggagaggcugaggcaagagggucacuugagcccaagagguggagguuacagugagcugugaucguccagccugggcaacagagugagacucugucucagaaaaaaaaaguggaguaauaaugugacugaacauuuuccaggucugucacugaacauuucagugacagaacauugcagagcuuuucacguguuaucucccuuaauuuucccagcaacccuaugauaaaaagguaaaaucuccauuugauagagaaggaacgugaggcucagagaaauucaacauugccugcaacccaaagcuagucaauggcagaacugggaauagacaccaccugucugacugcagaaacugcccugagaaccuccuuauucuauccugcuuuucaauucugauaaagugaacauauauuaaccacuuauuaugcagugauccccuuuacauucucugaauuaaauaucuauaaugaaaccaccaccaggaacugugggagaugcugagacgguagaagacauacaugggcccugcacugaaggagcuuucaagcaucuugcuggggagacacacuuucaugggcccugugccuggagcaauaacaagaucaugagacaggccccauguugaccaccgugucuccaguacagaacacgucacccaacaccuagaaacaauuauuuaaugaaugaauauacgugcaauagacaacauucggacguaaacucaguaagcagaaaaacaaauaacaucuuccuuugguuacauaaagcaugagaagaggcuguuggaagaagacaugcgacuaugucguuuagaauucucucuccucuuucccuugcaccccagggguaucccaggaucucugccuccaugaucccccuucaccugccaccuccuuucuuugccuuucaggaacaagauccugauuuuugggcuccuggaggagacggcguuggcugccuuucucucuuacugcccaggcauggguguagcccuccgcauguacccgcucaagugagugucucuuucgggcggccugaguagucauacggggggccuucagcccccuccaggauccaaguucugaucgcuuugaaugcuccuuuaugugacagccaccaagccaaccucugaugcugcugacacucuccuccauugcuuucagagucaccuggugguucugcgccuuccccuacagccuccucaucuucaucuaugaugagguccgaaagcucauccugcggcgguauccuggugguaagccccuccacauuccccccagcaaagugcaagccccaccaccagcuccucccuccaggaccacacgcagacuccacucccacuacugguuccugcuucuguuccucaacacccucagauccuggggucccaggucccaggagcccugacucuuucgaaccuguugucucugcccucuucccaucagauucuaaaccccgccuaacucacaguuggucuccgaggcccuccaccuuccaccugaaaccacagaacaucagaauuagaagggccuuuccaggucaccuagucccacguccauauuuuacagauagaggaggcucagaggugaaucuguucagggucguaaagcaaagaauagcaggacugguacuagaacccaggccuccugauccccacucaucaaccgacaaguuauuguuuuuccuacaagcguuuuuuaaucacuuaguagagguuaaaauaugauggcuuacaaaccaaauacuguccaggaauacuguuugguuugaccugugccauauuuuguguguguggggggaggaggguggauuaauugguccgauauagaaaauuuagggucuuucacauaaaaucugaauucgacuucuccugaagaucagaagagcuguuaaucccauguccacaucucugcacagcaagaauggacagcugcucccuuagacucucguucgucaccugaagaggcccugugggcguuugcauuuucacccucgaccuauucugccccagccuccaaugugcuaaauacaagucuccccuaaaggcagguucacccucccuuccuuuaaccuauggccccagcucacuggaccuccuucuccucccuuucaccuucuuuuuuuuuuuuuuuuuuuuuuuuuuuuugagacggagucucgcucugucgcccaaccaggagugcagugcaguggcacgaucucggcucacugcaagcuccgccuccuggguucaagcaauucucuugccucagccuccagaguagcugggauugcaggcgcaugccacuaugcccgacuaauuuuuuguauuuuuaguacagacaggguuucacuggguuagccaggagucuugaucuccgccugccucagccucccaguaugcugggauuacaggcaugagccacugcacccagccuccuuccaccuuccuaagccacuucccccagugcccuucaccaggcuucuccuuccaccuggcuucagcgacccaagccccuaggaaauugaucucuugccuccuuuuaagcucaugcugcaaucuccacucccaaucucucuaacaggcuggguggagaaggagacauacuacugaccccauuggaagaagaaccaggcauggaaagauggggagcucuggagguguuguggggauggugauggagagggauggaaauaacggguggcauuggguggcaacauuuggggagagauaaugaggcaacucagcaggcuaaguugcgggguauauaaauuggggugaugaccccauagaccuaacugugaacaaucagauuagacacuauguguuagaguccccccgaccagauccuuuuccaucccacuccacuauguugucuauuuuuucugaggaauuaaggguuaccccacccugcccacucccaucccuucaaccccacuuccuacuguaauagaucagcauccaaaagcaggaacccaucuaaaccagaaggaagcccucucagaucaccccagccucacuccauuucccacuuccacccccguuagcuuccugcaggacucuaucccuggcuuccccuucagaccuugcaaucacaaaagguucuucuggugagugcaagagccugagacuggaaaagguggacuugucucccagucgaggcugguaagggaccuucagggagagcugggcagacaggugggagauggagguagggcuggcuggaggaaggaaacaacaaaggaagugagguagugccaaugacaggacauuugacaugagucuccagauagaugucguggacuccagcucuacgucccacauuuuagaauaccccaccagcagaacaaacucagaucucaucaggguagcagcagaggcaggaccagaaggcaaucaagagcuuccagaaaugccacacuugugugccacagaguuccccgcugacccuugguuagggguccucuuaguccacaagguccggaugucacucauguacuuaauaacacuucaccuucuguaauacuaaguccucagagcuccaugcuguucugaaagggauggccacaaguucuuucccagccucuuccauucccuuucuuuucaugcccaucccgaugaaccugcaucauuccccgacacugccaagccaacccuggaaaaggaguucgcuggccauuggcuagaaucaggguggagaaguucccugaaccuuccugucucccagggacauguaugcuuccagggacaagcuuaggucaugaacauggucagaaccuuuggacaagaggaaaaauacuaagagauuugcuuuuucugggugcgguggcucaugccuguaaucccagcacuuugggaggccgaggcagguggaucaugaggucaggaguucgaggcgagccuggccaacauggugaaacccugucucuacuaaaaguacaaaaaauuagccagucaugguggcacacgccuguaaucucagcuacucaggaggcugaggcaggagaauugcuugaaccugugaggaagagguugcagugagcugagaucgugccauuacacuccagccugggcgaaagggugagacuccaucucaaaaaaaaaaaaaaugauuugcuuuugacgucuuagguggcagggcuguucccuccaggcaaaugcccuucaaaccgacgaucauugugcccacuuacccugggcuggagaguugguuucagguuccuacaggagauagcuuucuuucccuuacucccuaucuaacacuuuugcucugcaggcagccuugcccauucucuaagccuggcuuagaaggcacugggaauguccuguagagagagaccuagauaggucaugcaagugagaaagacaucugaggaaaauggaagaccuaaggcagacaggaaggaagcacaaaagacaagcauugggucagacccauaaaccaccucccaaaggcugucauuucauugcacuggaauuuugcuuuaucagaagcaaggaaguaagggagucauugccuugggccugggaaucuaagugggagacaauauuaauuuggauccgauuaauuggagauuacuaacuguggacaaaaguuuaucuuugcacaaucaauaaaaauggcauuuuuuuaguaaauuaagagcauaaacaauauugcuagagguggcauguuuagucuaccaaaaacaauacuuuucaggcacuuuagaaauauccuuuuagaagcagcgagugcaugggcuaauuaucaucaaucuuuauguauuuguuaaagaaacaucuacaggaucuuuauuggugaccuuuuguaagacauuaguuugagguacuaccuauguacuugaaaauaauaaaguggcauuucuuuaugaa

SEQ ID NO: 6299 - RNA, 131606 nt, Homo sapiens
gacuucucaggcaccaccagcagcgccaccgagaguuauuauuauuuuuugaccaagcagcacauuuccugguucaguggcuugagcucugugagcagcugacuagucaccccgggucuggcucaggaucagcuggugacgcugggcuggagucuaugacuucuuccuucagauugucaugaagaaggggaguuaagaggaaacuggggguccuccggaaggcgaucugagcacucaggcugaucuagaggaagaguagaagucauacuuuuuuucucuugcuuggugaauuccccagcagagucuggauccagcagugcuguuuucccugagggaauguggagcagcucggcuugagucuguugccagcuucaggaaggguucagacugaaaaggggguuugaggagaagaugcuuuggcugccugagguccugcuugcguucuuagaagucagauccagggagaaagugaacugggacaauugacaagcuccaagggucuggcagaagcuuccuccgagacugggcauuucauccucccuggagguggguaagaaauuugcucuaauucacaaauuaaacagcaguauauuuucuaaggaggaugagaaagccagaucuagggccuuugcacugggggaggauauugggucuucguuuucuuggccagguagcauuuuugguggcccugcgaccccuuuugccuuuucuaugcugauuagaaagcucgauuacaaaguguuaugucacagcucuagggaguccugaagaaacgcuuaaaucuugaugcuuaagaagaagcagcguuucucuaaaaguguagcuuucuuuaaaaaaccauaauaauauggggaaaggggcuaacagaccaaauaccugauagcguucauguacaguagucauuucaacacaugaugucagaaaccauuaggggaucugaggaacaaggacucagcugagacuuccagguaaagaaauggcuuucaaauuauuuagguuuaauuuuagacacugcuuucagauuagaaauggugacagagcuucagaauaugacugcauagccuggcugaacacaugauucgguuugcccucuaugcuggguuucuugagggagugaucauaguuaguucuccucacucuuggcuucucgaaaaccaaucauagcauuacuaauuugccaugggggucuugcaaugaaauacagauuuuuaaucccaugguuuuuuguuauguggucuuggacuaugcugggguccagugggacuuuuaugaaucauaaauaauccaggcugggccaaaucacacugagguuagcgauccauaccagaugugaugccauccgcugguccaaauguggcucuugucuaacuuaggcacauagauuauuuccccagugagagaguucugcuucccauaucaaugcauguaugagcacagucaggggagggcuccagugugccaugaauauguagacauagacugccguguacugaaucugcagcugguaaggcugugauuugcuuugccugcacaucucuucccaaagaguguuuuaaaccaucucagugagacuuaaacuaaaugaagcagccuugccucuuugcuagaggccaaauuggcugcuguaauccugcuccucagaaggcuuacugccugcugauggcuuucacagaugggucaggaugaggguccccaagggcuccagaguaagucacaacuuugacauaauuaccauauuuuggaaauuuggauuuuaaugccuugagugcuuauaaagguuuugccuuuccaucaaaugcuccuuccccuugggaauucuguuuuucaugugaaaauuaaaacauacuggcuccaucgggcaucucagucuauaaagauucacggggcagccagaaagaguaaaauagcauuguuugaaaugguguguuuauaaagauuuacccaugaaaugugagggaauaaaauagaaauagaggaagaaagaugcauuuauggaagcuuaaagaaugagaagggaacuuagagguuagauaguaugagaugauauuuauccagggcucagacucuggagcuggaaagagcugaagauacuuaaagcuacccauuccugccaguaaaguggagagagcaauggaaucuauaguuagggugauagguguaaggauuuaaugagaugaccuaugcagagcacaguggcagccacauaguaaauauucaguaaauauuagcugcuauuguuguuguuguuguugucauuguuaccauuuugucauuaucauuauaaguguuguugcuaaaaaacaguauugaaaaggcaacauguucacauccauuugccugcagaaagguuuugcuagcagaaaagaugccaucucugguacuguuauauccaaaugauucccacucaaagaaacuuuccacccuauugauugaguugacagaauaaaguauauuauccagaacuacuguauuucacagaacugaaagugaccagcugguauaaugaaaaucauuuagaacuaacuggggcuuaggcagccuuaaagaaggcauccuguuuuggcagcugacaagucacauguagaaagcugcggggucccaguuggaaucaaugcauuucuagauuucucuucugcuucaccuaugcaugugagagacaguccuuuucuuucuuaauucuuuucagugcagauauugagcauuuucuucucuauccagggaggccauugaauaugugcuuaaccugcugguuggcuccucagaaguuccaaggcugaauuuuugccaccaucugggugccuucagcuuauggguuggcugcuaagggaaaggaauagcccuccccugccugccugccuaccauggcccagucugucugcuuuuguuuugugucacugcuauggcacaauuuugccaggcucguggucugccuccuucaugccggugggccuacuucugucacacaaguggacugcuguuucucccuuuccucccaagaucuuucuuuuuaauuuuggggaauuagaacucugacacagggaucugaaagacaaaagugaauuacaagagugagaggagucugccauaaaauucuuucccaagaaacucggaacugggaguuggucguuccugguugcuacugaucuuuaguagaguuguguuuugcacggagaauaauauuuauaccuuaaccacagcccaccucccuuacuuccugaugggagguaugaucucaggagaguugccugaccucucugaacuuuggcuuccucauaugaauauuggaaauaaaguccccugaaugcaugggauugcugugaagauagcggcuauaaugcccuugcccaauuccugguacugacuggauguugagcauauuucccaguuaaucccgaucugugaacaacagggggcaguaauuuuaauauuuauuuaacggagaaacugaaggccaauagaauuaaauuagaaaucaauaacaacaagguauuugggaaauccaaguaaaaugacauagcagaugacaaaccgugguacccgucuagugcuucuuuuaauaaacaucaguuccaaacacucugaauuugagaagggcucaaugacccaacugcacugccugccucgaauuagcagaaaccucuuuauuuaguagcccccaggcuguggucauuucuucugugcugucuguaagcacacaagagucaaaaggcucugucccucagauaggaauucuggguggcaauuggauaaagacuuucuuuugugcuuaaagauccacugaaaccuuucucuguucauucccuccaugacuguggugcuuauaaacagggaacugcuggugaccaugagcuauuugcaaacuaagaagcuugaggaugagauauuggccaaaucuguuuucuuuguugaugcuuuugagugacauuugccccuuugcucugucuuaaccuguaaacauuuaaaaugaaauguucugguuuuuaugcugugugugugcguguguguguguguguguguguguguguguguguguguaugaaucaagcaggggugaagaucucuuuuggggauugagucagucgaguuuggagacuucguuuucuuuuuucuuuggccuauugucugagcaguuuauuauuuggcaucugaaaaccauaggcuugcuuguuguguuauuucccuggggauaaggcagaggagaaaaaagcaaggcuggagagaggggagagagugugugaguuuggauggagcuuuaagaggaggggagggaaaggaagacagaauggagaagcagcugggagaauaucagagcaauugccaauccaccacgaaagugcaaagcugaagguucccuuugggugaaguugcaacucagaaggcaacucuguucuccuuuagcuaaaaacuccucuccccaucuguccuacaaaacucacagcgaagccauuuuaaauccgaaaacccuccuuaugacuaagcacugcacauguuuuccacuagagcaccauggaccauuucuaaaaguacauuaauuaaaaggagcagauuuucaaguacaauaugagccugccuuucccugguggguguaggggguaaacuuuagcgcauguuuggcuaugaagucuauaaagaucaaauuggcugaaccaagcacucagauaugaguguugacuuggaagaugaaaccuaacacuccagggggcacagaauccagagaugucgcugguuggaacuggaggcaugaagaaaaucagggcuggccucguuugacaaagcauugccagagucaugcucacucagaacagcagagugaaccuacaggaggaagcaauagucggggguucucugauagcucccuucuuccuggugcuaguguuugagcugcuguauguguuugagcugcuguauguaaguguuugagugcuguauccuggggcacugaaggcagcacaggagcccuuucuuuaucucuuuggacauggagcaagagccacuuccgguugguauguuuuccaacccagcacccagccugccucgagugauagguggcugacuugaguugccucgauuccucucacacugggagugcuauugucuucaagucacccuccucuccucgacuccuuaaaaucaaaccuuguaaauauuuuccagccccauccaggguuaaggguagccagggcagaaauucuuagcauuucauuucaacugggcaagaugccaauuuuuccagcucuuuucuuggcauccauucaucaguuaugaguccuuagagaugccugcucaugaaaguuccaagacuuaacuaagaaacagccuauuuucuauggucacaaaaucugguaagguuuuaagguaacuguuaauauagaaggcaauguauguuuugggugucuaugugucuguguauagucuaugguuaauguugauguggauguaugauaacugucacagacugagcgccuacugaguguuugcuacgaaagaugcuuuauguaaacuugucuuguuaauucuuacagcaaucaugcagcuagauauuauugguucuauuuaguaauugagaaaucaggacuccuggaaguuaaguaacucguucaagcuuacacagagaguaaagaguaaugcugggauucgaacccaggauaauuagaguccaaauccuguccaccauucuaggcuucuuuauacuuuucauuauaauguccccuggggauguguuuguuucucuuauauagcuccuuuaugaaucccucauuugagaaacaccucauuauuuagccauugaauuaaaaucucguugguugaucuuugguaaaguuggaaacacacaagagaauaugucagacuugaaacagaacauaggggugucuucaccuucugcuuuuaauguggcuuuuggaaugaaagugugagauugcuuggaaagucagaagacacccugagaugagaaguaaaaacugcaggcagguggaagaaguccuuugcuggacuacagggaacauagggaauucuucuggucuaaacuuguggcugugggcagagagaugggaguucggagagagggaagccaagcuuguugcucuugaucgccaguugugugcacaucagguucuaacuaaaauguauguuuccguuuucugagccucaguucuuucaucuugaacaugaagguccuaaaucaggugaucuauauguugucuuccagccaugaccuugaugagugcaaacuuucagaaugaauucagccucaucagggaaggaguguaauuugcacuguuggccacucuuggcggggaacuaaaaggucaaguuuuagaucaggaccugacuucucuguguugugaauaugugcuggaauaugagaagugguagccccccagagaauggcgggaagcuuccuggaagaacgucugaccuuuggaugcuuuccacuagugaagagggggugucagugggcaguguguugguguugcucguucacuuucagaagcucuccagggcuuuguuauguaugcaagcauccuacagagugcuagagaccaaggcuucucaaguuuaaugugcaucuaccugggggcguugcugaaaugcagauucugaauuuuuaacaagcuccccugggaugcugaugcuacuccuucuaaacuaccuuuauaauaggcauagaggaaagaaaauuugacuaaauucagaaaguccagagucuaguuccaauugucacuuauuugaguaaaccucaaauaaaucccucagcugcaccaugacucaguuucuccaucugcagaguaauaaaauaauauuuaauauuuaaugauuacugcgugccaggcacuguguucacuagguguucacuguuuuaugugcuguauuuuacuugauccuugaauuaggaggaaggguuuguuaccaucugcauucugcaguaacuaagcacagagagguugaauaacuugaccgaggucacacagcuaguuaguggccaacuugggauuugaauucauaucaccugacucuggaaccgucacaacuuacagacauaagagaugugaaauaucuugggacuuacugugugaauguguguguaauuauauuauauguacaauuacaaauauuucagguacuugagauuauaagaaguagauguuucccagaugagguuuuauuguuuuuaaguaaaaaauguucugauuuauauaaauuaagguaaaaggcauugugaaguuucaaagagcacagguguuugcucuguugucaccugggguggggaggaagugguacaugaaaggaguauucuggggaaugagggguucugguuaacugagguuuuggcuauuuuaaauuaaaucccaguucauuauccgucuugguuuuguaaauuuguacaguaugacagauacuuuuucugccuuaauaggaaaagcaggguuagcccaacugaguauaucuugugauucaggcuguggcagccaugcagauuauuguccugaaaaugaaucccagugauccuauuuuguaaggaagcccgaagagguugauugugaacauuaucugaguuugauauuugucaccucacuagacaccaggcuguuuggacuuuacucuuauaaauguccugaccauaugauuaguaugucaaauauguggcaccuguaucaccaugcuccagucuccuuaguccacuucagaccucacaaauaaucgacacguuuuuuucuguccagccccaaugcauccccagaguccuucucaacacagcacuggaggcagccuguacccaugaguuacaguuggcccaggagauuuacacuacaugcuaacccaacccuuggauacccccuggaaguugauucucuuuccaguuuaguaaauacguauugaacaccuaccaauagccuaagugugcuggaaugaaacccuauuuuccauuuacucuguauuuuauucguucuuacgaaugugaauguucugcaggcuuacugaaaguuuuaguuaauuacuuaauggguacaauguacacuauuuacgugauggauauacuaaaagcccagacuucaucacuaugcaguauauccauguaucaaaacugcacuuguacccccuaaauuuauacaaauuaaaaagaaaguuuaauuuuugguaaauuaaaguuuuaauagucuuuuuuucuuucuuucucuguaauauacauccuuuuauucugauuaauaccuuagggcuccugucccuuuucaguaccagugauguagggucuuucuccaggucuccugcugugaugcugucagaggaauaccuccuuuacaaggggcuguuuucuguaggcauccuccuggcaguccagccauugguuagguagucaggggauaugaagugcgugcuccuggcacagcaacugcauagcccucagcuacagcucuccccuuccccugacagcuuauccagcaagagucagaacuucauuuaaaucgcugccugagucuauuacuugcuuuugaguucaucaucucagaaguugccaggaaagccugucaagacuagaagcuugccacggacuggaaagaugacacccccacccuugcauccuguggagguugggccacuccgaagugccugccucauuaggaaggagggugaaaaugcacagcaaagaauucacgugcuccucucucaacaggagcuucgauucuugcuagacuggcuucugaaaggggaauaaguagaaagcagcauaaucacagggccugacugaucagaaagcuugaaccugccuucuuuucacugugucaguuuggcugccuaaccagcugccuaaacacucacguuguuugcccuuguaaugcuuaaaaaugguuuuaaauccugcaccacugaauugcuaagaugcagcauccuaaaugguaacuaugauaucaugugcuauuuugaauuuuuaaaagaauguuacagagagugagaaauagcaauugagcaucugcgagauguaaggcgcugacuuuggcccuguggguaguuuaaaauaucacagccggucuuuugcacuuaaccaguuuuccaaaccagauguuuuuagcuuaggaucccuggacagcaaaggacuggacagaauugaugaacuuucugaaauuuaaugcaaaauuuucugugaaugugcauauguccauuuuuuaagggagaggaucccagcuuucaucagauuuuaagggcaucaagucacccgaaagguuuaaaacugcuaaguuggcugguagguuguuguaaacucauccagagaaaucucuacagguuaaugugagacuggaaaaaauaauguuuuucugccccagagcagauagcccagagaaaugcagcauuuuucuacaugauuacccaggagcuaauguuaaacccugcggagcuagaaggagagaguuaccugauuuucuuccauucuguagaugaguaaauugacggucguggucucagaugccaaggccauaggaguucuuguuccuucuaucucucagauaguuuuuauuguucacucaacaguuuaacaaccuuuugaacauuugcugugugcuaggccagaguuuuucaguauuucuguacuugaggcguucuuucaaauacuugacauuuugcaguacaguaacagaauuaaauuacuacacuauaguuaugguacauugucagcuguaauauauuuuucucuaccucaucuuaagcuuuugcauacuuucauuuaauugaggacaaaggcagucuuucuuuaaugugaucuuggccaaacacuacucgucauguaguugaaucacauucuacauuuuugacaucauuguagcaauauacauuuucaguuauuguaaaaaaauaaauaugaaaaauaaaauuuacgcuuuggucauaucuuguuaguagcucacugguugcaguuagauuucagacuaaguauuagucaaaauuucaaagagcuacuuauugaaugcuuauuauucuagauaaaggauuuuaaaauuuacauuacaaugggaaaagguauuuuagacacaccaacaaauaaaauggcgucugauguuaaggaaaagaugucuuugguugaugaugggaauagugaaaagcagaccagcuccugaaguacugagggaaggguguuuugggccgaggagcagcugcugcaaagauccuaagagagggaaagccuuggcaaauucaaaggacaaauaaagacugcugaggcuggaacaagauggggaauagaguagaacaaaauaaauuuggggagagaggaacagaccagguuauauagggucuuguaggcuaugguuaaggaguuugugcuucauucucacuguugucagaaguuaauggcacauuuuaagcaggagagcugaguguuaucaucauuguuuaaaaaacaaacggugguggaaauuagauucuagaagggcaggcauggaggcaggaaauuaagaaguaggcuauuguaguagcucaagcaggagguaauggugaguuggaguaggauaguaaagauagaggugguaaaaagagauaaugaauaaaugacuaagacucaucccgugcaccaaggaaguccacggucccggcuccuccuuguucguuucgucaacuaugcuaaaaguguguaggcguugcuacaucuagcaggcuugggacgcagugcgggggcugggauggaggagggguacauccuucaaccagcaccuugucaaaucggaguaaaacaaauuuuuuaauauuuucaaaaccuuacuccuguagacaugugaauccaauucaucaagggcuucuuuccaaaaaaucaugaaaccaggaaaugauauuuucuuucuguguacuuuccuccuuccuuucacugcuguaagaaugaggaagcgaguuguagcucagaacaaaaccacaaaaaccuuuccauagauccagcucaaaucagggaaaucagcaucucacuuuugcugccugucccuccuguagaaaacccugagaauuuuguuuguuuuguuucuuucuucggacuugacuaaagccaggucucuccugaaaauaaugucuuucccuguugugucuaacucaaucugaauugaggggcuuuacauccagcauuggugucugguaaaccuccaaucgcucgauucucuuguuucgcaaguccacuggggucguccggagccucuggccuccuuugcugagcaacauggauuucugggaaguuuuucccuccagcacuucagcacagauauuaaagggccccugucaaguuuugaagggugugaccauugccagaaucaccacaagccaagccccugagggauuccgcugccagcuggcucacguccauaccagagauggcugaauuucugugguucucugugcauggagcuggcccaguuccccuggaugaaaggcggccuaauauaaacugaaaauguuauuaauaagcagccacuuaagaauuuccuaugacuugccagugauuugggggccucucugugaacaggggaaaaagcacaucuuguuuuacauggauuaagggaccagugcagccagucuggaggggcugccaaaagguauucagguguuuggugaagggcuuuggguaaguuccacaaacucguugagccuugguuguccuaucuguaacaugagaaggauaacaauaauuuucuucucauagugugguuugaggauuaauaagaaaagcguggaaagcguuugacacagagcuuggcacauacucagaaaauguuuucugaaaaaaguuggagaaaucacacccccaaaaugaagccaaacugaccuuaugccccugggcucaggggaaaaugaguaaacuugggguuccagauaccuccagcauucaguaguaaccacaguacuuggcuucucugaacuucacuuucuucaucuauaaagaaccccugcucuucugacuaaccuuguagagauuauuggcaauucaaaaguuacaugaaaugaaagggcuugguaacucuaaaguccuugauucauccgacaggucauuaauuuacugucuaaccugucugccuuauugcaacuugguaugaaaagaaagucauggccgggcacgguggcucaccccuuuaaucccaacacuuugggaggccaaggcggguggauuaccugaggucaggaguucgagaccagccgggccaacauggugaaaccccaucucuaugagauauaaaaaauuagcugggcaugguggcacaugccuguaaucucagcuagaugguggaaggcugaggcaggagaauugcuugaacccgggaagcggagguugcagugagccgagauugcgccauugcacuccagcuugggcaacaaaagaaaaauuccaucucaaaaaaaaaaaaaaaagaacaaaaaacagucauuaguaugaccuugaaggauuaaaaacuuggucaaggauacauaauccuuugguagggauaauaaugaaauuaccuugcucaguccagcacaccuuuaaguguacacuaaggauuugcuaagauuuaucaaaaugaauuguucaccacccgucuguuuuccauugaucucuuuccauccuagcuggaaauagauuaguagggucuagguugacuucuagagaacaagaacccuaaauacuuuuguuuguuuguuuguuugacuuuguaucccuagacauaggguaggaccuagcacacuggcacauagucaaguuucauuauaccaagaauguuguauauauuaaguuguuaaauccuaguggcaacucagugaaguuaggauuugagcccaaguuaugguaaccacagaaucuaagauccuaacccacugugguauacugccuuuaaguacuuagggaauauuuuaugccucagaucuugucuguauaaguuuagccaaccucguccacaaagaagguagagacuaaacaaguacuucagcagguggcauggaagagaaaagcaaacgaagagguguuuuguggagucuucugauccuugccuugaaguuuggagaugagguguguuagaauucaguuuucauucauuuccucagaaauuggucccccaaaggauuuaucuggaaaggaggggcucuuagaacuugcucugauaaauguccaaugaagcaaaagugugcaugccauaaaaucacagguggcauguagacaaagugaaguggagaaauauaucuagaaggaguaaccaacucuaucuaccaugguuuauucuuugcagaacagcaggucugacaggcagcugaggaaaucggagcuuuucuagauaccccacagccuugcacagggauacagugauguggggaugcagguaguaguguugccauggagacaccaucaguggccaagcucuucuccuuugagggcucacuccgucuacucaucacgaaguugaauuagcucucuaugugcuugguaggcagauuccucacuggcuugugaacgcuuuuaaaauaaagccaaaacuccuucccagcugccaucuuguuaccauccuagacuccugucaacaucucagugacagcauguucucucccccugccaugacuuuauucaccuguuaggacuacuuuuucauuaucuuuuuuccuagaaaccucuccuacucaguaaccuuuggguccagcuuccucaagcaggccuucccugaucuguuguuaaccaggaaccuucuguagcacaguggcuaacacauuaaugauggccuaacaaaagagucgcaguaccaaccacuuucuuuguuuuaaaacuuuuuauuuuguaaaauugcaagguuagaucaaaguuacaagaauaguauaacaaacucccaaacacccuucuagauuuuucuguuaauauuuugccacauuugugcugcuuauucucucccucuguuccucucucuuuccacacacacaggcauauacacauaucauuuuuguugaaccaucugagaauaaauugcaaacaucaucccuuaucuguauacauuucagcaucuuucucuucagaacaagaacauucuuuuaaauaucuuuuucacaagaacucuccacuuugaaauuuauggucuagcuauuucuggcuguaucauugugucagauagaaacuccuuuuuauuuuuuuaacuccuugcaacaccuaccacaaugcaugguacacaguaaauuuucagugaauuauuguuuaauaaaugaaguugacugccacaaguauuucggcauugccucuguuccgccuuuuggacucaugguuccugcuucuguagaaacucuaccuuguugguugagccugcuugucuugccugugggagagggcaaagagcaccaaggaguggucuucaaccaauggcuguugagaguugguugauaaguaccccuacuuccuugacucucaaggggaauguaucugaggaauguucuguacugucucccagagguccucagcugaaaugaguucugguugcucaaagcugcuaccuguucauuaacuuacacucuauuggcauccuacccuuccccacuuucauucuucuguucccugucaggccuuuuugggaucuucucccacaagauucagauaccuuccaagagucugauucuggggaaaaccaaucuaagauacugccccucaaugacugaggcaucauuucugcaaaucaaaauacaguaagagaucuuuaaauuauauguuuccaagcaaagucacccaggaggcuuauuuuuaaaagggaaggaauuuccacugcucaaaaguuacaagauaaauuagucuaaaguaaggcacugcauauaauucuucauugaagcaugaauuggcauauuaaaaagaggaaacaacugccccugaaaauuacccuguaccaacuucagcaaccccugggagagagaagcacuucuuggugcagauggccagagccgcuggagcccagccggaagggagggaguuggauaggaccaggcaguguggucuuggcacucagcacacaccagccucauacccagcuggccccgucacagucuccgcccuugagcuucuguguuuauuaggaaaccauuuuuccuuucucacagagauagaaaucuugcucccagacauggcaagugucaagguucaugccugggucccucauucagacugaguguuugccaaaaaaggggaaaaacaaaguauuguggcuaggggcagggaguuaaggagccaguaagacugcaaauaacaggauaugcugacgucuggguaucaagacagagggauauagaaauuccaaggagaaacggguuagggaggacgcgaaguuuccuacacccacuaaaauggcaccguccccugaauuucacaucugugcuugggcuuugggacaggcaguggcccagccaguuuggucacugucauuaaucuagacagugguggaggaggagggaggccacaauaucaccuucugagaaugacucacacagugcucuuccccaccucaggaccugugugcucacuucuucucugccgggaaaacucguacucugauuuuucucauaucugccucauagucuucucaucacaacucaaaugucacuucagugggaggcccguccucacccauccucaguuccucucuuucugauuucccuauuucugucauaacacuuaucacaaucuguaaauggcagguuuaucuguuuguuuacuuaacuguugagugucuuccucacuugguucaaagcuccacgaaggcaggcauguugucugucuuaaugacugucgugugcccagcaucuuagugcagugccuaacacacaguagcugcucagucaauguuggugggugagugggugggcaguugguugguugguagguugguuggcuggauggauagguauggauguauguauggauaugaauggauggauagauggguggauggauggauagauguggauguauuuacagauaugaauggauggauagauggauagauauaguuguauguauggauaugaauggauggguagauggauugauagauauggauguauuuauggauaugaaugaauggauagauggguggauggauggauggguagauauggauguauguacggauauaaaugaauggauagauagguggauggauagauaaauauggauguauguauggacaugaauggauggauagauggguggauagguggauagauauggcuguauuuauggguaugaaugaauggauagaugggugaauggauggauagauauggauguauuuaugggauguauguauggauaugaauggaucgauagauggguggauagguggauagauguguauguauguauggauaugaaugaauagauggguggauggauggauagauauguauguauuuaaggauaugaaugaauggauagacagguggauggauggauagauauggauguauuuaugggauguauguauggauaugaaugaauagauagauggguggauggauggauagauauggauguauguucggauaugaauggauggauagauggguggauggauggacagguagauggauggauauggauggaauaagagaaggaauauuuugacacuguaccuaaaacaagguaggagaaagcacugguuuuagagucagaugacauagguccuuaacuucagucaagucacuuaugaguuuaucagcuaaauuuuuauaucugugaaauggauaaaaaugccaacuuuauaggacugcugagagagaaaugagauaaauuaagugaaaauuauugaauauuauaaaccuucacaaguaugagcaguuguguuaacaguagaacauagcugcucuguucaccccucaccugccauccucagucaaagcacagguugagcuagagcaacaggagucagagccuggaggucacaccugccaccuggaggccuugaucuuuuggagcagauuuuuaccucuuggaacauucccauuugauuucaggccagccucuacgaauauauuuucuuccuuccuuucuggcguucugacucuccgcuuaccccuuuugcgagggauguauaagguaggagcugaagcccugugugggggucacaugauccauacaguucuugaggagcguugcuugugcuuuuugugauagcucaauuuuaacaacucugaccuguucaaggcaggauuaucucagcaauaucuuagggcaggcagaccuugcuuccaguucuuacagacucagugaaacacaaccggggaaugccuuucuugcuaacaacagccacuguccuuucauuugcuuaccuuuucuaggcagccugcagucuagaaaaagcucucuuuacccagacaccuaauucccuccuaaaaccugacggagguguuacuaaagggcaguacacuugagaagaauguuugguucauuuuaggcugguguugugcgugcaugugaagaguugaugcuuucauuggaaacucagggaaaaugggcuacagagcagauggaguaagucaggccgcugcccagcuccuccugcgucagccuuucccagagaucuauuauaugguuugaagugauguaaguuaucgcagcauuggagguuauaugacuagcguacaaagacacaauucaaagccaagucuuagugguuuuaaauuauccgugccgcaucucucuccacuugcacagaaaauugcaaguugauagcuagugaaaucugguugucagauuuuuuuuuuaucgaagggaccuaacuuuuaacucugugauacccguaaguauauguuauauguaauucccacguuggagguaucuuuuacauuacauaaguggauuguugauccugcugcagggcaccaguucagaacagacccgcuuaucuggauugaauaaugcacaucuauuugcugagaguguugugugugcauguguggguggcucuggcucaugucuugucguuaccggccagagucuuauccccuggcucuggcugaugaggaacacguagaaugaagucuggucuccaguuucuuaacacuaagggaaaagaggaccagcagcuguuucuguuuaauggugauuaucuuugggauugugaguguuuugaaaauuuuuuacucuuacuucuuaucuguaguuucugauuuuuucuacauuaguuguauaguuguauauugcuuuuuaaggauaaggaaguaauaacuuuauaauaaguauaauaaggaggaaaauguuuuccucuuuuuuucuuauuaagaaugaaaagagagcugggcacagugacucaugccuguaaucccagcacuuuggaaggcugagucaggaggauugcuugagcccaggaguucgagaccagccuggguaacauggugaaaccucauaucuacaacaaauacaaaaauuagcugggcauuguggcaugugccuuuagucccagcuucucaggaggcugagaugggaggauugcuugagcccaggaggucgaggcugcagugagccaugaucacaccacugcccuccagccugggugacagagcagacccugucucaaaaaaauguguucuuuugccuuuagugagcuagagucauggaagaauuuaaauaccuaggauacaucuguuauuuagcaaaaagcaauggagagcuuuggguuauuuuagcccuuguuuuaaacaaaaguguguuuucccaccucuggccuugccugccuugggcauagccauguugaauccuauguugugcauuccuugucagucacuugguuuguacuggggcugaaccacucuuuaagcagucugccccuugucccugugcaugaaaguggccugaaccugaucuagccauggacuugggacagaggagcccacaccacaggggagguggaagucaagacagauggcagggcuagcaacaagagacacuauucucaugucugauguagucuugccuuucaccagugccuuuucacaccccacuggguacccagcugaguggcaggagggccuagugaugcaagagguuaagacaugguggcaaggaagggcuggcauagauucuuugggacaguuugaaaauguacauugcccagaguugcugagaccaucgauuauauugguaaaacccacaccuguuuuuaaaccacacucuacggcacuccuuucugacuaggaggcuacuacagaagaguggccuugagcugugcuuggaggaccggcugcaucacaaucaccaggcacacuggugaaaaugcacauuccugagccugccucagaccuauccaauuauagucacugggacauccuacuauuccccaugcaucuccauguaaugucuuggcaaccagauauacaguuucucacaacuagaauuauuauuuaucuaagaguuucaugauuaggaauuauuuauuucuuaaaagccguuaauagccucuauauuuuuucuucuuuccaucuagcaaauuaccaagcaccuacuucauauuuuggcacaugcuagaaaugacuucguggagucuaggaaauauggugguuuuuagccuuguggcuuuggaaccuugagaauuucaaggccaugaaugugccuggaguuuggggaggagguugagcuuaggagaaguugggcucauagucuucuucuccacaucaacuugggcagcccuguuuucuguuuugaguuuccacuuaugaauucuuuuacaaaauguauuuuccucuuauuaagaagcgggggggaauaaaagaaacagaaaaguaaaaaacaggcuuaaugauguuugcaaucccauucgaaucucaauuucuacaauuugcuacuugaacuugucaaaaaucauguucuaaaggaagaucccuuuuuugccuucauccuaucacuucucacauaaaacaagaccuugugguucaggguucgguguuguaaauaaccugucaaaaucucaaggauaaguauuccugccaccaacccuguccccagucuacucaugaugaauccuuucaaguaauggcaggcaaguuaauugguauagauuguuagucauuuuccaaaugauaacggccacuggugcagaugaccaagcuacuuggagauaguuaaagagagggucuccgccugacaauacuguguaugccaugaaagggcuaauuauggcugcugagauacggaagccaugauuuaaugcugcaacuuugggguagaggauuugcagagguuguuuugggguagaggagaaugcagaaucuccucucucuaaaucaugccuuauuccucagaaaccugucauucacaaacccaauuaugugcagauagaaugucaacucugacagaaugaagccaaugcacccuuuguauguuuuuuuuuuuuuuuaacgaaauccugcuuugcuagcagguucuauuuucauaaaugucuauuuaaaaaaaaagccaaaucauauauuuccccacacacuuccgaauauguuucauucagguuaaaagcuuuaaucaguguguugaaagagagcuguuggguguugcugugugcauuuugccaaagggggagagaugcaggaaugaagagaaauccucuuagcaucacuucugacccucugcccccuucugagggucugggccuuggguucccaauuuauacauggagguuauuaaauuagccauuaccaaagguugucauggaaucacucaaagguugaaaauucuuuacaaagaaaaaugucuugccacgggagugccaguuaauuauaaaugagaaguggaaggcgggcagcuagcauggaaaacagauaagguccuuguggcuuugaguuacuauuuaggguuuugguuuuuuuuuuccuuuucuuccccccuccuugguuuugcuuuugcgugugugugagguuuuuuguuguuguuguuguuguuguucagaaguaaaaggguauucugugguuggaaucagauagauuuucuauaaguaacuuuuugcuucaguggucaguuagagccuacuuugaguccauguucugcucacuauuuaggguugaucaacugcucugaauaguucaguugcuuaacugcuuacaagccacuuaaccacucugggccuuuguuuucuuccgugggaaguggagauaauauuuccuuuccuggaggacugauggaagagucuaggaucauguauguaagguauaaagcaacuuaaaugccaggcauauggcucgguauauguccccuccccauccugaccucccauauccugcuucuuucugguuuucaguagcacuugcugccuuuaacauacuuugugauugaaaggcuuguuauguguauuguauguuucuccccucugagaacguaggccaagagggcagggaucuuugucuugguuggguacccaaguaccuagagcaggccuugguacgugguaagugcuugauaguuauuuggguuuuuguuguuguuguuguuguuuuguuuuuguuuuagaguguauguguguguguguguguugagacagcaucucgcucugucacccaggcuggaguguagugaugcgaucugggcucacugcaaccuccaccuccuggguucaagcgguucucgugccuccaccuccugaguagcugggacuacaagugcccaccaccaugcccagcugauguuuuuuuuuuuuuguauuuuuaguggagacaugguuucaccauuuggccaggcuggucucgaacuccuggccucaagugauccauccaccucgaguuauuuguugaaugaccacauggggccucagcccuccccaucgucucuuuucuguuuauccuucuacuugucgaugcucauucuggaucugauucugcacuccuccuuuguuuucuuguuaucuuuauuccuucuccuggauccucaguucguuaaaucauguccauccggcauuagugugcucuucccugcauaauuaguaugugaauaaaugaguuuaauugguggauauuuugggacugaauuugguaaaaguuuucuacauuuugauguucaaguaugacuuucuaguaaaaagcauuagucaccaaagagcuuagucaacuuacuuaaacacauugaaacuuguuuuuccuuaagucauaaacuggcauaaaaauuucuuggagaaauaaacugacugcuucccaacagaccugaccauugugcaguagcugauuaauuaaagaguuacuauucaaaugagcucugacuauuuuuaaaagcaacaaccaggguuuggauggaacuucuuugaguuggagaugcaaacgagauccaaggugugcauucugucugguguauauuucugauuugaugagaagcagaaagugggggaaucugacaagccaaaaucaguuugguuagacuaaacugauuucguuucuucaaguacauuuuuauguugaaauuuaggcacaacacauuaauagaauaaagacauaaaauaacuaaucaucuugauagaugcagaaaaugcauuugacaaacuccaacacccuuuugugguaaaaacaacaaacuagcauagaagagaacuuccucuaccugauaaagagcauguacaaauaacucauggcuaacauaauacuuaaugcugaaagacuggugcuuucccuuaagaucaagaacacaacaaagauguccacccuugcuacuucuguugaacauuguacuggagguucuaaccagggcaauaagauaugauaaagaaauaaaagacaucagauuaaaaaggaaaaaguaaaacucucuauuugcacaugauauggucuuauauauagaaaauucuaaagaauacacacacacacacacacacacacacacgcacacaaguaccuaaacuaauacaacuaauaaaugauuuuagcaagauuguaugauuuaacaucaauauaaauaucauuuauguuucuauacaauaacuaccugaaagugaaauugagaacaauucuaauuacaguagcaucaaaaagaauaaaauacuuaagaauaaacuuaaaagaagugcaagccuugugccuaaaaaccacaaaauauaauugaaagaaauuagauugaaguaaauggaaagguagccuguguucauggauuggcagacuuaauaucauuaaaauggcaauacucuucagauuaauaaauugaucuacaaagucaguguaucucuaucaaaacucuaguuggcuuuuuuuugcacaaauugacaaacuaauccuaaaauucauauuuuaugaaugcaaaugcaagggaugaagaagagccaaaacaguuuuuuaagagaagaacaaaaauugcuugacucauauauacuucaugauuuuaaaacuuaccgcagaacugcagucauccagacagugugguacuggcacaaggagggacauacagaccacuggaauagaacugaauguccagaauaaacucuuacagcuauggucaguagauuuuuugacaaggguaccaagacaauucaaugggaaagauuauucuuuucaauaaauagugcugaaagaacuggauagccacaugagaaugaagguggacuccuacuuagugccauauacaaaaauuaacucaaaauggaccauagaccuaaauguaagagccaaagccauaaaucucuuaaauuaaaauguaagaauacaucuuuaugaccgugaguuaugcaauggcuucuuagaaaugauuaaaaaaacaaaagcaacagcaacaacaacaaaauuagacuucauaaaaauuaaaaacuuuugugcucaacagaugucaucaagaaagugaaaagacaguccacaaaauggaagaaaaaauguuccuaucacauaucugauaaaggacuuguauccagaaaauaugugaagaaagcuuauaacucaacaauuagaacacaacccaaugaaaaaaaauggacuaaggauuuguauagacaugucucuauucuaagaagauacauaauaagcacauaaaaagauauucaacaucauuagacguuagggaaaugcaaaucaaaaccacaauuaaauacuguuuuauacccacuauaguagcuacaauaaaagaagacagacaauaacaaaugugacaagaauauggagaaaauggaacacucauucaucaguggugggaauguacaaagguacagauauuuugugaaaacaauuugggaguuccucaaaauguuaaaucuaaaguugccacaugaccuagcaauuucauuucuaggaauauacccaaaagaauuaaaaacuuuggccaggcgugguggcucaugccuguaauccuagcacuuugggaggccgaggcaggcggaucacgaggucaggagaucaagaccauccuggcuaauauggugaaacccggucucuacuaaaaauacaaaaaauuagcuaggcaugguggcaggcaccuguagucccagcuacucgggaggcugaggcaugagaauggcacgaacccaggagguggagcuugcagugagccgagaucgugccacugcacuccagucugggcgacagagcaagacuccaucucaaaaaaaaaaaaaaaaauuaaaaacauauauccgacugagggcaguggcucaugccuguaaucccagcacuuugggaggcugacgcggguggaucaugaggucaggaguucaagaccagccuggccaacauggugaaaccccgucucuacuaaaaauacaaaaauuagcugggcgugguggugcaugccuguagucccagcuacucaggaggccaaggcaggagaauugcuugaaccugggcggccagagguugcagugagcugagauggcaccacugcacuccagccugggcgacagagugagacucugucucagaaaaaaaaaaagccaggcgugguggcaugccccuguguggucccagcuacuugggaggcuaagacaggaggaucgcuugagcccaggaggucaaggcugcugugagccgugauugcaucacugcacuccauccugggaaacaaugagaaccugucucaaaaaacaaaacaaaacaaaacaaauauccacacaaaaaauuauacauaaguaaucagagcaucauuauucauaaaagccauaggugaaaauaguccaaaugugcacaacugaucaaugaaaaugugguauaucuauacaauggcauauuauucaacaauaaaaggggaugaaggauugauacaugcuauaacuuggauuaaccuugaaaagucauucugugugaaagaagccaacuucaaaagaaccacauauuauaugauugcauuuauaugaaauguccaaaauaggcaaaaccauagagacagaaaauagauuagugguuguuagagccugggggcagagggauaugggaaauaacugccaaugcuccugggguuucuuuuggggaggggaugaaaauuagauagugaugauucacaauuccgaauguauuaagaguccaugaauuguacacuuugaaauggugaguuuuaugguuuguacauuguaucuucacaaagcuguuaucagaacguucaggcacaucuggggauuaaaauucugggcucuuuuaucaccuuuauaaggugcuacggaaacuaauaauuuuaaaaagagugaacauggaauaacuuauuuccuuaaaauuuuccuccucuauucuuuuuuucucucuuuuuauuuuauugguggaagcuagaaaugcuuuuguguugcugacaucaacauauuuauugcuucaucauuucuguagcuauggauaagagaacagaugguaaccuuaaaagagaaauguucaguuugggagauuuuuaucuuuggcugcuaccuuuugaaauaauucacaugcaugaucuucuuguauauaaaaaaccccaccaacauagggaaaauuuggguuucuaauuagaauuccaaaccuacagggaucuuuaauggaggugaaauugucuuuccuaugagaucuuagggccagauacguuucaugagaaaaaauauguauguuugcucuucuucuuaaagaacauuuuaccugcauuuuuaaaaccauuuucuccauuuuccagggcuuaggaaccuuuuauaaaagcaguauguugucaguauuuguuaaaucuacaaguaacacuucaggucaacauauguauuauguauauuuaauugcuauugcagucaaggaaauuguggucaugggccauauccaguggucuaccuaguaaaauaaaaacuauauuaccauuccucuugggguauugauuuagaagagaaggcugggguccacauguaaacacccuuagcaugcuuaccugguggccucugaccuuucaugcuguuuucacaugcguguaccacgcccucugcaaagacagucauguucuggaacacugcucgcgaugccuuugcccgaugcccauugccaaggaauguguuuaugguuugggauccaggggcuagugacuggcaggcucuuggaaaaaaaaaaagguuuuuuccucuuucucaccuucuaccuuuacugccugcaggaagaucugccugcacugcaaguguccccaggaggagcacauggugacagugaugccgcuggagauggagaagaccaucagcaaacucauguuugacuuucagaggaacucgaccucagaugaugacucaggcugugcuuuggaagaguaugccugggucccgccgggucugaagccugaacagguaccauucuggaugggagcaugcuggugguuuggguguuucacuuugccuuacugguccuuccucauuccaguucuguaggaagaguagacuuugcugauucagagaagugguagggcuaaauauguugaagaugccaggggccccaguggaaaaugaggaagggaaaugaaauugagccaggagugauccauugcuaauucauucuguauugucauuauuaacuguuaccaggauugucuagaaacaucucagagguguaccacauuuuucucagugaaauacagccucuuguauuucuugguacuucaaauuuucuccucuaccagccccauguuguuuaagaagcucuuuuauaagcuggguauuuucaugauguuuccugugagaaucugaagugccagaaucugaaguguuugaccacuguugacuuccucugacacauaaaauuucuuucucaggacaucuucucuauguccaacaaaaacguuuuaaaguuuaaacagcccuugaaauuuuuuuuguuuuauuuauuuauuuauuuauuuauuuauuuauuuauuuauuuauuuuagauagagucucgcucugucgcccaggcuggagugcaguggcgcgaucuuggcucacugcaagcucugccucccggguucacgccauucuccugccuuagccucccgaguagcugggacuacaggcacccgccaccaccccuggcuaauuuucuuguauuuuuaguagagaugggguuucaccaugauagccaggauggucucgaucuccugaccucgugauccguccguguuggccucccaaagugcugggauuacaggcgugagccaccacacccggccaucagcccuugaaauuuuaacuuggaaacuuuaggugugauaaugcuuuuagggaaaauucuuuuuuuuuuuaacuuuauuuucaguucauggguacaugugcaaguuugucacacagguagacuggugucaugggaguuuguuguacagauuauuucaucacccagauauuaagccuaguacccauuaguuauuuuuccugacccucucccuccucccagccuucacucugugguagggcccaguguguguuguuccccacuauguguccauguguucucaucauuuagcucccacugcaugagaacaugcaguauuugguuuuguuucuccauuaguuugcuaaggguaauggccuccaacucugugcauguuccuccaaaggauaugaucuuguacuuuuuuauggcugcauaguauucuauuguguguaugagucuaauauguagacucuauaaggaacucaaacaaauuuacaagaaaaaccaaacaaucccauuaaaaagugggcaaaggucaugaacagauacuuaaaggaacgcuuauacauuguuggugggagcguaaaugaguucggccauuguggaagacagugugacaauuccucaaagaccuaaaaacguuaauaccauuugacccagcaaucccauuacugguuacauacccaaaggaauauaaaucauucuauuguaaagacacaugcacacguauguucauugcagcacuauucauaauaguaaagacauggcaugagccuaaaugcccaucaaugacagaccggauagagaaaauuauuuauaauaaagaagaacccaagaauucacucauaacuuaagaguagugauacuaauauaaacucauugauuagccauugcucauuuucuucuaauuuugaaguugcaaauuggcagaugaaaucagggacacgguaggauuuguuuagccagcaagguauuguuuuaaaauuuaauuagcuacuaauacuucaaaauuagagauuuuuucauguaaaaguuuaugucuugaaauuuugaagaucuggaaucucauuccuguaaggauauaauugguuggaguugagugauggccauuccuuuuagacaaaacaaaacuugauuauaccgaaucauccgagucucuacaaaguccuuuuuauucuuuuguguuaccuuccugaaaccuacaggcacuuccguuuugugaucucuguucuaauucucacuacaggggagaaaaugucuuagaauagaaacacucccagaaaauaaucuccaugagaauugaaggcaauucucuguuggguuauuaacaggaagaaaugagugcuuucucccagucugugaguugagguuauaucuucuguuuuaguaaagauuuuauuauuaaauaauuaguuuaagaagaacgagaguguuugauugaguuuguuuagacacucagagaggguaguggcugaccgcauaacuuuguuugacauugccauucuaccaccaguacuugaacaguguguuuucauaccuagauacaccagugagcuuguuucauuuucuugcuaaccuuauuuccaacaacuucugcuuuaagcagcccaucuuucuuuuguuuaccugaaggauguugcuucuugcuaaauugggcucugaauuuuccaaaguuaagcuuuugucaguuuccugcuuaaauagaguuuucucuaagaccauuaaacgucauucccugaaaugcagauucagagaaaacguucuacucauauugacccaagaaaaaagacaauugcagaagcuaggguuuugauuaaauuuaugauuucaaaagugagugcuaaugguauuuuuggaggucccuugacucauccaaaaugaaugucuuugggaagcauaaaucugaaaugucuuugauuuguuuugaaagaaagucauuagugccauugaacaagugguuugaauuaugucaaaugaaaggguaguccuaucucuaauaauucuguuguucuuuggaugguuuucccuauuuccuacacuuacucaaaucuuuaugacacagaugauuagaaaaggaaauagcucugcagagagagacaaucuucucaaguuauuuuaagaauucuauagcgccuaauaaaauaugcaucuauauuaaugguguuugaaggggucauauugcauguaagaaaugggcuucaaauuuguaaauuggaagaucuuuuaaagucuauuacguauagcacuguuuaugaauuuaaagguuuuuuuuuagaaagcuguauaguaugcuguaagaaaaaauugaguuccuaaaugccguucacuaauaaaaauucugauguuuaauaucauauuagcugucugagaaagucuauuuuucuaucaagagaaauuauagugaguguaaaaaugcuuuguccuggaggcaaaaauauuaaagaccaguuaggguugagaguaauguacuuucauuuuuguuagaaaccuuucauuucacucccaggucguagguugguaauauaccuucaggugauacucuuuauuauuuuauuucuccugagaaaugccuucaauugaauauaauguaaacgaaaguccccucccuuuuagggaaguguucucgaauacggacauuuaauuucauaaaaaugcacuagcuguaaaacccagccuuuuaaaaauagugggaaaauaauaaauauaacagaugaugccagaaaggaaaggcauuuaucuugugaucucuaaugacugaacugaaaacugaucagagaaguuguucagauccuuugccucugcucacuccaaauaagggguuuaaugguagcagaacagagggcuggaauaugccccuaguugaucaucugaagucuuuuuuacuuuuuuguuuauuuuuauuuuuuuaagagacaggguuuugcugccacccaggcuggagggcagugguacgaucauagcucacugcaaccuugaacuccugggcucaagggaauccucuugucucaguccuaaguagcugggacugcaggcacaugcugccacacccagcuaauuuuuguauuuuuuguacagaagggggucucacuauguugcccaggcuggucuugaacuccugaccucaagcaaugcucccaaagugcugagauuacaggaugggccaccacgccuggucugaagacauucuuaaggcuucaauuucauuucaaacucaaacagugaauaguguauaccguaucucuuugaggugcuaggaugauacauuuacaguagauaauauuaaaauaggaacuuagaaaauaauuaacaagcuauaagaagggcagaugaugaagaggauuucucagccucagcacuguugacauuuuggacaggauaauucuuuucuguggugacuguccucugcauuguguaggaugcuuagcagcauccuuggccucuacccacuggauaccaaaagcacuucccauuugagguaaccaaacaugucuccagacguuacccaauguuccuggggaauaggaggaucacuggguggaagugauguuaaaaacuggaggacaucucagcagaauucuggcccaaucaagacaaaaaaggaugacucaauuuagcaaacauuuauugagcaccuaccaugcucuaguuccagcuuagaacaguuguugccuuguaauauggucgaguauucagcagagugaaaaaguggggaucccacguugcuugagcagaucccugaggcagauccugccaucuucacuaaaucaaaaugagaauuggagcugcaugaccagcuggcuguggagggucagcuuuuuguucucuaaaccaaaaagaacuuuuuccucuuuuauaaaagggagacuuguucauuaaaaaagaaaagaaaaaaugugagacauccaggaaagcaaauaaaaaucacucacaauuccaccaaccaaggaaaauuguguuucaaccuuuuugccugugcauuagucuguuuucacacuacugauaaagacauacccaagacuggacaauuuacaaaggaaagagauuuaacuggacuuacaguuccacauggcuggggaagucucacagugauggcagaaagcaaggaggagcaagucaugucuuacauggacggcagcaagcaaagagagcuuuugcaggaaaacuccuccuuauaguaaccaucagaucucgugagacuuacuaucacgaggccaucaugggaaagaccugccccaaugauucaauuaccucccacuggguaccucccacaacacaugggaaugcaggaugagauuuggguggggacacagccaaaccauaucagccuguauauucaaguuucuauguguguaggaguauauuucugcuuugauuuggacaaaaaugugaugacgcucuccacuuaucuugagcugucuuuucuaggccuuauauugugaacauuuuucugcaucaguauauuucgaucuggauuauccuuuguaaugguucgauaguuuucuauugguagguucuaaccuggagugguaccacugccucuagagggcauuuggaaauguauguuugggagagggcaauuacugucuaaaugacuaggggacuccacuagccuaugcauggguccuugagaugcuaagcaucccaaaaaguaccagaugauccugugcaaaggagaauggacccaucucaaaugccaagauaccaucauugagcaccauggagcugaggguuuaguuuugaccacuugcauuuauuggcagcuuuccucuauauuacaagacagcagcagcuaaccuuaugcauuuuauacaugugccugcuccuuuccauaagcguaauuucuggagguguaguggucauguguaagcuucucuaagguuuuagauucaugaugcuacaccacucuccaggaagaucauaacugguaugucuuguggguggauagcuuucauuggaugcaaguggauuuuauauuaguucucguccuugcugcuccaugaaacucugaagaggccaucagauuguuucuccugaguggaugucuuuuucauugauguuuuggaugcucccaaguguucauggaggguacuuaaauaugaauaucuccaaagguuaguaauuuuaccuugaccauaacuauguuuuagcacagaauaaguugcaauuagauucaucauccagaacacucaacucucacuucaaacugucgcaggaaggaugaaggguagauaccaagugugacugccuaguuuuuggcuuuccaaagcauugucucauaagugguaaaauagaacauccaguacuacccagagacaggggugaauuaguuggauuugagccuuguaaagcuguaaaauaucucuuuugggaguguauaaaauucuuuauuuggcuuuuauuuuagugacuauuacucauccaucaggugucagauuaaauguaucuccucaaagaacuacuuuggcuggccccuaauacaagauuagguccucaguuacaugcuuuguagcaaacccugcaauuuuuguuauuaacacuuauaaaacuuguaauuagauacuuauugguauaauuauuuauuuaauguuuggcuucccuacuuuccuuuaaggcccaggagggcaggaaucuugcaugcuuucuuguuucggaauccucccagcaccuagcauagugccugacacauggccagcacccagcaaacaucuguuaagagauaggccaacggcagggguccucuguagaaccagaaauguucaggucgcaucacacugaagagauaaaagccuuuggcauuauuuucgacauaaaggguuauuccauaucaauuauuucuguucccucggcugcuccuaaagauuuguauucuaagcagauuccccugaacaucccaauugcuucagaguuugcuuagguugcaaaaggccagagagggugacaucuugccaacggcugcauuuagcaaaccugaggcagcuccaccagcuccaagucucugggucuggagcagggugggaggagcagugggucuggcagaagcccacuguguauccaaacccaggcaccauuuauguccccauccgaaucucgggagcccagugggagccauggcaugaggaggaaacagccugguccagugggaagagccuugcuuccggaaucaggcaaaucucucuacuacuccacuacuuucugaccacaguaaaguuguuaaaucucugggacccucaguuuccucuugaugaagaugacaaugaugauggaaaaguaauuaaacucucauugaacacuugcuauggacccaccauccuuuuaaacacuuugcaugcauugucucauuuaauacucaaccaacauuauuuaguaauuacucuuccugucuucaccguagggugaguaaagcaaggcucagaggaguuaaauaacuugcccaagaucacacagcuaaugaguagcagagacagauauaaucucagacaaccugacuuuggagccgguacuauuagaccuggagaucacagggcugaucuggccauggaugagagagugcuuauaaugcuccuggcccucugucugcacguagaaguugcucaauaagucaguuguuuccuucccaucuuucuugugaaauaguaguaugugacuaacuaauuacuauugcccugagucagcucaaagaggagcagaaggaacguuuggcuuccgggaaagagggagguuacguggagauggagaaggcggauuaagcauaggguuuguagcaauccuagaguccuucucagccuucucaaaagguuuucauaagguaauuuugaauucugccaauaugggaaccuuucuguuucccaggccuucugcugugggauuguuauaaagauacaaguucgucccaguggaguucucuggcucuguggagccuguggaaguuauucagggccccagauggagccucuugauucugaauccucuaaugccccaagcaggcuuugggauuaucugcugaaguacugagcucugccacccaccuuccuuggugccugagaucuccugcagccucacaguccucagaccugggaggaaugaguccuuggggaauuuucuguaggcuucucagagugcaaagggagucuucccacaaagaauauucuacacaucucucuuaggggaucaacaggucagcagaggcuccuugauuuggccucucugccaguuggaaccuuguuaguaccugucuguaaugguuuggcuaugggcuucuuggcagcauuccacuugauuuuccccaugagaguccaaggaauaaaucagagagcaugcuagaaaauugggugaaaaggaaauggccauugggcuuuuucuguucacucauucaccuauuuaaggauauuuauuuuauaccuacuaugugucaggcaguguucugggcgcuggggacaaaacaguaaacaagagacuuaagguuucuacugcacuguaguuaugugaagaguaaagacaaauaauuagaaaacaaauaaguaagauaauuucagguugugauuuuuuuuaaaaaaacauagugauguuaagaauaggauuguaaauauuuagaaaacucuuacaugugucagauauuuuccugggugcuuuacaaguugcuucucacuuaauguauccuauaaaaacaaaacaaaacaaaacaaaaaaacagcuucagagaucauugauguggagcagggugcuggggggauuggcuaauuuagcccgaugggucagguccggcgucucuggggaggcaguauuugagcuguuacugaagaagccuacuaugcagagaucucauuuguuacagaaguuaacguauucauuugagugaaacucagaagugaaauaaaaucaguaccaacuuugugcacaaagaauuuggggagaguguuggcagacuggggagacacgaauggagcccaugcagugcucggugcuugccaagacaucccuggacaugaaggcaggacaguccaacuaccuugcuugccccuggaaaauuggaggcacuuaaucauccauccccuugauguuucugccccaggugcacauagggcaacagagagcccccauuugacuacagaggugacaucuuccauauguuaaauucauagcuaguacucuacuuacauuuauuuauguccauacuaccuuccaaaaugugagucuguuagagacggacauugucuuauucaccacucuaugcucaguaccaaaaauaaugcugggcacaugcuagccauuuaauaaacaggguuugcgugaauaaacagucccauuuaauccuugguacaaaaucuucuauuucuccauugaaaucauugaggcucacaggaucagaaacuugaccaagaugccgcagucagcgagggacaaagacagcacuugaaccagccauuugucugacucuagugcccgugugggcuuuuccuccuccaccccuuccucaugcacagugaagagcaugcacauugcuccacucagggaaucagauccaagaaagcagacuuggugugaguuggaggaggggaacagcaugagucacacagucucuuucauucuuagggaugggaaauuucuccuaaucugagguugaccuuagugacuaaggaauucaucuuuuccccaccuccaguuuccccaccacugcaggaagcagcauggcccugcuucaaagauuuguuucccuaucgacaaucucuguuuauccuuaucucuucucacucucuuacccuggcuuuacuguacuuccuccaggggcucucauguuacugguacagacagcgucacguaccugggcacucaauagugacauucauucagcaaauauuuuuugagugccaacuauauggcaaguacuuuccuaggcacuaggggacagcugugaauagaaaagcaaguacuucugccuuuguggagcugacaguuuagugaaggaugcagacaacuuaauagcugaauaacaagacacauucagagaccgacgucuauuaacaaagcaauaagaaagggugauaugaucuggagcaaggaguugacaggcuuugucuguaaagaucuagauaguaaauauaggcuucauggauuguacagucucaguggcaaauacccaacucugauguuguaaugugaaagcaggcauuggacaauaggugaacaaaugggcauggucaugugacaauaaaacuuuacuuacaaaaacaggaagggggccugauuugaaacacagaccccugauuuagagaaucuaucuacuuuauauuggauggcuaagagaagccucucugcagaagugacauuugagcugggacuuuacauggaaugauggcuugauuacccagauuuggucugccucgucccgugguuuucaaaacgagguucccauaccaguagcacuaguaucaccugggaacuuguuaaauguagacucuugggacuugccccagaccaaauaaaccagaacucugaagauggagcccaacaaucuguuucaacaaagcuuuuagguguuucucaugcaugacaaagcuugagagccauuacuguuggcuaauggaaaagccacauugcuaggaauagaugaggccacaucuagacuccaucacuuaacucuguaaccuugggcaucucaagcaucaguuuucuuagcuguaacacggggaugcuucugcccaagucuaaaguagcuaacagagaagaagugaauucaucuuuguaaggauccuaggacaaagcagacaccaaauagguccucagcaaaugguagcugcuguccucaucagaaucauuauuugaaucuccaagacacugaagcagauuugcgugcagauacggaugaagggugugccccagaagcuacccaaucccauuccugucuuuuugccuuugacuggcaugcccuggauaucacccaaauacaaggcugauuguuaaaggaaaacucaagaugcuuuuaaaagucuuucauuggcccuguuucuucagcucccuuucuggccuguuaaccuagagcaugcgcugauaccuuuuacugcaggaccgugaauuauacagcugugacucaccaccacccggcuggggccacagugccaggcguccagcuuuaccguuagcuuucaggcuacugacaguuugcucuuuuaugugagaagcuauuuauaccaggagggacaaaggcuggcagaugcugggggaagggagagaagaaugauaaaaugguucaucucccaaggucugcugggugguuuuggcuuauaggaaaggaaugcacaaucuaauagcccuucuaaaacccccauaaaaaccaucauuagacucaccagccauuugcagaguguugucuuuauuucauuacuccaucagcacaugcugagaucaaaauggaauuucaugguacagggagaugcaugucucuccaacugaauuggauuaaauucccccuaagcugcaucuccuaguuagccuucacugucacucaccucgguguuuucaaugcaguuugagagaugaguugggaagggagggaagaagggggcagggcaggaggaggcuucagagcaguccaccucacucuucuugggaagcuagucacaugaacaaugcuguauuuaucuuggcuccagaaauacacugaugucaucagauggcaaugggaaauaugccugugugugcagcuuucacuaaaacugccuguuaauaaacuuguuuucaacggagcugucagaguugggacuagaaccuggguucccaggcuucagggccucugccagaugaagucagcagcaacacggccagauuccaccagcagggacuugucaaggcuugcgugcagauuaugaggccuagaaaggccaaggcucauuugcaaaugcaggaugagagaccugccauuggaguucuagcuuucaagacagguaucuccaaccuuuacaguaaauucacucugggguccuaaaguuugggacuuggccucuuacuuagacuuccugcauaaauucacagcugcacacccuuucugcugacugggcagucuacacuguagccuggugugagaguuaauguaguaucaagaugaucuccucugccuuaugacgcaggagauauuuugaguaauuucaugggaugauuggauuaauccaccaccaaaucagcaaguaacuaacuuccuuccucaaucuauuuaucugccugugccuuccuuuaugcauuuauuugugcauucagccauuuauucguucaacaguuguuuauuaaguacccauaugugcaagcuguuaguauaggugugauuucaauauggcaguuuuccagguccaaucaaaaacuggagcuuuccaacaccagucuuuauauguugcuuuagguggccuggagccauacaaagguagauguagaaagugucucauggaagacccaugcagacaucaggcuuugugcuggccuccgauaacuucugucuuuugaguaacuauccuucugggcucauaaguguuugagagucuaagcuucgaugauaacuagcucuguguucaaauuuuagcugugcugcuuuccaacauuggccaaguuaauucaccuccccaaacuuucaucucaucuucugaaaaacaaggaugucaguacuuaacuacagcauaguugugaaaauuaaaugaaacaauguuuuaaacauuugggguuuuuaaaguggcugcucuuaguuuucuuuuccauagucaaaaauuggaaauaacucaaaagucuauccacagguacauggauaaacauauuguauuauaucuauauaguauacuacuacuucacaauaaaagugaaugaacuguugaucuaugcaaagugaaucagagucugagaaucauuauuccaaaugaaagaagccaggcaaaauaguacacacuaugugauuucauuuauauaaaacucuagaaaaugcaaacuaaucuguagugacagaaagcagaucaaugguuacuuggggauggggaaaugagagggaggaacgacaaaaggauugacaagaguucugggggugauagguacauuugcuaucuugauuauguugaugcuuucauggguacauacauauguuggaacuuaccaaauuguauacuugcaugugauuuauuauauguugauaccucgauaaagugauggaauaaaugaaugaaugaaguuacucuuuagcaaacaggaaggcaagcuuccucccaugccaaugguggaggcuuccuaagguuucaucaauugccucagggaguagcuaagucuuuugccaagcuuuugucagaaagaacugcucaguauuaaucaugcacaaugaaaaggagauuugggguagaaacucaucaacauccagauggauggcacaagaaaaugaguuccacagacuggcucauuucauaaucucuaagcucccaaggacagugccuaacacguaguuggcacucaguaaacaguggugguaguuguuauugcuauggcaauuauuagagugguacaaaaguaauugcuguuuuugccauuacuuuuaucagauaaucuagcuuggggacugacuuuuucuaauucuuaguugggaggcugucuuuuccuaacuuacugaaagauaccaaaaauucuagcagcaaucuagggggggucuguaaacauuaacuucccuacaauccugggguccugagaaaccuuucugacucuugccaaaggguguuaggaaaaaagagguggugucuccauccucacuggauccaguguuuggugagaagguaauaauuuccucaggguugaugaucaaaauugugaacacuuaaucucuguauguucccaaggacaauaucuaacauguaggcccuaacauuugggcuuguauuauagucuccuuucucuuccaucauuauguaaguuauugcaagaaucauagccuuagagaggcaaccagggaaaaaagcugcagugccaaccaacuaaguuugccaaccacuuggcaauucuacguguguugagagagaaggucaaaugacauggauaaauuugagguugggcuugaacauaguugugaaacauccaucuucuuuugugccccauugcuguguggauagucaagaauucaucuggauggugaauaugccaugagaaacagcucuucuggccuggaacagugacucauaccuguaauccaagcuacuuggagccugagacaggaggaucgcuugaaugauggcuugagucuaggaguuugaaaccagccugggcagcauagcgagauuccaucucaaauuuuuuuuuuuaaaucagucagucauuggugugggccuguagccccagccauucaggaggcugaagcuggcagauugcuugagcucaggaguucaaggcugcagugagcuauaauagcaccauugcauuacagcugggugacagagcaaggcccugugucuuaaaaaaaauaaaauuaaaauaacuaaacauaacuaaaagaaacagcucugcugaaauaugaucagugggaccauuuucuguggucuuucucaagcacaguaauuaagagccauggcugugguaucagacgcagcugggaccugauccaguucugccacuguccagcuauauuuaugauuggagcaaguuguuuuaccuuguugaggucauucuuucucaucuauaaaaugaagacaguaauguuuccugccuuauagagcacuuaaucaguaccuggcauuucaagaaauguauaucuuuccagacuagaauggccaauuguuuugaaaacacuuuucuugguaaggccuaucuggggaaacaagacugagaucuaagucugaaguucuuguccauagauguugggggcaagaauuaaagcauucuaagauauaagcaaaacaagacagaacagaaauucuuaagcccaaaccuuggauuuaauauuuaagaaaacagucucagagaacguacaugacuugcucauugucgcauagggccagugcuuagggagcaguuaauauaccacucuuccccuacgacaucaggguaaauacccagggaauguagacugggaagauacacagaaaagagagcauucaagugcagaaaaagucauggaucagaaaaguuuguuuucaggcagugaucaaguggccuugaccaaguuucuuugcaucuucuagcuucuauuucccauuuggauuguaaagaugugaaauauuuucuuuccauuauaaaguaaaaauaaacauggcaauguuuccaaauuguuagaagaaagaugaugauagaguucaugaacaguaauuacuauugcugugauauacucuauagcuuucauaauuuuugccuuuuuggucuaucaaugccgaaugaaggcaacuuaaaaucuuucucuguaauuauagauuuguuuuuccuuagauuucuguuuuugcuuuaugcauuugaggcuauguuuuuaggugcccacaaguuauaguauauaauauauaauauaaccuaugguuauacuauaguuuugauagauuauucuuuuguaacauuccuuauaaauauauguguuauuuuguuuauuugaacauaaaauaacuuuuaaaauuuuaugaacagcuacauaauauuuuucaggaauagaaguagugaacugguggccauuauaaaacgggucaauaaauuguaucacuaauaauuuugaaaugaccaaggaucuauuaauuguaacaucccuuuauaucuugccuaauuguauuuguucaaauucugguuucuauaauacuaacauugcauacuagcuuucuuuuggugaguaauugcaagacuaugcuuuuccauucuuuuauuuuaagccuuuucuuaugguuuuaagugggacucugcaagcagcacaugauagauauugcauuccuauuauuccaaacugauaauccaucuuuuaauugauggguauaauacauuuaaauuuauuauaauaacuuauauaaucauuccuaccacuuuauuuucuauuugcuaucuuuuuuccucugcuuuuuucuguuuucuuguguucuauuuuuuuuaaugaagccuucccaguuuucuucauuuuccuuugcuugguggaaagauacagaauauauuuauauucuuagagugguuauucgccauuucuuaacauccagccacacuggauccuugucuuagucuguuagccacuugucuuagucuguuuugugcugcuauaacagaauaccugagacaguguaauuuauaaagaccagaaauuuauucucucacaauuccagaggcugaaauguucaggaucaaggcaccagcaucuggugagggcuuucuugcugcauccucagguggugaaaggccaaagggcaaaagagggaauguguccccacauggcagaagaacagaagagaugaacccacuccagcaaguccuuuuuuuuuuuuuucuuucugagacaagguuucauucugucaccuaggccagagugcaguggugcaauuauaggucacugcagcuucaaccucccugcacucagaugauccuccauccucccaccucagccucccagguaacugggacuguagaugcgcacaaccacucccagcuacuuuuuguauuuuuuguagagacaggguuucaccuuguugcccaggcuggucucuaacacccggacucaaaggaucuuccaccuuguccucccagagugcugagauuacaggugugagugaccacaaccacgccuggccacaagcccucuuuaugucagcauuaaucuauuccaagcaacuuccaaaaggucccaucucccaacacuguugcauuggggaauaaguuuccaacacaugaauuuggggguacaaauucagaccauagggccacucuucaagaacuccaagcuuccucccaccucaugccuuugcacuugcugugcuuuccucccucuaucacuuuuaacaaagcuccaguuauucagcauuuuugucuuccuucuuaauagugaucuucugugacacacguuuuaaugccacaucuuagauuacccaugaaagauuuuucuucccgccuugaguagccugcaucucaauauacuucugaaucaauucaccagaccuuggguucauauucacucaagccaaaguaagauauaauuuuggguaguuucucuuuaaaacaaaaucauaugaauacuaagaauuuuaagaucauuuuaugucuguuauuuuucacacaucuuugcucccuucacuuaacacauuaacaacggauucugaaacucccauuuucaaagguuacuuccuaaacaugugguagaaaaguuaagauuguuuuuuuuucuuuucaauccauuuucugccuaguuuccgaaaggaucuggaagagcugucaguagaauaacuaaaacaaggggaaagcaugcuauaggcaacaaagagaaaggacauaauuauaauagauaaccaaaacuaaagggcacuaguagaguaaggcaauguuguuggcuaaccaccuaacaguaucuccaguuuuggaugaagacugugauagcaagaggaugagcguuguuuuagucuggauguugggacugucaggaugcggaaggaugccugccagaacugcuuuuuugggucugagccucauugaugcugagugcuugucucucacaauuguuggcuaacaccuuuuguugcuucucaugccacuccuagagcaaucagaagacucugucgugagccaggaagagguacuguauaaacggaauucuauaaucuguaaaauauaacaaagugaauggccugagacuaauaauucagaagcuauaacuugcccaauuaucaguggugauuuauuuccuaggucuucucaaugaaaaugcuacacacgaaugaguugccagaucauuucauuuguuauagauucugauugcuggggccagcaucuucccugugauccuugauugucuuauuaaaaacagaaggaaaguugcuuaugaaaggacuuaaauguaaguguagacacacugucugacucauuuucuccccauugauuuucaccauaauuucagagaauuuaccacagaaaaacauuuguucccaacacguaauaaaaaucacucucagcugggcgguggcucacaccuguaauccugguaccuugggaggccaagauggguggaucacgugaggucaggaguuugagaccagccuggccaacauggugaaaccccgucucuacuaaaaacacaaaaauuagccggaugugguggcacaugccuguaaucccagcuacucaggaggcugaggcaggagaauugcuuggacccaggagguggagguugcagugagcagagauagugcuacugcacuccagccuaggugacagagugagacuuuauuaaaaaaaaaaaucauucucaaauugucaaauuuguagauacugaaaggaaaaugguggcuuccaagggcugaaggggaggagaaugggaagugagugguuaaugaguacagaguuucaguaugggaagauaaaagaaguucuggagaaggaucgugguagcaguugcacaacuaugugaauguauuuaaugcugcugaaaagugguaaaaaugcuaaauuuuauauucuguauauuuuaccgcaaaauaaauaaacacauacauacauagauaacucucaggaauuggagcagucccuucaaggaccacauggucuuuguugaggaugaaccugggcacauuaacuucucuugcacagaccaaaggggaaacaaauucaccaagccugaguuaguucccauaauccucauuauauaacauacgcacauaacauucaaaguaugcacauuacucaauaaugcaguugauuucuaccuucuuuggaguucaaacugauccauguggcuuucaugauuaagcagccacucuggccuguuuaguauuuaagguuuuagcaggaauugcaagcuugaagaaugaacugugacuacacugcucauugauucaucaaauacauaggacagaguguaauccuuugacuaguuuugggagacagugggguggaauggauagagaaugagcuuugaagucagaccuaaauuuaaauccuggcucagcccuuuacuccuuggugaucaaaugguuuauaauuuuguugauccccauuuuucaugauucuguauuugcaaaugugcccacuugccaaaauuuauuuguaaccccaaaaucaauacuugcggcagcacuuucauggucauuugcagacuuuacuuguacccugaaaaucaauauuugcagcacucucguggucauuaacaggcauacacugagggauaaaaaauuugaauugccuaaugcauacauggccagcugagguagaacagcuaauucuaugcuuucuuauuccagcucacagacugaauaaacaaguggucuauuuagggccacuuuuuugcauccuaugcuuuuuguuggugauuucacuguuuaaaauagccccaagcauagugaagugccaucuaguguuucuaaaagcaagaaggcugugaugugcuuuauggagaaaauacguauguuaggccaggcacgguggcucacacuuguaaucccagaacuuugggaggcugaggcaggcggaucaccugagguagugaguucgaguccagccugaccaacauggagaaaccccaucucuacuaaaaauacgaaauuagccaggcauggugguacaugccuauaaucccagcuacucuggaggcugaggcaggagaaucacuugaacccaggagguggagguuguggugagccgagaucgugccauugcauuccagccuggaugacaagagcgaaacucagucugaaagaaagagacagagagagagagaaaagaaaaagaagaaagaaagaaggaaagaaaagaaagaaagaaagaaagaaagaaagaaagaaagaaagaaagaaagaaagaaagaaagaaagaaagaaagaaaauauguauguuagauaaucuucagucaggcaugaguuauagugcuguugggcaugaguuauagugcuguuggccauaaguuaaauguuaaugaaucaacaauacauauuaaguaaguugcccuuaaaaagaaacacacaugaaacaagguuauggauuaauggguuaacgaaaauguugggaccagaggcucacaggaaccuaaccccauauuucuccuaggaggaauguuuaguauucagaaauucaguguuugcugugauuuuauagcacauaacugccaugaauaaagagaaucacuuguguuuaccuuugcaaaauguaauauccuguuuacauaguacucucuucuuucccugcuguggcagggauuauggcuauuuacaaaugguugguuccuucuucuuccaggcacaaagggggaauguacuuucucaguccguuuaaaguuaggcauguccaugagacuugcuuucaccaaugaaaccugaacagaagucacauguaucauauccaggaaaaaagcuuuucacugccaguguucagcuccaaccauccuuuucucugcugccauccucauggaggcauaucuccauauggagcccccaucaccugggucucugccuaccuauaggaggauacagugugagacagaaauaaaaucaugguauagauaaggguuuaagauacagaauauauacgguucaacaagaagacaacucaguuaaaagaugacugaaggacuucaaucaacaucucuccaaagacaauauacggucggcugauaagcacaugaaaagauguccaacaucauuagucauuaauauaaugcaaaucaaaaccacaaugagauacugcuucagaccuacuaagaugguuauaauuuuaaaaacuggaaaauaaauguugguaaggauguggagaaacuggaauuucugugcauugcuggugacaauguaaaauggugcagccacuuuggagcacuguuuggcaguuucucuaaaagcuaaacagaauuaccauaucauccaguaauuccacuccuagguauauaugcaacauaauugaaagcagagauucaaacauaauuguacgccaacauucacugaagcauuauccacaguagugaaaagguaaaaacaacccaaauuccgucaacagauaaaaauggauaaacaaaaugugguauauacaugcagugaaauaauagccacaagcaaaguccugacacaugcuacaacagaaauuagccuuggaaacauauuaggugaaauaagcagacacaaaggacgaauauugcaugauuccacuuauaugaaguaucuagacuaggcagacucauagagacagacaguaaauuagagguuaccaggggcugaggggaggagaaauggggaauuauuauuuauuugguguagaguuucuguuuaacaugaugaaaaaguuuugugacgagauaguggugaugauugcaugauauugugaauguacccagugccacugaauuguacacuuaaaaaugguuaaaaugaggccaggcaugguggcucacgucuauaaucccagcacuuugggaggcugaggcaaguggaucgaggucaggaguucgagaccagccuggccaacauggugagacccugucucuauuaaaaauacaaaaaacuagccgggugugguggugagugccuguaaucccagcuacucgggaggcugaggcaggagaaucacuugaacccgggagacggagguugcagugagccgagaucacgccauugcauuccagccugggcaacaagagugaaacucugucucaaaaaaaaaaaaaaaaaaaaaaaaaaagguuaaaauggcaaaucuuguaauguguauaccacaauaaaaaauuuuaauuaaaaaacacugcaguacaaaacuagugauauuuuggugguguuugagauauugugucauacucuagcucauccaaaccaaaccuucuuuccugucuguuucucuaaaguggcauaauauaggcccuuuaggguuuuauggcuauacgcaaacuauaacccgcaggccaagauauuaccuucacugaucuuuuggcguuuuggaacuggaaagacugaauucucacaauuguuuuuaugauucauuugaaacuuagugggcaaggcaaguuacucaggcugaaaguagccgugguagucagaaauacauccuuuguaauguauaagugaguuccuucauuuucauauuuucuggucacuucucaaucauguauuuaaugugcagaaaugaaacugccuuaaaugaacugacuugaaacaaagguuaccuguauucuaaaauguguuuccaacaauguccugugaucaguaagcuccagucucuugcaaaaagaauucuuucuuuggauuauagcaugugucauuaugaaucacuuuggacacuugaaaacuugaauugguccuagaauuuccuucugucuuugcuuucuaaacuuuauucaaacuggcuuugcauaacccugugaaacuaauaguaauagaggaggguaauggacuaauuaugucauaugugaagugcagaaucaaaaacaaugauuuaaaaugcacagaaaagauaccauguaggacacuccuaaggacuccacauaagaaagagauaacucaaaauucagauauucuuuggagacagauugcuaggugucacccaguuuuagcaucuccuccuuuccuaauaacggaaccugauuguauucugggcagcaguaugcccuacuaaggacccuguuuccuagcuucccuugcagcuaguccuauucaaggaauuauaaauaggagguuaguacuucuaguaaaacucuuuaaauguuguugauccaucugccucuuacccuuacccaccuucuuaccucgaacgugaaugugaugguugagacuccaguagccauuuugcaguuuugagcauagaugucacuaacacauggaugauggguacagaaagacaggaagagccuaggugcuucaugguuuuuauaaaaugccaaaccaguccuaggccacuauucucgggucaugauuacuagcagcccaaagcaauuauaauuucuaguuuuguuguuauuuuuaauaauaauaaaacuaaucugacaauuauguacagccuuauaguucacaguguauuuucauucuuuugucacuuuauuuuaaaauauguuuauuuuuauuacauuuuauauugaacaccagcaaagaaaauaauuguaauaauuucaaaaugcaauaccuggauucaauaaauauccuguauaaucaauuauaccagucaauaucuagaaaugcauguagauguaaugaacaaaaugacuaaacuauaaaucuaagggaacuuaaagcuuugaucuuuguuaacuuaaaacaauucaguuucauaugaagaaauucaagaagaaaauuucgggacccuugaucagaagcuugcaaugcuuguuguacuacuuugguguagacaaauauucaaauaaggccaagaaagaagaguguuuccacugaagacacgaucuaagaaguaggugaacuaguguucuguagaaacuaacuagcuagccaucaagauauuuccacuaaagacuccuuacacuagcaacuaaccauguuuaaaaaaaccuuagccaguauuacaaaaacaaaacauauagaguaguguucaugaauacaagcauaauagguuccuugccuucuacaaaaauaaucaucuuugaaaugcuaaaagcagguuucaacugggguuccucucugugaugagaaggugcagauacacauggggugauccacugauuuaccuucucaaaguauucuuuggaaacaguuugauuugacuugauuguaggagacucuaguguccaguuugcugggcagacuucuccauggguuuuuuuuacaaacuggaaugccuuuaccaagcagagggugucuuccacguuuuagcccacugggaggucacugacacucaaaugcuugauaaauucauggggucaauuaugaagacuccucuuagugcaaaccaggaccuucuaacagcacaccauagucucaggaaauguguuuaauuaaaucugagaaaagugugauguucauguggcccaaaucaccauucuuucuugguauauuuauccaagcaagauggcuaaagugggaauccacuaagacugcaacaacuucacaguucacauuguaaaauucauucuuuaucacuaacagcaagaaauuguugucgacacacaaaggugaaauccaaaggauaggagaaaagcaccaaacauuuccccucauuaucaucaaggcuuagaucuuugaacucugcauugacaaaggcuguaccuuuaaaauagggugacagcaagugcaugguaugaggaaauugugccaaaggcgaauucugcucgaccagaaucagaccacaauauguuugucaagcauguuuuccccagaagccacaggccuaaggacugcagagacaggauggugugcacaugucggucaaccgaagcuagggacaaccuucccacagcggcugccaucuucagugccuugcaggagccaccuuuucaucacuuuaaauccucacaauaacuguaugagaugaauacaaguauucuaguccuagagauaaggacaaugaagcccagaguagguaguuaacuuggccaaauauugcacgcuuagaauuugucaugguuaggacucaaacauucaacaucaaaugcaguuucuuucuccuauacuguagguaaauauuaacucaguugauacuggaguagcuauucccaaaguggagaaucuuuuuuuucucuauuaagaaucacugaccuacuagaacacaguuugauaacaacguacuagcauaaaaaaggaguuuuauuaagguuugggaggggguuuuguuguuguuuuucuucuucauggggaacuacacuauguuuaacucacauccucuuuacuuugagaaaacaaaacaccugccaauacauaaauaauugugaguguucaucaguucuuauuauuccugggaguuuagaaaggagacaggagggagaaaagaaaagcgugguuuagagaaagggcaaaauucuggagauucggaaaaggcugggagacagaagagcugugacuauucugaaguaugugucagcugagauagacaacuuggcuuaaugugugauuugcugggaccguugaagacagaguugggcaacagaucaguugucaucguacucuucaaagugcucuuuagcuguuuaaucucauuuacagcucuucuacugcucuuuuuacuuuuuaaaagagaauuugccaaggauacuggccauuuaagcuucugacagaaugcuagagccggccucauacugccuugcaagagccaauuggucaguuuucaggaauuuuguaaauccauuguuaaauacagccauuaugaaaauuuaauuauauaaacuuauaauuaaauaaauuauauuuuuuaaagaugauaaauacuugaaauucaucacuuccuauuuaauuuauccuauuccacuguuaucuauguucuugagacuguuuugccuauuauaucuguauagugggaguacugugugaugguaugcuauguauagcucuucccaguuccacauccgaugacaucacauugguagcuugaaugugggauucauagugggaucacauacccuauggaaauuggcaaaugcuacaaaucaguaccuaacuuauuuuuuauugaaucuuuguaguguuuuugucuaccuauuauggcuuuugcauuauuuuaacuuuguauuguagucauuugucuacuugucuuauacccucugccaaauauaaccucuuuccaccuaggggugguuucccauucauguguguguucuuuccccacaagcacucaacaguuccuuacacuugcguaucacagauaacagaauagcacagacuggguggcuuaaacaacagaaauuuauuuucucacaguucuggaguccaaaagcucaagaucaagaugucagcaggguugauuucuggugaggcuuuucuuccuggcuugcagauggccuuuucucugugcaugcuccugguuaucucuuccucuucuuacaaggacaccagucuuauugaauagggccccagccuuaugaccucauuuaaucuuaauuaccuccuuaaaggcccuaucuauaaauauagucacacauagggguuagggauuugauaugugaaucacaggggguacacaauucuguuuauaacauagacauuuaugaauuaugcauuagacugcuucaaagccaagaaauauagagccuucagccugugccucucucuuuguuaguuacacgauaucauuugagccucuuauuaaugcuucaagguagauauuauuguccccaauuuacagauggagauauuaacuuucuacaagagaucaaauaacuugcccaacuacaugcagaugguaaguguuacauccauuauuggaacccaaacaaucugacugcagaguccaaacaaguuaccccuauaagaaacugccauccuucuuuuuucauacuuauguauguguguauuuuaucuaaaggcaguauugaaacuguugucaaaugaaguuagcaacuguuggggaauuuuuaauagggcauauacgcaaaugcguagacaaucugcaaaggguguuuugauaaaauugggaugagggagucuauuuaaguguagcuuaaguagaaaauguucaaaccccaaguucuuccauuucugcaaccuuuucuuuaacacaagauaaaauaaaugucagauaaugcuccaaacuaaauggaauguauuuucuaacaaaacauugaaguuuaauauucuaaauaaaauaauaaacaggguuggaaagaguggucaugugagaacuaacaggcauaggagcaaagcaacucaugugauucugaauuaugguaccggcuuagggcauaacauaauuauuuuccuuaguuuguucaaacgaaguuaacucaacuugaaagaaauucucuggcuucaaauacaaaugggugucgcuuuugucacuuccucugaaauaaacaguauauugacaguuauuccaugcauccuuuacuuagcaucuccacccaccccacagcacuaaucuuuggugaaaaaagcaaaugcuuugauggaaugaaagagaagcuuaaugaguuuuacucuguuuccucuugaaaucucgcuuguuuauucucuugcuguaugugucugucuagauccucuaauaacccagacagcuagaaagguaagauuugaauacagcaugcauccauucaacaaacacuuauugaguaucuuguacaugccagacccucuucuggggguauacagcaaacacaguccuaaguacucacauucuagagggaagagaaagucaacaaacaaauagaucauuugucaacaacugauaaguucuuugacaaaaagcagaugaagaguuuaucaguuucagcacuguuggcauuuugauggggaucuuuugcuguuggggcugacccauguauuguaggaaguuuggcagcgucccuggccucuacccacuauaugugccaaagcagcucccuccccaaguugcaauaacaaaaaauguuuguagacauugucaaauaucucuugggggguauuauugcccccauuugagaaguacuggguuggaagauaagggauagaggugcuaauuuauuaggauagucaaggaaggcagccaagguggcccuugagcaaagacuggaagaaaggaggaugacaccauguaaauaucugggggaauaaccuuucaggccgagggaauggcugguguaaaggccaugaggugaaaggaacagcaaggaggucauugugagcacaagaccugaacaaaaggaauaugguaagagacagagucagccagguuguaaggaguggggaggucauggugcuauagugaagacuuuggcuuugcauuauagaggcaugggagauaauccaggguuguuguuuuggggguuuugaguuuuuuuguuuuguauuguuuuguuuuguuuuuuugagauagaaucucacucugucacccaggcuggagggcaguggcgcauucgccacucacugcagccucaaccucccagacucaagugauccucccagcucagccuccagaguagcugagaccacaggugugcaccaccacagccaggcuguuuuuuuuuuuuuuuuuuuuuuaauguuucuagaggcauggucuaccuuuguuucccaggccagucucgaacuccugggcucaagcaaucauccucccuuagccucccaaagugcugggauugcagguaugagcuacugcacccagaccauccaggguuuugagcagagcagugacacacccugguuuauauuccaauggaguuguuauugcugcugaauagagacucgacugcagaggcacaaaggugaaagccggguccagaaguagccacagcaauagcucaggcgagcacuuagucauagcuagacugguccugcaggggugguggaaaaugacuggauucuggauauguuuugaaccgacauccaacaagaaucacuguugaauuagacaucaagugugaacaaaagaaaggagucuuugaaagagucuucuuugaaaauacugcaaaugagcuuuuauuucugauuuugauccuaauccuaggggaguucaacaugauggagacauuguuuaggcauuaggcauuagacuguuguuuccuaaauugcuuccugaguaaaccaauuaaaauuauaaugugggucuccaggagaaaagggaaggagccaaacuugguacaauuucaccucuuaaaugccacuuaacggcacuuuucuccuauugcuuggguaaugaaauucuggcaaauaggggcaaaaugaacacaggggcccucaugagcagcccaucccuauuuacucacagcuguaaugcuaccugaugguccuccagguccccauuugggaaccacuguguacuuuuuuaaagaccaccacgugcagcaaauucaggcagcaucuuucccuucucuguacaaccugccuucugagaugcucaggugcauuuuagauauuaccuccccgaauugagguagauuaaacaagguuccaagcuucucaaacugcaggugagggggcacgugaaauaaaggaucaguguucgaauuagucccuggguuaaguuggauuuuauaaaaccuuccaaauguaucagcucaugucugagauuacacuucaggaggguuggccuuuaccuuguguuuguguuugccuuuuccuuaaacuaguguuucuccuggaguggucugagguguuaagagugcauaguucuggccuccuuuucagacccagagggaugaaaauggccaucaucuuuaauaaaggccucagaugauucuaaaguaugcuacuguuugaaaaccacugcuguaucauuuaggaauugcauucacuuccuagcaacagagacuguaaauaaagaaauagcuuauuucucucacucagaaguucagagaaacgcaauccaggguuagucugguggcuccaugguauaaaaauuuuaaaaauuuuuugaaguccaggcucauaacuuuccguccuacuauccucagguuacagcuuccauucccauuuguaagguuacuucaugacacaagauggcugcuggagcucuagccauuguguuuacauuccagacaggaagcaggaagaagggggaaugggcaaaaaaaggucuuggcuaacaacugucuagccuccuuuaaaagagcuucccagaagucacacccuuccgugucauuggccagaauguguaaggccacauguagcuacuaaggagcugcagaaauauuauucuuagcugaguauauugaugcucucagucaaaugaggguauuguuaaggaagaaaaaaaaaauggauauggcugggaaaacucugccacaacucucuuaccaucaugccaugguguuguggaaagacuguaauuuggagauuuuucacuuacugucuguucauuuuggcuuuauuugggagcuguguguugguuauguucuggguaauaccaaaggaaaauguguucaucguuucuguggucagccacgcagaccuauugggaaucuacuguaucuggguaugauuugguuuuuucuuccuucuuucccauccaucugccagucucuucagucucuuuuuuucuugauaaaggagaacagaaggagaggauggggaagucaagcucaaagguggcucucucacuuuguaacuaugugauauucaaucugaugaguaugaaauacccaccuccagagugugcagaagguuuaugaaauacuguguauaaaaacgcgucaagccguagggucacucaguaagucaauaguucgaugaccgcuuccuucauucagaucaggcuuguccaacccgugguccacaggcugcaugcagcccaggauggcuuugaaugcggcccaacagaaaugcacaaacuuucuuaaaacauuaugagauuuuuuuuuugcaauuuuuuaaagcucaucagcuaucauuaguguuacuguauuuuauguguggcucaagacaauucuucuucuuccaguguggcccagggaagccaaaauauugggcccccuccgcaucuagauggugaagaacaauugauucugaaaucggccaagaaagucuaacuucuccuuuguggguuccugcucuaagaaaauaaggaugcuuuugauaaggaaaauguugccacccaaaaaugugagcacuuugcccuuaggauuucuuguucuugccagagcugguagaauccccugcugaaucauauaucuagguguggaaggagacaccugaaaaauugggugagguccaacaaguucucuucccuuuucugggcuuccuagaucucuugaagaaagugggaauccuaccauuugccuggcaacugcauaauguugguuguugagggaaaacaguagaaagcucuaaaacucacaaaguguguucccuggacuaacagcaggaccugaagaggagucagaaaugcaaauguccccaucccgggccuacuaaauuagaaaucuguguuuuaacaggccuuccaggugauucugaugcaagcuauaguuugagaaccagugcucuaaauaaagugcuuugcacacuucuuuauaaaaaaaaaaucagcuuacuuuucauacacuuuucucccaaaugcagaguuauugcuucuccagccuccaucuuucugcccaggcagaaaugcuaucaaacgugcaguuccuuccaacaagccucaucuuuccagcugggcgaggcuuugcuuuguagacuuuauaugcgcacugacuaaagugcuugcgaucugucugacacacacugaaguugcugccaaaccuuuccuguugcagaguuacaccuuaaaggccuuuggcuauuucauuuucauaagccaguuuauuguguucaaaaugcuuuuguuuaggggaaaguuaccuaguaugauuucaccugggguggaaucacagggcaccuuuaucugggaaugucuaaauggagcaaagucuuuagcacauucaacagacgugcuuuugaauaaauauguucaauacacacagaaugaaaaauacaguuaucagcauaauggguaauagcuugguaaugaucaucauugacaaaauucuauuggauuugcuuauuuacuccaaaaaaaaugaacaagugaaacauguuuggacuaaaaugaacaaucugcaggauuuucagggauugugccaaauuuaauuuuuguagugccagaaaguauacucaguauuuucccauuacccuugguucacuugauguuuguuuugggccauacaguaguuucacuguggagaaugccagaggaaaaugcaggcagcauuccuguauccagccaaagaauucaggagagcuguuucucccucccucccauccauccguuaauccccuuugcucagugaaaaauuuggaaaguccagcaucuaaacaccaggaggcgacacaaagcuaacauuagagggaugcguuuuucuccuggacuucaauggacuucgaagaggauuggaaguccugaaaggacuaaaucauucuccuuccucagagcaagccacaucaccuaccaugugauaugggagugauuugguagguuguuaauuaauauuaacuuauuuauuuuagaaauggggcaucuugcuaccuagguaaguucuuaagucauccaucaaauuauuaguuaccuugugagaagauauucuagcauauuguauauuugaggaauuacuggaauaauuuugagugguuaucaguaggcuugaauuauaaaaguugacaaaagauguccaggaaagauagagcuguguucccaaagaguagucacugccucuguugacuucagaauucagucuuuaggauggaucucagcacaccaagggacuuauuuacuccuaaguuucuccagaguccuccaucacugcuggcugcaccuucacucagucaugucauguugggauucauuuauucuccaguuuucaaaguacugaaugucucuaaucucauuucuggguguggacgcugcccaagacaggguaaucaggguccuucucuggggaauuuggaauugagaaaagcgagucacucuaggacagacucuugaagugaugcugugcaaacucaagugcugugggaaaccuuaaccuuugagaaggugagaagcagaucugcaggaagagaagagagcagagguaagaggacacugggcucagagagaacagaaacuugguacaaucaccuuccaguggcauauucuauuuccucaugagacccuuuuauauacauggcuaaguuucuaaaaacaaaaacaaaacaaaacacacacacacacacacacacacacacacacacacacacacacacacacaccuuuauaacaguuugccauuuuuccccugaagucaaacuagcuuuaauaccauuguauuccuugcaacguauuuuucuugcuuugacuaauauaaguggcuucaggguuuggucucacucuacaagccagcaguguugcugcccauucaaaagugggccugaugggguggcucacacccguaaucccagcacuuuggaaggccaaggcaggagaauagcuugagcccaggaguucaagaccaacuuggucaacauagcaagacccugucucuccaaaauauuuuaaaaauuagccaggcaugguggcaugcgcugguaguuccugcuacucugaggugggaagagugcuuaagcccaggaggucaaggcuacagugagccaugaccgcgccacuguacuccagccugggugacagagcaagaccuaguccaggaagcaucuggauuguuccauuuagaguaggccaggcuugauaguauaacuauugucauguauucguguuauuuauuuuuauuaagagccacaugcuugugccuacacucucauuuaaucaucacagucuuaugaugaguauuuugaacagccacauaacuugcucaggaacccagagaugggaaacaacagagccuugacucgggguccagaucuacuggccaugcccuagagggugcagggaagauuccaacuugggccagccuuagacaguaucagaaagggcuugguucaaaguaccaguuaagaagggcucucaggccugacugugcucuaggcaauggacaggggguaugugaguaauuagaggugauuaagaggagggucgauggaaccgcaacuagacucugcauuuucaagcauccauaguaauucaucucauauuagcaauugucccuaauguuccauaacgacaauggaaguugggagaaugacaaaguaaugauggaacaaggccuuucuacaagcagucuucugacuugggagucagaagcccauuccccaagacaugagacugggcgugcuuuuuuauaccuggccuuugucugaugaggcauauggcacagggacuuuucugaggauggaaugcugugcaagucucuaauaggcaaauugccagcuucuaaucccaaacuaacuagugaucugggcuuuuacuucuucucagaguacuggucaacagugggcucucuucagaacccggcaucauucauuauugccccugggcauagcucucugccagcugccuauagggaggggcuuauacagacccugccuuuggaaaucuagcuagucuaggacaagaauucucuuuauaguugccucugggauuugauuaaaaggaugauaggcacaugaugguuaaugguuaccaucauuaguuaugaaaauaaagauagcuuucacauuuuuuaaggccuugucauuacaaagccuuuucacccccucuucuaacauuuaugacuuaguuucuggagaucaaaguagacagagcuuucgcaccucuucaccccagcauucccaaaacauguguucauacccacggcucccuaaaugcaaaggaauuagaccaaguuuagaccaaguuuguagaauguaacaaauuuuuuuuuuuuuauuuuuguugauguuuuuugagaaagagucuugcucuguugcccaggcugugguguguucaagcaauucuccugccuuagccuccugaguagcugggauuacaggcaugcaccaccaggccaggcuaauuuuuguacuuuuaguagaggcgggguuucaccguguuggccaggcuggucucaaacugccgcccucaggugguucucccgcccgccucagccccccaaggugcugggauuucaggugugagccaccaugccuggccaaauaugaugacuuucagagcccucagucuuccaucuucuccauuuguugaaugaaugccuuguuucgcaagaggugcucaugucguuaaauaagagauacuugagaguauuuuccaugaugucaucugggcuugugggauuuuuuuuuuuuuuuuuuugccucuccuauauaauaacauaccuucuguauuagccaguuuuuucucucuaguuuugcauguggcugaaugguggaaugucuguuuucuuuucucaggcaaaauuagcugcuuggugcuuuccccaguuguuaggguugaaugagccucauaaaguacaagaauauguccuaacagucguaaacaggaauguugugggaugugcaaaaauccucauguuagugacaauuuuuaauuacaugcucugcaucccagauuuagugagucuauuucugauggaugucagcugcugccugccuuacaaaagucucgaaaccuggagggcuuuaaauguagguggaggcugagguaccuagggguuugccgagugccaaagacuggcuuuaacuccauugccgaggcaggugcugacauaucccuuuggcuagggaggcacgucauaugcuggagacuaacagagaaaaugguaaagccagcucucaggggagucugccgagaaagcccuacccucugguucaccagcaugucugcugaauucucuguuucuaggaaaauuuacuagcuuuauuuuucccucacagagagagggaaaaaucccagauauggaugauuugccugacucuugcuuuaaggaugaauuucucugcuuaccauaggaaacucaucugcuguugacuuucauaaagagucaggacugcagaagucaguuacauccugcugggggaaucaucuucccaguaagugggaauaggcacaugguuugaguaaugggcaagucaucuauaugcuuucuguccuucagguacaccaguacuauagcugucucccagaagagaaagucccuuaugucaacaguccuggagagaaacugcgaaucaagcagcuacuacaccagcugccgccacaugacaaugagguaaggggcuagagggggcuuaugcagaauuuucuuagugccuucuaugaauuguuaccuuuuucauaaucugccaccaaugagguagccgaagaagaacucuggcaauuuauuuuagguuuuagcuuccuuaauuagggccaaaauaaacuggccaacaauuuacuucuagagaguauuacuaaaaaagcagaaucucauuauaaacuggauuggccucuaugccuggcacuacuagcuauuuggggguagccagggagcacuaaaauucaaaagcuaugauuccaaguuuucuuacuugaagaauaugccauguggguuuccuguguauuuuggagagaugacugagauccccuggaccacuucaaguccuacaaaagcuuugugacucuccugaauuuucggcaucauuucauauuaaaugagcgugcaaguuuuccacacuacacugcaggagaauuacauguccagauuuguagcuucgaacgucuguguuuuugucauggugaagucugacuugcugagguuguucuuuguacucuugaaaguguggacuagcagacuguccuuuuuucugaacccagaaacauggcacuguaagcgggcaucucuuauccucgaaaucugauugcucauaaagagaaauuuguaaacaugguuuucaaagaucauuaugcuggaagggaagucaguuuacaugcuagaaauucauuuuuagguaacugguuuuucaaaauaguaauccuauggaacugaacugucuacuugacucugacugcauuuaaaacaaaaauguaauuuuuaauugauaggagaaauaacccccuuagagagcugggcaccagcuuucuaccaacucuccaacccacgagcugaaucccagcagcuccgucccaggggaaaugagugcuuuucagucuuauuuucccacauuagaaugaaaggggaucauuugagagccucaaaaauaaauuugaguaagcaggacaaaaacuuuaaaacugaagcaguucccuaaaaagagagcuaugauccucuuuacugcugcuuauuucagacaucauaaagcaaauauaaauaaugcuuucuccuuuaaaguugagagcaagcauuguaaccugaugccugguuaacuaauuuggaagugaaaaugcggguuuuuacaagcaggaagggugugccuuccuuugaaagcaugucccuaaaaugucagugguguaaccauauauucugggcuguucaggucacugcaguucucucugggacguuuacauggagacuuuuuuuuuuuuuuuuuuuuaacucuuuuuauuugacagagagaagggauuggcucuucucugauuuuagugguuuguuguguuuaugguuaacugugcuuuuaugaaaagagacaccauucagauuacaaugucccauugguaggaauugugugugugugacccagugggcagauuuagccuauuugaaauggcucuuuugaagacaaagggugauugugauucuaaaguaaauauuugaccauuuucuuuuuugcauagauaagacaauuuugauauccacagcuguccugguuuucaaauuaggaugugacaguccuaguuccaagguuucccucuaaccaucuguguaacaaaucauccaagcaauucacuuaaccuuucugauguccagauuacuccaaaguauaacaggagacgggauuaggaccguguuucccaaagugugguauauacaugacucugaguguuauguggacauggcaguaaaugaaacgaaaccacauauugagagaguuacuauauuuuaaguuguauuguauuccuugugauagaguaguugaauaaucaaggaggaaauuucaauuuagugcuagcaggugucucauaucucucuaacucacacuggccuccacuuuuaaguaggagcgucagggaucucuguuuuaggauuuccugcaagcaaagugaccagcuagaaucuaacaacaugguucuguucccagucuauuuagguuucuucugguuuuuuuguuuguuuguuuguuuguuuguuuguuuuuguuuuuguuuuuacgggugauauugguuuuccauuuauaguuauacuuucuuuugaaauaaaugcauccaaguuuccaaaaaacugagucaguauuaaaaacagcauugaguaaauaacagugcaagaauauagcacaauucccaaggugugcauaaguaaggggagauacuggauucaaauuaucuuuaauguuccuccuuuaauucucugaguuucuauauuuaacaagaaggaaaaugucucuugcaagucgacucaacugaagucuagcaggcagcuuguuccucucucuacaaagauaaacaugcagagacuuuugugcagcaucacagaugccugguccaacuccucaggcucacaccuuuguuucccuguuuuuccaaaaugagacgggagaacagaagcugugagcacguggacaccugcucuggcucacugacuuagagucauucuuggugucaaggaucacuugcaugggcacauggagaugaaaguaucagguuccugcaguuuggaagaaggagaacuucucagcucuuuccuggcagcugagccaccccagaugauuugaucuuaacauggugagcagagugaggcagucaggauaaggagcaggcaccuuuagccugcccaaggcuugggauccagaauucagagccuuugguaagcucuuuuggcuguccgcaaucuuaguagagacucaccuuaguagagacucaccuuaaaucucuccaaggcuguugugguuaaaguucaggcgagggcuauaaaaccaaaugagaguguauuuaacgagaaaacucagagucaugggcuucagaaaucuuaaggagcaagggugacuuuuuccaugccauugucugugucuauucagguucgauauugcaacucccuggaugaggaagagaagagggagcugaagcuuuucagcagccagaggaaacgcgaaaacuugggccgcgggaaugucaggccuuucccagucaccaugacaggagcuauuugugaacagguaagcauggauucaggggagugaagaggcauuguucuggcaucuuuucacccauucauucauccaacaauuguuuuacugagugccuacuaugugccugagauacaguagugaacaaaagacgggaaaguuucaucuugcccuucuaaggaguuggauucuaggggaggaagucagacaauauauguaaucaacaaaauagaaaaagauacagcaaggaaggagacuugaauguacuggaaguguggggaggcugcaguuuuaaggaagguugauggggaagaccccacuuagaagaucugagcaaagaugugcacagaugugcaagagggagagagucuugcagauuuuagggcagagggaaugcuaaggcagaaggaaugaccggcuuagaggcccugagacaggagggugucuauuauguucaacagugaguuggccaaugggcuggggcagagggagugaagggagauaauucagauaaagucagaguucugggugagccauuggaagaauugagcagagcaauggcaugauggauuuauguuuuaaaaagagaccuuuagaaaauggaguuggcuugggccaugggucagccucccucccaggaucaucccagaacgagagccauuuaaaggggagguaaaugaucuucuccugagaauugagaguuccuuauugaagugcaugaagcccuuccgagucauguugacaggagcuauuugugaacaggugagaguggguucaggggagugaagaggcauucucccugggaccucacugcguucaagauucuggauuuccugucuccucugcuccuguugagugcucaggguguggugaagaagaguuuuagagacugcagggugggaacacaccuugccccaccucucagcugccacaggcuuuccagugcugaucgucauucuugguacuucucuaaguccuacagcuuuuugaacauuccuaucuaacuccuuaagcucugcguagaccccuugagagcugaagauauguuaacuggaucaaagaagaggaggugggaugcugcccaagggaagcagaugucauuugaggcccuuuuuugagauuucagagggguagagugagaagguucaguuauaugggaugggguagcuaauugaccagagauuuggcagugggaucuuuauucuuaugaaguauaucugggacccacccuuaagguacagguggucagugguugugaucugagauucacugugcuccauccaggcaaggugaaauccuugcuccucucagaucagucuccuggaaccaggcaagcugaguuugccuaagggagaaggaagguugggcauuuugugggcaggugccaagaauuguguagaauagugccaagagugugaaggcagaaagagcuuucauaaguuugacucauguuucuuccagaugaccuugaccguguuacuuuuccuugguuuugucaucuauagaauggaugaaugaugacucaugugaggguuauauaggauuaugucugcaugcuuuagcucugcuaacauuaucacggaagguaaggauaacaugaugccuuucuuuuguccagucacacacguggaugaguucccagagacuguuugugaggucuuuacuucauuuucuaagauacauuucaacgcauagcaugggaaagauuuggugguagcuucucugcucuuuagacauuguccccugagcucagccacucuuguaugacccuagaacuauacucaaccugugaaccucaaggcccaugccauggucagcagaagcaucucccuagaccuacuuuccacauuuuauucuucccucagagucccucaaaccauauucuuuuugucccaaccccaacuguaagcauagguggccagugauucugccuuguuucuuuuaggaucaagagggaacuugagaaaaugagugagaagguagggaagggauaggaagaaacccuuuccauaguuuggccuuagaaguggugccgugucaaucaagacuauguagaaagauguuagaggaagcagacuaaaagcaugccugaaaggcacacagagaagguaguuaaaggugagcgugcuguuauguauccacccucccucccauauaaaaguauaggucccaccuccuccaagccccguccucccacccaccucccuccccagccacuccuggugguguuaaaccuggcugugucucugcauggaguuuaaaguaucuaaaagauaaugaggcuuuccucugugccaguuugccuccugccugcagagccccuguacguuauugugcuaaaagagcuuuucuuucuuucccaccuuugugauuccucauucucccaaugacuuucucucuacauuauuuguaagccuuaggaaaggagaguucagggaggacaagaaaaaccugcccugcugccuguguaaagcaggaagcauagugacugcuuugaacauaagcacucaguagccagcuaauggugguuguccuuuaucauuuaugcacagcacugggagaugggggcuagugugacuacugauguuucuguuugccucacagugcggaggccagaucaaugguggagacaucgcuguguuugcgucacgcgcuggccacggcguuugcuggcacccgccgugcuucguaugcacugucugcaaugagcuccugguggaucugaucuacuuuuaccaagaugggaagauauacuguggcaggcaccaugcugagugccugaagccgcgcugugcugccugcgaugagguuagagcaaacuccagcagguuuaccugcccaucaccccuucauugcaccauagccaacacauggucuucuggcuuucugcacugaagaaagccauaggcaacuucauuuucuugcauuaacccuuuugggagagaagccccacccaucccugguuucuagaaugucugggguugcggccugcuuuacugagcguggaggucucauagcuuccuguugggaaggcaguuucuguauccaugaagauccccaagugacauauaacuggcccuaaguaaguucagaacccuaaaaacaaaacaaaacaaaauugcauugugcaucuuuagauauuaacccuaaucucauggaauaaucaguaauggagugccacuuauaucuuaaaauuguuucauuuuccaagauucacugcugcaaaaugauuagaaaagagaaaauagguagcauuauuugauuuuucuacaguuuauaaaaguucugagugaaaaaaaaauucaggaggcagauggauacuucauuuggaugucucugccccaugcucuaagaaguacccuauguaagaaagcaggauagaacgcaaaaccucugccuggccuucuuccccuacuagaagcacacccuaccguguaagcugacagaauagaaaaccugguuuagcuuuauaaguugggagcagaaaaaagaauguucuaaaucugaccacuuuuaugggaauaauuuggguaaaaguccuagacagagguuuccuccugugcaaaggaguuuuuugcaucuaucuuucucuguaaauagcagugugggagguaaguaacacuccccuuuuucagccagacagccuacuguuacaugggcauuucuuucuuacaaacuaccuacgagggacucacuuucuaggaggaagcugaucaggcucaacuaauuugaauucuaacacuaauggugauguucuggagagaccuucuagaaagauagcuggaaaacuaaauucagguccaacucugugguucuagaacaccuuuugaccuucaugccucaguuuccacaucugaaaauuggugcucagaauacagcuuuguguugucuaauggcaauuagaauaugauugaagcacacacuuugaaauuuguuuauugagauauaauuugcauagcauuaaggacccuuuuaaaguaaauaauucaguggauuuuaguauauucacaaagcugugcaaccaucacugcugauuccagaccauuuucaucaacuaaagagaaacucuuuauccauuagcagucacuccucauuucccccuuucccuagccccuggcaacuucuaaucuauuucugucucuguggauuuacauguucuggacauuucauauaagugaaaucauaugugaccuuucaagucugguuucuuucguuuagcguguuuccaauguuaauccauauaguaguauauguaaguacuucauuccuucucguggcugaauaauauucaguuguauguauguaucacauuuugucuagccauguaucaauugauggacauuuaaguuguuuccacuuuuuggcuacucuaaacaacgcugcuaugaacauuucuguguguacauauauuuuuaguucucuugaguguauacccaggaguggaauugcugggucauaugauaauucuaaguuuaacuuuuugagggaaugccaaauugucuuccaaaacaaguauaacauuuuacauuccugcuaucaaugaaugaggauuccaauuuguccacuuucucacuaauacuuguuauuaucuguuuuuuuuuuucauuauagcuaucguaauggguaugaaguaguaucacauugagguuuugauucauauuuccccaacagcuaauaauguugagcaucuuuucauguguuuauuagauauuuguguaucuucuuuuucagagaaaugucugaaaaaauuuuuuuaauuuaaauuuuuugacuaccuuuucaauuggguuauuuuucccuuuuuuuuuuuuuuuuuuuuuuaagacagagucucacucugucacccaggcuggagugcaguggcaugaucuuggcucacugcagccucuaccucccagguucaagcaauucuccugaccgaaccuccugaguagcugggauuagaagcaugcaccaccaugcccagcugauuuuuguauuuuuaguagagauggcguuucaccauauuggugaggcucaucucaaacuucuggccucaugugauccacacaccucagccucucaaagcacugggauuacaggugugagccacuguacuuggccuauuuuucucauuauugaguuguaagagugauuuguauauauucuguauacuaguccaucaucagauagaugauuggcaaauauuuucucccauucuauagcuguguuuucacuuacucgaugauguccuuugaagcauaaaguuuuuaauuuugaugaagucuacguuauuuuuuguuguuuaugcuuuuagcaucauaucuaagaaaccauugccuaguucaagaucauaaagauuuacaccuguguuuucuucuaagcguuuuauuguuuuuuugccccuagcucuuuaaacccauuugaauuaauuuuuuuuucuucgagauggaguuucacccugucacccaggcuagagugcaguggcacgaucucagcucacugcaagcuccgccucccagguucacgccauucuccugccucagccucccaaguagcugggacugcaggugcccgccaccacaccuggcuauuuuuuuuuuuuuuguauuuuuaauagagacaggguuucacuguguuagccaggauagucucaaucuccugacuuugugauccacccaccucggccucccaaagugcugggauuauaggugugagccaccgcacccagccuugaguuaauuuuuauguaugauguaagguagggguuugaauucauuauuuuacaugaggcucuccuguugucccagcucuguuuguugagaaaacuauucuuuuccccauggaauggucuuggccuccuuuucaacaauuaauugaccauguauguaugaguuuaaaucuggauaccuauucaucuauaugcccagccuuaugccagugccaugcuggcuugauuacuguagcuuuauaguaaauuuugaaaucugugcuuugaaauuuuaaaaacucuauauugggggaaaaugcaaacacuugugagggccuggcaggugcuguaaaugaaggugacuuauuuuaaggcaauagggaagggugaagaauaugacaaacuggagaacuugccacucauuggaaagcagcagccucucuucuuagcucuaguuuauuacugccauguaggaaugugcacugagcauugcaaauguuguguuuucaaaagauaaaccaggauuacaaguguuaauaugauauuuuccauuuaaaaaaauaauauggccaggccaaaugaagcagauauguauguccaaugugccugugagcugucaguuuuugauccugccuuauauucuccaggguagaacauucuuucucuuauuaaaugugguuaaguuaauuacuggcuaggccagaaaucauguuuaauuaugcuuuagguaaauccauguauaggaacugauauacauacagaauaaacauauccauauggauuuuuguuuaauuauuugugaguaggaucugcuuucuuacccuucuaguucaaggaccccauagcuuucuuccuuuaaaauauguucuggauggguuuuacacacugaccauuuggcuuccccaucuccagaucaucuuugcagaugaaugcacagaagcugaggggcgacacuggcacaugaaacacuuuugcugcuucgagugugagacagugcugggcggccagcgcuacaucaugaaggagggaagacccuacuguugccacugcuucgaguccuuguaugcagaauauugugacaccugugcccaacauauaggugaggcaauauuuggcagucagcuugguccuucugugaugcggucaccuuuguuuuggguguaguuaaaguaucuuugauugcaaguguuagaaacccaacucaugcuaacuuaacugaaaaagggaauuucuugauucaugacacuagaaaggccaagaaguauacuagcuucagauagggguggaucaaggguucagacaaaaccgauuuuuuucucuguaucucagcuuaauuugccuucuguuaacaucauuugggagaagcugucuucaccuaauggucgagaugacucacuagugauacuagucuuaguauuugcauucucaaaaggagaggaacugugucucuuccaguuuucaggucaguucuuccaaauaagaaucuuuucagccuugcuuuggucaagggcccaccuccaaguggggacuaugugccauacagucccacaaccgaggcucagggcagugggggaagcucagaaggaaaaucuaaacagauaucuuccauagccuccuugggacaaguuggggauuugcagaggaggaaccaaaguggucucuugguggagagggauugucaaggaaacccaguggcuucuggcaaguaugucuuuaaaaaaaaaaaaauagcaaaagcuacuccagccaaaugcaaagcaaaugaacuucaaauaguccauaaacuauuaacucccccaauaaguggcagaucugagauggugaaaaucauuuucccucugcaaauacccaauuuguucaacccuuuaacgcuguuccagaucauacugcauuguggcuucuucauucaacuugccuuuucuggcaccuugggaaggagccaaccuuggagggaauaaaaaaguuggcaguggcugaaugucugugagaucacagccagaucauccaguggcuugugcaaucccaagaagucuguucagaagcugccgauuucuuaccuagagugaggagauacagagauaauccauuuuggagcccauuuugccccacuuaaaagguuuuaucaggaccaaaaaaaguggcuuuguuuucuugguucauaagaagugauguauucaaauaaaaaaauuagcuaguauuuggagagcucugugugcugauaaaaacccuggcuuuguggacaagacagcuagcgugugcucaacggugcuuugucauugggcauucuugucccacaugcucaggccugggcuuaagcucugcugugaagaccucuguucagcugcauuuccuucugggggcuuaggugauggcaaauuucccauccccuaaccccuaaaaaccucaccccucucacagccuguugcuucaacucaguacccaggagcuuucaugucucacaagaucaaaguagucaaacagauaaaccuucuuuuugcuaagaguuaggaaaugcgaagaucaguugugacaagugacaagacguguguggaaggggagagguaggacagugucagggaaaauggugcaaugucuugacucaguauugcccaaccgaggauucaagucugcaagugcacacuugcucagaugagaggggccaugugugcagaauaccagcccauggcaacaauaccccuucccauccauauuucuguuuuuccuguuucuguccuuggaggcuaagagccucuccagaaacugccacuuagaauuuuugcucaguacuuggcagagagaaaaaaucucucuguugcugcagcauguacaccucagauggccccucgguuuucuucucuuucuuucgcccuuuggcugcccagcacauuuauuggcauucucuccuccuuuccuauuaaauccauuaaagggugucaguguuuuaucagaaaaggugaccaugguggccugcaguauuauugcugcuguaguuaaaaugcugucccuaauguuuguuuuaaauccacuuuuuuaccaaacauaauuuuccugugacagugaaagagcacacucuauauagcaugcauaccucagucacugggugcuuuaccucugaccauacuguacaaauauuccauauuuauacagccgcucagagcaggcccugcgucaggcagccguugcuagggcaacgguacuuuugccugugcacagcagaguaaacaguccuauaaacagaccgaggcuguggcagcaguagacacacacacccuccaagaaguacuuaaagggcuuagagaaggaauaaaaaaagaacgcuuagaugucgaacagcagagcccuuuuccagauguuuagaguucaggagcaguucagaggaccaucugacaucgauguuuaucggggaccacguucugcugccugccaggccgcuuuaugauaugccuccccuccacucucccaaacugagcccuuccuuccaugaggcccccaucccgaggaacuaggcccuugcugcugcaucugagcaugugugcuugccaaagcuuggagaagcagcugguggcagacagaccagagggacuggacuuccuguguaccucuaacagggaguggggauagccgcagcugcucuggaugcugugcugauuagagcucaccaaaggacccagggaugccaucaugagcucucugcacucuuggcauuugagaaagggagugagaagaaggaggaggaagaaggagggugggagagggcaggagagacagagcagccuccuaguuauuucuuggaaugcaucugggcagugacccucagcgaagagagaggcaggcuuucagaccuaacgcaauaaaagaagaguggucaguaggcccaguucucagcacuccaugcauguuaacuccauuaccaaguacuaugauuauccccauuguacugauggggagaccaaaacaaagagaaaugaagcaauuugccuagggucacacagcuggaaugcagcagagucaagauuugaacccaagcagauggccgucagcaucuuuacaaccagcugcugugggauggagcugggauuugaaccuguguucaucagaguccugaaggcuuaugcuuaacuacuacagagucccaugucccugugaugucugccucagcuuucucccaagggucuggggaggaaguguccacggcgcucgggguugucuguuucuagccccgccccagcugguuauuucucacucugcuggggagcacuggugcuguaagagauggaguugauccgucucaaaaaaaaaaaaaaaaaaaaagauggaguugauucaguugauucacacaguuuccugucucccacuuggggugacccuuguggcugcuccuaucccuauaaaaaaaaauccccucuuagucucuaaggccagguuucaaaaugaaaagagaaccccauaguuugggaaagagcuaauacgagaagaauugcccucauuccucucucccugggcuccauugacacaaaagugagucagggaggagaaagguaggcugcuugggccgguggccuuuuguucuugcaauucucuucuucucccuaauuucugguucauugccucuuuagacaagucuccagaaguucuuccuugaaaguccaggcucaggaacucucagccacugaagauaaaggccacauuagucccuuuuucugggaagccguguaucauuacgcaucaggagaaugcagggguccugguccacccuacagucauagcuugaggcuauauucccagcaggcucuccccacgggaaggggccccagcagcucccaguuuccauucugccaguuuuacugcugcuauaaaaagagccugcugugugacugccuuagcaaaaguccugccuuagaaaaagcaaugagagguguuggcuuagugcaggucacuugcccaccccugaaucagucccugggugccaggagagcagauuuuuuuugcuggccuauguugggccccagaucagcuuuugccccacccaaagcucacggccugaagauggcagggaaauggugucccacagggagaggaaguccuauaaccagaagagggcagagaugaugagaaggcagaaccccuggggcugugggaggcucccuuaguacgcaguguggccaggcuauauaaaccuggcgcaggccugucacagggaggaaucguaccucuuccuucccugaugaaauuaagcaaaggguacuuacgcucccagaggggcaguagcuuuggcaauaccgugucuagguuuuucuuuaccgaaagcagauuuuuccuuaacaagaguugaaauccacauuuuuauuucccacuaagucuguugagacugcuuuaacggaauagcacagacuggguggccucugaguaacagaaauguauugcugacaguucugaaagcugggaaguucaaacucaaggcaccagcaaaugcagugucugcugagggccuguuuuuuguuuccuggaugauacuuucuggcagagucaucauauaguggaaggagcaaacaggcucccuugggccucuguuauaagggcacuaaucucauucaugagguauccacucucaugaccuagucaccucccaaaaagcuccaucuccuaaugccaucacuuuaggauuuagguguuaaacuuaggaguucugaagaaaacauucaccauagcauccacugaguugcugcugugacuuacccauuggaauagcauaugcuaguaaugggauucacucgaucuaucuacacacaaagagcccugucauacaccaggccauguuccagguccuggagaugcuguagaaacucaaugagucuguccucauagagcuucacuuuuagcgggggagagaaauaauaaacagaugcauguauauacuguuguaauguaaagcgguauuaaugcuaucaagaaaacuccagcagguaaggguggagaguaauggagaaucacuauuuaguguggauaggaagacuucucagaggaguuggcuuuugagcagaugccuaacuagagugaaggagauagugucaaugucaugguugagaauaagacuuccuggguacagaucucgucucugguuccuaguuauguuacccugccaaguuacuuagccucaucugccucuacuuucucaugugaaaacugcaaauaauauuagaaagcuagcucaaggagcugagugauuaaaugaguuuacauauauaaagcucuuaaagcaguacaugaucauacguuaauauuacuauugcuauuugucagggggaaaugugucccaggcagaaggauucauagacaagccauuuuaaccuagagucuuugugcuuggagcaaaugaguuaaggcgcauacugguacaacaaggacuucucguaauaggacgugaauaccauuuacauaagggucugauuguugauuuauugacaguuuauccugccgcaccuggaauccugagacaaaccaaggugcuauguguuucacgucccagugcagagcucugagcagcucaucagccucuccaaugucucucauuuuuuuagguaucgaccaaggucaaaugaccuaugauggccaacacuggcaugccacugagaccuguuucugcugugcucacugcaagaaaucccuccuggggcggccauuccucccgaagcagggccagauauucugcucacgggccugcagugcuggggaagaccccaaugguucugacuccucugauuccgccuuccagaacgccagggccaaggagucccggcgcagugccaaaauuggcaagaacaagggcaagacggaggagcccaugcugaaccagcacagccagcugcaagugaguucuaaccggcugucagccgacguagacccccugucacugcagauggacaugcucagccuguccagccagacacccagccucaaccgggaccccaucuggaggagccgggaagagcccuaccauuaugggaacaagauggagcagaaccagacccagagcccucugcagcuccucagccagugcaacaucagaacuuccuacaguccaggagggcaaggggcuggggcccagcccgaaauguggggcaagcacuucagcaaccccaaaaggagcucgucacuggccaugacaggacaugcuggcagcuucaucaaggaaugccgagaagacuauuacccggggaggcugagaucucaggagagcuacagugauaugucuagucagaguuucagugagacccgaggcagcauccaaguccccaaauaugaggaggaagaggaagaggaagggggcuuguccacucagcagugucggacccgucaucccaucaguucccugaaauacacagaggacaugacgcccacagagcagaccccucggggcuccauggaaucccuggcccugucuaaugcaacagguagguucuguucaccuugaaaacagauagaaaggggguagucucugggugacuggaugcugguccccaggaauuuuuuuuuuuuuugaaauggagucucgcucugucccccaggcuggagugcaguggcacgaucuccgcucacugcaagcuccaccucccggguucacgccauucuccugccucagccucacgaguaguugggacuacaggugcccgccaccaugccuggcuaauuuuuuuguauuuuuaguacacacguguuucaccguguuagccgggauguucucgaucuccugaccucgugauccaccugccucggccucccaaagugguaggauuacaggcgugagccaccgugcccagccugguccuccggauuuuaauguuguuucugccacgugcccucuucuaauaggcugcugaggaagguaaacccaaguuugagauggcuucuaucuuugaugggcuucccuguaaacaaagccugagacagguccagaugccugugauguacugagggagugcucucaggagaaggggagugagagaaagaggacagagcauggggaggagccaagugaggaauggugucuucacuggggucuggcuucugccugaucccacaggggacucugauggaugaguugcacuauagaaucaauugcuucuugugacgaaggggcugauguuuuguaccaucguguuaguuggucaucagcuuugggcugcugaggagugacaaagggaugagauaguggaugugggcuuggggcaaggcagcuccuguuggccaaaggcagcauuaaagaaagaaaauacuauggucugaauguuuuccccaaaauucuuaaauuaagauccuaaaucccaaggugauggcauuaggagaaggggccuuuugggaggugauuaagucaugagaguggagaccucaugaaugggauuaaugcccuuauaaaagagguccaagggaacuuguuugccccuuguaccauaugaagguggagaagguguagcugugagcugauggcaguacucacagcaccuggagcccaguugccccagcguggugcugccuggggcaccaaagcauccaugacagcuucugagacuguucugaaccuguuucucaccagggaacuggcuucaaagugcagauaaagacauaagaaauguuuggcuagacaaggagaagacaggcaggcugaaaagaacagaaguagagagagagagauaauggcaugcuucucucuccagugaaguuguccagcugguuuugugugcgugggaagacugauguuggccaggcaugguggcucaugccuguaauuccagcacuuugggaggccaaggcaggaggaucacuugaggccaggaguuggagaccagccugggcaacauagugagacucugucucuacaaacauauauguguguguauauauauaaaauauauagcguguguauauauauaucauauauaauauauauuguguguauauauaauauauaaauauauaugauauaauauauacaaauauauuauauauauauauauaaauuagcuggacuugguggcacaugcucauagucccagcuacuuaggagacuaaagcaggaggaucacuugagcccaggaaguugaggcugaacuaagcaaugaucccaccucugcacuccagccugggcagcagagugacaaccugucucuagaaaaaaaaaaaaaaaaauuuaauauuauugauuuaauauuuuaaacauuauuuaaaaaauauuuuuaaaugugggaaaaaauagaguaacguagauuuucucugugauagugcuacuuaaagcagaaucugaggauaacacuggcugagaacuaucacccaucagcagugagauuaguacuuaacaccuaucagcagcgagauuaguacugaaacuggaaguguuagaaacuuauagcaguucgauguugcggugccauccaagugcguuuucagcaggcuugucuuauugaucagguuauagacccaucaggguguuauagaacucacauacugagcucuuugugcuuugugcugugucucagacaugcucagcagggccauaugucgguccacaagggauugaaaaugaaaacaaacugguccuucaccacugauagcuugagaagaguagcgcucuaagaugugcuaaguauaucugccccuuugugggcaagguaccagaggagggagauauacgucugccccuuacagcaaggauuccauagccgauggugucuggauagagacugugauaauguuagccccauuugaaggggacggccacugcucagcuccagcugcuuguugccaugugcugggauauuuauguauccaccuaaccuuuauauagcucuugcaaugugucaaacauuguucugagcacgucauaaauauuagcuugcuuaauuacauugucauaacacugugagggaggaauauuguuaugauucucauuucagaguugaagaaacagaaauggagagguugagggacucacccaaagucacucagcuuucagagugguagagcagggauuugaaccugugcauaugauuucagaaccuugcucuuaaucacaccaggcugccagucuaauacaagccccauccugucagaucuuccaguuuuuccagagaaguuaaaaauguggauuuuuaaaaauaugaaaucuauuucaacacugcuagacaaacaaaaugaggcucugaguuguagcuuguccaugcaguggguuuuacuuucuauccuccucaaauacauccacaucuguguucccauuuguccaagaacaaagaguagauauccucauccccauguuucagauggaaaaaaaaaaaaaaaaugaggccuuggugacuaagcgccuugccugaugucuuagaagggagcaauuagugcagagugaugacugccuggcuuccagcccagguuauguuauucucgaaagauuuaugugcuauaauuauuuaagaggacagcagauaaauauauacuucagccucugaagaagaguuucucaaagcuagaccaccugcauuagaaucaugggugugcuugauucaaacauaggcuccugggccucccccuaaccccuugcaucagaacucuacagagguggggcccaggaaucugcauguuaagcagaucucugcugaggcugaugugcaccauugucugaggggagaugugccuggguuugucugcucugacuguaucauccucacguuguggcucaugaggaaaucagaagggcuagagguugaggaaugcuggaaagggcaagugaggaagacacucaauuuccauuccuaaggagggaguggacgcgguuuccauuccuaaagaagacaucaugggagauuuacucucaugauuuucuaggauccuugggcaaagcaacuaaugccccuuugccucagauuuuugggaagcaacccuggccaugccugauaaaacugagggaaaaaaacuccugagaucagcacugucuaauauggcagccauauggggcuguggaaauuuaaacgaauuaaaauuaaaugaaauuaaaauuucaggccauuaguugcacuagacacauuuuaaguacucaacagcaauggccugaaguuuaaauuuuauuuaauuuuaauucuuuuaaauuucaauagccuccuguggcuagaggugacccugcuagaaggugcagaugacagagugaacugauaagaugggcacgauauuaagccaucauuagucucugaaguucuuacaugagcccuaauuuuuugucuuucuaauuaauuaauaguuaggauuacugguucuggagucacacuugcugggaugagaucaagccuucaucauuuaggaguuguguggccuugaacaagucacuuaaacucugcaaaacucaauuuccucauccauggaauuuugugaauaaguggauaaagguguuccuguaguacuuccuuuguauagcuuuggugaggguuaaaugauaauugcguuuaaaaucauuaauauagucuuugacacauaugaccuucuauaaugguuaccugcgacuuuuuauuauuauuaauucuuucuccucccaaacacacugauucaaguuuugaccuguuguggcuacuaacuucucccaccauccaccagcugugcagguuugcauuuuagauuugaaaauacuccugcaugggccaggcgugguggcucacaccuguaaucucaacacuuugggaggccaaggcagguggaucacuugaggccagaaguucaagaccagccuugccaacguggcaaaaccccgucucuacuaaaaauacagaaauuagccaggcaugguggugcaugacuguaguuccagcuuuuugggaggcugaggcacaagaaucacuugaacccaggaggcggagguuucagugagccaggaucacaccacugcaccccagccuuuugacagagcaaaacucugucuaaaaaaaaaaaaaaaaagaaagaaagaaagaaaauacuccugcaggcuccuuuuuuccuaaccagccugagaaaaccaugaaaaacagggaauuaaagaaagucauuuugugugcguuucuaugguucugucagauaugacagugucagaagaaagaugguggcuaauauucuaagcacagcuucaucauuccucauuggagcagacccuacauagccuuucacauccuacucugcacacccauacaccgaggacuagacuuggaaaguugguguuuuugcugcugucccucacuguuuacauuugaauuuugcuagaaaauucaguaguuuuuuuuuuaauagcauucuaaacuaucugcauaucuuuaaauccuagaaucacagucugaauaccagguacgugccacaaaaggcuuagugaaagcaccuugauccuucagauaaagcuagauuucaagaugauggauucuuuuuucuuccauggucaguaacuuauguuauugaauaagucuguaguguuuaaucuggcaugaagugugaucuuucugugggcagcauuuuuccucagaacagaucugaaaaaacagauagcugcacuggcuugucagccucagaucugggcuuuggccucucccaauguguuuagaacugggaguguacagucccuucuccuuggaaaacacaauucaucccuuaugcuuacacggagugacucaggcuggcacagccaccauuuauaccacugcaaugcagaagccuugcagaagcgcuuuaacuuugccagccccuaaacaugccucuaaagcagcuugcagccugcguaaucauagcauuagaaguagaaauaauaacaacaucaagaacaacugacauuauugaguguuuauauggacuggauguuuuucuaaguacuuuccauaaacuaaacucacucaguccucacaacaacccuaugagguaggcaugguuguuauucccauuuuacagaugguguacaugaggcacugagaggcugaauagcccaaggccacauugcuuggaaguagaaaagcagaauuuaaacuugggcauucuagcuacagagcuugugcccuuaaacacugugcuauggcugaugugaaugaccaugguaaauguacugcugcuucugauguugauuguaaccaaugauaaucauaauagaccacuggcuaugaccugacaugcuaauggcuucauguagaaugcuucuuuaaaugcugugagauaaaucugaucauuauacccauuuuacauauggguacacuaagguuuauagaaguaacccuuuuguagucgccacagauggcgaggacuugaucccaggugugaucaacugcaaagccaugcacuuaacuggccugauauuccucacaagaagggucauaaucacagucagaagacuugcacaacggcuuuagcugaagggauaggcauuuucucuccugugacagcuggcuuguugauuugucuguuugccaaugcuaaagagaagcaugcgagcacagcugugaaugccagaagucagagguggcaguccaagaugaugugccaaggucagagguaggaaagacaaggcagacaagcagagaugguccaggggcuggugccugggcaagagacaccaagggcagagugggggaccaaggcauuaguugcaaauuagaggucagggcucaagccacacacugggaccagguauauaguagagcuggaauuggaacuggcugccuuaggcagaggccacaccacaggacaacuggagacugugagcuggucccuggugaaggaugcugguguggaaugaugaggcugggaacaugaccauuccuugaggaucagccacauucuguaagggguggcuguucauagagagcugggucccauaggaaggaccucuagguaaggaugggagugagggaaggggaaacaacguuucuguuuauuuuuuugauucacuuagcaaauaugacaugagcgccuacccugugaguuauagcagaauaguaugagagcaugggcuguagaccaguaugccagagcuggaaacuggacuuauaguuuaauagcucugugaccuugggcaacggauuuaucuauucugcaccucacuauccucaucuuugaaauggaaugacccuacuuuucaggguuguaaugugaauuaaaugagugaguucauagaaagaauuuagaacagugucuaacacccucuaagugcucauugaauacugguugguauuaguauuuguaggugccaccuaugcaaggugcugggaaugcaaugcugagcugaauuggacaugggccuugcccucuuguaccucacagucuagugaaguugauacacaguaaccauccaauuguaugauauaaguaagugugaggcuaggaggccuuacaaagagggauguggcugagucaaaggacauccugaaaaagugaugcuucagggauaggggaagggucauucuaggcagcaggagcagcauguguaaaggcccugugguaggaauguaugaagaguugucagaagguccuauggcugggugagcacuuagaguaauaagacuuggaaggaaagcaagggccagauggugcagagccauuuagggcuauauuaaugguguaggccuuucuaauaagggcaacggaaaacccuuaaaaugucaggcccugcagugagggaggugacaugauccaauuugcauuuugaaaagauggcuucagcugcuguguggggaauugauuggaaaagggcaagugcugaugcagggaguccuguuaggaggcaaucuggggcuguguagcccaggcuagaggugaagguuaauggcaaaguccaaaauaaguggauggauaugacagugacuuaggagaggaaauuggcagagguuuacagugucccaaggggaguggguccugggagacagaggaaaauagauaugaaaacauuagcaauaguuaaagguuggucuacucuguguuuuuuuuacucaggccagcaucaaaugcaagugcauguuuuauuggccugaauaaguggagacacggagcaggaaucugaaagggcuuccuaccuucuuugaucaguguugcauuguugugucaaggccaugccuuuuacacaccucaucuacacaccuuggcaagggaaacuuaguugugcaaugccagaagguaacaggguaauuuuucagcauugcugacaaacugggaaagaaccagaaaacaacaacaugaggauauaaagcaacaacuggaaccacucacuuuaccaagaaugucugagauguuuuuuaauccuugcaaugcaaaacauuucuauauuuaauuuaaggaagggccaggucuauucuucugcauaacuuggauaaccauccucuaacccaauuucuuuauuuaaauauuggguagaaccucuuaaccagcuggcacccauuacuucauuggccacaccucagaugugcuuauguauuguguggcccagaucuuuuuguucauucccgucacuggggaagaugugugguccagucuggaaucacaaccuugaguccuauccauugaccacagggcccugggauauacuugggaaaugcauagagauugccuuuguucauugguauugcagaacucuuuuguuuggaagugucagaauucuaacuccaauggguguaaacaaaauuuuuuugaucaaguaacuucauacuucacagaucuuuaguuccaggggcccaaaugaugucaucaggacucgguuucuuucugucucugaguucuuguucccuguacacuggcuucagucucaggcagccucuucccugggauagccaggagggcugucagucacugcagaccaauguccaucaacaucaggugaaggggaaaaaguauugaucuucccuauuagugucaccaaaaguaccagaauugagucuucucauuugccugacuuuggucauccaacaauucuuaaacuaaccacuguggccaggagaaugauagcucugguaugucagaccugagucaugucccaucccaggaacuaggcaaugaggucaaacccaucaaaacuucaggacugacaauggagaaggaagaauguucaaagggaaaucaaggucauguuuucaaaggaagagggauuaagcugcaaggagguaaaaccacaggcaccauagguaucccauccauccaggacugacguuuuuaucugauccccuccucuaaaagccccaccauauuugaauuuaacaucaaacacccauuauguauuucagcuaugguuuucuggagacaaagcucuggucuuugggguguggccuguggugauuuuaacguagggguuucaggcuaugaggagauauuuuggagggagagauuagauggagcccagccuucucacucaaugguuaguacauccuaaggagcaccuucugacuggucccauagauccccaaggaagcugugcccuguuguuggcauuucaugacucugaacaucaccccuagcucacagaccaggggccagaugaaaaccagcagagugaaagucccaggagaauccaucccucguuucuuuuucugcuuugcuuuccuggcaugugggaagccgaggacaaugucagagcaaggugggacaacagggaaucagugggcaguuggaagagagcucagcccagagcaggcgauauaccccugcuacaauguuguggucucccugacauuuucugggcccggagaaccuuuuccaguguccugguuuuugauaacuguucaaaagucuuauuuauaaccuccuugggcgugagcagucaucuauacccacagucaguaaccauggcugcugacagggagaaaagauugcugauuuuauucucuuuguuacugaaaaggcaacacuggaaaauucguccaggguggaggccagcaguggugggguuggggcguggugugucgugauggguuccccagacuggugcaagauuuuauagagugauuuuuuuuaagaaugugugaacauuucauuucucuuggaacuuuugaguuuguuaaucucacaaagggaaaugagaaagcucuuauccacuuggaaauggcuuuaaaacucaagccauuuaguuuuuaaaauauggagaguaaggaaaacacagaaaagaaaaauucuggaaaaagauagaaauagugaaaauauagcccaaaucucaccacuugaccaguguucauauuuucaugaauuuucaaguuucuucccuacguauuaguucacuauuuuucucuaacuugguuauaaacauagugaauaguuuguggccugcauuucuucauuugcauucuaucuuuagcuuaucuguguggcauuuguaaccaucauuuuuaaugacugcauuaauauucaauugaauggguguuaccacaccuccagaauuggacauauaggcaguuuuuuuaaaugaucuguauuuaaauccugauuuccuuugucugccaucaacaaaauauucuguuuugacuuccuuuuuuauugacuugaccuugaccuuccuaccuugaccuuccuaccuggccacuuggcaaaacuucuuuagcaucucccucccacaguguucuaguggucauaugagacuuaugggugauucugcaccgaccaucaccuuccuuaaccuccccuccucugccuauacguaaagugccucccagagcaguggaaaacuaacaugacuaaaacccuacuuccuaguacaagcagccuaagcuagcuuuggggagucuauuucuccauguaaacaauaaacuauccacuccaucaauuugaguauuccagggaucacuuacacuacguucaucuaggaugcuugucaauugugcaaauucuugggccacaucccacacccacaaacagaaucucucagggcucagacucagcaaucagcauuucgaacacacacccccagagaacucauagguucacuaaguuugaggaccacugagcuaaggaaacccagacucuucgucuuacauaugggugagguaccauacucaugagcucgccuguaguuagaacuugcaucugucuacacugccucuucucuuagcccugagucuagccuccugcugagacaaaagaaaaaguggauuauaucuccucucaaaauuucugaagauguccuugacaucaaaucacucuugguguaguaaauagcaccuuaguaaguuaagagcacauuaucugaagcauguggaugauacauaucuuaauuacauaguauggauuaaauaggaaagaggguaauacuugccaagagcauuugaugguuuuggaaucaucacggacugcaucagaaaagguggacaacaaaacacucuaaucuugaaauaggaccuguuuccgcucuagaaucaaugugaaaaucaagagaucaugagccgaaaguugcguaaaaaauuucaagauagcuugguuuguuguguguuugauuguuuaaccuagaauaguuuccaccaauaaguuucacucuccccaguuuucuaccagcaucaccuugagcacccagauagcucugugugugugcacgcaggugugugugcgugugugugugugugugugugugugugugaucugugaucguuccucguccuguucugccaggaaucuccuucagccugcccaccccaaaucaaaaucagaccaucacacaucucugggaggcagcuaucacaaaucaggcugagcaaacaggcagggcaccauuuagaagauaaagucugggucuuccacuucaaagucacuaagaaaacacguaguguuuuccuuggugcaaagacuuuuaauggcuuaaaaaugucauccagaauucccccauccauuuagcuaaggcagguguauuucucccauucuuucucuccuagaaaauugccuuucucaacucuuuguuacccaaggauuuaguguucuacuuugcagauuauucagacccugucuucucuuuucucucuuauuuuucccaugcacaaggaauggaggaaaauacucauucauuuugcuucuuacccagcagaguagagacuguaccucugugcguuucuguuaucugagucuuuccuuggaauaaauccuugacucucagcugugcuaagucugagggauucuugcauauucuugcuucuucgagucauuuauccaacccacucaaaucugcccccaccgaggguguuaucaguccaagaacaccugcagggauuuguuucugauucugacauugagcuuuuggugagaccaucccuagcagugacucugcugccuaggagugagcagcucauaccuugcuaggguuucucauccuggcagcagcagacuucccaguggcugccuuugaaaucaaaggugccaauuuuagaaggcagaaaaguccaguucagucuuuacuuugggaaacagauugagcucauagcuggaaaugagagaggagaggaaacugacuggaauaacucacccuuuuucuuucuuuauacucaaauaauggguccuagguaaaaagaugaaggaggaaauucccuuugccuaagguacacacucauacacaaacacuaccccaggggaaacaggguggucuagaugaaugauucucaacagagauggguggggguaguuacuagggguggugguuuuucccacccagggaacacuucgaaguuuggaggcauuuuugguuguaauaacugggggugcaggacacuacaggcgucugguagguagagaucaggggugccgcuaaaccuccuacagugcacaaaaugucauccaucccccuauacccagucaacaaagaauuauccagcuccauaagccagcagugccgagacugagaaagccuggccuagacacagggaauuccaaugaaaaucauuagucccaaucuaagucauucugaaccacaucugaggggaguaugaugucacgggaagggaccuccucagcuggaugcuucggaagccccgucugcagcugagagagcuuuuuuuacuucuugcucugucccuagcugcaacacacauucacacuuaguguuuaagggcccaguugaccugguugaaaccguaccaccucucuagcugugugacucaggcaaguggcuuaaaucucucaaucccucagcuuccugaguaaauguaaugucugcugcaguggggcugcuggguggugugggguaacaugcguggagcacuucaccgccugcccaguacauggaaaauucauuauuugagaguaacuauuacuuguauuauuugguacccugaucuccugccaccuuccucuuaacucugucucggccaguugcucacuuaacagggagagggaagauugaccagaacucaggaaucauucuaauagaaagggauagaaggcaagaaccagcaucaauggaugagugugagauuuggcgauucuguacaugucaaugauccagacccauguugacccccguaacuggggagcacuuugcuugcauuucuaggaaugcuugcagccagaaagaugagccuugucuccuugaaucugauuuacagccuugucugagucaaaagaggcuaccagaaucuguggccuaauuaugcccauguuaccccuauuaaugcuaauagagcccagccuucacaugugagaaaguagacugucaguucacagagcucagccuuccugcacugaucccccuggccccccaccccaguaucaauuaacuucacagagaauucccauuugccacagcuuagaggaguuaauuuguucucugagucuguggaugagaaacaggcccagcuuuggucccuaagugaggaagacaaugaggagaguacaguaauggaaguuuuccacugagaucauuaucagcuccuggaacaagcccagccaggcccuuggcugcagaucuguuuccagcucuggcuccucuuccaggagaaaaauucgaacccggccugagcuucccaucaagcuccccuuuauacaacccaaggcucagcaucccugagugaaccaugagccguacauguccagguccucugucacccauugugccucucuuucuauucaggaguuaggacuaccuaagaagcagguggcuuccucugucacuuucugccuucugaagcgguuuaauauaggggcacguuaggguaggggaaucuggaugacacaccuuuaucuggcaauacuggaugaagcacaucaaaucagaggacaucuuuuauuccagcuuccucugagcccagggacugcuacaaaagaagaauuuugaauccucuuaguggguucauaaagcaccauuuccauucccacuccuaccccuguugucuuccagagaugaacucaaagucuuccuggaaacauggaguuguaaauaucauuuagucugaacucagccccuaauauuguguaccucaauuaaagaaacuguguaaggugccacauccucccacacggcaucugcccaaaauauaucucuaauguacuggguuucuagaguagcaauuuaagagggggccaugcuggugggcuaccccaucuacccucaaccccagccacacuguuuuaucuauucucuauaccagaguuugaucaagaucuuuguggaaacaaaaagaauggggaagagaaagauguuuuaaauuuuugauucugaguuguuuuauauucauguuuucaacaaauauuuauugagugucuaccaugugccaggcacucugcuaguugcccaguguacguuggugaauaaaucagacuaguccuucugugggucaggccccagcaggaagcagauggcauauucaagggguaauuaaagaaaaccuaaugaaggagauagauagaaacugaggccuuagguagaaugcugcagccaagcugcagccuagcaggagggagccaggacaauaaauacuuucuacccucugaucuuuucccauuggucaaacccaaccagcagccagagagcaagagagccauucagggcagaguaggguggagaauggcuuauaauguaggaggggaccuacaaacacacagagaaggacagauugugauaaguugcaaagaaaaaaaugagcaaagaaaagaagagcgaauauugaggguuaacugcauugaaaggauggucaaggaagcucucugaagugaugggugagcuaagacuuggaugagaaggacuuggccuugcaaaggaaagaauuggcaaggaagaagguuaucuuauaugcaaaggcccugaggcaagagagaacuuguccaguucuaggagcuuaaaggaggccaguguguugagauuauaguugucaagaggaaagagcuauauuuggagugguaaagcacucacauuuuauugcuggcucaaauuccaccuccugguaucccucugagaacacugcccugguccccuuuuuuuagugggaugucuuaaaguagaaaaagucagaugauuuacagaggggauugagaaagcaaaugcaagacuacaaagaggcaguaggucgggaauaccaugugcauugagaaguacaggguggagaacuuuccauuuauaacagaagaaaaaauaucugugaacucuuacuacuguucuuucuauugcuauagcuuauuuuuccuuucagggcugauuucucucuugguuauguccuggauuucauauacacaguacauuugaauuuuaccccagguguccuggcuuagccaaguaacuaauauacaaaucugauuaaagcacaaaaccuuuccuuaaguaaacaguaagccuugaaaacauauggcuaaacagaaguugauucacaaauccccuuauuuuucuucucuugcaccaguuagccaguauuagccauggcagauuguuaucagggcucuuuggauauuucuguugguccuuaagaagaaagacugagcaguugucauuuuucccagguggguguugccacaguuacagaaggcuuucuccugucucucaaagaucuggaucccuccauccuaccucaaaaaucccuuucuaaggcugagguccaggaguucagcaggaagaguuuccauuauuggggggaaaucauauggaauauuguccuccuacggucuuaucgcuugugaugaaacagaugaggccaaauaggcucacaauuuggggcaaauucagcgacugggaccaaggcucagccuuacaaaucucaagagccaucucagguuugaggccuuuuaccacacucagcuuugcucugguuaacauggaaaagggagacaguaucucacuggaacuccaaccucaaccucaacagguuuagagugaauacuucacacuuacucuaaacaguccgcaggccuucuccaucucuuguaagagagaauuagauuggguacccacuggaaagauguaaggcagaggcuaaaauacccaggcacugguugucaacuuuggccacacuuggagucaucuggggagcuuuaaagaaauacugauaccuggaccccacccccaagauuccaauuuaacuggucugguauuuggccugggugagggacuguuuuaaaauuguccaauaauucuaccagucagacaauauugagaaccauaguguuaagaccaaacuaaauucuucaucaggugccuguguuuccagcuucugggauaauucgugggugguucugcuccuagugcccuaguuugguucuggguguacaugugugagacagaauuagcacucauccuaagagauagagagcucauauaugagcacacaaaaugcucucuucuaguaaccuuugcccuaccaaaaucuacccaaaacuccuagaaauugcagagagucuagcauuacauugccucucucaagaggaucuugagcguuagauagaccacuuuucacccuuggcucuguccauuacuggcucuguggccgcgggcaaguuaucuaaacucugaaccugaauuuccccaccuauaaaaacuuuuucaugggauuaaaugagaaaaaauacaacaccuagaucacaguaaacacucaaaaguauuugccauaauuagcaucaacagagauguggaauacucucaggacauccagauguuaacguugugauagcuaagggcugaaguggaaaagucaagugaacuacaguaaacaucaaccacauugauagugauuauccccaucuuggagaugagcgaacaaaggaucacagaguuuaaggucacacagcuagugaauggaugagugaggauuagagcaguuugccaguguguaguuugaaccacuacuccacauuucuguccauaaaauaaaaacucuuggugacaucagcccuuaaucuuggcugauaaaaggggcuugacacaaagcucaagucuuucugaugggaagggguuccccagaaagggaucagcagauaaagccaaaaugagcuggguccacugacugccacagacaccucaaaaaucaucuucccucccuuucauuguuuguuuccuuuccucacaccucuccagccccuguggcaccccccagcagccaggacacagcccuugacuaauacguaaaucugauuauacauuaaagccgagucucagcccaaacaaccucaguagcugccaguguaagauuaaacuccuaggcucaaugggucucucuucuccuuguuccuucugucacuccagguagaagcaagauccucugcaauucugcuuucaacagccaugguucagaccgguguuucucaaguuuuuuuuaaugcccuuuuuuuaacuaaacaugagacucccaccccccagcauucccgaauuuuuuauucuuugcauucccgaucucuuguccagagacuguccucuuuucauccccaaggugacaaagaucugcugucauacauagagcuaacagcugugaagccuuccaagugggacacuguguuaacuacuaauauauuguuaucuugguuaaucuuuacauuaaugcugugaagcauauacaugaugucaucugaugucaucuccguuuuauagauaagaaaaccaagacugggagagcauaaguaacauguucaggaucacagauuagcaagugguuaaacuaggcaucucaacacuugagucuuguauuuuuacaacacuugagucuuguauuuuuaaccauaaucccaugguucucaaccuggaugauuuuacgcccugaucccugccccaagggacauuugacaguaucuguagacauuguugguugucacaagagagaauuggaugcuacuggcuugugaucugguggguagaggccaaggaugcugcuaaacaucccacaaugcacaggacagccuccacaucaaggaauuauccugccccaaauaucaacagugucgaaguuaaaaaaaaaauaaaaaaucccugccauaaccccaaacuacuaagguuuuuguuuguuuguuuguuuguuucuuugguggaggagagagggaggggauauguacugugaaaauaacacuuuuuuuucuuuuaaaauguaauaugguaucauaacauugaauaugccuuuuuuuuuuuuuuuuuuuugagacagucuuacacuguugcccaggcuggaguacaauggugugaucuuggcucacuacaaccucucccucccggguucacauuauucuccugccucagccuccugaguagcuggauuacaggugcauaccaccacacccggcuaauuuuuuguauuuuuaguagagaugggguuucacucuguuggccagacuggucucgaacuccugaccuugugauccgcccgcugugagcucccaaaguguuaggauuacaggcguuggccaccgcaccuggccaaauacgcuuuuuaaauugcccaugccccuccccuugcucuacaguucucuucuaggcagggaagcauuagccauuccacuccccacuuugagaaucccuggcuuugucuuuggcaaaaucacugcauccuguuaacagcuaaaguugaaucuguuuucagaaauuucuuuuugcuugcagagacauucaguugcuaugcuuucccagcuccaguaauucaguuguuccacguguggagaaagcgaugggugccugucacccucugaauccgcugugggcacucuuagaccaggccagcccuuccugcccacacugugacuccuccugccaccucuaacgcccccaacgcuaccuccucuccuuaagccugggagcuccuuccaugggagcaacccccaacugcugcaaagggcagugaacagaaguggaacuuuuuuugaucauauaaaauaugaggaaauccucugguugcuugaccucagcuguucaauaaaucugcccugcucaagccccacucucuuuucaaggguucugguuuaaucagugccugcugcccucuuccuguaggggaaaacguucaagauaggcagcugagucucuuugggagauccaaaaucacaaaaugggaccaagagagagaagacaagucaggauuccaaguuugccuuuacagguuaucuugagcaucggggccuagcauagcucaccaagcaggagaugacgcuggagggcaccgugggcugacggcucagguccucaggaagggcugaggaugcccugagauggacgcuggguacagucuugcuuuugcaccugggaggcagaagagcuccccagcugagaccuuaagccuucagucaggcuaaucaggauuugaauguucccugugugaucagggcagcccccaaccucuuugagucucagauuccucuuuugaaaaaaugagaaugaugauaccugcucuuaggggguucaugagagucagaugagguuggauauguaaaauugcccagcaccaugccuugcccauggaagauacucacaaugguaccucucauuaaauaccaauagaggaaaacuuacagaggaccagcguuggcugcaggagggagagugaccguggacaaaggugguaguaauaguaguggugguagucauggcaugaguuauagaguggugacuacaggauggggguucucccuggagcauuauguugcacauuaucuuauuggguaaggcugagcuuguauugccuggauguuguccuccaugaacugcucuucuuauuccuuuccugccuuauuuucucuauaacacucagcaccauuugacauaguguauauuuuacuuauuuguucuguuuauugccugucugcccuacuggaaugagugcuccuuaagggcaggaacuuuaucugauuuuauuuugcugguguugccccagcagcuggagcacugccugaugcauaguaggcauuugauaaaccugacaaaugagugggcauucacgaacuauuugcgaaugaaugagccuccauuuuacagaggacaaaacagaggcuuagugagguuaagaaaccugcccacaaggccgggcacaguggcucacaccuguaaucucagcacuuugggaggccgaggcgggcagaucacaaugccaggaguucgagaccagucuggccaacguggugaaaccccgucuccacuaaaaauacaaaaauuagccaggugcaguggugugcaccuguagucccagcuacucaagaggcugaggcaggagaauagcuuguaccugggaggcggagguugcagugagcugagaucaugcaacugcacuccagccugggcaacagagcaagacuccgucuaaaaaaagaaaaauaaaaagaaaccugcccacagucacauggcuaaugagaggcagcccgacuccagagccuuuaaccaucaugcaguguuguuuggucagucucgaugaccauuuaaaaccagcugcagaggcaguggauccuuucuuuggguuuugagcuuugagguagagguguggguugagaugguaugguuuaagaugccugcaagauuugaaacuaccugccgugguuucucauaccugccaugacuucuagauuuucuguuguaaaacagcugugaauaacuuagcacaagauuuguggaggaauuuuucuuugcugcaucuccuaguguuucagaaaugauaaauauugggcuaaaaauucuugucccagacuguuucagccccagaaaaagcuucagauucucuugggagauaggccaagaugguaaaggguaggccccccaaguuuuucaugaaauuuuacuguuuucucuaauuacaagcaaaaauagcuuuuaaaaaauuacaaacuacagaaauauauaauguauaaauuaaaauuguccacgauuacucuccccccauugacuauuccuuugguauuuguuguuaggcauaugcugacacauagauaacuaaaaacaaacaaaaaaaaaagacucaugauaauguuuuguaauuuguuuuuucacuuaacguuauacagguuaggcaucccuuaucugaaaugcuaggggccagaaguguuuuguauuucagguucuuugucagauuuuggaauacacacauaccucagagauauuucauguucaguucuaaaacaccucaauagagcagauaucacaauaaagugagucaugcaaauuuuuugguuucccaaugcauauaaaaguuuuguuuacauuauacuguagucuauuaagugugcgauacuauucugucuaaaaaguguacauuaauuuaaaaauacuuuauuacuagaaagugcuguugauccucugagccuucagugaauaauguuuuugcugguggagaguguugccuccauauuguuggcugcugacugaucagaguagugguugcugaagguuggcuuggcuguggcaauuuccaaagauaagacaacaaugaaguuugacacauugauugacucuuccuuucacaaaagauuucucuguaguaugugaugcuguuugauagcauuuuacccacaguagaacuuauuacaaaauuggacucaauccucuucaacccugccacugcuuuauccacuagguuuauguaauauucuacaucuuuuguugucauuucaacaauguucguagcaucuucaccaggaguagaaucuauuucaagaaaccacuuucuucucucauccauaaaaagcaacaauucauccauucaaguucgaucaugagauggccccaucuucaggcuccacucuuaauucuaguuuucuugcuauuuccacuauaccugcaaucuagaaccccucaaaguuauccaugaggguuagaaucaacuuuguccaaacuccuauuauuauguauauuuuaaccuccucucaugaaucacgaguguucuuaauggcaucuagaauggugaauucuuuccagaagauuuucaguuuauuuugcccagauccaucagaggaaucacuauugaugcagcccugugagauuuauuucuuaauuaagaagacuugaaagcugaaaucauuccuugauccauaggcuaaagaaggggugcuguguuagcaggcaugaaaacaacauucauauucuuguacaucuccgucauaccucuugggugaccaagugcauugucaauaagugguaacauuuugaaaugaauuuuuucuucugaacaguaggucucaacagugggcuuauaauauucaguaagccaugcuauaagcuuauuugcugucauccaggcuuguuguuucauauauacagcacaaucagaguggacuuagcauuauuauuaagggcccuaagauuuuugaacuggucaaugagcauuagcuucaacuuaaagucaccagcugcauuagccccuaacugaagagucagccuguccuuugaagcuuugaggucaggcauugaguucuccucuuuagcuaguaagguacuagaugguaucuucucuguugaagacuguuucaccuacauugaaaaucuguuuaguguagcuaucgucaucagugaucuuauguagaccuucuggacaacuuguugcagcuuuuccauuagcacuugcugcuucaccuugcacuuuuauguuauggcgauggcuucuuuccuuaaaccucaugaaccaaccucuguuaguuucuaacuuuucuucugcaauuuccucaccucacucagccuucauagaccugaagaguuagggucuugcucuggauuaggcuuugacuuaaaggaauguugugggcugguuuguuuuucuguccagcccacuuaaacuuucccugugucagcaauaaggcuaggucacuuuauuuucaugcauguguuggaguaucccuuuaaauuccuucaagaacuuuuuauuugcauucacaauuuggcuaacuggugcaagaggccuagcuuuuggccugucuugacuuucaacgugucuuccucacuaagcuuagucaucuccagcuuuugaucuaaagugagaggugcacgacucuuccuuucacuugaacaccuagaagacauuauacgguuauuaauuggccuaauuucaauauuguuuggucucaggaaauagaccugagaacagggaaaaagaugggggaauggugggucaguggagcaguuagaacacacacacauacaacauuuaaugauauuauuuaccaucuuauaugggugcaauucaugauaucccaaaacaauuacaauaguaauaucaaagauuacugaccauagaugaccauaauagauauaauaauaaugagaaaguuugaaauauugugagaauuaccacaaugugacagagacacaaagugagcacaggcuguuggaaaaauggugcugauagucuugccuaaugaaggauugcuaugaaccuuccauucguaagcaucacaguaucugcaagaugcaauaaggugaugcucaauaaaacaugguaucuauauuugcauauggcuuaccaguugagcaucacuaaucuaaaaauccaaaacuugaaaugcucccuugagcauuugaguaucauauugucacccaaaaguuuucagauuuuagaacauuuugcauuuucagauuggagauacucaacuuguaccuuguucauccuucacuguugguccauauagcucacagucaucugaaguugugcuuuauuccauuguguccuaauuauuuuaacccaccucuucuuguuggauacuuugauuuuuccauagcauaaauuccuagaaauaagacuguuggaucaaggagugugcacauuauaaauuuguacaguuaauagcaaaugguccuucuaauggcuggaucaguugcacuuccaucaaaaggguaggagcucugagcugggugcuugacagaaccacaaauccugcugaggacaggagccacauagcauucccagaguguucacacaccugcucugauauuuugggguuguaagugcucacagagcagcgaacagcucugauggccaagaguuggaggcaaaccaagcaaaguuccucccucucuuccaggucucuagcauccuguuggguuucucaggugcugaccuucugaagaguuuccagggggagcugggucaccaucuacccuggcuggguuggcacagggaccacauuuagugacaggagcagggaauuaagucaucagucuucaccagccaggauuuggcgggaggaguaacacaaauuguccuggaaagccugcgucugacaguggcccggggcuuuggcaggucacagaauccucacaccuugcuuggcacugacaaggcagaguuaccuaacaggcaguuuuucagagucugaauucuagggucacccacaagugagggcagccagugcugggaaaccugaucauuuguucacacccacaugacuucaaagcagucauuuuuuggaucuuuaaaggcaucaaaaucaacugaagaacuggcugaaaaugcagauucuugggccucccagaaguucugguucacuaggucugggacaggacuggggaacuugcaggugauucugugauucugacacagcagugguucccagacaacacccugaagugagccuuggcuguuggguuaugaauuuuugggggcaaagggugggcuaguggggacaucuacuugagaccuguuagcagguuuugacuaaugacagaugaugagguagacaaaucuuggguuuagguuucucuuucucucauuuauguuccuuucugucaacaaacuacccccugguuaucuaggaaccuccuaaguguuuuccauucugaccucucuggcagcauuccauaacucuucuuucccucccuuuuacccccuuuaugaaaacuuacuuugcuagauaacauucccuuugcaaagauacucugcagauauuccucaaccauaauccacacugaucugauaaugggugguaucuggaaucaaaaucacagacucagcugggaggagcuuggagcgucucugcuagaaguucagaagaaagccaagguucagaggagagaagugauuuauucaguaucucacugguauuuauggcagugugcucuacuuuccgagccagucauucuuuucugcuacccuggaaagcaccguuuauagcaaauauacaacacauggaacuucacaaaugaaaaucaaagauuugacuaagguguaaggugaguggccugucugcccagcaugggacuagggggcggcaagaaacacccucccccauggcuacauaauuuaaaggggugccaaaaaacuuagccaucaagauaaggaauauuuuaagcauuaaaauucauacaaaaaaaauugugacuaacaaaagaauacaauuuguaaauaaagacaggaucuguuucacugauuuuuuuuuuuucuuuugccuuaggcuccaguuuggcugaacacagccgaguuacaauaacugagacagaaauuauaagcagauauguuuggauuuuaacaggaaucaauguugguaaaccacuauuucucaaaacauguuuaugagucaggguggggcuggguagagaagggguucuguuuccaaaguauggaaaacaaugcauuuucuaucuucuuucugaaaauuccuacugcacugaagccuguuuuugagaagugccguagaaauucccaaaccuaauuucccacccaaucguuuuuuugcauaauccagagaggauaguuuggaaaggcuuccuuuagcucacgagcuggauugauauaaagauuugcaaggugggaggaaagagauuugagggcccuggaggacucuccagguacucagcuccuaccagguaagcagcugcuuauuccaucugugcagagggggagcccagccaaacccacguugccucaggaagccagacgaagggcacaggcuggcugagacagagauuggagaccaagagcaggaaaagaaguuuucauggcccuguucaaggucuuuaugcuuuccaagaauucaguccuggcuuuguuguuuguuggcagagacaggauaauggguucguggcagcuucacuuuugcugaagggagaaguaggacacggcauagugcaaagccgugcuuucucucccuauuccugagguucccuagcugccuggccagaagccugggaguguggcaugcucagguacagccccugguuggucucuaugauauaugccuuccuggauauguuaugagaaacaaggggagcuaggcuuucuuuccacacucaugagauaaaggaaagcaccccagacccuuugcuguuccaaauguggucuguggaccaguaucuucuagaagcuugucagagauucagaaucucagacuuaguggauucagauuuucauuuuaagaagaucccugggcgacuugcaugcuucugaagcuugagaagagguugccuuagagucuggagaccugcuuugauucuugccuccaucacugacuccuacccucacccaugaccuugggcaaggugcucaucuuuuuucuguuuucaguuccuuaucugccaaacgaagguccaucugcugucuuuccagauuuccggaagcaccagugcauuuuaugcucuuaaaaaguauaaagagcucuauaaaugcaaguuaauaauacaagcaguaaugauuaucugaaaacuuaauucuuaccuaagaccuuuauuccauagcuucuauuuuauuagaaguugacuuuuucuuauaauuucaacuuuuauuuuagauucaggggguacaugugcagguuaccuggguguaguacgugaugcugagguuugggguaugauuccuccugucacccagguacugagcauaguacccaauaguuagauuuucaaaccuugcuuccuucccuccuuccccucuaguagcccccaugucucuuguugccaucuuuacauccguugaguacccaguguuuaccucccacuuacaagugagaacaugugguaauucguuuuuuguucccaccuuaauucacuugggaaaauggccuccagcuguaucgaugcugccacaaaggacaugaucucauacuuuuuuauggcugcaucauauuccaugguguacaugccccacauuuucuuuauccaguccaccauugaugagcaucuagguugauaccaugucuuugcuauuguaaacagugcugugaugaacauaugagugcaugugucuuuuugacagaauguuuuauuuucuuuuggauauauacccgguaaugggauugcuggguugaaugguaguuugguuuaaguucuuugagaaaucuccaagcugcuuuucacaguggcugaacucacuuacauuugcaccaaucguacauaaguguucucuuuucuccacagccucaccagcaucuguuguuuuuugacuuuuuaauaguagccauucugacugguaugagauaguaucucauugugcuuuugacuugcauuucugugaugauuagugacguugagaauuuuuuccuauguguguugguagcucguauguguucuuuugagaagugucuuuucauguuuuuugcccauuucuuucaacuuuuauuuuaaguucacaaaguuacaugcaaacauuuguuauguagguaaacuuguguuauggggguuuguuguacagauuauuucaucacccagcuauuaagccuaguacccguuaguuauuuuucaugaucuuccuccuucuacccuccacccuccaauagaucccaguguguguuguuccccuccauguguccauguguucucaucauuuagcucccacuuauaaguaagaacauguaguauuugauuuccuguuucugucuuaguuugcuaagaauaauggccuccagcuccauccaugucucuguaagggacgugaucucauucuuuuuuauggcugcauaguauucuaugguguauauguaccacauuuucuuuauccagucuaucauugaugguuaugcagauugauuccaugucuucgcuagugugaauagugcucaauagacauaaacaccugcaucuuucuuuauaauagaacaauuuauauuuauuuggauauaauauuuauuugcuggguugaaugguauuucuguuauuaggucucugaggaauuaccacacugucuuccacagugguugaacuaaucgacacccucaccaagaguguacaagcauucuuuuccucugcaaccauaauccauauuuuuuuugccuuuuuaagaauagccagcaucaguaauuuuuugccuuuuuaguaauagucauucugauggguaugagauaguuaucucaucaugguuuugaguugcauuucucuaauuaucagugauguugaguuuuuugcaugauuacuggccacauauaugccuucuuuugaaaaguauguguucauguucuuugcccacuuuuuaauggggugguuugguuuuuuucuugcaaauuuguuuaaguuccuuauagauguuggauauuagaccuuugugagaugcuuaguuugcagaaauguucuccuuuucuguagguugucuguuuacuccauugauaguuucuuuuugcugugcagaagcucuuuaguuuaauuagaucccauuugucaauuuuugcuuuugucgcaauugcuuuuggugucuucaucaugaaaucuuugcccgugcccauguccugaaugauauugccuagguuuucuucaagguuuuuauaguuuagguuuuuacaguuaagucuuuaauccaucuugaguuaauuuuuguguaaggaaggaguccaguuucaauuuucagcauauggcuagccaguuaucccagcaccauuuauuuagcaggcaauccuuuccccauuacuuguuuuugucagguuugucuaagaucagauagcuauagguguguggccuuacuucuguguuuccuauucuguuccauuggucuaugugucuguuuuucuaccaguaccauccugccuugguuacuguagcccuguaauauaguuugaaguugggaaaugugaugccuucugcuuuguucuuuuuugcuuaggauugucuuggcuauuugggcucuuuuuuguuuccauaugaauuuucaaguaguauuuucuaguucugugaagaaucucagugguaguuuaauagaaauagcauugagucuauaaauuacuuugggcaguauggccauuuucaugauguugauucuuccugucaaugagcauggaauguguuuucacuuguuugugucaucucuaauuuauuugaacagugguuugaaguucuccauguagagaucuuucaccucccuagucagcuguauuccuagguaauguauucuuuuuguggcaauugugaaugggaguucauuuccgaucuggcuuuuggcuugacuauuguugguauauaggaaugcuagugauuuuuccacauugauuuuugauccugagacuuugcugaaguuguuuaucaauuuaagaagcuugugggcugggacugugggauguuuuagauauaggaucaugucaucugcaaacagggaugauuugacuuucccucuuccuauuuggagugccuuuuauuucuuucucuugccugauugcccuggccaggacuccuaauacuauguugaauaggacuggugagagagggcauccuugucuuaugcugguuuucaagggaaugcuuccagcuuuugcccauucaguauggugguggcuauggguuugucauggauggcucuuauuauuuugagguauguucauuaaguaccuaguuuauugaaaguuuuuuacaugagaagauguugaauuuuaucaaaauccuuuuccacaucuauugugauaaucauaugguuuucgucuuuaguucuguuuaugugaggcaucacauuuauugauuuacauaugaugaaucaaacuuguucccaaggauaaauaaagucuacuuguuugugguggauaagcuuuuugaugugcugcuggauucggguugccaguaauuuuuuaagaauuuuugcaucaauguucaucaaggauguuggccugacuuuuuguuguuguuguuguaucucuaccagguuuugguaucaggaugaugcuggccucauagaauaaguuagggaggagucacuccuccucaguguuuuggaauaguuucaguaggaaugauaccagcucuucuuuggacaccugacagaauucagcugugaauccaucugauccugggcuuuuuuugguugguaggcuauuuauuacugccucaauuucagagcucauuauuggucuguucagggauucaauuucuuccugguucauucuuggaaggguguauguguccagacauuuauccauuucuccuagauuuucuaguuuauguacauagagguguucauaauauucucugaugguuguuuauauuucuguaggguaagugauaauauccuucuugucauuucugauuguguuuauuuuaaucuucucucuuuucuuauuagucuagcuaguggucuaucuauuuuauuauuuuuuucaagaaaaccagcuccuggauucauugaucuuuugaauggcuuuuuugugucucagucuccuucaguucagcccuaauuuugauuauuuugugucuucggcuaguuuugggauuucuuugcacuugauucucuaguucuuuuaguuuuuauauuaaguuguuaacuugagaucuuucuaacuuuuugaugugaacauuucagugcuauaaguuuccugcuuaacacugccuuagcugcaucccaaagauucugauauguuguaucuuuguugucauuacuuucuaaguacuucuucauuucugccuuaauuucauuauuuacccaaaagucauucagcagcagguuauccaauuuccauguaauuguaugguuuugagugaauuucuuagucuugauuucuaauuugauugugcuguggucugagagauuguuuguuaugauuucaguucuuuugcauuugaugaggagaauuuuacuucugauugugugaucuauuuuagaauauaugccauguggugaugagaagaauguguauucuguuuuuuuggguggagaguucuauagauaucuaucaggucugcuugauccagagcggaguucagguccugaacaucuuuguuaauuuuuucuugaugaucugucuaauauugucaguggggcuguaaauccugccacuauuauugugugggagucuaaaucucuuugaaggucucuaagaacuugcuuuuugaaucugggugcuccuguguugggaacauauauauuuaggauagugagauuuucuugcugaauuccacccuuuaccauuacauaaugcccuucuuugucuuuuuugaucuuuguuggcuuaaacucuguuuugucagaaacuaggauugcaacuccugcuuuuuucuguuuuccauuugcuugguagguuuuucucuaucucuuuauuuugagccugugugugucugcaugggagaugggucucuugaagacagcauaauaaugggucuugguucuucaugcagcuugccacacugugucuuuuaauugggucauucagcccauuuacauuuaagguuaguacugauauguguagauuuaauccugucaucauuauguuagcugguuauuuugcaaacuuguuuauguaguuucuuuacagugacacuggucuggguacuucaguguguuuuuacagaggcugguaauggucuuuccuuugcaaauuaaguacuuccuucaggagcucuuguaaggcaggucuagugggaacaaauucccucagcauuugcuugucugaaaaggaucuuauuucuccuuugcuuaugaaucuuaguuuggccggauaugaaauucuggguuggaauuucuuuucuuuaagaauguugaauauuggcccccauucuuuucuggcuuacaggguuucagcugagaagucugcugucagucugaugggcuuccuuuuguagaugaccugaucuuucccucuagcugccuuuaacauuuuuuucuuuuauuuugaccucagaaaaucuuaugauuauguguacuggggauaaucuucuuuugaaguaucuuaagaauguuggccucucuagcuagguuggggaaguucucaugaaugauaucuugaaguauguuuacuaaguugguuccauucuccccaucucuuucaaggacaccaaucagucauagauuuggucccuuuacauaaucccauauuucucaaagguuuuguuuauuccuuuucauucuuuuuuuuuucuauucuugucugccugucuuauuucaaaaagccagucuucaagcucugagauucuuuucuccaguuacucuauucuauuaauacuugugauuguguugugaaauucuuguaauggguuuuuuuagcucucuaaggucaguuauguuuuucucuauauuggcuauuuugucugucagcuccugcauuguuuuaucaucauuuuuagcuuccuugcauuggguuucaguguacugagcucaaugaucuucauuccuauccauauucugaauuucauuucuguuauuuuagcuaucuuagccucagcccaguuaugauuccuugcuggaaaggugaugcgguuguuuggaggaaagaaggcacucuggcuuuucguauuuucagcauucuugcccugauucuuucucaaauuugugggcuuaucuaccuucaaucuuugagguugcugaccuuugcaugguuuuuuuuuuuuucuuaauccuauuugaugacuuugaggguuugauuuugguaugagauggauucagcugacuggcuucauuuuggggagauuuuagggggccaacacccagcucccaacugcuagacugugcucuuacucugggggacuuguauugggccccagcuuuguuaucuggcucugcgacauuuggaguccacugcacuggaggugccaagguguggcagcuguaacagugcuagcagaugcaggggugccuaccucccuguggguguucaccacaaugacagaggcagcauagcuggguggaguggggggccccugcuggagauuaugugugugguuguacuggauaugguauuggcuuggggcagggugcuggcuggggcagguuugggugccuucucugugcccugcaagcaggagugaucccugaggguguggggguguccgcuguucucugugcaguauuaguauaagggcagggugcuggcaggggcagggcuugcuggcuuuaugcccaccaaagcuccaucugcagugguggcugggggcugggugggugcagacuacacuccagugugcuggcagggcaaggaaagcaaaaccuaucugugcagacaugugccagcaaagugauguagggcauugccaugggccccggggaagcugcaguauggggagggagcaugugcauggcuguauaggccacaccucacuggacuucuccaccagucaggcaagguucacuggcacagaagcuaugcugugggcccccaagguacccaagacugcccucuaagcagguguggccaggcuggggccccagaagaggccaacagacuaaggggugcacaggucagaccagccccaucugaugugcaagaccacccuucagcgaucagguccaacaguucuucuagggcuaaagucucuuaugggaacaaguugagucuaggggaauggccaccccugcccgugcugcacugcagacacccccacagcaaacccucugggcuacacaucagcuggcuuguugccccaacacuucccuaagcagcccucccugccaccucaaguguccaugguggucaaggggucccccuccuucuaggguucccaaggccugugacaagagcagguugcuccuugccaguucaacucacccauucccccugagcuguuguuguucaaaagugaguccugcugcaggguagcccaugcaggguucccagauuucuaugucuugccuccauccauucucagugcccuccuucugaagaucuguuaaaagcaugccagucaucucagucccuccuugggagcuguuccacuugucuccgucuagucagccaucuugccuucucccccuuugcucauuuuuuaauggagcuguuuuuugcuuauucaguuaaguucuuuauagauucuguauauuaggccuugucugaugcacaguuugaaaauauuuccucccauucuguggguugucuauuuacucuguugguaguuuauuuugcugugcagaagcucuuuaguuuaauuaggucccacuuggagguuaacuuuuuuugagagcccaaaacuuugucuguccuguaacuacaucacauuugcacccauucauugauuaauucaguuauccuuccauuuauuuauccccacccuuuauuauccuucauaccauacacccauccauuuaaaaauuauuccaucuucuuguccauuguacccauuuauccaucugucagccaaucuaguaauugguucuguuguacaugaggucaugaacugcugucccacaaauggcacuuuaucaacccccaccuguagagaagggagaucuugagaagcaaagaucccaagccuaaaggaguacauuguauuuugccucuuaaauccauaaaccacuuuuauccaaacaucuaacccaccucaucaaguuggcugagaccagugggaaaugcauaugucuaauggggaaaggagggguguggacaggcagguauaauaaauguguaaauuuggccaaggguaagagcauaggugauaaagguccugguguaucccaacuuaaaaaggcaaaaggaaauuuaacccuugagauuaaauaaaaaagcuuaguguguuggccaccagguggaaccaugugugccagccauacaagucuaguguaugagacgugccguugaggaaguguguguguguugggauaggggauugugaguucugcauguuuaccuuuuacauugucaugagugcauucuugccucucaguuauaauuucucauaaacauuauauagcuguauaacaaauagaaauaugcaaaaaucacaagugacaccucagugaauuauuacacugaugguaccaucucccaagucaagcaauaggcagugccaguaaccuagaagcucccucaugcccccucccagccgcugcucuuccuuccucuccaaaguaagcacuauucugacaucuaacagcauagaugauuugggguggauuuuaacuuucuauaaaugggauauacuguacauguuauuuuauaucugguaucuuuuacuuuaugagauucauccauguuguugcauguaauucauauuuauacaauagaaaacuauacauuaauaaaaaggacuguuuucauugcagcugcugguuagaagcuggggagugucacuggaucuguacuucucucugccuccugcccccucaaaucucugacugcuagcacucuggccacauuccuuuuacuuuuuguauucacaguaauaaaaggcaggaggugggagaagaguucucaaguagcuucuguaugaccuugggcaaaucauccaaacucccuuuucccacuuagaaagauuguauaacaaugcccagcaauuucauauaugacaacaugcguaaaagugcuuuaaaagugacagauaaauauggaguaaaggacaguaagaagauugaacauuucauugguguccccgcaccagcacuguucuaaguacuuuguguuuuaacccauuuaauaccuucucccuuagguuguaugauuauucccauuucacagaugagggaacugagcacaaaagaguccaggccugccugagaaggcacagcuucaagggacagaacuggaaggugaacuccaaagccaaugcuuucaccaguccccugugcugccucucaguuacuuuuuauaauuuugccagcagcacaugaaagacacuuuuuuuuuuuuuuuuuuuuuuuuugagauggagucugucugucucccaggcuggagugcaguggcacgaucucggcuuacugcaagcuccgccuccuggauucacgccauucuccugccucagccucccgacacuuuuaaaacccagaguggacuaggaagaaccuccguguggcuccuuuucaccuucugagccucauuccugcugcuguccuccuugcucacaauguuccagugucauugccccucugcuacaucuuagagcucguggcaccuucucuaguacaaaauauucuugcucccucugccuggaacacuuuucccugcccuuggcugggugggcuccuucucauccuuuaggucuccccauagucaucaccaacacagaguucuuuuccagcacucaaaguagguccagucuuuauucucugccauagcauccccuuuauuuccuuccuagugauuauuaucuguaacggucaccuugcuaugcugacuugguuaucuguucucccugcacuaggucauauccuucuacguuguccucuuaaagggccuuguucacaguugugcucccagugccuggcaauagcagggcuuugucaaagaucuuugaagcaacucaguggguccccagguucuuggcugcccacucucuaccacuugggagccauuuagcuuuuguccuccuguagucaaguguuucccaaguaaauacagcauggucugcuuguugacccagacuaauggguucuagaaagcagcauggggucaguguaaacccagagcaaacucuggcaaaaaaaucuucaacuggucugaauuuguuguguauccuuucaauuagcaauaugcuuuguggcaauacaaccagaaucccccauggagcugagugguacuaguuaaaacugacuccacaugauucuggaagaugucccuuccugguuuccuccuucacuuuuacaagugguuuuaguuaaaauugacuccaucuuuauuggggucacugauuuauccggaaguuaauaggaugagcaaggaaagggauagaagguaagaaaccuccaauccacacucaaguuuuuaucugacuuguccuuguaacuguacugggucugucagagaagugauucuagucccauuauaaugcuugucacuccccaaccuccaguucaaaggcaagucccuagaaugaaugcugcuaaaaaacaaagccgcuauuguugggaaaaccaagaucaguccaugacccucuuuggaagcagcugguuguaaagaggcuguuauuuaguuugggccuaaacagcccaugccugacugagagggaaggcaggccaagccugggggugggagugugaaguaagaaguuaugcacacuccccuccucccccaccccugccccagggcuuggccuccccuuucccuuucccuuccccagugcagcuggcagaggaaaucauuccuuagacuaccagcacugauccugguagcaccagagcagaugacagauguguaacugacugcaagccaacuugugaucugcugaucaccugagaccugcuagauaggccaguggcuggaguaaggaaguaaaagagauacaucaaaaacucaggauuucaaaagcuucaaaccugccaggaaaauuagacagcaaaggccuuaacuggggaguucuugauagccacugagagaaaggaaugugaauuuucugagaagaguuuagagagaaaauaacuuuuagaguuccccaguuuuggggacauaccacacccaaccaggcagagcccugauaauccuucucuagaaagaaggagcggcaacccccaucgugacgaggcuccugucugcaggaugggguagagcagguuuaacucacuccaacaacuggguggacaggaacagagcuccccuugggcuauggucaagcagcagguggaggacaggaucuguuagagcagcgguccucaguugggggcgauuuugcccuccagggacauuuggcacuguuuggagacauuucggggcugucacaaccagagggaugugugacuggcaucuaguggguagaguccagagauacugcugaacauccugaagugcacaggacagcccaccaaacaaagaauuauccagcccgaaaugucaguaguacugagguugggaaacccugaauuagagucucugagagugugagggucuuguuuccuggaguagaagcacccuuguguugcaaagaaaaucguccuugaaacucccaucaucuugguguuccucuaacucucaugaacaugagaaucaccagggaucucguucaaauguggauuugaauucugcaaguccggugagggccugagagucugcaaccagcucccaagggauggcaucguggcugguccacagaucacacuuucgagugcauucauauugucccacucuccucuuucuguccccacccccagccuucuuugucauacucuguuugagccauuccaugcccugucaccaagaaacaugugguggcguuuaagcuccacugcccagaugacaguaucucuccagcuguugccaauuugaaguucgggauguugaggaaaucgauugacuuaguuggagaaaggaucccaagggaccugaucaagcuaccgccacacaugcuucaaacaaacaaauauguaccuugggacacuuuuugcacggucugagaggcuucaacuguguagcgcccaugacuucggggcuguucaggcuugccgcagcaugcuaaaccagagguugacaaccugugucuauaaagggccagaaaguaaauauuugaggcuuugcaggucauacagucugucacaacuccccaaaucuggaaagcaaucaccaacaacaugcaaaugaauagguguaguuguguuugaauacaaauuuauuuacaaaaacaggcaguaagcuggauuuggcccauugccacuguaguuugcaaaccgcuguucuaaacaauuccauuuucuccauguuucuaucucagcaaaaaagaaaauaaaaaucauauaggaaagacccuaaugaaagggagcuacgucaucaguauaaguuguaaaugucuggaggacaugguugaauagauacuauuuccuuuacugcacagaaaugugaaauaugaaugcuuaaaaaaguuauuuuuugaaaggcucuggagugcaguggugucaucauagcucacuguaaccgugauccuacugccucagccuccccaguagcugggacuauaggugcacaccacuaugccuggcuaauuuucuguuuuuuguuuuuguaguuagggggucuuaguauguuuccagggcuggucucauacuccugggcucaggagcuccucccaccucagcuucccaaagcgcugggcuuauaggagugagccaccgugccugguaauguaucuuugaaguuggcagaaacacagcucucugucuucuggugcggagugggauaagacaggacaauaaauaaggaacagaaagaugugccuaaagucugccguucaaucuuagucuuuuucuucuuucuggacuugcaugcauacauuuugcccacaaagacaugugggggaggggagccagcaaauauuuucuuuccguuccaucagaccuugagcauucuuugaagaacauugauuuucucgcagaggccaguuucugugagaccuccuauuuguagagagggaaacauuucucagacagaaaugccaguguaccauagaaugccccaaaugcaccuucaugcuggcaguuaaaccacagagaaccacaggcugaauuggaugcugaccucucuuuguagaagcacagccaaggaucuuaagggaaccugcaccccuguggugcauggacauuugcguagcucccagucacacugacccuugggauauggauaaaucacugcguuuaacucuaucaucacccugagcaccucucauaaagccugcauuauuuggcagggaaaaacccucucuguuaauuaagaaaacagagcucugcuugagagggaaaugaccugauaucugugucuccuugccaucaggugggauucuucugccagauccuccagaggauguagggguacugauacugcccuggacuaugugcugcagccagaguucucuggcaaauuuagcuugcagcucccaccucccuaucacacaugugcuugagcacgcacacacagacacacacacaccccauggcuuaaacaacaagaaaagaaaaauguguuuauuacaggagaguaagggcauguuagagccccauuagguuggauucuauugauuugcauuauuuugacacugugucguguucagcacagacaaauggagugaagaguugagcuucgucuguguagaggaggaaucccagccacgguuuggaggcacagauaauuuacaacaguggcuggcguucaaguggauaucagugcaucaggcccuguuucucaaauucauuaauccauacaaucaugcauucaaugauauuuguuugccuguaacauauuugagucuuugcaggucauacagucugucacaacucccaacuccagaaagcaacccucgacaauaugcaaaugaauaggugugguuguguuccaauacaacuuuauuuagaaaaacaggcagugagcggugagcuggauuugguucacuggccauugcaguuugcaaacuccuguucuaaacagcuccauuuucuucaugucucugccccagcacauaaauaauaaauaauauaggaaagacccuacugaaagggagcuaaaucaucaguaugaguuguaaaugucuggagggcauucacagucuugaggcaugcuuucuuuccuuggggaauuuuaggccuuacuaaaccuucuuccugcauacugaauaccagguaugaggucagggcuagcaaacaggagcacaguuucugcccucuuggagcugcugaucugucaagaagacagagaugaaacaacaacuacacagaugcaccauagucaugaugaaccuuaaaaaggaaagauauauuuuuccucaucuaaucaucacuacagcuuuaguacucacuuccugucauuaugcccaucuuacugaugcaucucaagagguuuacaaauuuccccaagucacccagccagaaaguagcucuccaguucuguucguaguuagaggggaaaggagugcuucucaaguuggagugugaccugugacaguacaguuccaucuuggggacaguaucagcugcuaauuuaaacacaucaacagagcugugauuaguaaggagaaaacauuucugcagugcagggagcucauuauaaaucacguguacuuugacuuuaaaauuggagaaaccccagauggugggcuauauaaugaaucaccagagauggagauugacaggugugaucaugguauuuuuuucuggauguuuggaaucccacccauguggaucacagcacugacccacuccagguuggagggugguugcuuuuuuccaagcuguggguaacaugagaauccauuuacguuuauuccaugaguauguauugagcaccaaaggguacugggcacugcuagcucugcaagaauacagugaagaguagggagaagauccuggcucccaggggauucauucagcuacaaacuuacauaugaccuuaauaagucagggugaguaguuuaaaaaagggucaagugcaauagugagugguuggccagaagacaacuaacuuugcuacuuuagaaggaguguucagaaaugacacugcugaggaggugacaucuacacgaggacuuuaacaaacagaagucaggcaugcaaagggaagaguuuuccaaggccugcuggaauaagcuuauuguuguguuuggggagacagggaggaauguaagcacagcugaagcagaguuaagcgaggaggaguguuuaguugauuaucuuggagaaagagaagagagccaagucacguagggccuuaaggucugcguaaggauucuagauuuugccaguaaugaaaguaaccacagaacuacccuuucuagaggcaaguacacaguuauugcucaucuuuggucaacauuggccuuucuguucaugcccugcaugcaagaagacccuggaggaaaaucugaguuaaugaaucagaagagaggcauuucuccucucuagagugagcagguaguauuuccagucccacccacacauaguccaggggaaugaauggcuuacauuuaggugaaacugauaguagaugcugggcuugugcaacaggacccuccugcucugaucaagcucuuuuguuuuucaagggggugccucagguuaucccgagcuuucccgggaugcagaagccugauaccagaaggcaguacaccucccagcagaauagaagcugcucuucuucgaggucaccuccucacggaaauaggaaucuguucacaagcaggaugcucucaaaaacauuucacuucugggcuuaugaaagacagguucgggaaaacagcaugcuggggaauuaauaguauuugcuaaguuauuuaugcugacccuaauucuacucaagagcuagguuggaaagcccugcaaagaucauuguguccaccuuuuguuucuagacaugaguuugaagauguuuucuuuccuuucuuacuagaguucauccacucaaaccacucauucaucaucuuagguuguuauccucuccucucugcuuucauauuggggaggcucuggaagugauuaggcuguuguaaaucggcuuuuaugauuuguauguaagagauaagcagcagaguaagcaagcgauuggaggccccagcugcuauugcccugacaguuaucccaggaacgaaauugaaacaaaaaauuacuggaguauaugauauuuagcugauuaauuucuuuauaggcauauccaauguuaaaauuugacccuuuaacaaacauuguuuuauuuuuuauuuauuuauuuguuuauuuuuuggagacaggggcucgcucuguugcccaggcuggagcacaguugcacaaucucggcucacugcagccuccaccuccugggcucaggugauacugccaccucagucucccaaguagcugggacuacaggcacgcaccaccaugcccagcuaauuuuuguauuuuuaguagagacaggguuucaccauguugcccagguuugucuugaacuccugagcucaagcaguccacccuccuuggccucccaaagugcugggauuacaggcaugagccaccacaccuggccaaacguugcuuuacuuuuacuccauuuuauugagauauaauuuacacagaauaaagcaaaccaauauuaaaacuacaucucagugaauuuuuacacauguguauuguuuuacagccaccauccagauuuaguuauagaacaauugcagugcccuagaagccuucuucauacccccuccucccacugcccugaccuguaucacuauagauagccucagccuguucuugaacuucauauaaauggaaucauacagcacauauucuuuuugcauguccaagcauuuucuaugagauacauccauguucuuggguguaguuauucguucucauuauuguguaauauuccauuuuaucaggguuucuucugagacuguugacaguuugguuuggaaaauucuguguggaggcaaggaagccauccuucacacuguaggauguuuagcaacaucucuggccucuaccuacuagacgccaggagaaucccauccuaauagugacaaccaaaaauguguccagauguuuccaaauuuccuucagaauuaaaaaccaucauaucagaugaauauauucuaauguuaaagaaacuuuuuauuuggaaauaauuucagacuuaaaaaaaguuauaaaaauagaacaaacaacaccuguaauguacucuuuacguagauugauccauuguuaaccuuuugccacauuuguucuuucauguucacaugcaugcacacacacgcacacacacacacauuuuauuuauaaaccauuugagagcaaauugcauccaucugggccauuuaccaccauauccuuccauauauauuucccaagaguaaagaucuucucccacauuaucaccauuauuaauugaccacaguaaauuuagcauaauacuuuuaucuauugcccauguuccauuuuuuuuucaguugaccaaaaguuauccuuuauagaggcaguccccaaccuuuuuggcaccagggaccgguuuuauggaagauaauuuuuccacagacuggggccaggggguggggauggcuuugggaugguucaagugcauuacauuuauuauguacuuuauuucuauuauuacuacauuguaauauauacugaaauaauuacacaacucacuuuaagguagagucagugggagaccugagcuuguuuuccugcaacuagacagucccaucuagggguaaugggagacaguuauggaucaucaggcaugagauucucguaaggagcacacaaccuagauccugcaugagcaguucacaacaggguuuacacuccuaugagagucuaaugcugcugcugaucugucaggaggcagaggucaggcaguaguuggagcaauggggaguggcuguacaugcagaugaagcuucccuuacugaccacucaccuccuucuguguggcccugcuccuaaccagucuguagccugaggucugggaaccccuacuuuauagcauuuaguuucccuaaagagcagguuccaguccaggaucagguauuauauguaauugccauguuucccucguacccuuucaucuagaacauucucucagucuugucuggucuuaagacuacagucccuuuuuucauaacaaaugucccuccuuuuggcaucugucuaauguuuccuccugaaugcauucggguaauacauucuugacuggaauacuacauaagggauagugugcccuucugaguacaucucaacuggaggcaugcagggugcaguugcaucucaccagggauguuaaguuugaacuuaaggucaagguguugucugauuuuaccuuuguuuaguuacuaauucuucccuugcaacuaauaagcaauguguagggaaacacuuuaaaacaaugcucucccccaucaaauuuuacccccuaaauuuagcacacuuuuugauucuugugugaagcacucuaccuccaaugguuauaaaaugacuuuccaaaucuggcacccccuuccuucuugugaacuuacucuacugacagcgguuggcauuccacuauacauagagcccucucuuuucccuguuuguguauuuauuuauguuuuuauuuaucugcuaucagcauggacuugugaauuccuauuuguuucagugguuuauaaaucauuacuucacuuaaauauuugagugcucaaauuguucagauuuggccagugggggccccuucaaguuaggcccuguguccuucugacaaaccccugccauaucuuauuuuuaauacuuucucacuuuauggcauaacaagauccugguucuuuuaauuuccuugccuuuauccuggaauuggccaucuuucuaaagagccuggauuccuuuuaguggggaaugguagaaaaaaccacaauauauuuauccauuuuccugauaauugacauuugaguuguuuccguuucugggcuauuacaagaaagcuucucugaguacccuuguccauuucuuggaccuucuuacuaacuucugaugaauauauaaucaagagugaagauggagaauuguggaauuucuacucuuggucguacacccaacagaaauucauaaguccacaaaaaauggccaaggauauucagagcggcuuuauuuauaauucauauacguauauguguauuuagcuuuaguaaauauugccaaguaauuuugcaaagugcucguaacacugcuuuagguuuugucacggaagaggaaguuggaggccccaguaggagacaggaauaaucaguagcaggggugauaaugggccauugcaauccaaaggcauguugucuaugaccaggaauggcaaauugcugauccuugcaauauguaaugaguggaaaaugcugagacuuugccaccuggcccauucuuaaacaucuccuuagagagcucugccugaaaaugagcaaaauggaaguuacugcagucaguaucucccacuaccuucaaaaugguuuucaucucagggaugccaagagcucauuugacagcaguuaagaaauggagguccauugcuggggcacccacuguuugagagcaucaaacccacugcuuuacuuuugaaagucccuccccgugcgaccgagaggucccuuggggucccacacacaucuucuggcugcuagagacccauuuacaaccuuggagcauucacugaauggucugagagaguaaauauuucucuaucuauaucuagggagucacuuaguguccaagacacuuuugauagggagccaccugccacuuagggacagcaggcaaagcaggaaacugcugcgggcuaacagagaagugaacuggcccaauauuguggaaccaguguuugguauugccagaaacagcuugggcaugauccagccucuagagcuuaaaguuugcucauccaaaauaucuguccuacagagcuuauagugcaugauuagaaucaaaaauguaauuaaaguacuuugcaaagugaaacuccaaauagaggaagcaucauacauaggauacacagugggcucuuaguaacuuugaugagccuuuggaggaacuaguaacugguaaaauacaucucuggaagcauuuuaaguaagugcccccucuagguagauagugaccuacuguggaguggagagaacccccucacaggcacaugugcccccugagagggccuuugugcaguacacaacuucacaacgguauauaaugacccuagauagaugaccagcagugacagugauacccauugcugcacaucuguauuaaucucugugguccccuccucucuuccccaggccucucugcugaugguggugccaagcgccaggagcaccuaucccgauuuuccaugccugaccucagcaaagacucuggaaugaaugugucugagaagcugagcaacaugggcacucuuaacucguccaugcaguuccggagcgcagagucaguucgcagccugcucucugcccagcaguaccaggagauggagggaaaccuccaccagcucagcaaccccauuggcuacagagaccugcagucccacggaaggaugcaucagagcuuugauuuugauggagggauggcgggcagcaagcugccagggcaggagggcgugaggauccagcccaugagugaacgcacccggagaagagcuacuucacgcgacgacaaccgccguuuccgaccucacagguccaggcguucccgacgcucucgcuccgacaacgcccuccaccuggccagcgaacgcgaggccaucucccgguuaaaagauaggcccccucugagagccagggaggacuaugaccaauuuaugcgccagcggagcuuccaggagagcauggggcaugggucccggagggaccuguacggccagugcccuaggacugugucggaccuggcuuugcagaaugccuuuggggaccgcuggggacccuacuucgccgaguaugauugguguuccaccugcuccuccucuucagagucugacaacgagggcuauuuccuaggagaacccaucccccagccagcgcgccugcgauacgucacaagcgaugagcugcugcacaaauacagcuccuacggccuccccaaaucuuccacauuagguggcagaggacaguugcacagcaggaaaagacagaagagcaaaaacuguaucauuucuuaauaugauugggaucagggaaugggagaagaugggagcuaagaauguaaagucagaaacuugcacuguuuuaaauguuaaagcgcuuuuggggguggcuuaugggggagaaaagggaaaaugcugucaguagauggaggcaagguuacagguugacucaauagguagucacaguucuuggcauguugaauauuauuugcacauuucacuuuggaaacacaguagacucuaucgaggccaggcuuggucacuuccuucccaucaguucuguguugaguugccaucucucaagaugguaaauuguuuccugcucgcuuuuauccucucugguucucuuacuuuuaggacccuuuuuucaguaaguaauuuguuuauuagccaggacccaagacuaaguuauuuacauguccauuguaaaugcaauguaaaugagaguucugauaaaauauuuuuguauuuuguaauaucaaaggaauuucuauaucguaggacucaguggggacuugcaugcacauccaccauugucucugaguaguauugaaauguggcccgguaccaccuuuuuuuuuuuuuuuuuuuuuucuauacaaauuuguuacaugucagugagaccuuuuucaaaggaacauauucaauuuggcuuuuuguggcugaaaaaacauaacuguuagacccaaagcauuuuaugcuccguuccaucuuaaggagccauccuuaagucugcucccacccucaguagaauuuauuuucuacaaagugguaguaauuuuuuuuuaaauugcaaauguaauuuuugccaauuagagaaaccaaccggugucaguaaaauucugugagaaaugccaucccugcugggaauguugaaguuacuuaauguugaucuaucccuuggggaaaguaaaagugacugugaguggugccauugugugaugucagcaugacguuguuuugaauguggcauuauguucuggugcucauguuuccuggauuguauuaucugcuuuccuuuaccaaggcagacagaacugcugccuuagccugacaaccgguuguccucaaagcaaaugaacuuaagcauuugggauugagggacagaaggauucugagggggcucugcgagggacggugugugacaugucaugccuggagaaggaacaaggcuauuugaaaacagaaggcaggucaaggguagaaguuaaaggagaaucugaaggcaggucagggaaaagaagaacuggaaaugaaacagaggacaggugacaaccaccucgaagagcucccagagauuguagaaagaguccaguguaaccagcuuaguaaccagaguaucuggauuacccaggaagguugagcugcugagauuucaguggugcaaugucuuuaaaaaaacaggcuuuguugggaggguauuuccauuuugaacuuugaggacuguuggucagaaaaugggcucaaaagugaguuugcuuaaugaagacauuuaacgguugugcuguuuauaguaaaauaaaacucccuaccuugcuucaguuaaaaaugaagcacuugguuucuuccauccuccuccuccccuuaauggauuguggcaguugaaauaauccaucggaugacccaccuguagugagauguacugucgauguagugcccgguguaucucaguggccaucugccauggugaggugagcgugaucucuuuucaguauaguaguuaacauuuucuaguauuuuuuauggagagaaugucaaaaguggcauuucagaccccgucccagaugggucugaggaaaggaaggcuguaaaggacaugguaauggcacuccauucgggauguauuaaaauaauuugcuuuucagguauuaauaugacauuugucauugucacugauuuuuuuaaaaaagcaaugcacauguugguuguggcuguuuuccgcaugcuaucuucauaucuaaaugcuucauuaauuauccgagccuccggagaauuaacucuauuacguuuguauaguaaguuuguaaacugcuuggcaaacugauuaagaaauaauuugcaauaccgugcuacuaaaguggcagguuucugguagaaauugugcgaguccaauuuggaguuuuaaguuccuugauugaugaaacuaaaaaggcaauuuuggaaaaagagagggggaaaaguagaucacuuaucuuagcaaacgguugaaaauaugucuguccucuguggccccaaauccagugaaagaaauucucccaguaaaaguugcuuccuaacucuguuuuucucagaauaccucuuaccuuucucaaagaaagcuucaaccaccaucaucagaaagaagguggccuaaaaacugacacauggccagugcccggaggggucuggaggcauaagucuagaugcccagagagcauccaggcacugaacugcucagagcuugagaugaaaugacauacaagcuucaggguaaaacugucuacuagcaagauuaccucccucaauucuaccauugcagauuucuucugaccccaaaugcaaccuuacagagaaugcugaaugaggaaggccaauuccuuacaaugauggcagaacccccaagcgaaugcccuauugaggagaaggacaucacuguauuuggaauucugccugcuagugauagcucacacaucacaucccagaaucccacucccaaugcauuauuuccugaggcaagaacuuaagguccucaccuaauuccuccaucacaaccauuaacucuuauuggacaagcuccuccugugaguagggccuguacucacuuccucuuagaucauaauuccaucuucaagagacugauuuccagaauaguaaucuuuuuccagcguucucucuucuccaaugcccugguuguuauuuuucccaccucuccuaauauugaucuucuugucuuuugguuagaacugcaacuucggaguugaguucauuuccuauugcugcucaauucaguagcaacauagcuggcuuguucccagacccaggaaguauaagucauugacaguuuccugaguggcucugccaauccauaccacccuugguacugugaaaaggcuucuuggcagccagguggcauugaggaugguauucagggcgcuuuccuucugucauauaguugugggaucucuaccaagugugaaggugaaugagguaagggagaucagaaccaugcuuccugguuuuucauacauccaaggaagaaguccugguguggguuguuugacaccuucuuuccacuuucaccuuuuauuuuuuauuccuuccuuucuacccccaaccagucgagcaaaugagcaauuuuguguuucuaauacaggaucuggaaguagugcuuucuaauccucauuuccuguaggauguuccugcacuauaacaagauuauguuuucuuccuucugcagcagcuuucugcuucuuggguacuacuagcuauuguucaauucaggugaggccugugaugacauauauguagcaugugcucugcgcucccugcaagcugagcagauacaaccaaugcaucacuguauacucuugcugagaauguggaugcagccucacagaucuuugcaacacuccaaccagccaggaccaguugaucagaacugaucuuauuggucugauaaccaaucuuauuugugaacugauucauaucugucuuuccacucuugguucucuugccguagaacaaaaacaguuuaggaagcauaauuacgaacauuuaggaaccaauauguauaaguaauucggagacuccaauucaccugccccucccccaucccagguuguggaggcucgaggaagcugacuucuuaggcuaaaggacaaaaaaaucucuuuaccuccuuggccauuuucauguucucugccaauuacuauaggcagucuucauuuugcagaggugagguaagacuucaucuuauucuucauguaaucccaccuucuaacaaaaaauaaauaaauauuuaaauuccaaggagaaguguucuuuguguauuucuagcagaaaacagaugcuuaagccuaagaaggaagauccguccaugacaaaggaaaguggaaaacugaaccaguuaucugaauacuucaugccaggacaguugcuauuagcaacuguuuugcaccuucagggcuuuaaaaugggcucugcagacagcauuugcauaugcaagacucaguagccaagccuccacugccaauuguugaaggcaguuucagaucgccaccuuuugagguacauuucuuuaagcacaagagaaguagaaauggccuuugccuugucuccagugguuugucccucuggugccucagcagauaccagagcuuauucuuaugaccauuuggaaguaguccucaaaguaaagaucaagaaaaaauuggauucuuuuuccauuuucucauaauaguagccuagucaacacaagacucccauaaaauaugacucacuauugggagccauacuauuuuauaagcuuacuuccugcugacaaaacuagcuuuccucaaggaaauauaaaggaggggaaagucacauaguguuaggaaaacauuccuguguuuugaauacgaugaauccauaggauagagaaaaaucugcuuguucuauucugagaguucucugagauaucccuucacucugcuuggcauuuggccauugauauucaacaggucacugaccaagcuuuucuaaauuuuucagagagaguuacuuaccaguaaggucuguucuuaaaccuaccuaguugauuuucauaucuuuccauaaagugucaugauucugucauagacccugacuuaacauuguaaggacuaugaguccuccauuuuuuaauuaauuuuuuuuuagcaaauuaggacuucggcagguuuuccucuccuaaacucauucuuuccuccacaggauugcuuuguccaucuccugcuuucauuucaagugcauaaacaaaaccucaaagggccugggaaggugaggcaggccagagucuguguucuguguugagugucaagcuauuuguuaagaaggucugcaacaggccuuuggugugggcucugccagagacuguucugaacacuuugcuugagauccgugcccuguaaaauggauaugauguuuuacugaugucuguaauacauuuguaaacuuccaauaaaauuugaauaaaagaaauguugccauucuucuca

SEQ ID NO: 6300 - RNA, 80455 nt, Homo sapiens
gcggccgccgcccgccugcgcucagagacucacgcagccccagucccgccaguccgccaacacaguagugccggccccccucuuucccuggcccugcccccccuccccgccuuuggcucgcuccgccuuucugccccccacccccaccucacggguacgggccauucccggccaggaaacgccguggcgccgcguugggccuaacucgaguccugccgccucccgggagugccgugcgccgcagcccgggcccaggccccggcagcgccugggacaagguaaggguccgacagaaaagagaccgaaccucacgaucgggccccaggggagggaagggucaccuccuccgucuccccgcgcucgcucuccuugggucgugggccuggcccuccccaagcucuuaggaggaugcugccacuucucaccccccucgccgccuugcacacaccguugcaacaccccauuuucccagggagagagaucccccucuaaucuaggcgacccaacucccccuuucauguuuuuccugggucaggacgcuuccccucccccaacgccucuucacccccuuuccugggaacugccuacuccacguuuaccuuucccuugaggagaggccucuugcugcccuccgcucgaaauacacaggcauacuuuuuuucucuccccgaucccccacucccuacccccguucucgcggccuugugacagacaacucugaucgcucugggggccgcgaucuccccuccguaaucuuccuggacgccuucccucucguuuucuggcuucccaccucagauggcugcuucccaaaggcauuaccuucgccacccccaccacacguucucuggcuccccguggcgugugccacagcgugucugagauagccucguugaauguguaggguucgagccuggaguugagccagauugugucguuuuacuugccuugggcguggagaacgaucuugugagaauaucuucaaaggcagaaaaauauucccuuuaugaauucucuuucccucugcguguaagucgggaaugugaagaggaguguaggaaagagcccugguucaaguagguaaaucgcaugagagggaaaguuaaacuguugggaaagccccuucuaugcuaauugauucuauagaguccuugcuugucucacuucuugggcgucaguggucuuucucuuggauauggaugcugcagucagcucugcuggucugggucaggggugcguguaugaccugcauuuucugcuuucucauguuacuugugcaauguauucaccgguaacucauuucuuucccagaccucuggguuccacugggcuuugucuauauuuaaguucauuucuccaguuuccuuccugcacauagguacugaacgaauccccaaguucugugcuaauuaccuucaucaguugacuaaacaaguuuuuagaugacauauuugugaccaaggucauauuuacauuucuuuguuggacagauguuacauagcuauacuugugauuggggaggauccagcugaguggagugugcugagcuuuuuaggagaguguguacucccuauuugaaauuauuuuuugguuguuaauuuuauauuauuaauguuuuuaggucacagaaaguucuaagugguaauuuuagaugugugggaucugagcuaggacuaaagcagagaauacccacguaaucagagguuucugggcuccauagaggacguagggcuuuuuuuuuucuauuggauuucuuccaguuuucucaggaucauuaguucucuucuguagccaaaaauucuggccuguuaugggauuagagucuuuaagguuuacucagacugucauuauguguagaaaaaugaauuaugcccuuugguaggacaugacacaaggcucuguuucuagcugcaaauuuaaauuagauuguagagugcuugggaaauuggcuuucaaaagaccaaagcuuaaucuucacuccuaaacugcuggcuuaauuaaaauggauauuuagaauuugguaaauguugauuuuucuaauaaaaggccuugguuuaaaagggugaccuuaggauuguuucuuucuuaaaagcauaauuccagcccuucuggcauggagcacugguccaaaaaaaaaaaaaaaaaguguguguaaggagugggggugggguaaagagaagguuguuccuuuggguuggaucacaggggugaguauacaaggcagcagcagcugcuggcucuggagcucugguugcuacgugagaagcuugaguagugcuggcugcugucuccagggaaggacagcagugcagcguccauuaaugcugcuggcugcagggagcagcacuuaggcgauggcugcuucaggacuaagaagaaaccuugcuuuucugggaauuuucacugcugagcugguuugcuuuuuauugguggggagaugggaauuaguaauucauaaucuccuacccauuuauggauauuggcaucuggaaacuggaucaugguuaaagccuuucuuuuuuuguuuguuugauuugauuuuuguuuuuuggcagauuuuuguuuuuuaucuagacauuugugcuuggauaggacuaaaaguuccauuagaguuuuaauuuuucaaucaguuuaaaaacccaaguaauaauuuuaagaaucuuucugauaaccacaauaggaagaaaauaacaggaauuuuuuccugcagcucacauaucaugccuuccuccaucucuuuaaucauagaaucaauucuuauuauuuuguuaugugucuccauccuuucgauuagaccacauuuaccuuauagacgauuugcuaaacauuuuacuaagcuugaacucuuaaacucuaaaaaggugccauuuuggagugguuucuaaauaaauauuuuuaauuuguauauuaguaauaaacuucuccagauuagauauuuucuuuggaguuugacuuauaagauugauucauuauauacauguuggauauagccuucugacaucacaaauauaugucuuuggccauaauccaucugaaauguaggacagaccagaagaaauaugcagaaaucgaauaagucuaguucaggauacugagaagauggccucugagccccuuaggugaucuccccucccccacaacuccugaacauuaggaugaucucugauuaagcaaaacagucugagcguggaaaaacuugaaggagaaccaccaccaccaauuauaugcaauacuggacauauuccugugugcuguuuuucuuccccaagacucguguauccuauacuuuuuucucucagaauuuugauuuguucauuuucguguaaauguacuuaaaucucacaaacaucuauaauuuguaguaucacucuggcauuuguggcagagaaccaaaaagaauggaaaugaguuuugucauucacaaauguggcucacauuguuuucccaguaauaaaagcagaccaaugaaacagaaccuuuaauggauacuauuuuaggagguuccaauucuuauuacuaucacauagauaagaugcaauagcagauaaauaugauuucauguauacuggcuguuugacauacuuaggguuuaagauaaaaauguuuguaguuuuuuacucuguggcuuaaguugcuauauaaaauaauugcuuuuacacucgaauuuccuguuguuuggaaccuuuugugcucuugauauuaucauuuuuuagaggaucauacaggcccuuuucauagaaggauuuacuuaaguuauacccuugaaaacuuuuuuauaucuuuugauacuguuuuguguccaggaacugacuuucugaaauuauucuggcuuuucuggggagaaugacuauuucauuuuuaccuuugaauggggaaauaauaaagugcaaaguacagauuugcagauaauuacuuuugcuuuauccucuccauguugaaauaacuuaugaaaaauuaggccauaguuaacagcagucaaugacuauuggauacauuuuaucagaggggaacuggaucaugaauaaaauaaaauuuuaaaaauaauuuuuggcugaacucuggugauucaucaguuuaauuugaagucagaaggucuagcagugaauuuuauuuauaaaaauuguauuucaaguguugaaaacugaaacuucuugaccaguauauuuuguuugaggcaucaaacuuugcaaaaugugcaucguauauuuagugauauaacugguagucauuuguaauuuaaaguauucuuucaaaggcacucuuuagaaaguaauguaguguacccgugaugggcagggauugguaccauuccuuacugccaaaaauuccaaaauauguggcaaaaugauugauuuaucuugugggugggauucugggaaguucaugaaagguggagagaauauaguuuccuucacuugucuauauacauuuuguuaaauaagucuuaggaaaacuguuuuauuguaucuuuaauuaugaauugcguaaaagauacccaguaacuuuggggggaggugcuguuagaaagcauuacauuggagagaauuccccuacccugggacaaaaugcauucugucuuuaauacuuagcgaagggaacuaugggauaaaauaaacaaugaagguaagcucagucugcuuuauaugugcccucacugagcaaggaauuuguaaucgcaucgugccucauucguuuauaccaucauauugauuuuguuugcugaguaccugagggaauaccuuacuuaauguaaggucacauuaaguauguuugauaugaagacagggaaaggaauuuucugcuucuuggaguaaugucuuaguauuuuuaaaacacuuaaguuuuuacaucaggccaguuuugccugaugcucaugucuguugcuuugguugggcugcugcuuucucuucuguguucuuauggguucguugugguauaaggauucccacagcuuucauggcaguaugaaguaaugagaagcauugccuuagccauguuaguuacauguauacuuuuggccuauguuaugaaucacaaaaagcgguagcuauaggaauguauacaaaauagauuucugucuggggaaucaaguuuuugauuugugcuaccuaauggaggggaaaaugcugaauuucuugcugcucuguuugagaaauagauggaagcaugggaggagccagagaccucugcagcaggauuuggucuaaguagaaaaggaagauuuuuguuucaaauugccagcugcuuaugucagacugacucccuuauuaugccuccaguaggccugucaauauggccaaacagcuagauaagugcggggcaggacaaagggcucuuugcacagcagggaggcaauguuggugggggaggggcaggagguaggaaaggcaagaggaggagguucuuuucccugggagauuauucaguuuggcauacaauuaaagaaaucauuuuuaguucccacucaagcauugaauuuuugccaaccacauacuauuaaccccaaauuugauacauuucagaauaucuuguagggauccauucucgccaaggaaaaauaaaaaaauaaauaaagcucuguauagguuaaaauaaaauaaaucccacacucugcacccuccuaggugcaagucaccucccgaggagacccguucuagagcugaauucucauuaagaaauggaaaagaauacucuaucugaauaaaaacacauuguaauacaauguguuuauuuggguugggauuggaccugaacauguagaauaauuuguuucccuuuaugaaauaguugcucguaguugucuacaauuuuauuucauuaagauagguagcacauuacagcuuucauguguuggguugccauauguaaaaugcuaacugaagaaaggcuacuuuuuaauuucagccucauccuuaguuccuggagaaccugauauuuccuggagauuacucccucccccaccuuuuaguuuaggcaaccucuuuugauacauuuguguucagcucgcauacaagugggauaguugcauccaguuuauuaagacuuaguaugaaucauagaguuggaaaagaucuguugguuaucugguccuuuaaaccaaaaucauaaugaaauauuuugaaauuugggucccuauugaaguuuucauuaaaauguuaaaggaucgguguucugaacaacauuuuuaguuacuuuuaaaauaaauguuuugcgucaguucuuuuuuuaaaaauaaagaauuucauuuauaggcaaauuagcuggcaauuauuugaauugugauaggauuucucuuuuaugaaggaauauaugacaagguuuuucaaaaugcuuaauauauuuuaaaagacuuuaauuuuuagaaauaauugguuugaacaguuuuccaagagcacauuuguugcuuggguugagguaccaccuauauugcaauguuacuaaacuagccuuaaaguuuucccuucugucuauacugcaugcaacaauaaagggaacuggaauguuaauuuccauuuauggauuagcagaggagauguuuuaaccgauuaauaaccaaaaaacugccuuucguacacguaauauuaagcaagccugaccaaguuuuguguuauuucucucuguuaaagaaaacuggauguguuacuacuuaacauuauauuguuauuuaauggucuuggcaguaaugauauaauauuucgaccaaaagaaauuuugaguaauuaauuauuauuguaauuaguuggaaguuucucaucaguaaaauagcaacagcauuaacacaaaaucuagugagcuauauuuuauauuacuacagaaauuuaggguagucauuucuuucuuuauaauuuauucacauggauuauuuccauaaauuugugggacuaaaauagaagccaucuagucaagcaccagucuccauaccagacaguuuucucugcaugugcuaugacccacauugccaguauuaaacauccuuuacacccucccccuucccagauaauuagaaaucucuucaggguagcuuccauugcuccuauuaccuggaucuugcuagaggcucuaagaaguuccugguaaaagugagacaguaagggaccacauuuugauuccaaagguuuugauaacuguuagggcuccccaaacagcuaaucucauuuucaccaagacuuagccagcagagggcuggaauggaggugaaacacaagcacuguaccucaucuugccugugcagcugcuccaccuuauuuccugcuauuauuaucucacaacgccuccucccaucaaaaagaaacuaggacaaagggggaaaauuggaugggcuaaugugauuuuuauuaugcuagguugugggcuuguuuauauguacuuaaauacaaagcuaauuugccccauucuuaaaagucuuuagugauagagauuuuguaacuucuguaucuucuacuuucuuucuugauaaaccauuucagauucucagccuuacagaaagaaagguuuuaagcauacuuaauuuucguuggccguucacagucauuauuaccaccagaugccacuguauuauuagcuugaagaaaggugggcucucuucuguacauaauaucugcaauuuguuuuggaaaauacuaauuuguauaaaucugauuuaugacuaaaauaagguuaaaaauuagaccucuauguauguuuacccuauuaccuuagugggggugaaauuaauuagcucuuugaacauaaauuuuucaugucuuagaguucuuuuuucaagcugcauaauuuauguucuucaagccauuuuuaucccauaccacccccacaaagggggaaauuuuauuuuuuaucauuuuuauugucuuucaauggugagauuuucgccaccccacuccugaaaugugaagacucaaauaaaacugaguaaucuaauaagguauaugcguugcugaauguaguaagaugauuguuucaucauucuuagauauuaugaucuaguuugaaucugguuuccaguaucauguuagcauauuuaauacuguugauauguuaauuuuaauacaugcccagguggaucuccuugcuuucuauuugugccccuuguuugucguuuuguaugaaggggguuuuuguuguuggauuuucuuccccaucucuguguccuguuauguucuuuggcuuauguuucaaaaauucuguuuccuaccaccaaccucuguacaugccacaacacauacaauuuguacuuucacaguuucugugaaguaggaugaucugcaguuaauaaucaacuguuugggcauucuugguauccaaggaagguuuuacuuagaaggaagaaccuggaaggaccuguuggcaauuagacuacuucugcguuuauuuuacauuuucccuuauuaacguaggcuguugagaguugacuuguuuuauaagagaaaccagauugacagagaagacccccaaucagauagaguuauuuuaaaaauaaauguguuuauuaugguaacauuugggguagaaucuaaagggcauauuuuuaaaaaaacuuuuaguucuaaagacaaaagaguuuaaccuaaaacagaacaaagagaagggccuuugaagcaguaugauugauuauaugcugaauguagcauuagaauguuguaugaaagcauaaauuuuuauuuucucaauuucuaugguacaaacuacuaugcccauggaaguauguguuuaugcccacagccugaaauauauucgguggaaugccuuaaaaaagaauaaaucuggccgggcgcgguggcucacgccuguaaucccagcuacuugggaggcugaggcaggagaauggcgugaacccgggaggcggagccugcagugagccgagaucccgccacugcacuccagccugggcgacagagcgagacucugucucaaaaaaaaaaaaaagaauagaucugaggaaaauguaagagcaagucuaaaauuuugaaguccuuuuugaaaugcuauuuuuuccuagacaaauuuaguguuauuuguggcaaauagaacuuuaaugucguaauuuaguaauagaacaaaauaaggguggguuuacaugucccugcacauuuuaggauggagcuaaaaauuauaaugucugcauaccaaauuguuacacauuuuaauauuggggcuuuuauugaaaaaguuuacccaauauuuagaaaccuuuaaaaacaaagugacauaaaauauucacagauaaaucagguagucaccuuauugguggcauauuauguaaguguacuaaagccagauauuuaguguuaauccaaaaauaugaaaauuaugcuaacaucauauacagaucucagaaguugcuguagccagccaggcguggcggcucacacuuguaaucccagcacuuugugaggccaaggcggguggaucaccuuaggucagguguuugagaccagccugaccaacauggugaaaugccauuucuacuaaaaauacaaaaauuacccgggcaugguggugcgagcuuguaaucccagcuacuugggaggcugaggcauaagaauugcuugacccugggaggcagagguugcagugagccaagaucgugccacugcauuccagccugggagacagagcaagacugugucucaaauaaauaaaaaauaaagaaguuacuguagaugccacucuuacuuaaacccuaggccauguguggagucccaggggaagacauguauuuuuagagaaggaaggcucuagguagguguaaccuuccucuuacaguuuaucaugaacaguuaguaugaaaaggaauggcuggaaguuugcaguaguacaccgagcaacaagagaaauaaacauaucccacuucaugaaaugacuaugccagccaagggagaugaaaaacaauuuuuuuuauaguacaccucauuuuuuuaaaaacacuuuaauacuaggaauauguuucuguggcaaauaguuacccccaaaggauuaugucaaauaucucuugugaaaauuaauuuuaaaauuaaucuuuuggcugggugcgguggcucaugccuguaaacccaacacuuugggaugccaaggugggcagaucaccugaggucuggaguucgagagcagccugaccaacauggagaaaccccaucucuacugaaaauagaaaauuagcugggcgugguggcgcaugccuauaaucccagcuacucgggaggcugaggcaggagaaucgcucgaacccagguggcagaaauugcagugagcugagauugcgccauuguauuccagccugggcaacaagagcaaaacuaugucucaaaaaaaaaaaauuaaucuuguguagauagugaccacguuuuacuuuccuugggacaguccugguuuauaccugcuauccuagcguaauuaguaauagcacccguuucacucucaaaaaugucucaauuuggaucauaaauuauacgcuuaccauaauuguagaggauugugagacuuuuagucgcuaccuagcaaccuaguuuuucuugauagagcucuucuuauucuggagucuccugugcugcgauuuaucuguugaccucucugaacccccauuuccaaaugagcaguuuuucgaaugucuuuuuucuuuucccauuaggugguaguaagggaaggaguagguauagauuugauuaauuuuuuaauuuuuuauuauuaaaaacuccaauuacuacaaaauagaaaaauacuuuggaguuuauuaaacuguuaguuuaaaagguuccauuugaucaggauaagguccauaccuugauugguaaguuugagucuuuauagauucuguuuuuuccauguaggauucuuguuaaagaaauucauuauuuuguggaguucguacucuggauuuugaagguuggauaaucauuuaacacauuccucuauuaaacaaccuccccccaccuguauuucauguaaauuacugcuuagauagauuguaagcauauuuuauaauaguacuguguauuuccauuaagaguuacauaauuucugcuugucuguguaauguuaagcagcuguuguuauucauugccuagaucaaacuuuguggucuuaaaaauugaagaccuggaagagcuuuuguuugugugaauuaugucaagauuuaccauauuagaaacuaaaacugagaaaaauuuuaaguuauuuauuaauauuaaaauaacaguaauaaagccugcuaauacaaguaaugugauuuuuuaauaaaaauaacauuuuuaauuuuauaagugucguuugacauuuuugcaaaucucuuuaaugucugacuuaauagaagacagcugcuuucucauaacuccuucugcauuuaauuucuugugauaaguuguuuugguugaagacugaagaaaaucuggccuuguacagauaauugguuggaaaauggaagaccucauauaacccucugacagaaucuagaggacuucaggcauucucacaccacccuuuuugagaaucacuggccuauauucaugauuuacuucauauuagaugauauuuucuuacuucuucauuuauuguccggaauacucacccuuauuuuuauuuggcuauacuaagauaguuuauauacagaagguaagauaagcacuuggguuuuuuacccccuuauuuacuaguuuucaaaauaauggguugguaacuuagcaacaucuaaagacgugaaugaaguauuauuauuguguacucaugguuuuaaacauguuugauauguuacagucucuggcaguuacuauuuuugacauucagguuguccuaccuuugucuguuggcuacuaaauucuuuugauucauucuuaauacuuuccucacuuguuuccuugcuuccuacuauuacuagauguucuaggauaauuuuguacauuuuuugccccaaaccuggaaucagccauuucugcagaaaccucuucauucuuuuaaugaaaaaugguacuuagaaaccacaguauggaugguaggaguguucauugcucuugguuugggccuuguuucuagauuuuucaaugaacaaaguuuaaaaguauuuuauuucuuuuuaaaaauaucacuugguauuuuaaaagcugcauuucaaacucagugcuacaugauguuuacguaaaccuaaucuuucucccuuuccccaugcccaaaaucucaguuuucacuaacaccaauguaauuucucuuuguuuugugccacaauacacacacuacaguuuuagugugacagaacaauaugauuacuggaaaguggcuuuuuguuuuguuuucucaugucuuuuugcccuuaggguauaucccuuuagagauagagauagucaugccucacuugaugaggauauuuucugagaaauguguugucaggugauuucgucauugugugaacaucuagaauguacuaacauaaaccuagaugguacaccuaagcuauaugguauagcccauugcucuuaggcuacaaaucugugcagcaugugaccacuggauacuauacgcaguuguaacacagugguaagcauuuguguaucugaaaauggaaaagauaaaguaaacauacgguauaaaagauaaaaaaugguacaccuuuguagggcagcuccauuacagucuuaugggaucauuaucauaugugguccauccuugacugaaaugucguuauguggcacaugaccauauauagucagauuacaguauuuugaaaucccccuuagaauaguucucuaugguugugccaccaguuugauacacagugagguuaauuuguuacauuuuacuuucagauuuuucagggauuagguuuuguuuuaugauuauguaaaauacuuaaaugguuaauaagugaaauuuacgaagcuggguauaaucagaaaaauugagcuucuauccuagugucuuccagcugguucucucccugucccuguauguuagacucaacagagucaucaugaauuuucagagugauguuuugucgauacuuccccuuuuagcagaagaagcauuuagguuaguucauuuacuaaaacuauuuccuucuagauuuuucacuaacuaauauuuuuacacuguagaagaggaauguggaaauuucuguucuuucuuuuuuggaaccagaauuucuuggcuuaauacaagcaguuugagauaagaaacuuucuccaguaaaaauucucuuuuuuuuuuucuuuuuuuucuuuuuuuugagauggagucucgcucuguuucgcaggcuggagugcaguggcaugaucucagcucacugcaaccuaggcgucccagguugaagcaauucuccugucucagccucccaaguagcugggacuacaggugccugccaccacgcccagcuaauuuuuauauuuuuaguagagacaggguuucaccuuguuguucaggcuggucuugaacuccuaacuucaggugagccaccgcaccuggccaaaauucucucucuugaaaugccagaccauguuugucucugggaauuucagguacacuugggacacuggugcuacuugaaguguagagagcucaucaguuaacauuucuugaaugguuugcccuuagaccugaaauguauguuauuuagaaaggaugucauauauuuuuuaacuuugucauuuaaaauccaaguuauuugauuuuauguguuuuaaauaaaauauuaaaacuuuaaaagucuuguaccuguuaaauguuuuauccuuccuaauuacaguaucuuaaaguuaucacauuucagcaauacgucacuuucuaaugacuaauauagucuuuaaaaauacuaaaucaagauauaccaaaggugaagaaauagugauuaagaaugugaggauucuagcugugguuuucuugcuuuggcuuuggccaagaugaguuuaauucuuuggucuaauaggaauaauacuuuucuccuaaacauuaugagcauuauuugaguuaaugcaugaaaagugguuaaaggaacaguggcuggugcaacauaagcauccaguaaaugcugccuuuauuuuggaagugguuauuguuacgaguauuugaucaguucucuaaacucugucugaacuuuacuuagaauuaguaauguucauaugcuguaaauaacaccugauuuucaauacuucauugguuauaugaaaagaaccaacuguuaacaaaggaauaauugguaucuaguuaaaauuugaggccucugacuucacaaguauaccagugcuuacuauauaaauauaaucacauuuaaaaauuuaauaaagaaaguuuuaaggaaguaagucuccuuuucaggauccaggguccuuuacaaacacuggauccugaaauuguauuauuuguuguggcuuuaggguauuguguaugcugaccagagucacaggugguuuuuuuguuuguuuaacacuagaauuuugagauacauuugucuuuacaugcccucaaaguaaguuauauaacaccagauuguucauuaguucagguuugauuuuuuuguuguuguuuuuuguuuuucuuuuuaauacucugggguuggagugagguuguagagugcuauaaggaauuccuauuagaagauaguauuuuagauaugggcauucuaggaaaggacaaaaugguacacuaaaguuaucuucccuuuucccccaccaccaaaaaaauaaggagcaaacuacagugcacaguuuuggguuuuuuuuuuuuuuuuuuuuuuuuuuuuuuaaagagacaagguccuacucugucgcccaggcuagagugcaguagcacaaucauuguucauuguaaccuugaaccacugggcucaagcaguccucccaccucaaccuccaguguagcuaggacuacagguaugugcuaccacacccagcuaauuuuuuaaaaaauaucuuguacaggugggggucucacuguguugcccaggcuggucuugauugaacuccuggccucaaguggucucauaccucagccucccaaagcucuggguuuacaggcauaagccaucaggcccagcccacauuuuguuuuuuaaacaagucuuuaucuuuuggagauacaugcugaaauauuuauggaugaaaugaaauguuaucugggguuugcuuuagauagagaggagauaauagaugaaacaaucaacuuauuaguuggucauugucgauacuagauaaugaauaaauggacuucuuuauaccauuuuacuuucauacuuuauuugaaacaaggucuugcuauguugcccagcuggccuugaacuccuggccucaagagauucucaugccucagccucccagagcuuugggauuacaggcaugaaccaccaugcccagcccauaauagaaaguuuuaaauuuuaaaauaaaaguauucauagacuuggcuaucauggauccugguaaaguagacuagugaacauaaucagauguuucagucuuucccuguugauacugcuugcccucugagcccauuuccucuccugaucaucgccugcuauuuccaaucaacagaaaaaauagaguagccuacauauauaaugaguuuauacuaagagggaaauuuuaauauuauaaagaagucuauacagauucuggagagcauuccugaagagaagauugaggaagcaaauggauuaauuaauguaauaguguguucagugugcaauagguaacauuuuaugauaugguugaauuucugaaaagguaucuuauaaauaucagaccauauuuaaggagacuuccaccucuacugauaaaaucugcccuucucucucccccugacuuuauugcugcccaucuguaguuuugaucuuuuuucucuaggauucuuugccuagaauugccaugggccuucuggaucuggaacacggaugaaggaagaggaugaauguuuuucagauguuaucccuuaugggaguaauuuguaaauucuagcuucuucggguggggggaggcgggguguguguguguguguguguguguguguguguguguauuauuuauuuauuuuuuuaaguuaauuggccucuuccagcaaagaguauacagcagagaccuagaaguuucauuuuuuguuuguuuuuguuuuguuuuguuuuguuuuugagacggagucuggcucugucacccaggcuggagugcaauggugugaucucuucucacugcaaccucugccucccggguucaagcaauuuuccuaccucagccucccaaguagcugggacugcaggcgcgcgccaccacgcccagcuaauuuuuguauuuuuaguagagaugggguuucaccauuuuggccaggaugguuuccaacucuugaccucgugaucugccaccuuggccucccaaagugcuggaauuacaggugugagccacggcuccuggccaagaccuagaaguuuuacgucaaauuuugucucugcaguuuucugaggaaugaguauaugugcucaaauaauagcuaaguauuaagucugaaauauucuagaaaaacagucacaaaguaguuaugccuaggauguuuuugaauauugguacuagaacaaauggauuccuacuagauuuccuuuuuacuuucauauucagauguaggaagaguuggaauucaaaaugugaaaagcagucuugaaucucaguaaauucuuaagaaauucuuaauucauugaagagccauuggucguguguguuuuuuggggaguguguguguguguuguuguuguuaagaauucggggaugaguaugaggcuaucauugcuucuacaaggcaacuuaaugauaguuugcugcuuggcacaacaggugaaagggccuuucuagagcagggaucuugguuucccuuuuucccaccuaguaguaucauuccauguauuuaccaggauauacauuguuuaguccugucuuggcuaaauagguaaugguccuuaaggacauaaaauggaaggauauugugcagaagaauuacuaguucuccguaguguauuuuuuuacuguauucuccucaucaacagauggaaaauuuuuaaacuuagaagaaaaaacaaguguuuuucuccaaaagauugagaaccacugcuuuuaaguuauuaauggaggucuucaauggauuuguuaaaaaucuggagcauggauuuuuuuuuuuuaauuuuuuuguuauugguuacugaguauuggaaaaggaaauacaguauucaaaaacaguaauguucaggauuuggaacuauuuuacucaggaaaaaauaaguuuauaaauagacauuuuaaugaaaaggaaaauagcaaauuuauggaaaucugagauagucuguguuuugcuucacucuguuuagugcuagaauucuggacuuuguuuggggucaaacucugauaugacaggaaaacuaacagaugauuaaaagagacaguaacauaaaugggaaaguuuaaauaugguauaugguuuuaauuauauuuuguauaagaaagcaguuuauaccaguuguauuccuaacuaaaaaguacuauuuuaucaguuuccugggacuaauuuauuauaaguuaauuaaugacaugagcauuuuggcccaaauacaguugaaauguucauugaaacuggaucaaagaugagcauaugugucaaggcuuuaaaaucauuuuucauauuaagauuuccagagaaaguuuuuguaauauauaaguuaaauauuuuuaaugcuuuagaugacaggaacuguugaagguccuggaucucauaacaagccacuagcuagcugauccaaagacauuuggccccaugggcuucuaggaagacaaaugugcuuaccauuucaaagauuuuauuuugcucaguaaccuacuagacauauauuaguguuuguuugaguuggucguugucuuccauugcuguuauuuuauuauuauuauuuuuuuaauuuuagagacaggaucuccuugucacccaggcuggagugcaguggcacagucauagcucacugcagucucaacucuuaauuaggcucaagggaucgggauccucccaccucagccucuuaaauagcuuggacuacagguaugcaccaccacuccuggcugucuuauuguguugcccaggguggccucaaaacuccuggccucaagugauucuccuaagucagccucccaaagcgcuaggauacaggugugagccacccugcccagccccauugcuguugaacuuuuuuuuuuuuuuaaagacaggcucugguucuguugcccaggcuggagugcagcagcgcaaucucaguucacugcaagccacccaccgagcucaagccauccucccaccucagccuccugaguagcugggacuauaggugugcaccaccaugccuggcuacuuucuuuguaauuuuuuugugguucaaauaggaaucuuccacgugcauccaaaauauuuuugguuugugacacucaguguuauuauugacucauuuuuccauuggaaggugugccucagagugggugagccuuuuugcccucagucuucugucagcacucuaagacuccaaguacucuaagagauugcucacuaaaaauaagaacagcuggccaucuaccucaaaugugagccgucacuuuugugauauaaucaguccuuaucuuuaguacacagauuuauggaauaucacacucacugucugccugcuuugggguguuucuccugugucauucauuuuuguauauuggcauauagcaaauauaggaaugcugugucgcagcugugggucauguauguacuugcaguuagcucuugcucccaagaaugcaagaaauuuaucaacaaacucgugucauaaaaauaguuuacagugauuuuuuucuuaaaauauuucaaugauuaagacuuuuuuuaauaaccacaaguguauaauuguaaaaccuaagcauuacucagcaaaucuagcaauuguugaauugcauaagcuucuuguucauuggaacuuuugcuaaagaauuaugaccuuugauuucuuaucaccaugaccuaucauuaugauaaacaugccccucuuauguauccuuauacccauuauaaggauaaacaagggauagcuccacccaccagaugucauagacacaacugguauuuuggggauuuugcuguagacuaauccuggaaggaagagagguuauagauaaaauaagauuggccaugaauugauuguugauuaaagcuggguagggaacauuggguuuucucugguuuuauauuuauuugaaguuuuucaccauaaaguuuuuuuuuuuuaagauaaaaaauaaaagcaugaauaguguaaacaaaguuuugaaggagaaggaaacagguuaguagcuaauuaacaaaaauguucuuguuccauucaggcacaggaguuuggacuagcccaauaagcauuaaggaaaccauuauuuguagauuucagauaaugcaaugauaguaaccaaaguuaugcucuagaagggauaacaucauggaagaauauagaguagauuggaggguucacaccccagagguagugagaccaguucacugcuauuauauaaugcuaccuugaaaucauagggaggcgacugaugugguuugcuaaaagucuccaaaaauuucaaaggagaauagcucuucagucaggugcuagugccagcacaacaaaaaagaggguuuuuucccucauuuggccagggcauggauuuggaccaugugggugucauaauggaguauaccaagugauuuuguuccuaugaugaaagugaaguccauauuuugucuccugucuuuuaguaaaucaguauagauaagucuuuuuuuuuuuuuuccccccgagacggagucucgcucuaucgcccaggcuggagugcaguggcgugaucuccacucacugcgagcuccgccucccggguucacgccauucuccugccucagccucccaaguagcugagacuacaggcgcccaccaccaugcccagcuaauuuuucguauuuuuaguagagacgggguuucaccauguuagccaggauggucucgaucuccugaccucgugauccgcccgccucggccucccaaagugcugggauuauaggcgggauccacugcgccuggccaagucuuuuuuuuuuuuuaauuauuuuauucuuuauuuuuuuccccacauauucuaaaauaagucucuuacagugucuagguuucuuuccaaaggugauuaaaaaugaagcaucauauuuuaaacuucugaggcagaacugcuagaacaagaguuuuguuuuuuuuuuuuuuuugagacggagucuugcucugucgcacaggcuggagugcaguggcgcgaucucggcucacugcaggcuccgccucccggguucacgccauucuccugccucagccucccgaauagcugggacuacaggcgccugccaccgcucccggcuaauuuuuuuuuuuuuuguauuuuuaguagagacggaguuucaccguguuagccacgauggucucgaucuccugaccuugugauccucccgccucggcuucccaaagugcuagaacagaguuuugauaauuuguuugaaacgaagcacucaaaucuucuaguuuauuugcauuugcagucagaccucuacagaugccagcuagauuacagauggcuagcauaaguuuuuuucauuacagaaagaagaaauuuagagcuuagugcggucuauuaaaagaauuaaagguuaugucaaaggacaacuauaagaaaguacuuugguucugaauauugcuucagcuaggguuuauuuugaagcuccuagcccaaauuuguagaaaugcaacuaagaucuaauauuuaguguguaagaacuuuacaggacauccagucaguaguagucuuaaaagugaaucacauaggcugaagcaggcagaucaccugagcccaggaguucaagaccacccuggccaacauggugaaaccccgucucuacuaaaaauacaauaaucagcugggugugguggugggcaccuauaaucccagcuacucaggaggcugagacaagagaauugcuugaacccgggagguggagguugcagugagcugagauccugccauugcacuccagccugagcaacaagagcgaaacuccgucucaaaaaaaaaaaaaugugaaucacauacauaaacauugggaauuugcagauaacuuucauuuuaggguuucuagagcgcagugguguaaucuuggcucacugcaaccuccaccuccuggauucaagcgauucuccugccucagccucccaaguagcugggauuacagguguccaccacuaugccuggcugauuuuuguauuuuuaguagagacgggguuucaucaucuuggccaggcuggucucaaacuccugaccucaggugauccacccgccuuggccucccaaagugcugggauugcaggcaugagccaccacacccggcccacuuacaggauuuuucucccccuucaugguuguauaaaugcaguacuuggcacauaggcaaaccugaacaguuugcaaguugccuacccuuuucuacuuuggauaaaauaaaccucuuaaaauagcacuuaacauaguaauauauguauauuaauaguaguuacuucauguuuguugaaugaaugaaugaaaaaaguagcaaaucuacauaauauaaaucccaagacagccaggaauuuuaucuggaccuaauugucuuacauagcaccaauugguacuuaauaaaaacaaggcugggcauggcaguaugcgucuguggucccagcuacuugggaggcuaaggugagaggaucgcuugagcccaggagguugagguugcggugagcugugauugcaccaaagcacuccaaccugagugacagacccugucucaaaaauaaaaauaaaaacaauuaguuauaacucagauguugcuaucuaagguaaguaguaauuacuauaauaaacaagcuauauauuaacaucuuaauuuucuuuccucugaacuuuacuacuguagguguguagugaacuucauacaaguuaaucuuuuuguagcucuauuucuucauuucuguuuguucaucgguuggagaaauuuugcuuaaauuaaugaaaguaaaaauacagauauuaauggcucauaaaugugcacaacccacuucaucuauaguaaguaaaaguggcucccauuuugggguuugaaaaugaagaagaucugaauucacagagaggaggcacguguagagauaugagaaguucuuuuccuacucuacuuugguacauuggucucuaacacauguucugagccucagaacacaguagaacagaaccuucagaaaguguugagaguauaacucuuuaaagagguuuagucagucuaaauuauuugagggcaucaucuuuauuugguacuuagaagucuaaaaucuuccugauuguuguuaagguuacaaagagucuguguauuguugguuaguugagcaguaaauaccuuuuuaucauuguuaaauggguuguaaauaaaauauuuuucuucaguguuaaaauaauuuaugaucacaauauuuagauaauaauaauaauaauucuguuauuuaugauauguagucuuauccuacugccacuccccucuucugcuccacauacuacuaaguaugacuuggucucuauaauacgcacuaauuaugaaguuuuuuacggagaaggaaauucuuaauauagacuaggauuuuuuuucaguugucuuuuaauggccuuuuauucuaguaaacuuagauuucuuauagacaucgguuuauugugccgagcucaguagcuccuagagggaguauaaauuuaggcaaaggaaucaaggaauaaacugguauuguagaagagaugggagaaaaggaaauuuuuauuuuugcuuuaaauuacuaaaucaugauguuuccugucucucagugcuuaccccaaucaguguuucucucuuuucuuuuuuccuuucagucccgaaccccuaaaauucuuugcuugcauuaacuugcuucagauuauaagccuaauuuuacuguuccaaauacaugaacuuuucacuguaucuccaagugcucuuuuagaguucaucucuuuguuuuccaguaacucauauuuguuucuucuuaugcuuaacacuucucucucauuuuuuuuuuucauguuucucacauuuuuucuuuccacauuaucugcuguagcaaacuugaaauauaugcuuuuggagaagaguaaaaacaguguuuagccauauucagguuauuagcagcagcuccucuuucuucacauauacuuaaagggaccagaaaguuauuuaagcucuuacuugcuacaaaugcuguuccaugugcuccuaugagucagcacaacagguauuuuuuuuuuuuuuauuguacagaugagaaaacugagacuuugagacauucuaugaauugccugagcuaguuggcagcagugccaggauucauagaaauuuggagcaggaagacaacacaaugaagauuuuacuuugaggaauuuaggguucaucuauguaaagugauuuuucugaggucacuaauuauguuguaggcuagaacucaagucuccuaacuccuaauauagugccuuuuuuuucuuuucuuuuuuuauuuuuuuaggagaugggucucacuauguugcccaggcuggucuuaaacuccugggcucaagcaauccuccugccucagccucccaaagugcuaggauuacaggugcaagccaccgcaccuggccucuaagagugcuuuuuccuagcauacuuuucuucuccuaagguaaaaggcuguuugucaugguacagcuacggugauuuuacuugagauauuugacuuugagauggagaugaagauaaguauauaaugcagcugccacauucauucucauacaagguaaagucauucaaaagauaaaucgaagaacuauagauguauuuaagaagaaauucagccuauauguaacaacaaaauuuugaauaaucaaguucagaaauuggauuuuuaaaaacuuauuagcuacuuuaacccuuuugaaauauucccaaaaaguguuuucucuuccugaguuaaauuuauucauuuauugaccuauuaaagauuuuuuuagugcuucagagcuauucuguauaucuguucauuuucguuauuuaguaguauauagaaguaauagauugggcugaauagauuuauuucaggauauaucuuagauauuuguguuuuuucaugaaucccaguuuaaggguuauugcuuucaaaaggaagaaauuugguuagucaugacuuuuggcuaguugaaguuuagagaagugcuuuauacaggaucuuuuauuuagugagaaaaaaauaacuuuuuauaauuuuauaauacugugugaaaaaccugauaccaaaacuucugaaaaagaaaccaggccuaggagaugaggauucuagggaagauuauuaaauugaggauauuuuuaaguuagauucuaaauuaguaaaucguggcuaauaagaugaaaauaaucugauccuuuaguaagaucugaaguaauauuguugcccugcaaaaaagugguuguuaucagcauaccuuauaugucagccuaagcaagauuagauuuucucuuuucucugauagaugccaauauuuaacauugacuuuuaucuacuuucaaaaauaucuaugaaauauacuuucugucucugaauuagaguguauguauauuuguguuuacuugaaauguuauagcuggaugauagauuucagagcaguuuuuaugcuuagggaagccacugccucccaaaaagguuuucuuaugagaaugaggaaaauaaguauaaauuuucauauuuauguuauuacuauugaugugcuuggauaauuguauuuauaaaaguaaaaaauguucaguauuuuaucugaaauuuaauaauggauauuguacagccuaaggaauuaaaagaaaaaggacccuuugagaaaauggcuuguucuuauguaucuuaauauauacuguguucacuuuauguuuugucagacacugaaauugaggaagagagauuuuggcguucuguugguuuauggagagaguugaucagagauugcuccuuggcugaguugcugucugcauaggcuguuaacaauuguuucucuggcagcagaucuuguucaucaggauugcaucauuucugggagaauggccaagguccacagccucaauacaaagacugucugaagcauaugaggccuguucucuuucugaagcggcacuccucuuccugccaguccucuucacaggauuacugaagcagacuuguucugaauuucuuucguuggauugguuguuuauuggacuuuugucugccagcugcuuccgccucaccugucugaugcaauuucuucuucugaaaucuguuggaauuguucauaaaacacuuuuuguuugucuucucugugagugaccagggagaucauacaggucuugugcuuucagcaagucauauagagaagagacugucagaaugaugauacagagacuguuggccauuucugaaaccaauuaaaaagaugggguaauuaagaaacauuucuggcauguucuauuuaacauccuuuucccuagaaacuguauguaaauggcaccuccuaaagagaguacucgguacuacuggaagauacaggcugugucuguuucugaauccaagaacuuacuaguguuccuguggauucugauggauuguucuggaaauaguuaaauuaauaauaaauugaaacugugaugcauucauuuacccccuacuguacacucacaucuauuucgcuguuuuccuccuuuccuuuuuuucuuucuuauuugcuauugcuucuuccuugauuuacuuuauuucuuccuuccuuuuacuguuacuuugauacuuuuauuucucuaauucuggguguacuauuuuaaaucguuucuaaaaaauaguuuauuuuccaguuuuuuaaaauuagaaaucauaaaacaucaacauaaaugaaaugcaugcguucuaaugcuugguaacuggaauccuaugaauagcucuuuucauguuuaugauauguuaaucuuuaagguguuaauaacucuggcuagcguuaaauuugacuuuuaggaaaaaacaccagagacuuaaaggauacugaucauuuucccuuccuuuuuggaagguagaaaauuaauuuaagcgccauuuuuuaagcauguuuccauuugaccgcaaauagaacugacuccuuuuuaucacucuuuuuuauaguaggacaagaaacuagaugguguggaaugaagggaaagaaaggaguaauaaauauggacuuguaauuuaaugggugaugauggccccuugucuggcuggacaguugucggacaucggguuaaagaaagaacucugaauuugagaaguguucagugaagaagggaagcaccuuuuaggagagagaaaaagaagggaucccuuggaaaaugagauaauucuaauuugaaggaagaggaaaaauuagccagugacauaaguauuuaccauuuaagucaaauaauuuccuucucuaccaucucguuucuggcuuuauggaaaaauaaaaaauuaaagggcaaaaaauucagugccggauggacguagggugguaaacgagauaguauagauguaggaugauaaacaagacaguauacagaaacauaauauagcuguagaauuccauucuguguguucaucaauguuauuucuuucuguacuaauuuuugucucaacuuuuucuaggucuucagaacuacuagcagauaauuuggggggacuucauauucagaagucuauauaaaggugacugacccaaguaaauccuuuuaauuucuguuuuauuuuuugcauuuuaaugacugcuggaaucauguuguaguaaauugugauuauaauuuacuuagcagauauuucuggaacuucucuacgugucaguuauuguuuuggccauugaaacuacagcaguggauaaaaaucccuguucucauagaguuuauauucugguaggaaaaaacaaacaaauuauaauaagaaaauacugcauuuagaugaucuguuaaauguuccucgguuaacauuuuaauagcuacauuuuacagaguuacuuagggaaggaacuauucuuaggguaauauuugagaaauuugggauuauuaacagaauuugaauuaagaagccucaucauuauuaaagcauuaguuagaaugagauggucaagcuaaccuauuaugguugcuuucaucagaagaaugaaacagucauguuaaacuagacacaaggaaaauggaauaauuuuuaugaaauagaaauuuauaguuaccgacaauguuucuuuuuuuuuuuuuuuuuuuuuuugagacagaguaucauucuuguuguccauguugaagugcaaugguacagucuugacucacugcaaccuccggcucccggguucaagcgauucucuugccucagccucccaaguagcugggauuacaggcguccgccaucgugcccggcuaauuuuuuuguauuuuuaguagagacaggguuucaccguguuagccaggcuggucuuaaacuccugaccucaggugauccgcccaccucagccucccaaaguguuggaauuacaagcgugagccacugcaccgggcugacuuaauguuucuuaaggauucaucaacuauccaaaauagcuggguugguguuucauuagugaauguagcaaucauuuauucacucauuaagauguuaucugaaguaacuuuuccaucuuuuccuuuuaguauaucuuuuaaaaauugcucuaggaaaaauaucaacuaucaucuuggguuuauaacuugucuuuuaucuagaaacuguacuuuuuuuuuuuuuuuuuuuggagaaagaguuucacuuuugcucaggcuggagugcaguggcccugucucagcucacugcagucucugcuucccagauucaaacgauucucgugccucagccucccaaguagcugggaucacaggcauaugccaacaugcccagcuaauuuuuguauuuuuaguagagauaggguuucaccgugaaaccaugcauuuuuuaaauggguguacagucguaauggcuacaacaaaggguuuuuaaugauauuaaguacgguuuuugguuuaagucuuuuacugaaaauauaaaacaauucagauucccuuugcugaucaggggagguacggugauaaucagacuuucauaugauuaucuggucagacagcuuuggggcuuuucuuuuaaucugaauuauacaguaagacuaauagaaagaguagugaccaacagcccccaguauuuaacugucuuuuggguuuacuugaugaguguucuuguuuuaucauuuacagauuuuacuucaauuucccaaaggcuuagaagauguacugccaaggucucuguuuggauauacuguuagggaaaggaaacauacauguguaagacuggccuaaaggcaaaaaaguucaucagucccuuuuuuuuuuuuuuuuuuuuuuuuuuuuuuuuuuuuuuuggcaacagggacucacuuuguugcccaggcugagugcaguggcaugaucucagcucacugcaaccuccaccucccaggcucaagcaauccucccaccucagccucuugaguuagcugggacuacaggugcaugccaccacaccagauuuauuuuuuuuuuuugagauggagucucacucugucgcccaagcuggagugcaguggcgugaucucggcucacugcaaccuccaccuccuggguucaagagauucuccugccucagccuccugaguagcugggauuaccagcgugugccacuacagcuaauuuuuguguuuuuaguagagaagggguuucaccacauuggccaggcuggucucgaauuccugaccucaagugauccacccaccuuggccucccaaaaugcugggauuacaggugugagccaccgcgccuggcgcacaccagguaaauuuuguauuuuuaguagagacaggaucucgccauguuucccaggcuggucucgaacucccaagcucaagcaauccaccugccucagccucccaaagugcugggaugacaggaaugagccacuucaucuggcccagucauuucccagcccagcuauaugucaccuccaauuggguguaggaacaggcguauugucauacccagaggucucacuucaucaucuaggcuggagugcagugcaugauuauggcucaccucagccucuaccuccugugcucaggugauccucccaccucagcucccaaguagcugggaccacaggcacacaucaccauggcuggcugauauuuuuuuacuauuuuuguagaguuggggucucacuauguugucucagcuggucucaaauuccuggacucaagugauccuuccaccuuggccuccuaaaguguugguauuacaguugugaaccacugcacccagcccacaauuuuuuuuauuugcauuaauaucaaaguaagauuggagcaucucagaccaucuaccauuuacaauuuacauuaaccggccaggcacgguggcucacgccuauaguccuagcacuuugagaggcugaggugugaguggaucaccggaggucaggaguucaagaccgccuggccaacauagugaaacuucaucucuacuaaaaguacaaaaauuagccagacaugguggcaggcgccuguaauccuaacuacuugggaagcugaggcaggagaaucucuugaagccaggaggcggagguuguagugagccaagauugcgccauuacacuucagucugggcaacaaaagugaaacugucucaaaaaauaaaaauaaaauuuacauuaacccccuggguugacucagucgguaucauguacuuuucauuccuuuaguuuuuuuaguauuaauaauuguucuaaugucuuauuaugaaucaguguaucagucaugacucucuuuguagucuuuuuugcaaaaguccuuguuaacaugggucuuugacauucacauugacuuuauucccccccaaauaaaaugcuuuuuguuucauccuuucaauguuuuuuacacuacuguaaaacuacuaauguaaagucacacaaagaacacuuguuucccucugcaccauaccuccaaaucucuuaaucuauuuuugcauuuuuuuauacuucaguaauuucugagucuuucuguucccagcuuucacugguuuauggucaccaugucaagcuauccucaccgcuuuuucauacacaguuguuuagucuuuaucaugaaacuguacucuucgugauuucggggguuuuuuuguuguuuuuaaaaaguagucaacuuuuuuagagcaguuuuagguucacaggaaaauucaucaggagauacagagauuucccaugcacccucugcacccacgcaugcauagccuccuccugguuuauauuuuuguucauaucuagcagcguauuauuaccccacaaauaaaguugcuaagaugauugcaucuucucccaaaauuauaguuaagaugauuuaaaagaaggaagagaguguucaaugacaaaagaaggcacuaagaaacagcuguuuccaaucaaguauaaacaacaaauugaucucuuuuaauuuggaagaaauaacauuauugacugcuugugaaacugcauuuauuuguggccuaggaaaaaaacuuaaaugaagaucuugaauuuuuaaagaguuuagguaaacugggauauuuuuaauaaccauccuuuaucuuaaaacuuguuugcuauauccuaggcugccagaaaauuuuguuugggcaguuuuagaauggggagaauguguugguuagugagauaggcagacucuuccuuucccuucaacugaaaagaaaaacaaaaguaaacauaacuuuuugcccccuacuuugugaaacauuaaugaaaugcauaguaaacaugggacacuguggcuguauuuauuuuauaauuaucccuuaaaagccuuauucaagaaugcagaaaaauauucaguaacauuuaagauaaacuugaagaacuaucugauaacuagguauuuauuuuacuagauauuuuccuuuucuguuacaggauuccucauguccauaacauguuggaugaggcucugcagcucacccccacucucagaguggucagucuccauuaauuggaccccgugauuuccaaucucugcuguguuggacgucaugagcauugcaaucccucugggagucaccacaucagauacauccuacucagauauggcugcuggaucagaguaagugcuacuuucuagguaguagguacauuaucagucuguguggagacagccuucuuauggauagcuaauaggauaauauguaguauuuucuuaaccagauccuauuccacuguaauuaacauuagaccuuucccuuuacccccauugaaggugguggaaaaaaggaauuagaaggggaaggaagaguuuucagagggguauuucugggcaaauaauuaauagaaccaaaguugcaaaguaggaauucauuuucauuuguuuuaauggguggagaaaauuggaauaaaguagguguuacuaccugcuucuguagaguuaaugauucugauggagggagauaagaagguguucuuuccaacugauuuuccuugaaguccucuuccuauguacuucccauuguucuagaguaaaggggccgaaacuauaugggcagguugccuagaccuucugacaucugggguagaaaacauggagaacagcgucaucuguuuuuuuauaauauucguugccuagaaagaggaccuucaaaaucagugguaccaaacuuuuuuuucagcuaagagcagcuuuaggaauucagaguuuguccaaaggcccaaucccuaaaauuauacucucaauucuugaagaauguaaaugccaaaugacaaugaagguaggccuucauuauacaacuuuauauauauuauucacaguuuuaaaauuuuuagucuuuuguaucccuucucuuuuaaguuguccgagauucccccugcucacagauucccccucuuguccuuuuaccucccuuguacccaaucuuccuugcuuacagaaaggaaguggaagcccccuaccuuucaagacgaaguggcacuacaccaggaugugaaaguccagcgaaagagacccaaggggccuagggggcagcacacccccagaagccaagucuauuccaggcaguaccagggauuagggucugggcuggaaaaauccugguguuuugaauauguucagguccaguucagacucuugaucccacagccacuucuugagugagguggguguugcucuaauuccccuguuucucuugccauuuucacagucccuggggauucuucccccuucagcaaagcaaagcaacuguaccagauuucuggguugaaugacaucccugauuaauaagugguuuucuuccuuaaaacagaauauuauuaaagagcauguauauuucuucauaaagccaccuaauauaacuuaccuguuuacugaguuccuuaaagaggaagacuuaaagcuacccugagaaauaguauauaauauucugggguagucuaaaaugaaaagcaguguuugggcuuauucccauauaaaaaggagaaaggaggguuggggguggggaaggguugauuuuguuucuucuagagcuuuuuucuucuuuuguuuuuguuuguuuuguuuuguuugcaugcaaaagguauuuaguuaugucaguaacugagacuuacuuaaccauuuuacaacucuuuccccaaauaaaguacuuaaaacucucccugcauuaguagguagccaguuuguauuguguuuauagguuuuuauaaagucagcuacuaaccugguacuauguagauugucuaacuguauagauagauagcauuaacauuugugagaaauuucaacaaagagguuaaaccaauacguuuggaauugcuggauaaaagacccagagcaguuaaucuuacaauugguguuuuccccaaaguauagacaugacugcccguaaauacugcuggggagucuaggacuaauuccagaaauaaaaauacuucuggucuacaaaugugacugcgcugucucuguuaacaccaacauauccuaggauuuccugaaacauuuucauucaugaucuccagacagauuugugauacuguggucauaacuagcuacauaguuaugcauuucugcaaagggaaagaaugucaguaacuagcuacauaccauucuguuaaauuauuaaugauauuuauuaauguuucaucaugccuauuucgcuguucugggcacuuuaagauuaaaccugguauuaagugcagcauacucaacuagauguagacuucacuucauagaauuuuaaaucugauggcaacuauaugcaauacgcauuuauuuuuguguguguuuguaggaaaauuuguagauguaacaagcaaaacaaagauuuuucugaauuuccaacucuaccauaacagaauuucaggcauuuuccaagaaauggcaugauagcagcuggguugcauguuguacuuagaacacuguugauggaguauaucuguugugagccugguuucuguguauguguccaauucagugauaggagaagaaagccuguaauuacauuugcauaaagugguuggcugcuaaagagauguaauuccauuauuccaaacuuuuaauucauauuuuaaaauauaaaaacuaguauauauaucaaggaauauuuuaggaaaucuuguaguuaccuguaagugucuaacuguguauucaaucaguaaccaauauggaaauugcagaguuucuucaucagaagauaugaguuuaaauuuuauauuuggcaugcacagcaauauauuaaaugcugugcuuaacuagaaaguauugugcagugugauggccuuuuaaccuccacaauauacauuuuauuuuuauucccuagacuugcacaugaagugcauauguucauauuuacccguuuggagauggguaagauacaaccagcauagcuccaucuccauggccaucuuugauuucaugcaacuuuccuuuuuccugucccccucccaccaaaaaaaaauccauuccuaauaaacagcuaucauguuucacuccauguguucagugguacaaaaccuauauaaaauauguacagcucuuuggaauacuuguuuaucuaguaauguaccuaguaaauuaacaauguuguauaaauuuauuacuuucuuuuaacuguccaucauagaaacuaaauuauaccuucauuuuauuaaugcuugucugccuuugguuucauuuaggaaaccccaccuguuuccuaauacucagagaugauugccucucagugagccauguucagaucaucuuuuucucaagaauacugaccugcauucuugauguaccccucccccguucccaucuugcagacacuuuuaaguaauaaaaugcaugcaccucacuaacagagaauacuuuccucugucuaaaguucuucacuuagaaauuuccuuugcuguuauuaauaagauccuuucucacaguuuuggagcauauaacugggugaguuggauacauaucucagaauuuucuuugaucccucacuucucaauugacauugcaccacauugaacugcacacuuauuccugcuguacuauauauuguauaucuuuaagcaggaaaaaaugacuuguuauuucaagcgaacaauaugcauuauuugacucccugaaagacccauuaaucucuaaguuagaguuauaccaaucaucggaguuucuaauuugugaaucuguguucuaauuaauauaaauuacaaauuacuauucuauucugcaaagccauacaaacuuuauauuuuugaauuacccuucaguauucccuaaaaccuaaccagguaacaaucagaguugaaguucuuucuucccauaaaccugauuuuuauccuuugccaucaaagccuuuuuauuguaaaggcuuauauuaauuuucuaaguuugaauacauguauaauucuacaauaauacauugcgcuugaauaguuuauuuucuacucacaaaggguacaaaaagauacuaaaccaagcuucucacuaagccugguuaauaaaggucucaaauaauuuucuuuaaaggacugaaugucauucucauuucuguaguggaaagagcauagacuuuggagucagacagacuuuguuucaaaucuuagcugugucaguguguaaccuuggggaagucauguaaucucaccaccacaucuucccacucuguaaaaauggaguauauaccauguuuagugguugcugaaauuaaaugaauuaauauguauuuaaagcaccuaacaaauauugggcaguucacaaugguagccauuacuguuguuauuauuugucaguagacuaacauaacuuuacaguuuaguuuuuauuuugaaguucuaugguauuaucaugcagcugauaaauaauuuuguccuuaauaugcuugcaugucauugguggaugagaaauuauuacucuaauauuugaaagguguuggggguucaucaagaugagagguaugauaaauauaagaugccauuguuuuuaccuguacuuucuucaggguauccugucuugguagugaauggaagagggccuggucccuggggcagugcagaaggcacuuugaucaucucacucacugcaaaugucaugugagguuucauggaaguauuaagagauccaauuaagaagaauaguucugagucuaaaccagcccagaguggcuucucuaggggaaacuccccgcucagcugguacguuuguguuugucauuagggacaccuuguaucucaggugccugccuucagacaucugccuguacuggcuucauguuacacacaaauccacauuuaauaacacuccuacuguuauuuauaggcuuaguuauguuaauaagauuguuucaccgaguucuuucucuuauccuaguggcuagugguuguggaaagaggagggguuagaaugggaaaugaaguguuaguuuaagggaagauuagguguuaugcuaucaugcauugcuuuucgccuuugugcagcccugaaucuguggaggcuaguccagcaguuaaugagaagagcguguauuccacucauaauuaugggaccacucagaggcaugggugucgaggacugccuuaugcugugaguaugcauuuguuucucuccagaacagugaucuuccuggaguguaauccauucuuauacauugugacuuucuugaaauguuuauaugcagcaugacgaaguugccccuuuugcacuucccugacuccagcggacgucuagcccugcaucauuguucuuguuuuuaugucccaguugaccuuggcauuuuguuuuaucacuuuccugguugaagccaaaaaacaaaggguacuacuuucuucuuucuuuccauauguaccauacuuuaggggagagaggggccaguguuuggacacuguugauuuaaaaaaucuuauuuucaggaucauaauuacggagccccuccuccuccgacaccuccugcuucucccccuguccagacgaucaucccucguucugaccugaauggccugccgucgccuguagaggaacgcuguggagacagcccgaacucugaaggagaaacuguaccuaccugguguccuuguggucuuucucaggauggcuuccuucucaacugugacaagugcagguaagauccuguuccaucuaaauuuaagucuggguugcugggauuaggguuucuuacaaguagggaaaagcucaaaguauucuuucuuguguuuguuaauguagaugauuccuuagugcuccuuggcucgaauucucugcacuaggugagaauugcugacaacaaggaaugagagauugauguuaaagcuauugaauuugauaugaaauuuaauguccuggaaacauuugguaggugggagggaggggguagcauaugcagagacacuucgcccaugugugcuaugaugugaugcaugcuguuggaaggacuacuuuaaguuuauuuucccucuuuaggggaaugagcagggggaagguuauuagacuucaucggcggaagcaggacaacauaucaggugagcggaagauggguuagguccacaauuugacauaaaaauauucugugaucugaauguucauuuuaagaaccccucuuggccaggcgcaguggcuuacgccuguaaucucaccacuuagggaggccaaagcgggcggaucaccugaggucgggaguuugagaccagccugaccaacauggagaaaccccaucucuacugaaaauccaaaauagccaggugugguggcgcaugccuguaaucccagcuacuugggaggcugaggcaggagaaucgcuugaacccgggaggcggaaguugccaugagcugagauugcgccagugcacuccagccugggcaacaagagcaaaacucccucucaaaaaaaaaaaaaaaaaaaaaagaaccccucuuacaaguucccauggucccccagccagcucuuuucacagaaagagauagaaguccucucaagaccacuguauaguucucucauuguaaacgaaauguguugagaacaguuuaguccuguagcaaaguauuccuugugaacacaaaaaauauggauuccuguuuuaaaaauuagccagucucaaauuguuauagauugagucagcgaagcuuagggacugaauacaaggggagaaauaaauaccaugaggaacaggguuuauaugcuuaaugccaaugacauagaaucuuguuuucuuaaggaagaugaguauuuaacguugcuuuacagaugauaagaguuaauaguggaaguaauggcuuacugcauguggggcacaccuaaaagaauaagcuacuuuuaauguacuuuugaggcuauuaguaccugaacuaugaaaucaucauuuuucagguggggauagcagugcaacagaaagcugggaugaggagcuuucuccuuccacuguguuguauacagcaacacagcacacaccuacaagcaucaccuuaacuguuagaagaaccaaacccaagaagcggaaaaagaguccagaaaagggucgugcagcaccaaagacgaagaaaaucaagguaugcaggguaaaaauaucuuaaauagaaauugucugaaauagcuuaaauuuuggagcaagaaugcaccaaaauucuuuuaagaaguuugauccagguguuugaagggccacuuuuguucuacuugcaaaaaucagcuaaucuguguuauguacauguagaccaaccucucuucugccacaccauaucaucaccacuggcucaaaguuucuucuacuccaguccccaucccagguaugaaauuccagcccuaccuggcacaaucccguauguguugcagccucaagucuaggcuuccacuauccuuacaguaucuccccaccucucaaccccaaaguacagucugaaauucuuguccugguuacaugccucaugucuuuggguugauuguuuuuccuuguuucaaaaaaaauaaaaaucaggaaacaucucuuguauggucuagguuuccucagugucauggucacuuuccuguauucucagcuaaaaugucuacgggagaaacuucuucugguuuguguucuuucuuccccaucacagcaacuuuguugcuucuaggugacuuguucaucccuuguuaaggggauuggucuuuguuuccuucuuaguuucaaaacugguaaaucugcaacuuuaaaguuuuuuuuuauuuacuuuuucucuuaguaucagaggugcauauaggauuuaagagaugcaugcucuucccuguuaauuaccuagcuucacaguagaaaguauuaaaauuagucucagaguucauuggccuugagcuaccccuauucuugguaauaguuuggggaauuccauuguauuuuuuaccuagagaaagggggacagaauagaacacuaguuugugccuuaguuuuagucucagauagguauaacugucauucuugguaccaaguuuuguuuguucuacuuguuuuccuccuugggauaggcauuucgagagggaucccggaaguccuugcggaugaagguaagggguaaucuucgcugaugcuguguuuuacuucacugugaucuugcauuuuggucagcuucuuuccugacauugauggucugggaaucuuggacucugcuuuucauuaguuuguaguuguugccauucaguuuucauagagcuuuucuccaaaguagauuuucuuggccauuuucugaaauauuuucccuuucuguaaucagccuucauugauugguuuuucauucauugcuuuccuaggggguaagugacauuuuuccaaacaaaaugaggcuaguguguucugucacugugauugaacucaaccuuaggaguggaguuuuucugguaaugauacaggaucucuugugcaucuacccuagcacugugugggcuuuaauugcaggacgcuuguauuauugauaagaauuacuguuuucucuuagcauaucuguuugguggaaaaaacuuagguaaugcuagcauguuucuuaagauaucaaauaaaagaguuuaugaaguaugauuuuguaaagaacuuggagaauagagcaaguauguggaaugguuuaaaagaaguguaaggugcugguugauuaaaaauagcuugccaaaaggagauuugauuaugcugucugguauccuccuuuacguguguguguguguguguguguguguguauaaauauauauauaugaggaaaacaugccucucaaauuauuacugggggcuucaaagcauuuaaauagaauuaaauucaaguuuaugaguauucauauuccuaaaugauacaaaagcaggaucuuuccuauugagaguuauagggcauaaauauuaaaaucuuuaguaaggccaggcgcaguagcucacgccuguaauccuagcacuuuggaagaccaaggcaaguggaucaccugaggucaggaauucaagaccagccuggccaacauggugaaaccccaucucuacuaaaaauaccaaaauuagccaggcgugguggcaggcaccuguagucccagcugcuugggaggcugaggcaggagaaucgcuugaacccaggaggcagugguuguagugagccgagaucacgccacugcacuccagccugggcaacagagcaagacuccaucucaaaaaaaaaaaaaaauucaguaaggauaagcuuuuuaggauugcuuuaugugcagcaccagugugacugguguuagcaaagauuacagguagcacuuuaccuaaaguuugaaggccccacuuaguaucuaucuuuaaacagacuugcacauaccugugaaagaguugggagaggacucagagcuacagagcaucagaggccugggaugugucuuggaagacaaaucaaucaugccuuugcuggauccgucucuugcaaguggccaaguuugcuuuagcuuccccuuuauuuuugucucauuugcuuagagaggggccuuuuaaauagacuuuggaggcagauaauagcccuaauccuggcuacuaaaugcuuuucucuuaucaagcaacuaucauaacuuaucuccagaagcucgaaaccuuucaaaagcuauaaacuggcucuaccagaaaacugcacauaaaccccauauuuugcuuacaguuuugggagguugacagccucacagguguguuaaaauuuagaaaaaaaaauuacuagucauuuugauucuuuuaauucuaaauugaguuauaaauuuuaugcucagaauuacuaguuuaaaacuccuccagugauccaggugggagccauaagaauuagaaaaaauuaucauuuggauuuuuaaucccagugucaagagcagcuucccuacugaagacuuaauuguaaaucaggguuucucagucuugacacuguugacaguuuggaccagauaauucuuuguuguggaagggacuguucugugcuuucaagaugugaacaggaucccuggugucuacccacuagaugccgguaacacucauacacucaguugagauuaucaaaaaugucuucagauauuaccaaaugucaccugggugcaaaauuucccucaauugagaaccacuacucuaaacccaacugagguagagucucuaaugccuugaaggaugggacagcagaguaaacacacagugagauuagcgaacaauggcuaauacugugacagaggcuuccagaauacaguacacuuaucaaguguaaguuuaacaauugccacuuaaagcugggaauauuguuuggacacugccagucccccuagucuguaagcuccauuaagccuaagguuuugcacuauucuuuugcgcaacugcuacugaugucaagcaggcgauacucugauugucaguauguuggcuuuagguguuucuuuagaucccuuuguuuauuguucagucuuuuggacucuaguaagaaauguggagacaauaguguugauuuuuuuucuucuauacuccuguuccuugcagaaaggauaguagacaauaaucagucagcaacagugaugcaaaagugguaaaagaaaguguuaugauaagcaucaguguuuucugugccauucauagaaaguauauuuaauuuuauuguaccuguuugcaaguuuaauguggacauggauuuucaaguagcuuugguacuacagugucuuuuccuucuaaucaucacuagcaugacaucaucacugucaguguuuguuuuguuuucugauggcacuuaagucuugaacaccguggaggagaacauguauugggcuuaugcuuugucucuguagcucaggcacugucugccuaggaagcuguuccugaguuguaguaaucuuuucucaauacugucaccauagagggcaaugguuuuccuagaggaguauagcaaaguaccuccuagacauuuucuauauucucccuaccuacuccucuccccucacuucaccucuucagauuauuuagaaugugguaauuuaaauuguugaaaauagaguguuagaaagauauacucaaauaauaacuuuuuauauggguaguaagauugggauuggauuaaugagauugauugauuaagaucacaucuagguuuagaaugaacauguauuaugaaaauaauaagugauacaaaaacaugcauucuccuggagaauagucaaaaaaccaguuugggcuaacacuuaacacagauauucagugaguaugaaaaauuuaagcagugauaaauuugaggucucuacuguucauuuguaugaagauuuucuuaugaacuugaugucaguccuuugauuagaaaauugauuuuuaugacuuuaaaauggucauaaaaucacagugaugggaugaaacuaugauccagauuaauuucuuacuuuauaaauggagaaacugagcuuccccauuuaaagaaguuauucaaggucucaccucucauugguaacaaaagcaugauagaaaccagauccucugacucccaguccauuacucuuuuaugccacaucaauugccaagugauaaauuuucucuggaaccccagcuugucccacccccauucccaacccucuauuuaugcauggacuuuacuaaccucccugaauuuguuuucuacagaauucucccucugaagcacagaauuuagaugagaauacaacugagggcugggaaaaucggauaagacuauggacugaccaguaugaagaagcuuucacuaaucaguacagugcagauguacagaacgcgcuugaacaacaccuacauucuagcaaggaauuugugggcaaaccuacuauuuuagacacuauuaauaagacugaauuggccuguaauaacacaguuauugguucccaaaugcagguaagcaccaaaggguugaggacucucuaaguagcugaaauuuuaagaacccaggaagaggguaauggauuggaauuacuguuccuuccaaauguacaaggccauggaauaacagauuagccagguguugaucauauguaaccaaaaguagguuauauuaacuggaaacuaccuggauacauauuuuuaaacuaccuuuauuaauaaaaaaauagaugaauugaggcugugugcagugcaguggcucacuccuauaauacaacacuuuggcaagaagccaagguggaaggauugcuugaggccagcaguucaagaccagccuguacaacauagugagacccucucuuuacaaaaaaaaaaaauuaaaagccguugugaugauacacaccuguaagucccagcuacuggggaggcugagguggaaggaucacuugaaugaauuugagguuauaguaagcuaugauugcaccacugcacuccagccugaaugaaagagugagacccuggcucuauuuaaaaaacagagagagagaugacuuaguaugggaaauucuauauacccuagguaggaauuauguaauauuuauagaaaguuaagcauguucuuucucaucuuuauuuuagagauagagucacugaagucuuaaucauguauuuuuuuuuuuuuuuuaauauuuucuugccguuucuggggaggcaauuucacuagauguagcaugucucuuagaaaaauugagcuuucaucacauuuuaaaauuucucaucauugaucuaaauaacauguacagauaaaaccugaaaauauuagcauguuuuccuuaauuaugaaguaauuugagugucuacuaagguguucuugcuguuguuuaauguuauugcucugguuuuauucaguuacagcugggaagagucacucguguucaaaagcaccggaagauccugagggcugcaagagauuuggcuuuggacacucuuauaauagaguaucgugggaaagucauguuacgacagcaauuugaggucaaugggcauuucuucaaaaaguaagaacgucauucauugagcagugagggcuaagguggaccugguugaccaguguuguuguaaaaaucauucuguuugauaagacgcucuugggagaaaaaaaucacaacucagauaagcucacaccugucugcuauuuguagagaagugcaaguaaaucuucaaauuguucaauguauaaaauggugacaccuccuuuccaagccaagcauuccuugcuuugugcuuguucuuuaaucaaaagcagacaaacgugaugcuuucccaaguuuaggcguugcaaaagacugcugcugcuucucucagcauaugcuucauauuuggagucaugggguggccuucuuauuuguguugagaauuacaggaauuuuaauuguaucccuagaccauaccccuuugugcucuucuacucaaaauucaaugguguagagauguguguggaugcccguacuuucgguaaugaugcucgguucaucagaagaucauguacaccaaaugcagagguaagauaucuguagcaacuucccuuugacuggaaccaucaaaugacaagcuuacugaagaagcagugugaaaacuucacucagauaaaggucuguagauaauagucgugauauuucaucgugggaggugaaaaacaaaaguaauggugcuuuuauacgacaaaaugggcgcaaggaaagaguuuucuuuagagaaggcagaaauagaaaagagcaaguuagcauuugcuaaggagaaaaagcuagacuggauaagaaaaucaaguguaguuauauuaaagagauugccauacgguggaaguagauguuguuaggccuaacuaagcuauuugguugcaguuuuuuuagauuuuagugaguaauguuuuaugagaggaucuagacauuucuagaauucauuacucagagcaaccacaucaaauaaagcaagaaaauccacagagcuuuacuuacuggcuaaggaauuuuaauucucugguggagcuggaaacagcuauaagaugugaaagcggcugggcgcaguggcucaugccuguaaucccagcacuucggaaggcugaggugggcagauaacaaggucaggaguucgagaccagccuggccaacauggugaaaccccgucucuacuaaaaaaaaauagaaaacuuagccaggcauuguggcgugugccuguauucccagguacucaggaggcugagacaggagaauugcuugaacccgggaggcagagguugccgugagccgagaucacgccacuccacuccagccugagcgacagagcaagacuguaucucaaaaaaaagaugugaaaguagagauuuuacccugauuucuaacaucucaagguuucuccacauauuuaagaaaguauuauaaauuuucaagccagugcaguauaauaguuucagaugaaaugaagggguuaaauaacagauuaccauaacuccuuaaauaaauaauagauuaccauaacuccaaauggagagaaaguaugguuuuuuucucucuuacggaaaguucauggucuuuaugaaaaauccaaccagaagccuuuucacacaggugcgacacaugauugcagaugggaugauucaccugugcaucuaugcugugucugccaucaccaaggaugcugaggucaccauagcauuugauuaugaguauaguaacugguaagaccucagaaaccuuuccuaacaggaauauccaugucuuacauauuaagcuauucacucuauuuaaagucugcucuuguuucuugccuuuuccuuuguuuacuuaaucuuuucaugacuaaugaauuuucugccuagaaauuguaaaggaaaagacaggcaagauuuuuuuuagagauacggauaccuuguaugauacugcucacaaauuuccugacagaaguguuuucgcuuaugccuuuuuagcaagaauagcaaaauggauauauauguauguaugagacacuccuggaaauuacaauagcauccuguuguuaugcacagaguacuuaugucagggaccauauagaaugagaauuuaggccaggcgcaguggcucacaggccuguaaucucaacacuuuggaaggcugaggcgggcggaucacgaggucaggagaucgagaccauccuggccaaugaugaaacccugucucuacuaaaaacacaaaaauuagcugggcguggcggcacacgccuguagucccagccacuugagaggcugaggcaggagaaucacucgaaccugagaggcugaggcugcaguaagccaagaucacgccacugcacuccagccuggcaacagagggagacucugucuuaaaaaaaaagagagagaauuuaauauguuaccucuacuuuuaauuugucaauuauacccuuauaaagcuaggggugagauuuaaagauccacccuguccacagaaaccauguuaucuagcuguauaugacagugcagaaaaccauaaagggcaauucauagaugaauaugugggauuuuuuaaaguauaugcuuuuuguucuuuggucauuuggggcaaaauagagguuaugugguaaagugauguuuggcccagguauaaggaaaaaagauguucugcuuaauucaucaaggaaaauaaaaaagguuuuaagaagguuauaaaagguuuuaagaaguagggaauuaguagguaaaagugaggacaugguaaucgugggcacaagaugaguauggccacaucagacuuuaucauugauaaacugccugcuaaauagccaauaaaccacuggggggauugaauuuagggagggcuuucuuuuuuuuuucccacugaccauggaguagaauugggguuacacaaagaaagacagaauauugaaaguguuacgucaggcgcggugacugacgccuguaaucccagcacuuugggaggcuaaggcuggaggaucacuugagcccaggaguucaagaccagccuagacaacauggcaaaaccccgucucugccgaaaauaaaaaaauuagcugggcguguagucccagcuacucaggaggcugagguaggaggaucacuugagcccaggaaacagagauuaccgagagcugugaugcaccacugcacuccagccuagaugacagagcgagauuccgucuccaauaaaaagaaaaacaaaaguauuuauaggacucucuaaugucucuguuuaacuuauucagagacaauaucagaggaaguuacuguacugauauuuuaagagggugaauggauaauguaacugaauuucaaggguacugagacaggcauuuugguuguuucuuuggagcaguaauuauaaaguggacugugccugucacaagggaaaccggaauuguccuauacaaaaaaggaauccuaaugcuacagaacugccacuccuaccaccuccuccaagccuacccaccauuggagcagagacuagacguagaaaagcacgacggaaagagcuagagauggagcagcagaaugaggcuucagaggagaauaaugaccagcaaucacaagaaguuccagaaaaaguaacuguauccagugaucaugagguaaucgccccuggucaaaugaugaugcuauggcaucaauccuccaaaggaagaggaacccggguugccgcaugguuuaaguaggggagcuauaguaacacuuagugcccuuuauaucaauguggguuuauuguguucauacauuucuuucuguuuuacaaagucaaaaacauccuuugcugguuuugcaccagagaauagggguuaguuaucaucuguguuuaccauguggccucacaugaguuaacaguuuaaagcacuagagauuguuauagagaguuuuaagcuaccagaauaaaacagauugauuuuuucucagagcuugaguacagcugaauauugccucuaucuuaaaggaaguagacaauccagaagaaaaaccagaagaagagaaagaagagguuauagaugaccaggagaaccuagcucauagcaggagggugaguacugucugacauuacuuugcuccuucucauuccugcuaccuccaucaugugaaccucuucuguucucuugacuuuguaucaucucauugauuugaccugaagguuauaauuugggcuuuuuccguaauaaagauuuuauuauaauuuuuuuauuuauuuuucucuauacacacaguaguuuuguagugauuauuaucuagugaugguuugaagagguuguuuuuuuuuuuuuuuuuuuuuuuacuaacaaucugguuuccgcugggcgcgguggcucacgccuguaaucccagcacuuugggagggcgaggugggcggaucacgaggucaggagaucgagaccauccucgcuaacacggugaaaccuugucucuacuaaaaauacaaaaaauuagccgggcgcgguggcgggugccuguagucccagcuacucgggaggcuaaggcaggagaauggcaugaaccugggaggcagagcuugcagugaguggagauagcgccacugcacuccggccugggcaaaagagcgagacuccaucucaaaaaaaaaaaaaaaaaaaaaaucugguuuccgaaaaacuggcuggucagaaucaaaauguauuauaguugguuugcucugaauuaggaauuuucuagguuuuugugaguucugaaguuuuuuuaaacccuuuuagucauaugaacuaaaauuuucuacuuuuaugcugaaaccaauccuguguguuuaugacccugauuugaugacuuuuuuuuuuuucuuuuugagaccgacucuugcucugucaccaggcuggagugcaguggcgcaaucucaacucaccacaaucucugccucccggguucaagcaauuccccuuccuuagccucccaaguagcuggcauuacaagcaugcgccaccaugccuggguaauuuuuuguauuuuaguagagacggaguuucaccauguuggccacgacggucucaaucucccgaccucaugaucuucccaccucagccucccaaaguacugggauuacaggcgugagccacugcacccauccuguuuuucuuucauauuaaaguuucaaaauaacugacccuuuuugaaaaguuuauguuugaccuugccuuuauuuacaacuauuccccacauuuaaaaugaaauauuuuauuuuuaaucuucuguuuuccaaguuauaugugucaucuuacugguaguuaaaugaauuucuguaaauuuccauuaaaaauacuuuuauaaaagcuauccacucguccucauuugaagcuuccuucuacaccaguacuaucucuuucuagaccagggaagauagaaagguagaagccaucaugcaugcuuuugaaaacuuagagaaaagaaagaagcggcgggaucagcccuuggaacagagcaacucugauguagagauuacuacaaccaccucagagacuccuguuggugaagagacaaaaacugaagccccugaaucugaaguuagcaacucuguuucaaauguuaccaucccaagcaccccacagaguguuggugugaauacccggaggucuucccaagcagggguaagaguugaaaagacuucagcacuuagacauccucaccuuugcuaaugucaauaccuaacuuuuggaauuuuuaaaaucaguguuuucagcuuugcuccauaucacaauaaauaaggccauuaacuguuuaacuggaaccauuucauuggccuauuuuauaaaugcuuauuagaaauaacgcaaacauuugucgcuagccucuuuagcucauuuaaguguauacauuuuuguauuuaaaaauuagauuuuaaauuaguguuucuaauccuuauauuuuucaucaguagacauucugaaugcuuaaagugaauaggaaauuagacuguuugcugauaaaacauuucugguaagcaucugacccuacuauugcuacaggauauugcugcagaaaaacuaguccccaagccaccuccagcaaagccuucuaggccccggccgaagagucgaauuucucgguacaggaccaguucagcccaaagacuaaagcgucagaagcaggccaaugcacagcaggcagaauugucacaagcugccuuggaagagggaggaaguaacaguuuaguaacuccuacugaagcuggaagucuagacaguucaggagaaaacaggccauuaacagggucugacccaacuguggugucaauuacuggaucccaugucaaccgugcugcaucuaaauaccccaaaaccaaaaagguaagucacaaaugcauccuuuauaaguccagucuggcaagggcugucuuagugaaaugagaggaccuauaaucccuagaagaaacuaaucucaauauuacuagauugaaaguucuaaaaugcuuugacacaaaaggcuggagucauccugcuaccuguuuccuuauuuuuagucagcuuaaaucacugauagcugaaauuauuccucucuuagugggcguggagagggugaaggaagauauccuuguguucuaguugcucaauucauucuuacugcagcugcugcaucuccuccuguccuaguuucuagaugacguuugucuuuaugaacuacacugcuaccucuugauuuauaaacuaaugaucucuuuuuuaccuuaguaucuaguuacagaaugguugaaugacaaagcagagaagcaagagugcccuguugagugcccuuuacguaucacaacggauccaacuguacuggcaacgacccuaaacauguuaccaggucuuauccauuccccguuaauuugcaccacccccaaacacuacauucgcuuuggcucacccuuuaucccugagagacgucgaaggccccuucugccugauggcacauucagcuccuguaagaagguaugucuguguuuuuguguguguguuguguuuaugugugugugcuuuauuuuuuuaagccuaagauuccuaucaucaugacauaaauaaaauguucucuagauagccacucugcccaugugaguuuauaaugaguuaguuguucagccauaaauacugauucaucaagagucugugagacugugguggaaugaauguacugcauuuuuagugcucagauuugugacuggucacugaugucucuucugagaacccuugagguuccugagugagagcacacagcaguggaugacuggguagagacggauauguuuugugugugcucuugugauauggguuaacauguccauuuaugauuauugugugagauuaggcccuggguccucuagaacacuguugcauaaaugaaaaaaauuaaauuguuuugaaucaauucaaccguuauuauccacuaucaucacuugaaggaaauuagaggaaaaauccuauuguaauuggcauaauuccuguuccuugaucaaaugacaagucggacuguuuauuccaagagaauacagaaucuacccuaaaagacucucuuucccucucuguuucugccucuuucuccucuuuccaguuacuuacuguuuuuggaucuaguggcaguagcguuuggugguguuuuuggaaugcucuuucuuaauucccagaagcccugcauauuuuccaaaggugucucuuaggaauagaucacucccucagaucuaugaugucguuuuccauguuucuagaaguauaggacacccuuucauuuggucuuccuuugagguagagucuguucccuggaacacccuuuucucuuauccucagaucuggauucaggcugccuuccucagugucugccauugcccuccuccacuggcaucacguacaugaggaugcugcauguagauuauuugaugugaugaagucuccaacuccaggcaggucuucccugacuccuccaaacuuaaaagcuuuucucuuuccccaaagaacagaaguuauuucuccgggggaggggggcaugaaagaugagccaaaguggugugggauauggaggggaggagggcaauaggaaucugcaaaaaggaaggacacuacugcugaaugagcagcacauugcagaaagucuuuuccuaauugcacaucuuaccuaaacauuggaaucacucauugguuuguucggggaaacgcucguagaauuccuaaagagaaauuugaccauuucuaaggauguuaacuguugaagcaucuuaucaagccaggucguacaaucuccuauuuugguccuuuaaggaguguaggcaauuauuuauuacagauaaguaaugaagucugagcugcaaauaauaugaacuaggcucuugaauugaaauuccuucuugauaauucuaaugcuggguugcagucuuucuguuuccaucuuuuccaacuagcagagacuuaacgaaaaccaaaaacgugucuaggacuguaacuucagaucugguagaaaaugcauuucuuuaagcuuuuuuaacuugguucugcuuuuauacuuguaucuauagcacauccuuaaauuucuacgggcaacagauagaaauuccauuuaacacaagucccuguuauauucuccaaguguaucugacuauccuuaaucucauuuauacaggcucuacucaagcacuuuuaucuaugugucaugguuagucuuuaggaagaguuuaggcugcauacacaggauuaucauaacaagacuauuuaaauaggaucuuuaaaaacuguuuaagucauugcuuuauugugugcuguucacauaucaagauucuauuuuuuaaaauacagcuuuuuaugaggcaaaauaaaaugaaauggaauguuuuagcuagaauagaauuuggcuuuauagcagugaagaagaguucuucuucuaauauuggucuucuucuaauaucuccuaauauugguuagaaaggacuuaccuaaugcagaaccuaagaacauuuucauuauucaacaaaauuguaauaaaauucugaaaaucccucagaguauaaguuaaucagauagauaagaaaacccuccaugggauuauuuagaacaauguauauuucuaauaggcucacuguuucauaucucacuaaagagguaagggccuggccuuguaaguuaaaaacuuaccaguauaggacaaauuaaaguuguaucuguauaguuguacucagauucuuaugcuauuuauuuuuauuuuuaucauuauuauucugcaacuucugaaaagaagaggaguucagguauuugacagaacauuuuaugauaucccuagaguuucuaaauugaaucauaguuuuuaagaagcauuuugcauuuuuuaguuccucaguugguauuuuaaaaacauuuauaaguggccaacaaggcucucaguaguguuucaccuuguucucucuaaacuccucuucuaaacacaauguguauagggcauuuggucuccagacuucuuagaaaaaccagucugacugauaaugaaacagugugcuuugcauugauaauuaauauuucauuuuauacacuggagcauuaucuguaaaucuccaaacauagcauugaaauuuaguugaaccgggacucggugaaaaucugcucaguguucaguacuguacuauaagcuuucuucacauacauuaucucacuuaccaugcaugaaauugggaucauuguccuaaauuuauauauccagaagcuuugucucagaaauguuugguaacuuguccaaagugaagcagcuaauaagugacacagccagauuucuucuggugggggauaguagggguucacagggucucacuguuguccaggcuggagugcaguggcaucaucacaggcucacugcagccuugaccuccugggcucaaaugguccuccuaccucaaccucucguguagcugggaccacaggcacaccaccacgccuggcuaauauucauauuuuuuguagcgacaggguuuugcuguguuuccuaggcugaucucaaacuccugagugcaaggagucugcccaccuuggccucacauucugcugggauuacagauacgagcuacugagcccagccucacagccaagugucaagccagggcuucuggacuccaaaaccuguauugcuuccuugcucuuucgccauaauagcgagaccuuuaaaauauuuauccaucuuugagccucccagaaaacuccuuugcaauauauuuuaauagagguucagagaagggagaaauguucuuuugauuuuaacaacuugcugaguaggugcaucuaaaauuaacuuauuauccaugagguuaauuguaucuuguuagauacaaacaaauguccauguuccuuuuuuauaugaguccugaaauauuguaaaauuauacaacagaaccuggaggaguagguuugauuguauuugcuguguuucaccucauagcuaaccaugguagcaucuuucuucuagaauacuccuguucugauuuuauguucccuuuuuguagucaucagauccagaauguaaauuauuuuacaaguacaucuacuagacccuggaaauauuaaaaaauuacucagauaggaaagcuuagugaccccaaaugaguguuuucugcuuugaaaagaaaaacuuaaagguggccauaacaaaagauuuuucacuccugagccuaauuuuuccauuuauaaaaugagugcuuuggacaagaugacuucuaaguucucuucuaagcuuuaaggcuauauguaugguucugacaauucaucuuuacaucauuauucuguaucuaagauaguucauucuucggauuuuuuauuuuguuuuuguguuugcuuuucagagaccugguuguauccuaaaauguuuacgugauucaaauuaccauugagagcucuuuuuuauauccuuguucacucuuccuuccaaguguuuacagguuuacaguuucaguuuugcuuucauuuggccagccacaaugacauuuguaugauguaagauuuuuuuuuuuuuuuuuuuuuuuuugguaaaauuuuuguggauuguuuccuagguuucuaagagggaaaaucuaugagaauugcucucuggugaagagaguauuuacuuaccuguaauacauguucucuaaagguauaaauuauaauaauucaccuuugcucuuccuauugggggagggucuuacucagaaauugauguuuaucaaaauucgaucugucuuaugucagggcaggagagccacagaguggugagcaaccuacaacuguauaucuuaagagaacacaauuacagguaagaaauuuucugucuuccacaggauacauaaucuuauuauccuaaucuuugcagguuuacuaucuggccuaaauuuauuucuugucaguuuauuauucuaaucuuuacuaccaaaaacuugugacugauaggucuucuuuuugacuuuuucccuuuuuuuugauuucuacugaagcucauuucgugauuugcauuacucaugcauaauuuaaccaaacuacuuguuggaggggggagucccauagguuauuucauuugaaauaaaccuuuuggaaacgcuuuugguaccuguagugaagagcuauuaauccucauccaaaaucuuccaaugaaucuuuuuuauuaccucuucacacgucucuagcacggggcagacaacuuuuaagagaucuuuaucuuccuucuaggcgcuuauuuuauauauuaguuuuauucuauacgaucacagucucuccuaaauaaauguuaagauuucuuccucagucuugccauuuuacaccaucccaaaugguaugaaaaguugaauagcagucauuuuuuauugguuuuugucuuuugaugggaucucauuauauguaauccagauuuccucaaguuuuucaguuaaaaggaauugauaggacaauguuccaauaugcugagacacaagacaauaaaaugcuugacuguguaacugaauuaguguguugaauuguaucacucaccaguugauguacauuuaaaacaggugcacuaaauaguuuuagauaauuauugauaauucucugguucuuuucaauuauagcgcuggauaaaacaagccuuagaagaagggaugacucaaacaucaucuguaccccaagagacuagaacucagcaccuauaccaaagcaaugagaauaguagcucuucuaguaucugcaaagacaaugcagguacguaucuaaaaccuuucugauuauaugaccaaugauuguuucaggucugcauaaaaaauuuaaguaugaguauuucugauacaaaaagaaauggcguguuuucuaaauaguuacuuuacaucugucuuuacagaggaagagagagaucucaagucagggaucaguuuucccaggacgacaaagaaggacuagacaguguacagauaacagcagaaaugguuauaaaaaagguuagauacauuuaaaguaguaaguuuaggaaauuuauauucauauuuauaagauggggcaagggcaagaaagugguggaacacuaauauucaggaaagaauuaaaauucugagugauuaaguugggugggacaugguugagggagcaggggaugaaugaaauaagugaaaaauuauuaucaauugauuguuuucaaaggggcuuguauaauuagcauacaauuuuuaaaagaacagccgggcgcuguggcucgcaccuguaaucccagcacuuugggaagccaagguggguggaucaccugaggucaggaguucgagaccaacguggccaacauggugaaacccugucucuaccaaaaaugcaaaaauuagcugggugugguggcaggugccuguaaucccucccuaaacaggaggcugaggcaguggagaaucacuugaacccgggagguggagguuacagugagccaagaucacgccacugcacuccagccugggcgacaagaaugaaacuccgucucaaaaaaaaaaaaaaaaaaaaaaaaaaaacaaauuuuuuaagacagcuuuaaaucuaaagucuuugugcauuuuuaaacuagaugucaaugaaaaaucaucuguuccauugguuuugacagugacuugcaaaggauguaauugaaagcacuugugauaucuuaauguauuuugugacaaucuuuuuaccaguuucuccugcaaauaucagcuuaauugaaaaguucuuugugauuuucauaacuuuucucuaaaucaguuuuuuaaauauuagacaaucaaaauaccaaaguaaauuagaugcuaaagcaaccuuucagguugcaacaaacagaauauuucacauuuucauaaaaaacccacuucauuguuccuguuuaccaacuugcugaauaaauguaaugaacuugaauuuaauuagauaaauuuuuaguagcagauauugcaacuaaaaucagaacuuuucuuaaaguucuuacuucauuuggauuuuacuucuuuuuagauuuuauuucagaaaacgugaauugccuuuuuuucuuuuuuucuuuuuuuuuuuuuuuuuuuuuugaaauggagaaucaagcgauucucccugccucagccucccgaguaacugggauuacaggcgcccgccaccucacccggcaaauuuuuauauuuugaguagagacgggguuucaccauguuggccaggcuagucucgaacuccugaccucaggagauccgcccaccucggcuucccaaagugcugggauuacaggcaugagccaccaugccuggcugugaauugccauuuuuuaaauuauggauuuaguuuauucuuuugucucuagauuagauuauaccucauaaguuaccaccuauauaccucaggauaauaaaauuccaguuaucugaaagauaaauuauacuguuuauuuaaaauauuuucuucuaguauucaccaaaaauuagggauauuuagucaaauaugaauaguauaaagaaaucuugguaccagauuuccauuuguauuauuucuuuuuuaacagcuuuuaagguguuaguaagaauauaacuuagcugaaauagacuaucauguuuguguaucuaucugguguguguguuaaugcauguguauaguuaagguugggaacaggagauugcauagcaguucacauccugacuagcaaaggauuauaggaaaagugucuuuguuaucacaugcccugguuggaaggaaauuaggauuccuagucaccagccuuuuuuguuauuguugagcuucugcccuagucuaacagugagaaacacucacaggacacaccuugcccuuaaaaagcaauguaggaaaauauuugauuuuaaaaaucaagcagcagucaaaugcgcaaguuauauugcuacaaaauuagcauaaauucugaggaauuacuuuuauuuguuggcucucuuuuguuuuuuucaagaauaccaaagagacauuaagaaaggggaaaggauuucuauaauagaaaaaaucaaacagaccuuuacuugaaaaccagcuguccccuuuacuaacuauaugauguuacuagaagucucugaggcuaggcguugguggcucacaccuguaaucccagcacuuugggaggccaaggugggcggaucaucugaggucaggaguucaagaccagccuggccaacauggugaaacccugucucuacuaaaaauacaaaaauuagcugggccuggucacguaccuguaaucccagcuauuugggaggcugaggcaggagaauugcuugaaccuggagguggagguugcagugagacgagauugcgccacuccacuccagccugggugacggagggagauucugucuuuaaaacuuaaaaaaaaaaaaaaaaacaagucucugagccucauuuguaaaaugggaauagcaauaccugcuuuauagagcuaacauuagaaugaauaauguauauaaaguucucaauauaguaucaggcccauaagaguaauuauuauacggucauuauucuacacagaauacucuuucuuguagaguauuuguggauuaauaaauacauuaaagauucuggcugggugugauggcucacgccuguaaucccagcacuuugggaggcugaggcgggcagaucacgaggugaaaagauugagaccauccuggccaacauggugaaaucccaucucuacuaaaaauacaaaaaaaauuagcugggcaugguggcaugcaccuguagucccagcuacucaggaggcugaggcaggaggauugcuugaaccugggaggcagaaguugcagugagccaaggucacgccacugcacuccagccuggcaauagagugagacuccgucucaaaaagaaagaaagaaagaaagagagggagggaagaaagaaaagagaaaagaaaagaagaaagaaauacacuaaauauuuuaaguuccuaaaagcugaaacuuuauagaaauaaaaguuauuaucaaaguagggcaggggcaugauguucauuauuuguaaaugaugugggucuauucuuagaagagccuaaguaaucagcugaaaaacuuagaauuaauaauaagaguuuaggccaggcgugguggcucacgccuguaaucccagcacuuugggaggccgagauggguggaucacaaggucaggagaucgagaccauccuugcuaacacagugaaaccccaucucuacuaaaaauacaaaaaauuagcugugcgugguggugggcacuuguagucccgcuacucggggggcugaggcaggaaaauagcaugaacccaggaggcggagguugcagugagcugagaucgcgccacugcacuccugccugggcaauagagugagacucugucucaaaaaauauauauauauacuaauaauaauaauaagaguuuauuaauaucacuggauagaaggauaaauauauaaaaaguguaaauauauuuuaaaaaaucauuuauauaccaagaaaguaaaugaauaccaauuuuuuuuguucccaaacuuaacaaaacuaagaaacugccuaggaauaaccuuaguuggguauauggaguaaacuguuacugagaaauauuuuuaaagucugaggaaauggaaauuucuuuuucuuuuuuuuuuuuucaugaaucauacgugagccuuugauaaauuucauguucauuauggaaagaauauauauauguguauauauauauuucuuucucuuucucucugucuuuauauaguucccaugaaacugccuuguuuuuggaauuugauuaaaugauucugaagucuaccuuuaaaaaaauaagaaaaaaauugaaaaaauaauaaugaaguacuuucucuugagguguaagacgagcuucuaguaugaagcuaauaguuaaauuuaguauaauauugaugcaagaauggauguauauauggaacaaaauagucagaauaggccuaaauauaaauguaaaaguugguaaauugucauggaauuuuuaguuaggagauugaaaaagaauuagaaucuagcuggacacgguggcacgugccuguaacucucaacuacuugggaggcugagguaggaggaucacucaagcccaggagucaaguucaaccugcgcaacacagcaagaccuugucuucaaaagaacuacuagguccuuugccaaagaaaauucuaggcacauucaaauauauauauuuuuuuaauucaaacuugggccuggcauggugacucucaccugcaauuuccagcucuuugggaugccaaggcagaaggaucacuugaggccaggaauuugagaccagccugggcagcagagagagacccacaucucuacaaaaaauaaaaauuagccaggcaugaugguggguugccuguagccuuaaggaggcugaaguaggaggaugacuugagcccaagaauuugaggcugcagugagcugugauaaugccacugcguuccagccugaaugacagcaagacaucugucucuaaaaauaauaaaauaaauaauucaaacuguauuaaccauguuuuugugucuauacugccucuguauuaauagaggauuaguacauuggggaaaggauuugcaguaaaacugccggggaguaauaucccugcuagcaaucugauaaaauuuaucaugugcauuaaaaauauucauaauccuuaaccuaguagucguucauuuguucugcuugguaucuuuccuacagaaauagacaaagaaaccaaaauuuauauauaagguuggugcaaaaguaauugcguuuuuggaccauuaauuuuaaaucacuguaacuagacucagacacaucuuuauuaaucaaaauaggaaccacugcaaucaacacauuuuugccacugagaaauaaguuuguuuauuccuguagccuaaaaaucuaugcuucaggauucgacaaacucuuggaaaauauuuucugcauccugcugguuguggaagcaccuucccuguaaaaaguugucagaugcuugaagugguaccugguuggcgagaggucaggugaacauggcgggugagacgaaacucuguagucaaauuuguucagcagcuucagaaguugaaugaauuguuuauuagaauaauuaauucuuaguuauuaacaauugcaaaaacuauagguuaaaaauaaucugaauuccaaccccaggaaugguagaauuuguaauuuuaucugcuugugcacauacuuguaauggaguaucauauacuauuuauugaaaaucuuauuuuugauucauuuuaucaaauuaacucccucuacccccaaaaacagcguaguaccacuuuugaauuagauuugugaucuuaccuagcaccuugaauuuguaagaauauuaaaagaauagccaggugugguggcucacgccuguaaucccagcacuuugggaggccgaggcaggcggaucacgaggucaggagauccagaccauccuggcuaacacggcgaaaccccgucucuacuaaaaauacaacaacaacaacaaaaaaaaaaaccgggcauaguggcaggcgccuguaaucccagcuacucgccacugcacuccagccugggcgacagcgagacuccaucaaaaaaaaaaaaaaaaaagaauauuaaaagaagaauauacgaugacuaagguuccuucuaggaauguaaggaugaguuaauauuugaaaauuuaauaaucgucauuuguuagcaggucaaaugggggaggagaagucauaacacagugacuuuuaucaauuuaaugauaaaauaacauacuaugaucuuuuaauaucuagcugaaaaauugccaguugucaugcaucaugaaaacuaguuaaacaucaaaauaggcuaucaaauuaucccacuauuaccauuauuauuuaauauagucuaaguaauuguuagccaaaguaauuacaccaacccccucccccccacaaaaaaaaucaacauaagagauauaaguacugguaaagaggguuaauguguuaucauguacaaauacuauuaucuaccuagagaguuaauugaaaaacugguagagauuaauaggguaacuggauaaaaaauaaguauguaaacuuuuuaaauguuaauaacauuuagauaacaaagggagagauacguuuuauucauaguaguaaaaaaaaaaaacuaaagaacucuggagaguaaacuuaauuagacaugugguauauauagaugaagagggacauaauaugugaauaacaaagauuaugccauguuccuggguaagaaugcuucucaaauuacuccugaauuucaucuaacaccaaucaaaauccuaacuuuuuuuuuuuuuuuuaauaguaugagcauggucauugaaugacuucuauaguucauugcuagaauagcuaaaauauuuuggagaacuagaacagaauaacuggaauuucccuaacaauuuuaauaaaaaguaugcugguguugauucaguauuggacaauaaguggaaagaauaacauucggaaauaaacauucagaagauaagcccaguauauguaagaaucuaauaagauaaauauauuucaaauuaauagggaaauuauaguuauucuacauuuacagaagauuuuggaagaaggugcuggcuauuuguuauggggaaaggauggauuaauugcuaccccauauuuaaguauguucuuuuuuccuuuuuuguaauggcaguuugucagugugaaauaaaauguucuuuuuuaauuaaaaucuaaauuaaaaauuaaacauggagacaaaaggaaaauaggcuggcauuuuuacagugucaggguggguuagcaaagacaugauaucagaagcagaaaauaaagugauccguuugacuaaauagaaacaaaacauauagcagagacuuguaaauaaaauugaaggcaaucaguaaacugggaaaauacauuuguaauuuuauugacaaggggucaacauucuuacuauuuaaagagcccuuacagaugaagaaaaagaccccaacaccucaguagaaugcaggcugaagaacaugagccagcaguucucacaggacuaaauauaaacuacacauauauagauauucuuuugauuuaauaauccuacauguagccauuuguucuaauagcaaaaaaugaaaaaaaaguugguuaaauuuugauaauacuaauguugugcagucauuaaaccugaacuguagauuucuauucauugucauaaaauguugaccauguauuucugagugaaaauaguuacugaguaguuuagguaaggcaagagucagugaagcaaugucucgauaaaaauuuaccaggauauuagcaugcguuuauuuguggauaugauuuucagguuguguaugugcuguauaaccuugguaauuuuuugaguaaaggugaaaaauaauaauaauaaaagauggauagauuugaccacauaaaauuuggaaacuauauaugcaggaaaaagagaaaaaguaggcaaaugacuuggcuuucuuuggccuguaaacuucuuaagggcagacaucaggucucuuguugaauacaguaucauaauaaguacucaguaaauauauguugaaugaaugccuuguacauugauuugcacguggcagauuucaccuguaucuuauaacuccuuucuacaacuaacuucaucacuuaacauaauugacuuugauaguuauaguguuggaccuagcaguacagagaucuguaagauuccauuguuuaagacccuugaaauauuaaauauauaaaaguuauuccgaauauaagccaugaauuacauguuuguuucuguuuuauaccuaggcacuuuuuaaaaggaggaaagaaaauuuaguaucuggaacaaaaggaagaugugaauauacuuccaaucuaggaauauuaaaaauccugagauaucagaaaggaaaaauaugcaucuucaauaauuuuuugcauuuauucuucccucuucaucuaaacaucuccuacccuaguuuagugccucauaauucuuugcuaacuacuguguuaacuccagaugguuucccaguuacuagucucauacugaccauugcuuccagauaaucuuccuggcccaaaaauuuuccuugaaggccuggaauaaaugucacuccuuccauccaccaagccuuggggauauacuuuaaccuauugauuaagaauauagauagauggagccaggcgcgguggcucacgccuguaaucccagcacuuugggaggccgaggcggguggaucacgaggucaagagaucaagaccauccuggccaacauggugaaaccccgucucuacuaaaaauacaaaaaauuagccgggugugguagcgagcaccuguagucccagcuacucgggaggcugaggcaggagaauggugugaaccugggaggcggaccuugcagugagccgagaucgugccgcugcacuccagccuaggugacagagcaagaguccgucucaaaaaaaaaaaaaaagaaaaaaagaauauagauagauggggccaggcgugguggcucauggcuguaaucccaacacuuugggaggcucagguggguggaucacuugaggucaggaauucaaggccaacauggugaaacccugucucuacuaaaaauacaaaaauuaagaauguagauauaugggagcaagaauaccuguuuugucucucuccacacaucaaguuucucaccuuuaauauggggaugauaauaauagugcuugauuuauagaguuguuaaaauuagauauuucacaauaaagcacauggcauagucugugguauauaaucaucauuuagaaaauacagcuuuuuuuuuuuuuuaacuaacacauagcaauaugaucaccuuucuugaucaugcuaauacuaauguguucacuuuuuuuguugugucguuuuguuuuguuuugagacagucuccucccucugucacccaggcuagaguacaguggugcagucucaacucgcugcaaccucugccuccuggguucaagugauucuugugccuccaccuccugaguaacuggaacugcaggcaugcaccaccacuccugcuuaaucuuuuuuguguauuuaguagagacaggguuuugccauauuggccaggcuggucucaaacuccuggcuuaagugaucugccugccucagccucccaaagugcugggauuauaggcaugagccaccacaccuggcccuguuucuauuucuuacaaauuuuaagccucuugaaaauagaauguaugaugaccauuuuucccuucauaccuaguucaguaaucaguagguauuaaauauauauacuuuuaacuguaaaugaauaaaacuguauuuuuauucugagaaucaagugagaaaggugcuuugaccuaaauggucacuaaaauauuuaguguagugacuugcuuuuuaaguggaucuaagaaguacagaaaauaggauuauucuagucaaaaagaaugugaaccuaauuuuuuaaugguugggagaaguuuuuguagaaaucauuucaugcuuuuuagguagaaaaggggcuagacauggaucaaggaaucauauaagaauagaaagagcuucugaaaagggacacacauauauaagagauggugaaaggaauuuggauuuagcaucccaguaccuuuaguuggugauauagcaguuuaguagaggguaacuguaacacaguaacaaagacuuuucagaaacucaauguaaaagaaagaacuguagcaguggcucacgccuguaaucccaacacuuggggcgucuaaggcgggcagaucaccugaagucaggaguugaagaccagccuggcaaacguggugaaaugccaucucuacuaaaaauacaaaaauuagccagguguaguggugcaugccuguaaucccagcuacucgggaggcugaggcaggugaaucacuugaacccgggagacggagguugcagugagcuaaguaaaugccauugcacuccagccuuagcgacagagcaaggcucugucucauaaauaaauaaaugaauaaaugaaagaauuuuauauuuugcacugguagaaauuaaauuagagaucagucacauuugauuuaccuggaguuugggagauagaauguuuucagaguuauuuuaagcaugguaauuaaagaguuucuuugggauuuugguuggauuggaggagauaacuuaaugggaugaggcagaaaacaguuaagagccauuguagauuacagauuaauggcuuuacuguagagccuuaaauuaaucugugguuucaaacucucauccaagcuuuguguuucacagacuuguugagcccauuaaagaaauggaagucucgcuaucugauggagcagaaugucaccaaguuacuucggccucugucuccagucacaccacccccucccaauucaggcucaaagaguccccagcuggccacaccuggcucaucucacccaggagaagaggagugucgaaauggauacagccucauguuuucaccagucacaucucuuacuacugcuagucgcugcaacacuccucuacaguuugaggugauuuggguuugguugcugggagugcuggauaugaaaaucaucauuuguaccuucucauuucaaauauaauaccauuccaaauguuucuuuacuaucuuucuuccccaucucaguaagagaaugggaaaccucagggucauuguggccuguuaccugguagccucucaucuuggcagccccuaugcuucccaaaauaggcauacugcuaccacaaaucccauucauguaucuuuugcaugcaguccaucaaucuccauaaguuuagguaguaagcaugcuagaucuccaucguuaucuuuacuguauacuuuggucaaaauaggccucuagcugccuguaguaucuguuaguaacacuagccugagagcacagaugauauugauugauugugucuucguuucuaggccuuuaaauaagugaagugucuuucccagguuguuugguauuuucauuguggccuuagcagagauuuagaaaacauugggguauggcuuauggcgaauguggguuuuuuccacuccagguuacuuucccucuuuguuauaaugucuuaggaaucagaaguagacaagaggcuagcaacauguauucaugagacaaauuuauuaccuucacuguuggauuaaguuagaaaugucugccucagcuguuucaaaaaguaaucuugaaucacuuuaguguucagguuugggugacagcagguuucaauagaauccauguauacuuuuuuaaaacacuucaucuauugcauguuacuuugauuuguaauuaaaauggacacugucucuuuuuuccuucucagaaaaauuuguucugaccacuaaacacacucugcugcucugcccccuuguuugcacuucuccagauguguuuuuugagaaaggugaacauuuuaaccaaucuuacguuuccuauucagcuuuuccaaguaugaggauucagaauacuuagcuuuuaugaguaacuaagaggcagcuagcaacauugaaagcagaacuguauucuuucuuacccuagaccucuacuuuuggagcagaccucuuucugggugagggaaaaaaccuccugguuacauaucaguuaucuagggaaauuacucuuuaccagauuauuuaugaaauucuuucagccagauaauaaagcagcugauucaggccuuucuaacuugacuuugucuacuugcaauugacuuugcaguuugcaccuagagcuuuauaguaagguaucaugagaggaauucucccuggagggcauaagauuauaggaauagagugucauacuuuaucaauacagguuuuauuauaaauguggaauuaugaaaauuagaaggaggccgggcgcaguggcucacaccuauaaucccaucacuuugggaggcugaggcaggcggaucacgaggucaguagaucaagaccauccuggcuaacguggugaaaccccgucucuacuaaaaauacaaaauauuagccgggcgugguagugggcgccuguagucccagcuacucgggaggcugaggcaggagaauggcgugaacccgggaggcggagcuugcagugagccgagaucgcgccauugcacuccagccugggcaacagagcaagacuccgucucaaaaaaaaaaaaaaaaaaaaaagaaaaucagaagguaagucacuuugcaaaacaagcggguucaguacucaguguguuccuuaucccuuguagcauuugggauaacuauuaaacacugcaaauauaaagugguuuugguuuuguuuuguuuuguuuuuuuuaauuggugaucauuuuaauaauacaguccaugcauaauguuagaauaccaggagggaaggaaaauauuaaauaguaaaagguccaaggcaugguuucacuugcaauuuaaggaaauuuuaccuuucucaucaauaauagaacagauuucaccacccugacccauucuaaucaccauuuuaauggccauacucuuugcuguauucuaguacagagagguggggagccuuuuuuguagcaaaggcugugacacauugugaaauaucaaaaaggugucacguauaaagaccagcuuaggcugggcaugguggcucacaccuguaaucacagugcuuuggaaggcugaggcaggaggauugcuugaggccagggguuugagaccagccuggguaacaucgugagaccacauuucugcaaaaauaaaauacaaaacuuagccagguguaguggcauauaccuguagucccagcuacuugggaggcugaagcaggaagaucacuuaagaccaggaguuuaagacugcagugagccauuauugugccacuacaugccagccugggcaacagugagaucccaucucuaaaaauaauuuaaagaccagcuuaggccagguacaguggcacacaccuguaaucccagcuacucgggaggccaaggcaaaggaauugcuugagccugggagguugcagggagccaagacugcgccacugcauuccacauuccagccugggcaacagagggagacucucucucaaaaaaaaaaaaaaaaaaaaaaaaacaaccuuacuagauuaguuuggggaaggauauuuuugagaaggaaaaaagcauucaggaaaauggugagaagucuuaagugcuaaggggaagaagguaagaagauaaacaguggaagagaacaagaucuucaggaggggaaagcaucuagaaagaagaguggaagcaacauugggaggacaagcuuaguuagccucuccuuucuaccagaauaacccuccccuccuauucuugcccugagagccauacuccacccgccauuucacacauacgugcaccuagauguacaccacccacuguccaugccaaguaaaauucacagccaaaacccugcuuugcugaagcagccucauuuccccuaccucagcaugugccugccaccuaggccacaguuauucagagucuacauuaggcacccucuccuuaccucagcccuagcaccccugagucauugucacacuaccaccuucacucucuucacguguucccauuuacaucuuuccauuaagcacucacugcucagucucuguuaugggacugcugccucaccugaaagucccaagguaaaguccuacccucuguaggauacagggaccuaaguauacacauacaugcuuuuucugcucuguugccaaaaguacaauggauuuuacaaaauaacauuaauagggguggcucaggucuaauuagauuaugccaagaaccaacucuagccugugagcuagggauuccaucaaucacauuuccuguaacugucauucaagaggaacuggccaucucccuaaccaugucagcccccagcacacuaaugucucccccuggauagcacugggagggccugaggcauauaagagaauaaagaaaugugacaagcagaagaggcauuggaugaaggaacaagguccauguaaggaggaauaagggguagggugccccucaauaacaaauacuguagguugcuaaacucucaucuaaaauacaaagacguauaacacuaaaauuucaccagucuaacucuuuccuuguaugugcuugagauguuuacuuacagcaugaaacauuauaaccaauuuauccuuaaaugcuuucagagauaccaggaagcauuuuaacaagucauucuguccauugagaugaguucugcaguuaaauauuuccccuaugcauucuuauucaacuuccccgcccccgaaaaaaguuauggcuaacaucuaugcuugcuuuuauuuuuuguuuuguuuugcuucuugacuucgaguagaugaauaauaacaagaugcuuuucccuccucuagaacauauccuccccugagaguuccccugcgcauaggcccgagucccugucacccgagguaguuaucacaccaucucaaucacacuuggaggcugagagugaguguucaugaauguguuccugaguguguggggagggcuggggaucugagucaguggggugaugggcuggagggcggccacucagucacaguaaguugaaugagucuuccugugugacugugacuacacaggacugucaauguagauggaggaaaaugaagguaggagcguguguguuuguguguguguguguuguguguguguuuggugggguugguuuuugccguuugggggaggggguggcuggaguucuauuaaagaauagaaucuagaagucaagaugcugauaugugguaggagccuuguuaaagaaaggcuaauaaaucaggaaaguugagucaaaaguuguaagagcuguuuuuugaguuggguggugacuuaugccuuguucuaggguuaaucuaacagcucuguaaaccagauguuuugaccuuugguugauagauugagcagcuucuucaggaagggaaagucauucugucuuucagcuuuccuacauuuucucugcagcuccuuacugggugcacaaggaaaccaagugagucccuggcuuucugucacaggccaccauucugcaaugguuaggauaugguugcuauacaaguguuaucucuuuaggauaucaguagagugguuuucucacaaacccuacugcuguggauaugucaaacucagauuuuagugcuagaguuucuauuauaagcuuucagauuuaguaacauuaacucugaaucuauuaauacaugggaccuuuuuucucuugaagagaaaguuagagucucucagaaauagucaacugaacuuuaacccuauccccuuccaauaaaaaauuagggcauaauucagugacagucuacuaaguucugaaucaguaguaguucacagguuaauaugaaacugaaaaagguuuuauuccacuaguauauuagagauuuucuugguguuuugacucuagcuuguuaggaaaguaaagcucucucuccucaguuguuaaagauucuaagauaacguaauuugaagacugauaugguaugguaucugguuuucugguaccauucuuugucgguuagcuguaguugaccuaguguuggaaguuuggagguuaugauaaccaaauaguaggugggguuuauuuuugguacauuucagcauuucagaaucugcagugaugagcauuaguggucuugugguauguugacguacauuagaggauaaagaagaauugaguggccagaaaguuguaugagaaacacagcuucuuuaacagugaaagugagugaagaacugguugguugaugucuuuaaugccauccuccuuuacugaaccaguaacuuaaguacuugccuuuccgucuaccuucuccuuccuccaccuuuuucccuuccccccaccuuccaucaauauuaauuuagaaauugauaaccccggaagccaguuaucuuaagacaccagucucaucuuuguuuugugcauggggcuaagguaaauuccuaauuauaccacuugucccuuaguguaguacaaggugacucagcaaccugaugaaaggcuaagcaggcaaaauagucacauuuagccaauuaccuaauucuaacuuucccaguauuucccauccagaaagacuugaaagcaauuuuggaaaggccaggauucuuuaguacucuggcccauguacacuguugcuacgugggacuuuuacagaauauaauggcuuuaucugcucuacuuccgucccucuuaucuuucccuguucaccugugucccucuccccuccuuucugcccuuugacuuuuuccuuucuccccuaccccaugucuccguugauuuuuauucuuucagcuuugucaccgaaaagaccuggauuuggcaaaaguaggauaccuugacuccaacacuaacagcugugcugauagaccuucccuacucaacucaggucauucugaccuggcuccucaucccucccucggacccacuucugagacugguuucccaagcagaaguggagauggacaucagacccucgugagaaacucagaccaggcauuucggacagaguucaacuugauguaugccuacuccccuuugaaugcuaugccucgagcagauggacuguaucgaggaucuccucuagugggggauaggaagccuuuacauuuggaugggggauauuguuccccugcagaaggauuuuccagcagauaugaacauggcuuaaugaaagaccucucucguggauccuugucaccugguggugaaagggccugugaaggagucccaucugccccccagaacccaccacagaggaaaaaaguaaguguuucauguuauaucggcgaacuuuucaagaauguuaaccaaguaguuuaguagauauucauaaguuucugcuauguguuccgcacuacucucagacaagugagacauagucucugccaaauccagugaaagacaggcuguuuuaguacaacuuggugaauguuguaaauauucagcaaauguaaaugccuguaugugccauauacuugcuaggcaauugagagguuagaacagugaaaaagaaauuuuaccuauuauuuagugugucccaaguucgaggcacuguauuaagcucuuuaaauguguuuuauccucacaguaagccuauaagauaggcaauuuucuauuuugcacaugaggaaacuaaggcaaguugaguaacuuucccguggucacacagcuaguaaauggaaggaccaggauacuacccaguuugagagagaaggcuggagugagaggcagcagguuacugauuuaacugaaucucaaacaauaaguaggagucagccaaccaacaauugagggugagguauguuacaguagagggaguagaacagguaauuagguggcacuccauuggccaggcagcaggcaugcaguauggugcaaacaguuggauguuguuguaucagguggaaggccgggggagccaggaggaaagugcagagagugcugggcugggccaggccauagagagcuugcuaauggguugggacuccacuuccaaguaaugccugaucaagaagucacaaagccaaaaauaugcuuuuguauaagugguucucaacuagggguguuugagaaugaguaggaguguuuugaauugucccagugacuugcauuuauugagcagggccagggaugcugaauguccuguauaggggacagucccauguaauggccaaacaucuguaguauccucauugaaaugaaaccuagugguuuuuuuauauuuucauuauaaugauauuaccagaauuuauuaacuucuuuccaaaauuauuucuagaaaaugcauaugcaaaacugucuauauuuuuguuccauuuggacagaaaaaugagaacccuaaggggauagaaggaggaggaaacauuggcagauaauuuggauuaagauaauaauugauuucgaagauuguugcgugaacagcauugacuaccagaaacaaacaugaaaacaaucuuuggauuucugguuuuauaauauuuacuaugugcaaaagucauagaaauuaugauauuuuauuucagaaacacuucugaaauuuauugggcacauuuaagcauaaauuuaagcauaugccaaauucugugcuggauguuaaagauaaaaagccagauaaacuuggccuuugccuuccuagaacuuauaguuuagucagggagcaaucaaggcaugguaauagguucuacggccuguguaagcaaugugccagaacaacaaagagaagguguacuaggcagggcacggauuauggugggcagggugggaugggaggucugcugucaggaaagaaugagcaagcauuagggagaugaaggggaaguuagggagaaguuaccaaguuguuuucuagagcuagcuugcuaaaauuauaaacuggaaauaauaauuuccucucuuuuuacauuaauuacaucuauguguaagacagaaacaguaauaaauuccuauuuauaucuugaaaauuugaacauauuuaaguauccuggagcauuggguuuuucuucuguuuuguuuuguuuuuccuucucucucucccucucucucuccaccuaccucuccccaccucccucuccuccaucuccuucuccucucccugcuucuuucucucaaacagcuaacucuagggguucccaaggaguacagaacagccaucagucaccugggaggcuuuuuaaacuauacaagcuuccaauucucccuucucuagguacuuccauuguugcaaauaacugugauagcaugcuucuguuacuguguaaugguaaccucacaaguuuuucugaaggcagaaaaaaagaugguggucuaauuggcaaacauucuuuagagacuugccuccuaguuuauuaucuuccucuuaccaauuuccagcugccuuaaauauguagcugugcucagaucucuuucauacuccccaaaaaaaguuaucaggguuggugucugcuuuguuugcguggcuuggcuagugguuuacuaagguaccaucuuuccuucuuucccuguugcuggugauccacuaaugauauccagauagaguaccguuuuuuguuuguuuguuuuuuccuuucuagguaucccugcuggaguaccgaaaacggaaacaagaagcuaaggaaaauucugcuggugggggaggugacucugcacagagcaaaagcaagucugcaggagcugggcaaggcagcaguaacuccguuuccgacacuggugcccauggugugcagggauccucagcccgaacuccaucuuccccucacaaaaaauucuccccaucucauuccucuaugucccauuuggaggcgguaagcccaucagauuccagaggcacuucuucaucucacugcagaccucaagagaauaucagcaguaggugguaaguuuauauuugauguuuuauaguuaaauugggggugggggggaguauauaucuaagaucauucccaguuuuaccuaaaaucuaugggaacacuugaugggaacaucugagacagccagccaacaguaccaucuguccuguucagcugauuuaauaaugucagcugcaaccccccagcuuugcagaauuaagaauuaccaacaugccuguggagcagugcuuuggaugacauguaguuauggaugcagaugagcucuuucauuuggugggcacuaacacugccuuuccuauuucucauuucacaugaaaggugagucaagaauccagccaaguuccacaugaauuaacaacagaugucucucuuccacacagcuagcauauacagagcaaaaagacauucugaaaggauuugucugguuuaggggagaccacaaauuuaaaaaugaauaauacugguggcaaauacugaggaucaaaugugugaaauagagaaugaagcacaggaguucagggaucuugaacugaaaaaaauaagucugggaaagaacaguccuggcucaaauguuucauguucauuaaucuaugaaaccuuuauuaaaccaguacuguguaucaggcacaugauuuccuaaaggagaaauuuuaacauuuuaaauggggguuaagggaaguuaacaucuuuaacccacuuuuuccuugauuucuuuuucuuuaaaagugguuguuguugauguuucucuuuugugccugacauaguuggaggcagaggaaauacguuguuuuaaauugguucugaagaaaguaauguuuaagaggauguuuuaagaaaauacacugugcacugguuagggcuucauuuguuuugguuaaguccuguggcuugaacuugcacccuguugccuuuacaggaugguucccacaucaguagaacgacuccgagaaggagggagcauccccaagguccuccgaagcagcgugaggguggcccaaaagggagagcccucucccacaugggagaguaacaucacagagaaagacucaggugagcccauggccuucugcugccaccacauucagggacacaugagccgaguccuguacaguucaugccuagugcugaguugaggugagucaguuucugaugcaguugggcuccaccgcaugcuagguuccagcccacuuaugcucauuugggcuaccacauuuguaagaucuagcauugcuugcucucugucugcucuuuuuuccccaaggaauaccuuucuguaacucucaucucuccaaaguccuggaaaucuaccucgaugaaggaugaagagaaagaagacgggaaucacaucaggcauuuagaacauagcccauaauuaaccacucauuuugcccuucuggcaugcugcacucacccaauuugucacaaagagagcaguacggguuggugauggcacuggugauuuaaaugaaaaauggcucuuucuuacuuauucuaagaagccaaguugauuuuuuuuuauauauguuaccuuccagacccugcagauggagaaggcccagagacauuaagcucagcacucucuaaaggagcaacaguuuacagcccuuccagauacagcuaccaggugagaugagaaauugcuggucucuagccauaggaguguguucugggucccaaauuguccuggucauccuuugccauugagaugcugucuuugcauauaguuucagcagccuuggaaauaagucaucaucugcuuguccucagguaauaaauuaugccagaagaugaauacggugaucaaagacagacauuuuacugccuuugguuuccuaaaaagaauacaugguuaaaagaugaagaaaaaagaauguaggguauuauaaauguucaccagccauuuaagggacuuguucgcguccuuauucguuuccucccaacuuugucuagcuccugcagugugauaguccucggacagaaucacaaagccuccuucagcagaguuccucccccuucagaggacauccuacacagucuccaggauacaguuaucgaacuacugcacugagaccuggaaacccccccucucacgguucuucagaaucaucccucucuuccacguccuauuccagccccgcccacccuguguccacagacucguuggccccauuuacggggacaccaggguauuuuagcagccagccacauucuggaaacagcacuggcagcaaucuuccaaggaggagcugcccuucuagugcugcuagcccuacccugcagggacccucagacucgccaaccucagauucaguuucucaguccagcacaggaacucugaguuccaccuccuuuccucagaacucuaggucgucauugccaucagacuuacggacuaucagucugcccagugcugggcagucagcugucuaccaggccuccaggguaucugcgguuuccaauucacagcacuacccacaccgugggagugggggugugcaccaguaccgacuccagccacugcaagggucaggagucaagacucagacgggacuuuccuagggcuucuggauuugggcaaacagaacugaaugagcccauagcugcuuccuuccagcugccucuggaaccuaggccgagcauauugcugaggaacgggggguacaaggugccagaggauugggucugguggacaagaaacaagacuuguggucacaauuggccucuggccuuggagaaagcuguaaaucuugucugaagcagagacuauaaagaaguuucucccugcugucaaggguacauuguugacaagcaaaugguguuucgguuaguaacgguucuaagugcaaugaguuguguugaagccuccgucucccauccuugccuguagcccguagucacuugugcagugaggacaucuuuuuaaauuuaaaaaaaaaaaaaaaaaaaguuuucaaaggaaaaaaaguuaaaagagccaaucucaaagccccaagccaucugaguacuguuaggguuuuaugcacuuaagaaaaaagguagguauguaaauguucauccuaagacaaccauuccaaaagcagguaucuggccaauguguguccaccaagaauacuguuuaucuuugucuuaagaucaccaagaaauaggcaaggauaguaaagcuuggaaccugcaccaacuggagggugccuggcucuuugaagaaaagcucauggucagcucuugauuauucgggagcagauuauuugaguagauugucugagccuccaacuguuaccauccuacucccccuucccaagcuauuucacagcucaguaacccaugaaguaaguagacaagaaaaggaggaaugagacaugauauaggccaauugcauugcuacuuaccagcuuuuggcaauaaauuucauuaggaaggauaccgagugguuugggaaugcuucgaauuuuauuuuuucuacucccaauuaaucaggaguugaugaucccaugagcaggaccgccuccaugauuggggagcaugcacuugugacugcaggguaagagugggaagauagguuuguggaguggcaccgacaggacugugauugugugugggccugccccacauuucucugggggaugcuuaugugagagugggcccagugaaagaguuaccaagccacccacaccccuaacacuguucuggaugagagaugagagcagaccggcuucuccccaucagugcauugugccuguuguacaccccuggaggagcccuggagccagcccaggugggguacacaaucuuuuuaaauuccauaugguugccagcuuauuucuuucacuuguuuacuguaauaucuggcguguuuuuauuuaucuaauuuuguauucaguuauaaccaugguagggguagugaauauaugacagguguaaucccuggugcugcaguggaccuucuuuucuuuuggacaagauaauacugugaguuucccuccuuccuucccucuaauuuguuuuccuuuuuuccccagccucuugcauccccuucuuuucuacccuguccuacaacuaucauaugcacagucuucucucuuugugugugacuguuacaaaauuucacuuuucaaaaucgaaaucagguguuugcucaaaugaggggagauuuuuuuuuuuuuuuuuuuuuuaaaugcugagaccucagcagaguacuuuucuuuuuguuguuucccccacaaacccaucagucugggagagcauugggaguggaaaucauguugccugggaugcugguuucuuuguauauuauauaaaacguauguaaaugucucuccauuugggcugggguuugcauucuccccuuggcuauuuaaccaaggggagaggccagcgggcaggcggcccucacccugccuggcacgugcagagaccccagccacucugugugggcagggugcugucaagaccagaccucuuggggggguaggggcggggggguggggggaacucuuggaagggaagaaguaucacuucuuucucaaguggaguguuuacaccuugcuguaacauuugaacuuucacaagagauguaauaauuuugauaauaaaauucuuaaccauaauaaucauaaaguugagaa

SEQ ID NO: 6301 - RNA, 80455 nt, Homo sapiens; identical to SEQ ID NO: 6300

SEQ ID NO: 6302 - RNA, 10290 nt, Homo sapiens
gauucccgauggagcuggccccuucguggcgaccacaaguccuaucacgccacaagaaucucggcuuguucaccuacaaaugaaggccgacgauacuugcagaccgagucugacaucuaugggaccccacuccuacccugcgccucaggggccgggacaaccgugacccguaccgacuccucgcgccuccgggaucaaccucagaccccugugggcucccggggaagacgcaugcgcacugcucccuccucgucuccuucccuucguuaauuaguccaucgcauuucaagugcuggauccuuuuuguccccuacugcgugcgguggcagcuuccuugcggaaguggugaccgugagagaagaagauggcggccccuguaguggcgccgccugguguggugguuagucgggcuaacaagcgcagcggcgcggggccgggaggcagcgguggcgggggagccagaggggcggaggaggaaccgccgccgccccuacaagcaguucugguggccgauagcuucgaucgccgcuucuuccccaucuccaaggaccagccucgggugagcgccgcgcacgcgagcagccagagggcaggaaggguggcagggcuggagcaaguucucauuucggcuaacuacaacagcaugcccuugaaggaccugcgucuaugcuguuauccuaaaaccggaugcagagggacugucuaaacccugaugacugcugaccaaguuaguggccggcagauuugggcauucguaaugcuguccaccucggguuugaaaggaaugaagagagcuaaauguagaaacagcgcuugagagaagccuucacgcggggauucagugccccuagaagaggcugcgccgcuuuuaaccuugccgaugacgguugcuuaggugaaaagaaacgaccuuuugccucugaaagggcgguaauaugccuuaaaaagagcgggcuagaucucaggcaguguauuuuuuuuuuccuuccagguucuaaugauagccggugcuaucugucgaaaggacaaaauggguuuagugguugauugccaucagcccccgaguugucuagacaaugggguauuggacucagcugggucguucagcagucaguucagaaagagggaacugcauuggauuuaaggaaaauccucucuaauucccucgaaaaagccuaauggcuguucauuuuugacaagugacgggagauggcuaaccucugacacuuagaaagggaucaaggaaggaaaucuuauggggaagaaggccuuagcaaugcuuaaauuuauggaaauaugauugauuuccaguauuauccuuugccagcagugaacugccauucugucacagcucugugucugauacaaggcacauagauucuguacuuaccauccccaaauugcaaugucucagacucaggcuuagagcauggcaugaacaucaaaggcaggaaccuguuuaucuuugaauuggaaagauacagcaaaauuacacuguuuggaaauacgaauagaggagugaaaauuguugcagugggguacccaaagggauucgagaccucaaguuuuuuuucaucuuguauccuucagguccucuugccccuggccaauguggcauuaauugacuacacucuggaauuccugacugccacagguguacaggaaacauuugucuuuuguugcuggaaagcugcucaaaucaaagaacauuuacuguaaggcccugcaacuuuucuuuccauguuucgccaucuuuuuccaguuuuuucaggaugaauguaacuaaggggaaaugugagaggggaaaaaugugucuacuuagaugucauuguaaguucuaaggguauuuucuacacuuaucaggaggugagcagcugaaacuuuguaucugucugucuuggguuuucugugacaaagauuaaagaauaaacuuggguuuuuucugaaucucauuauaaaguuuggugccaguggacuuugcuuuuauuuaauggcuucaguauggaaguuacaaugauaacaucuuuguuuucccacugaguuucuaaaucuuguuuguucucaccuucaaggauauaaaugagcuccuugucaucuuuguauucccacugccuagcucagucccaagcauauagugagcacuuacauguuuguugaaaucuugaaaacuagggaaucgcauugcuuauggaaguccaggauguaaagacuaggacauuagcauggucuccaucagacaguuccuaaauguuauauggauugcagaaggggaaagcugacgugaagcguguucccaggcuacuuuguguacccuaggcuucagcaggauuuugaguucaaauugauguuuagggacaaggggucaagguauggagaggaaauaaccauguuuccuaacccauaaaacaagacuggugacacaggaugcugaaagcauucauuauaguucauaauacucuuugaaguugaagacgcuggcaagaacccaaaaaagccaucgagaaggacugugagugcugaaagggggugaaaaauggggaaggcucaaaugaucuuuaugcuugauacacucauuccccucacccucccuuccuuuaggaagucaaaguggugccgcccuacaucucucaaugugguucgaauaauuacaucagagcucuaucgaucacugggagauguccuccgugauguugaugccaaggcuuuggugcgcucugacuuucuucugguguauggggaugucaucucaaacaucaauaucaccagagcccuugaggaacacaggucaggaugggaaaaugacaggaacaaggguuaaagaccagcagagcccugagacugcuuuuuugcaguucugucccuccuguccuuuauagguugagacggaagcuagaaaaaaauguuucugugaugacgaugaucuucaaggagucaucccccagccacccaacucguugccacgaagacaaugugguaguggcuguggauaguaccacaaacaggguucuccauuuucagaagacccagggucuccggcguuuugcauuuccucugguguguggauaucugggguccuuugagauggggaagugacaggcuucagugggagaaacaaauuaaaguccuuguaacuucuccccacagagccuguuucagggcaguagugauggaguggagguucgauaugauuuacuggauugucauaucagcaucuguucuccucaggugagcucuuuagggcuggggcugcacacccaaagaguagaacucugugggucuguuauuguccccuuagaaggccaggguauauuucuucucccuguuuauuuucauuauuuuuacuuuuauuuuuugagacagagucucgcucuguugcccaggcuggagugcaguggugugaucccagcucacugcagacucugccuccuagguucaagugauucuccugccucagccuccugaguagcagggauuacaggcacaccaccaugccuggcuaauuuuuguauuuuuaguagagaugggguuucaccauguuggccaggcuggucucgaacuccuggucucaagugaucuaccugucucagccucccaaagugcugggauuacaggcaugagccaccacaccuggccuuauuuucauuuuuauuuauauauauuuuuugagacagggucucgcucuguggcccaggcuggagcacaguggcaccaugacugcucacugcagccucagccucccagguucaagggaaccuccugccucagccuccugaguagauggaaccacaggcaugcacuaccacuaauuuuuguauuuuuuuguagagacgggguuuugccauguuguccggccuggucacgaacuccugagcucaagcaaucugaccaccucagccuuccaaaaugcugggauuacaggcaugagccaccaguuuuuuuuguuguuguuguuguuauuguuguuuugagauggagccucgcucugucgcccaggcuggagugcaguggcaugaucucagcuuacugcagccuccaccuccuggguuccagugauucuccugccucagccucucaaguagcugggacuacagguacgcaccaccacauccggcuauuuuuuguauuuuucaguagagaugggguuucaccauauuggccaggcuggucucuaacuccugaccucaggugauccucccgccuuggccucccaaagugcugcaaucacaggugugagccucugcacccagcauuuuuuuuuuuuuuuuuuuuuuuuuuuugagucggaguuucacucuuguugcccaggcuggaugcaauggugcgaucucagcucacugcaaccuccaccucccagguucaagcaauuccccugccucagccucccaaauagcugggauugcaggcaugugccaccacacccagcuaauuuuuguauuuuuaguagagacgagguuuuaccauguuggucaggcuggucucgaacucccaaccucaggugaucugccugccucggccucccaaagugcuggcauuacgggcaugagccacugcaccuggccuuuuuuuuuuuuuuagaaucuauuguaaagcaaagaucuugucuccaguaucccacugggagucucuuuggaauucugguccauguucagcugucauaggguuugcuaggucucugggggauuaucugugcuccuagagaauaguacuuaauccuggccaagcgugguggcucacgcuuguaaucccagcacuuugggaggccgaggugaguggaucaugaggucaggaguucaagaccagccugaccaacacagugaaaucccaucucuacuaaaaaauaaaaauacaaaaauuagcugggcgugguggcggacgcuuguaaucccagcuacuugggaggcugaggcacaagaaucacuuuaacccaggagguggagguugcagugagccgagaucaugcaacugcacuccagccugggcaacagagcuagacuugucucaaaaaaaaaaaaaaaagaauaguacuuaauucuagcccacuccacuucccuuccacagguggcacaacucuuuacagacaacuuugacuaccaaacucgagaugacuuugugcgaggucucuuagugaaugaggaggugagaaaagucuuccaaugccucuuuaggagagaggagaaggcuaugauuguaucucaugcugguaacuuuugaucuuuuuuguauuuuauugaggcuuaggagggaggaaaagcaggggacaggaggaacaguacacaaagaagaaucuuuguggcagugagaggcagaggggaacuuaaaaggauuagaaaaguuguacuugggggcauucuuccugucuuucuugcuuaggugaccucccuuuccuucucauucagauccuagggaaccagauccacaugcacguaacagcuaaggaauauggugcccgugucuccaaccuacacauguacucagcugucugugcugacgucauccgccgaugggucuacccucucaccccagaggcgaacuucacugacagcaccacccagagcugcacucauucccggcacaacaucuaccgagggccugaggucagccugggccauggcagcauccuagaggaaaaugugcuccugggcucuggcacugucauuggcagcaauugcuuuaucaccaacagugucauuggccccggcugccacauuggugagcacagguggggaaucaagccaacuauccuaggaacaggaaccugggggggccacgucuccagaaacacaagggauggcuacacaagggacagucccugggaauaaggaacuauagagcggcuaccucaggaaaggaggaaacagggauuugaaaacagcgauaccuuaauuuguagccugugggccucucauuggaugacucuucacauuccaggguacccuguagucacauucaggagcaaguagauaauuaacaugcaguaacaacaucuauuuagcacauuacaguuuacaaagggcuuuuauauacauuguuacauuuaaucuucauaauuuacaaauaaacaggcucaacaagauuuucuugcccaaggucauugguaauaauggugggaccugaaucuggguauucugaauguaaguccaguguucuuuugagucuaccauaacugccugguuggccucuugguaucucauuuugguugcaggagugugaugcgucuaauaguacugccccuuuccaagaacaacaguaaggcucagauucuaggggcugagcgugguggcucaugcuuguaauccuagcacacugggaagccauggugggaggaucgcuugagcccaggaguucaagaccagccugggcaacauagcgacaccccuucuccacaaaugauacaaaaauuagcugggcaugauggcgcgugccuguaaucucagcuauucgggaggcugaggcaggaggauuaccugagcccagaggucgagggugcagugagucaugaucauacuacugcacuccagccugggugauggaaugagaccgugucucaaaagaaaaaaaagacuugguuucuaaaauguaccagaagagguggaauuauuugguucugcuuguaggcguggauaugauucuaauaagguuuuuugaguucagaggguccccagaaauccugaagguucucggguucuuaagcucuguguguagucuauaauuguuguaaacuuggugaaguaucuucucaggccugggcuuagggggugaguggguguuucuggugacuugcgggauggggaaugagagcuaggugggagcugugcuggugucagucagcccuguccucuaugaagggcucugcucugcgguuggaacccugaguuacccagaggucuucccauccugagccaggugauaacguggugcuggaccagaccuaccuguggcaggguguucgaguggcggcuggagcacagauccaucagucucugcuuugugacaaugcugaggucaaggaacgagugacacugaaaccacgcucuguccucacuucccaggugagaccugaucuauacugugcacaggcccugaauugcauggcagucacacugagccagaaggggcauuauuuccacccauaauccugucuaaaaaaguugcucucauuaucaggaugcacuuuuccuccacacccuaaugguucuguguuuuuuuuccccuuagguggucgugggcccaaauaucacgcugccugagggcucggugaucucuuugcacccuccagaugcagaggaagaugaagaugauggcgaguucagugaugauucuggggcugaccaagaaaaggacaaagugaagaugaaaggugugagacucaacagguguggggcaucugugugucucgcugccucauagaagaaccaguguuuccuccuggagggauuggugcuuccgccgggcccucucuauagaucauugccuuuuccagguuacaauccagcagaaguaggagcugcuggcaagggcuaccucuggaaagcugcaggcaugaacauggaggaagaggaggaacugcagcagaaucuguggggugagcuaggccugaugccugcccuucuccuccugaaucggaauauuuugaaggauaaugaauacuucagagucacauuacuuauucacuccuuuauucaggcagacagggcagguauauugcucucugucaaugacucuuuuuuucuuuuuccucacccauuauggcuucucaggacucaagaucaacauggaagaagagagugaaagugaaagugagcaaaguauggauucugaggagccggacagccggggaggcuccccucagauggaugacaucaaaggugaguggcaggggagaaaugcgcuggaccaguuuauucucugccuggaucaacuagccagaggcuuacguuccucagaaaggguuugguaucgagucaagacuagaugacuuagagcauucugaaugauguuggcccaugaacuuauccuugcuuugauuucaguguuccagaaugaaguuuuaggaacacuacagcggggcaaagaggagaacauuucuugugacaaucucguccuggaaaucaacucucucaaguaagagcagccccucccuguucuccucggggugaucccgggaagguagaggcuuucucguaaguguuuugucuccaaauaggaaccuauuccuucgacaucccaaauggaaagaccaguaguauuuggagcaaggagagcauuauuaaguucuagccucagcauagacuuucuccuuccuaaacccuccccuuccauauuguuccauccagauuccucuccaaugucuaucaaagucauaguucuaagccugcugaaaggccagugaaggcccuggugucaccccagucuccccacagguaugccuauaacauaagucuaaaggaggugaugcagguacugagccacgugguccuggaguucccccugcaacagauggauuccccgcuugacucaagccgcuacugugcccugcugcuuccugugagcaaagauuggagcugaguacaagggauuggguacaggcaaaggaaaucaggaguagacugucuuguuauauuggguguaugucacuucugguuccuuuuuccuugccucuggaagcugguugggcucuagagcagccuuggcugguucagaggggucagauugaguucaauacugacuggccuuugagacuccaggauuucauaccauccuaggcccacaaagguauauucagaauggaccuggacauucagacucuauggcagcaauuugacccaacacaagaucagccucuggggugggaauagguauuuugaggcagccuauagcaucugauccccuuucaccuucccuaaggaaucucuuuuucccaaacccugucaacaacucccaagucccucugacauaauuccacagaaccuguaucaucucccuuuuguccacccaugucaucaguauggauuugcuuggauguccagguauaggugaaugcuuaggaauauacugcagcucccuucuuucuuccauagcugcuaaaggccuggagcccuguuuuuaggaacuacauaaagcgcgcagccgaccauuuggaagcguuagcagccauugaggacuucuuccuagagcaugaagcucuugguauuuccauggccaaggugaauaugaccucaagccccauucuucugcacuugcuuucaaacgaggguuggugacccccuugggagacauaaaauagaagcuaaugugaauccaguauggaccauccacucccaauaugcuuauugcuagaauaguacagcuuggagccggacuaauaagguagccaucugggggguggucuggaaaugugcaaagcucuccccagcaauaguuccagaaguuagaccugccccaggagcagagcgaacagcucacucuuguccguuuuggaggaggcuacucagugcauagagggaucugagggccugguagaguauccugcuggacuuuccaaggccccugagguccccuuuauuggccuuuugcagguacugauggcuuucuaccagcuggagauccuggcugaggaaacaauucugagcugguucagccaaagagauacaacugacaagggccagcaguugcgcaagaaucaacaggugcgucaggcuguccuccucucgccaagaugguuaucucauucccagguccuggccccuagacucuagggugguugguuucuggggcucugguuguuagagcuguuuaucugccgaggggagcaggagaguuaugugcaccucccccagccgaucucuccucugcuucuuuacagcugcagagguucauccaguggcuaaaagaggcagaagaggagucaucugaagaugacugaagucacacugccugcuccuuugggugugauugagugcccuccuggcuccugggcugggacaagugaggaacuagcugcagagggaugagugaccaccauccaggcugagacugaaaggagcagaggcuggaacuacaguauucuuuccccugcuagcaaccaugugccucccauccugacuguggaguugggauguggaaguggggcuggaacaaagcuucugccuagggaggagcuaagcaggcccggcaguuggaggaaggccagaggaacagcuuugugcuccggcuuucccucagggaacagcagagagcaguuggcucuuucugcugcuuguauauguuaauauuaaaagagagaguggugua

SEQ ID NO: 6303 - RNA, 41509 nt, Homo sapiens
cgaucgaucuccuccggcuccgacguccucggccugccgggucccggguccuuugcggcgcuagggugggcgaacccagagcgacgcuccgggacgauguggggcagcgaucgccuggcgggugcugggggaggcggggcggcagugacuguggccuucaccaacgcucgcgacugcuuccuccaccugccgcggcgucucguggcccagcugcaucugcugcagguaaccugccggccccgagccaccugaucuucagccuggggucggacgaggccgaagccucucagggacgcggcgggacaccggcugccacccgggcgccgccgaagcgcgcagagaucagggucccucgacggcagggcccuucuggguagucucuggaucccacaaguccagugcagcccugggcucgucuuaucccaggucuuuucacuuggugaaacugaaccuagaaacguccuaauauucuaccacuguuuuuauaaauauuccuuauuccaggcuggaaaagcuccugagaagugguuuguuuuuauuauuuuaaaagguguuuuccuugccagccauuuccaguuaaccugcgcugcugccguccgggccgcgagagcgggacgcagaguuguuggcggagccccugucgguucccggggacuaagcaccgcgucccaugagcgggaaagguuaauacaaugaugguucugcccugcgucgcugacgcggaacacagcuguaguguguuaggaacacauaacguaguuaagaucacuugaagcucugcgaucagucgcccuucuggacguugugguuaggauguuucacaguucuaaccacugguggagauacagcguccauauuuucauaauuaaaaauagaggcacauggucucacgaguuugaguguacuuaugggggcaaaaggacggcguauuugaaauccucauaaauccuggaugcaugguacccaccaguggcuaaucuaugcaaugaauagaguuugcaauaauuucaagcaucccuucuuuccacuugaguuacuuccccauaccuaggggaagauauuuuugguccacugaaaacaugaguucagcagaauccuccuaucaucgucguuauuauuuuuuaccacuaaguagacaaucuuuugguuuuugaugggcuuuauggcuagagacaaaucagucacugucaccaaguuccagguagaaguugguucagugcucugucagcuucgaugggauuuuucaacauguuuucaaaucugcacuuaauaguaggaaugcuuucuuacaguaacucuaauuugauccuaagauguaguuguuaccuuacauucaucacuguuuaagaauuuaguggucuugaucuuuguuuuaaauuuugagccuucgggaaguacuuauaagaauuaauucaugcauaucuuuuugaaauguaaaugucuuuagcccuggaacaaauugcuguuucuguucagcccauauuagcagaauaggucaacuuuacuuucuaauuaucaauguaauaaguuuauuacuuuauagauuccauaaaucuauacauuuauuccucgaugaauuauauaaauuuauagaauuuauguuuuauagaaaauuuggaaagcauggaaaauuauuaacaagaaaauaaguuacccauaaucccagaacuuagaggugacuaauguugacaguuuggaucaaaucuuccaguuuuguuucuaaucuuuauuuuuaacauaaaugagguccuguauacacacguacaguuuuguguccugguguuuuuauuuaauguuauuaugaguguuuuauuuuguuaaaaggucaucauuuuaaguuguuaauuaguauucuagcacaaauuugccauaauuuauuuaauuguuuacuaugauugaccauuuagauuguacuuaauuuuuaggcauuagaagugauaaacuauauuuuaaucagacguugaaaauaacacaucuuuguuuagaaaacaucauuuuauuucugguugucuaggauagauucccagaauucuuggguuagaggccauagauaauuaugaaagcagaaagauucacaaguugggaguuaauacuugaauuacuuuauuuggggugaagcauugagugcauaauacagaucaugcaguaaugggaagaaggguuggaacaaugguuuucuggccuaugucagacuuaccuugaagcuuuuaagaauacagauguucugaucaacccucagaccuauuaaaucagaccuaaaaucuuagggaauaggcuuuaggcaucucuaauuuuaaaaaauuuauucaggcuacuuggaugcacaaaagaguugagaccuacuguccuagaaucauagaauuuuaaugacgauagagaccuuaagcaucuaggucguuucuguacuuuuacauguaaggaaacuggcauuccuaggccaguaccauugccaugcagcuaauuugcccucuugucuauagcucacucugcaucacccaaccuaccguucucacuguuucuucuauaaccaaucuccuucccacuucuguucucuuacucaugccauucuucccucagucauuuuucuuccuuccauacaaauuccaugucuuuaaaaaggaauaauccuaccuccuccacauagcuuuccaauucucuguugcccacauuugucucccuuucaauacuucucuguuguguuaugugacacaucacauuugauauacucuguacuguguuucaaguauuguauucucuuguuuacucaagucauuauuucaggacugacuacccaguagaugcuuuaagucaggauuucucaaccuuggcacuguugacauuuugagcuggauaauuuuuuguuuugggggcucuccuguacauuuuaagauguuuaacagcacccuuggccucuauccaguagacgccuguacugccucccccuaucugugacaaccaaaaaggucuucagacauugucagaugucuacugaaggacaaaaucaccucugguugagaaccaccgcuucaacuaaguuaucuucucuguacucagaacuugaugugauugcagcagggggagaggauucauauacacagugaaugcaaacgaaccuaaaucaccauucggauauggccacacaauuuucauuucccuuguguuagcaagagauacccuaggcuuuggaccugauuauuccuaaggcauucugauguaugguuuuaccugcagauuuccugguaauacugauaccucaguuugggucaaagaaggucaauuaauugauugauuugauuugacuccuggaaaagacgcuccuuucuagcugucucuuucuucucuuuaccugaauagccagggcucugugguucaagugaaguauuuugacauaaaaauuaacuuagaacauuggucugcagaguuugcucaauauaacugagcacauauuguggcuuuauggagcugguuacuacuuuuugaccaaauaaauaauuagaaguauuuuuccuccucaauaagguucauuuuuccuuuuuucagugagcugguagaguuuccuuuuuugauauuucagggcaucuuucauauuuccaucucuuaaguuucuucauaugaaguagaauuuaucuggauuauguauugcugacucugaugaaaacccauagaaagcaucuggggcuugaucaccuucauucuuguaauagcucacacgguuacagcugauaugguaacuuaagacuuuugauuccaaaucuaggcaaaauacacucaguugaaagaauuugucagccagaacaguuggacuguucugugaaaauugugagaaaaauuacacaacuaagugauacaugaugauggcuuucuuaaauauaaaauuguaauaacaugguuaauuuccaguacguuauauugucccagaaguggcuccaacauuguuugaaauuugucucauuuaaagaaacauaagcuggcuaugguggcucacgccuguaaucccagcacuuugggaggcugaggcaggcagaucaccugaggucaggaguucgagaccagccuggccaacaugguaaaaccccaucucuacuaaaaauacaaaaauuagccgggcauuuggugggggccuguaaucccagcuacuugggaggcugaggcaggagaauugcuugaaucugggagguggagguugcagugagccgagauugugccacugcccuccagccugggugacagagugagucuccgucucaagaaaaaaaaaaaaaaaagcaagaaacauaaagacugggcauguuggcucaugccuguaaucccagcacuuugagagacugaggugggaagaucacuugagcccaggagguuaaggcugcagugagccgugauuuugccacuguacucgagccugggcaacacagugagauccugucucaggaaaaaaaaaauugcauguaaaugaaugaauuugauauuuaauauuuuaaauuaugaaaacuguucuguagagauguagaucuugccauguugcccaggcuggcuuugaacuucugggcucaaacaauccuccugucucagucucccaaaguauaaagauuacacaugugagccacugcaccuggccuaauauuuuuaacuuaaugaauuuauuuugauauaaauaaauuaauaacacugaagcuuccugauauaauaagucuuuuugugugugugacggguucucacucuguugcccagacuggaguguaauggcacuaucauggcucacuguagccucaaccucccugacucaagugauccucccaccucggcuuccugaguagaugggaccacaggcguaugccaccacaccuggcugauuuuuaaaauuuauuauugauacauauuaauaaaauuauuuuuauuuuaaaaaugauauauguggcugggcaugguggcucaugccuguaaucccgacaguuugggaggccgaggugggaggaucacuugagaccaggagcuuaagaccagccuaagcaacauagugagaucccaucucuauagaaaaaaaaaauggcuagguguggugguguaugccuauauucccagcuacucaggagacugaggugagaggauugcuagagcccaggaguuucaaguuacagugaccuaugauugugccagugcacuccagccugggcaacagagcaaaauccugucucaaaaaaaaaaaaaguucgaaaaugcuuaugaugcaauauaaguaguggaaaaggauauuaaauugugccuauaugaacacaacuauaugaaaaacuugcacauagagaaaaggauuaacaagaaauagaccaaauuguucacaugguugucuuguuuguggagagaauaucaguaguucauuuguuuccuuccaaguuuauauguuuuccgaggucucuauaaugaguuuguaauuguuuaaucauagaaaacccuuuuuugguccuuggccacaaacuuacauguuuuaauguaauugcuuuuuuaaugagaauaaauguuauauuuugcuuuuuuaaaaccuauauucccauaguuauaugagcccuuacaauuauuaagaggcugcauaauauaacguuucuggaaggguacagaagaaacagcaguaauuaccucugagaacagagacauggcuucacauuuuacccuuuuguacguuuugugcuuuugccacaugcauuuauuauucuuccaauaaauaaguaaauaaauauggauuguauacuccaucugguugguguuucauaauucuaaaauuauauugcuacauuuuuaaagaugauauguguuucuacuuauuaacguauauguuaaaauaguaaauuuauaucuuauuuaauaauuucccuauugauagacauuuaagacagucucaaguguucacuaucauagaaaauacugcacagauagcuuuugcuauaguuucuuuuuucuuugaaucguuaauugggaauaaaugcucaaauaguuauauguggcucaacugcuauuuaaguuuauugacugacugcugccauuuugaauucugaagggguugauuaaauuuauaaugcugccauaagaauauaaggguauuggcuucauuagcauccaccagcauuggguguuggaaaugauuauagauuuuuaaaugcuacaacaaauguagauaacagagaacuaucuauagaacucuuuuuggacaugugaauuguaauaauaguuuauuuucaugugaauccagaaaaauguauacgaaaaccuuuuuuccucucauuucuuauaugaauagaaucaagcuauagaaguggucuggagucaccagccugcauucuugagcuggguggaaggcaggcauuuuagugaucaaggugaaaauguggcugaaauuaacagacaaguuggucaaaaacuuggacucucaaaugggggacagguaagcacaugugauggcaauaacuuucuucuaauaucacauaauauagcaauagaaauaaaauuaaaaguuuagauuuuuuguuaaaggaggugagaugucaccuaauuuguaugcuauuauguaacuagucuaggauauugaagcugacuauacucuguuuuuaggucauuaucuuguaguuuaccauacucccuacuugcuucuuauucuacuauuuaacucauuuuccacauccccuaauuuugguuucaugaaauuauuuuuccuucugaauuacuagguucuacuuacuauuauuaaacuuuauuucugacauauuuuauaaccuuccauggucucacuugauuaaaaauaaaaaauucagcugggugcgguggcucacaccuauaaucccagcacuuugggaggccaaggugggcggauaauuugaggucaggaguuggagaccagccugcccaacguggugaaacccccccucucuacuaaaaauucaaaaauuagcugggcaugguggcaggugccuguaaucccagcuacucaggaggcugaggcaggagaauugcuugaaccugggagguggagguugcagugagcugagauugcacugcugcacuucagcugggugacaagagcgaaacaaugucuugaaaaaaaauaaaaaauaaaaaauucuacaacacaggguuauuauuuuuccauuuuuguuuucccuuaugaguuuaauauguuuagauuauaaaccugaaagcuugaauaccuaugucuaucuuuuguuuucuuauguuuaucaaguuauuccuuuaaacauuuucuaaacuguaagaauaaugugaggcugggcucaauggcuuaugccuguaaucccagugcuuugggaggccaaggugggaggaccacuugaggccacgaguucaagauuagccuggcuaggcaacauagcaagacccuaucucuauaaaaaaauuaaaaaaauuagcugggcaugguagcaaaugcuuguagucccagcuacucagcagacugagguaggaggaaugcuugagaccaggaauuugagugaccuaugauuaugcacuccagcccgggcaauagcaagacccuaucucuuaaaagaagaagauguaguaauaauacauauucauuauaacuauuuuaccauugaaaguaaaaaaugaguuuuuaccuuuucccagucccauccucagaauggggaucucaguagaccuuuaggauuggaagaaugagaucauucauauuuucugcaauuauuaccccacaaaauauuucagauaccuuuccauguauuacaaacaaugugcauuuaacaugucucucucuuucucucucucucugugugcgucuucaugauccucuguugcagcccugccaguaagacacuaucuccugaagaaucacugauaggaacagaaaguggacuggcuaggccaggaguccuuagcuucuuagggggcaggagcugcuuugugcuuucucagaaucagauauauauguggacugaaacauuuaaaaacagaauagccaagggugcuauacguuuaaaacuuauauagauggggcuacauugcucucuauuacuaauuucccaugacaauacacgagagugccaugucuuuuuaacuuguuuugagcacagacuaaucuuguuuaugcauguuuuuugaugagaauaggcuacucaugagaaaucuguaaaccuaacacuagucccuugcauacucuaaauuguugcuagaaucuuaaaauuuuagcaccagacggaccuuagaaaucauuaacuuuggugcuuuguucuacaauacaaggagauggaauauuuuacccaggauugcuuagcagguuacaguucugcccucugaguacccagcacuucccugugggcaacaucaacuuccugauuuucaagucuuaauuaguacucugaagaauccuacuuguuuuuaacucccauuugcuuugaagugacuuuaccugauuuuuuuagaucccuuauugcagcaaugccacuaagaaacugagucucuagcuucuuggugggcaggagcugcuuugugcuugcucagaaucauccuuuucaguaagggagauauugaagagaaaucuacugaggagucugggggugaggcacucagggaaauccugcuccaguccacaaaagcagagaggaaggguugguuaccuagaguauuuaacaugcagaggcuuuggauuuuacuccuuuaauccuuggaaaugccuauggaaggggaaaggaaguaagauggugacuccagcuuauagacauacuaguguuacauauauuuaaacuauaauaggaggguauuauuaguuuuacuuaacuuucaacugugaaggauuauacuucucaauauuugucuccagugucuauuucaguguauuuuucacuuuucuugaagcagcaugucuguugcaaaacuucuagaaauaaugagaauauuuauauauuagaucaagccauaacuugaugauauagucauuucuucuuauauuuuuuacuuacauuuuuacauuuuaaugauuacuuucauuuuugaaaaacaugucaugcugagauguauuuuucuucauucuguaauuaguuaugaaacaguuuuuccuaaaaugcugaguauaucaagucuuggcuaagaauaaguaauaaauauuugccacaugaaagacuacacauauagccaggugcaguggcuugcaccuguuuucccagcuacccaggaggcugaggcaggaggauugcuugagcccaggguuuccaggcugcagugaacuaugauuguaccacucuacuccagaaugggugacagagccaggccccaucucucaaaacagaaaagaaagauuacauagacuacauauacacccccauccaaaacauacacacacaucuacuuaaccuaaaaugguaagaagauaacuucuuauuuucuaauauaugacacagaaaaguuuuuuuaaaguaguuuuaaauuuuuaauuuuuucuagguauuucucaagccauguucccaugugguaucuugucaacaaguugagguggaaccccucucagcagaugauugggagauacugguaaagaaaaccaaauaagaacuaucucauuuaagguuaaauuacuucacaauaucaaugucuuuagcuuucucuaagcuuuauuauauauucugaguugguuuugaauuauaagaaugaauuggggccaggcacaguagcucaugccuauagucccagcacuuugggaggccaaggcagguggauugcuugaguccaggaguucaagaccaggcugggcaacauggugaaaccccguaucuacuaaaaauacaaaaauuagccaggcaugguagugcaugccauuagucccagucacuugggaggcugaggcaggagaaucgcuugagcccguaaagucaaggcugcagugagucaggaucuugccauuguacuccagucuggaaaacagagugagaccuugucucaaauaaaaaaagaaugaauugauagagaucuaauguacaaccugacaacuauagguaauaaaauuguauuggggauucauguuaaaugaguagauuuuaacuacucuuaccacaaaaacacaaaaguggguaacugugagaugauguauauguuaauuuacuucacuauaguaaccauuauacuaucuauauguagcucauaacaccaugucguguauauuaaauaugcacauuaaaauuuguuuuuuaaaaaaagaauugagauuuuuuuuaacuagauauggaguggacaaaauguaaagugaauugaucuuuucgucuguugguucuaggagcugcaugcuguuucccuugaacaacaucuucuagaucaaauucgaauaguuuuuccaaaagccauuuuuccuguuuggguugaucaacaaacguacauauuuauccaaauugguaggugcuauuguaauauuugcugucauauucuacacuauagcauugaguccaaaguagaaaugaaugugcacuaaugagcuuuauuuucuacacaguugcacuaauaccagcugccucuuauggaaggcuggaaacugacaccaaacuccuuauucagccaaagacacgccgagccaaagagaauacauuuucaaaagcugaugcugaauauaaaaaacuucauaguuauggaagagaccagaaaggaaugaugaaagaacuucaaaccaagcaacuucagucaaauacugugggaaucacugaaucuaaugaaaacgagucagagauuccaguugacucaucaucaguagcaaguuuauggacuaugauaggaagcauuuuuuccuuucaaucugagaagaaacaagagacaucuugggguuuaacugaaaucaaugcauucaaaaauaugcagucaaagguuguuccucuagacaauauuuucagaguaugcaaaucucaaccuccuaguauauauaacgcgucagcaaccucuguuuuucauaaacacugugccauucauguauuuccaugggaccaggaauauuuugauguagagcccagcuuuacugugacauauggaaagcuaguuaagcuacuuucuccaaagcaacagcaaaguaaaacaaaacaaaauguguuaucaccugaaaaagagaagcagaugucagagccacuagaucaaaaaaaaauuaggucagaucauaaugaagaagaugagaaggccugugugcuacaaguagucuggaauggacuugaagaauugaacaaugccaucaaauauaccaaaaauguagaaguucuccaucuugggaaagucuggguuaguauaaauuuuauaacuugggagaaauuuuauguggcuuaaacauccccaaauuaugaauuagaauaguauuucauauauaaauugaaaaucaauuaaaaagaaacacagugccuaaaggcacuugggggacacauuuacgcuuugcaguaaaguccuuguuuggauaaagauuguauguuuucuggccaaguaagcuugaauagguacaagcuuagauagguucaggccagagaggucaaaauuacuugccugagauugcauagcuaguguuacaacuaggauucaaacccaggcagauugacuuggggguucaucaggauggagugcccuacaaagccucccaucuuuaaugcuugcagauuuguuccccaguuaccgaaagcaacuuguuaauauuagggaaaagggccaguguagggagagauccauggcaugagguaaccuuccugcugcaugugguggcaccuggauuggaaugcauccaggagcugcuuacccugccggugucugcucuuuaauuuguguauaacggagaggaaguagacagggcaacuagugcuccagccccucauccuggccacaaauauuaaugcuaccuuuauaugacauaagucacuaguccauuuauuggaaccuaaauuugaaccacuguaaaguaagacuucauagugauaaagagaggaacuuguuaggaaagagaauaaaauagaaagagaagguugucuccuuuuguagauuuuuuuuuuuucuccaacaguuuuaccugugaccuuuauacaaauaacugacaaagcauuaaucucuuuggccuacaucauuuucuuuucuauuuuuuuuuuccacaagauggaguuucacucuucuugcccaagcuggagugcaguggcaugaucuggcucacugcaaccuccgccucccacguucaagugguucuccugccucagccuccugaguagcugggacuacaggcaugcaccaccacgccuggcuaauuuuuuguauuuuuaguagaaacuggguuucaccauguuagccagccuggucuggaacuccugaccucaggugaucugccugccucggccucccaaagugcugggauuacaggcaugagccacugcuccuggccggccuacaucauuuucuaaagcuccagaccauucuuuucuuuucuuuucuuuucuuuucuuuucuuuucuuuucuuuucuuuucuuuuuucucuucucuucucuucucuucucuucucuucucuucucuucucuuuucuuuucuuuuuuugaguuagaagcuugcuuuguugcccaggcuggagugcaguggcaccaccuccacucacuacaaccuccaccucccagguucaaaugauucuccugccucagccuucagaguagcugggacuacaagugugcgccaccacuccuggcuaauuuuuguauuuuuaguagggacgagguuucaccauguuggccaggcuagucuugaacuccuggucucaagugauccgccugccucagucucccaaggugcugggauuacaggcgugagccacugugccuggccucagaucauuauuuucuguuagcuuuaaacuguccguucaggagaucccacugcauccucaaauucaaaauaucuaacacugagcuuaugauuuagcugguucugucauuagaugggaauauccuuuuauuuccuugaaauuauauggugagaacagggagaagugcugaugguaaaguccugugauuaagauagcaauaaggacuccgcccuucccacuccacugaagguugaagagccauggacaaugagaagucacaguaggugaaaucagguacuaaaauggacuuggcuugagagaucaaaauugaucacuuggugauacaacuaacaaauucauguuaacuugaaccuuuauuacccugugaagcauggugauuaaaaaaaaacaacaaacaaacaggaaacuugauuguuaaauucucuuuaagucagaauauguaccuuagaguuuuuauuuaugcuuuugucuaccauuaauaugucugcaccugcucuuuagaaguuaauagagaguaaagucgucuuuaugucuuucagugcuuacuuauauuugggaaguugagaaaaauuuuuaacaucauuauugauauauauauauauauauauauauauauauauauauauauauauauauauauauagauaauuuuuuuuuuuuucuugagacggagucucacucugucgcccaggccggagugugguggcgaucuccacucaaugcaagcucugccucccagguucaagcgauucucuugccucagccucccgaguagcuaggauacaggcucccaccaccacgccuggcuaauuuuuguaguuuuaguagagacgagguuucaccauauuggccacgcuggucucaaacuccugaccuugugauccgcccaccucggccucccaaagugcugggauuacaggcgugagccacugcgcccggcugagguaaaauuuaaaguguacaauucagucauuuuuaguauauuuauacuaguuguacagccaucaccacaaucuaaguuuagaacauuuucauuagggggugggagaaauuuuacucugcuuuuuagauuaaguuucugucuggaucuaaucauuuaaucagacaaucaggcagauugucugugauuaguuuuggccauuccagcuucuucauugguuguuaacuuucacaaauaaaggcugcucaaagauuagaaauaacauuuaauuugaauguaaaugugccauaguuuaaaagauggguuuggugaauacagucaaauacauacauuuaaagcucuaauucugaagauuauguaaagaaaaggaaagaaauguagggagaggauugaaauguucaugguauaacaauaucugaacauccaucuggucacaccguugguauuugaauguuuuguccuccucaaauucauaugucgaaaucccaacucccaaggugaucguauuaggagguguggucuuugggaagugauuaggucaugaaggugaagccuucaugaaugggauucgugcucuuauaaaagagaacugugagaaauaaguuucugucguuuguuagccacccaguuuaggauauuuugauauagcagccugcauggacugagacaacuaugaguuauuaugauagcuucuguuauuucaccuaaauucauagaagcuaauauaucaauauuuaugcuaugaaauauuucuuaaccaagcuuugaauauauuuauauuuuuguuuauuuuuaaauuucagauuccagaugaccugaggaagagacuaaauauagaaaugcaugccguagucaggauaacuccaguggaaguuaccccuaaaauuccaagaucucuaaaguuacaaccuagagagaauuuagugaguucaaauauauauguuacaucaaaauucuuuuacacguuuuguaagauuucuaguugcuuuagcuaaguaauaagaauguuguauuccuuuuugauacaaaucuuuuuuuauuguguuaaacuauauauaacauaaaauaugccauguucgccauuuuuaaguguauaauucaaaggcauuaauuacauucauaauauuguacaaccaucaccacuaucuauauccagaacuuuuccaucaccccaaagagaaacuugguacccauuaaacaauaauuccccguccacuccuuuccccagucccugguaaucucuaauguauauugugucucuaugaauuuacuuauucuagauauuucauauauaaguagaaguaugcauuugucuuauguaucugacuuauuucauuuaacauaauguuuucaaggcucaucuguguuguauguaucagaauguuauuccuuuucauggcugaauacuauuccauugacugcauauaccacauuuguuuauccauucaucuguugauggacacuuggguuguuuccacauuuuuggcugcugugaauaaugcuacagugaacauugguguacaaguaucuguuugaguuccucuuuucagcuccuuugggauauaccuaggaauuauguuuaacuuuuugagaagcugagaaaucuuuaauaaaugauaacacaaauacuuauauuugccaaugcaaauaugaauauuuuuggcuuuuaagagauugaucauuuugccacgugguuguaauuaaaaaaaauugucccauguuguuucaguauuaauauuguagccuaaaagagugcuagacuguuuuacuuuuuacucaguuaauucuuuggauacugguagagucaggaaaugagauauugaacuuaaagaucuuugcaggugggguccaguggcucacaccuguaauccuagcacuuugggaagcugaggugggaggauugcuugaggccaagaguuugagaauagccugggcaacauagcaagaccccaucucuacaaaaaaauuaaaaaaaaaauuaagccaggcgugguagcucacgccuguuaucccaacacuucgggaggcugagauggguggaucacuugaggucaggaguuggagaccagccuggccaacauggugaaaccccaucucuacuaaaaauaccaaaauuaucggggcguggugcuaauccuguaaucucagcuacucaggaggcugaggcaggagaaccacuugaacugaggagguggaaguugcagugagccuagaucucaccacugcacuccagccuggguaacagagcgagacucuauuucaaaaaaaguaaaaauaaaaauuagacacaugugguggcacaugccuguaguccuagcuacucaggaggcugacugaagugggaggaucucuugagcccaggaguuccacacugcagugagcuaugauugugccacugcacuccagccuaggcaauaucucaaaaaaaauuuuuuuaaauagauuauuaggccagacgugguggcucaugccaguaaucccagcacuuuggaaggccaaggcaggcggaucaccugaggccaggaguuugagaccagccuggccaacauggugaaaccccaugucuaccaaaaauacaaaaauuagcugcaaugucuauaaucccagcuacuugggagccugaggcaagcgaaucgcuugaacccgggaggcagagguugcagugaguggagacugcgccacugcacuccagccugggcgauacagcgagauucugucucaaagaaaaaggaauuuguuuuccugucuuuaucguagagggaggaaagggagaaugggguuggaaugguuauugagugagccacauuaugguagauguaucacugggcauagagaaaaggagcauuuaaaacuuuuccgccuaacagauguuucuucaggcuacacugcacucauugugcuaacuguaaugucaaaucccagaccugugccuauagaacaugaacauccuucauuggauuuguuuggucaggcuuacacuuuauuaggaagaucagauguuaaaauaaggguguuaaaguuaaguucagauaugaggauaauucauuacuauuccuuuuucuggcagccuaaagacauaagugaagaagacauaaaaacuguauuuuauucauggcuacagcagucuacuaccaccaugcuuccuuugguaauaucagaggaagaauuuauuaagcuggaaacuaaagauggugaguacauuuguuauuuugacuuuuuuuucuauuuaaauaguuguacauuuuuaauuguucuugcaaccugucauaccugugaacaguaugugaauagugaaauauaauuaugauaauuaaacaguaguuuuuauguauugaaaaauaucuuuggccgggugcaguggcucaugccuguaaucccagcacuuugggaggccgaggcaggcggaucacuugaggccaggaguucgagagcagccugccaacauggcgcaacccuaucuauacaaaaaaauacaaaaauuagccugacauagugguguaugccuguagucccagcuacuugggaggcugaggcagaaggaucacuugagcccaggaggucuguguuccugccacugcacuccagccugggcagcagagugagacccuguuggggggaaaaaaaaaaaagucuuuaacuuaaauaaauuugacauuuaaaaucuuaaauuauuucaucucuguuucaguacuaacucugcauuuauuacuuucuuuuuaauaggacugaaggaauuuucucugaguauaguucauucuugggaaaaagaaaaagauaaaaauauuuuucuguugagucccaauuugcugcagaagacuacaauacaaguaauagcauguuauugaauauuuaauaaaauacuauuuguuacauaugauugauaauaaaguaugaaguuccuuguaacaccuugcauugugaaguguauuaaaaaccugcuaagaguaaggaauaacuugauuuaaaauauuuuauucuguaaucucuuuaaauuaucuguacaaauuauugacuuaaccuaaauuuaaaaaugaaugccuuagcacaauuaaguuccaagaauagaguugaucauguuaacugguaaauggaucaugauuuaaaauucuucuaggauugaaacaaaugaaaacguaguuuuaaggguuugauuuuuuaaauuccuauuuuuacaugcaauuuuacugcacaacccaucuuauuuugacaguucuuaaauucgcaacucuucagaaauauuaucagaucacuuuucuuugcuuccauaaguuuuuuuauuauuauauuauuauuuuuuuuuuuuaaaagacggugucucacuuugucgcccaggcuggagugcaguggcaugaucauggcucacugcagccucgaccucccaggcucaggugauucucccaccucagccucccaaguagcugggaccacaggcgaaugccaugaugccuggcuaauuuuuguauguuuuguagagauaggguuucaccauguugcccagaauugucuugaacuccuggguucaagcaguuguucugccuugcccacccaaaguugugggauuacaagugugagccacugcgcccagcuauucuagaaguauuuuaagagucaucuuuuuuuuuuuuuugagauggagucucacucugucacccaggcuggagugcaguggcacacucucggcucacugcaaccuccaccuccuggguucaagugauucuccugccucagcuucccuaguagcuaggauuacaggcgcaugccaccaugcccugcuauuuuuuguaguuuuaguagagacgagauuucaccauguuggccaggcugcucuugaacuccugaccucaagugaucugcccuccucagccucccaaagugcugggauucuaaguguaaaccaccacacccagccaagaguggucuuuuuacaauauuauuuuuugauuaggacauucauucuugucauaaaauugaagauacucuagucauuuagaauuucauuguuuuggaacuagacauuguuucuuuauuuuugaaauguuauugaaggaauaccauuuggagaagauacaaauguaagaauugugaaaaggauaauugugacacaaaucaaaauuauagauaaaaauauaccuguaaaauguauuaaggcaauaacauucuuucugcuuguugaccauaaauauuuauauucccuggauggguacauuguuauugucaaggguguuuaaauaaugaucuugcaugcauaauuuauucucucugguauaacagaaucagcaauuuaguuuucugggacccgagaaaaacaugcaaaagacauacuuugaaauguaaaacugauuuuuccuugcaacuguagguccuucuagauccuaugguaaaagaagaaaacagugaggaaauugacuuuauucuuccuuuuuuaaagcugagcucuuugggguaagaaguuauggccaaacuagcauguuagacauguuuuuaacacuauaucuggcagaguuuucaauguaaauauuaaaguagauguuaaugucaauaagugaucuuaauaaugcaucaguagauauuuuuucaaggauugucucuaucuucacgccuagcuuauaauuugccuugucgucuuuuuuuuuuucucuuuauuuuuauguuuuuauccaucccuggugguaggggauaaccuugucuucuucgauaacaagaagucugaagcuuauuagaaauuuuacuuugagaauugaucgaugagaagaaagcaacuagauaucacguggaucauauaugcuugaauaaaacaauaauucuuagaacaaauaaauacauuuuaaaaguuaaagccaaaaacauuaguugaauguuuaaaaauauuucaaauuaaguuauuccuucacugucuuguauuacuguaauaauuuggauuauuuguguuuuucucaacuuuuaaaacaaauauuuaaaaaauuccucuuuugauuaaguagggcuagauaaaauauaaaaaauauuuuuuaaacuccucuuaauuuccauauuucuuauauaauaugagaaucucuuauaaacacuaccucuuagaagucuccacagaagcuuugguagauguaguaguagggauuugauuucuuagaaugguauaaucuguaaauguuuuaguaaaaggauuaaacgauaaagucaaaauguuuauagcacaguguuuauuaauauaaaauaaaaucucuuuuuuuuuuuuugagauggacucucacuuugucacucaggcuggagugcaguguugcaaucucagcucauugcaaccuccgccuccuggguucaagcaauccuuccgcaucagccuccuaaguagcugggauuacaagcaugcaccaccacaccugccuaauuuuuuguauuuuuaguagagaugggguuucaccauguuggccaggcuggucucaagugauccgccugccucagccucccaaagugcugggauuacaggcgugaaccacugugcccagcauaaaguaaaaucucuucagacucucaugugaucauguaaaguggcaggcagucacagucaagaaguaguuuaaaguucauguuuguaaaauauaaucuacagauugauacuggauuucauagguaauguuuaagagaaaauaaguuuuuaguuauccucaguacuucaaaagcacccauuuaugauuauguugauuacuaaacuaaaucauuugggggcuagagguguuuuuuuauguguuaagauuccuuaaggaguucuauuagggcaaaacuuuuaguaacugcauauuuuaaaaguaauaaaacuaauuuuaaaagcuuggaggcugggcgcgguggcucacaccuguaauuccagcacuuugggaggccaaggcggguggaucacuugaggucaggaguuugagacgagccugagcaacauggugaaaccuugucucuacuaaaaauacagaaauuagccaggugugguggugggcaccuguaaucccagcuacucgggaggcuaaggcaggagaauugcucgaacuugggaggcagagguugcagugagccgagaucaugccacugcacuccagccugggugacagagcaagacuccgucucaaaaaaaaaaaaaaaaaaaagcuugaagucagauucgacauuaaucaguauacuuucucucaaguaggggacaauuucuaagauuuuagucuuuuaaaauuuauuaacuagucugagcaugguggcuugugucuauaaucccagcacuuuguggggccgaggcagauggaucacuugagcccaggaguuggagacuagccugggcaacauggcaaaaccccgucucuacaacaaaugcacacacaaaaaacccaaucagcugggugugguguuacacuccugaagucccagcuacucgggaggcugaggcaggaggaucaccuuugccagggcguuugaggcugcagggagcuggguucacaccacugcgcuccagccuggaugacacagcaagccccuuucucaaaaaaaaaaagauaaaaaauuaaauuaaauuaauuaacuacacugggaaggcaaaauucagcauuuuuuuauagcuaaauuuuauccugcuucagucuuuuaucauguaacuauguauauuuuuuacagaggagugaauuccuuaggcguauccuccuuggagcacaucacucacagccuccugggacgcccuuugucucggcagcugaugucucuuguugcaggacuuaggaauggagcucuuuuacucacaggaggaaagguaagugguuaagguguguucauuuuucuguaacauuuaauaacuuuucauuuaucuuucuuuggguuuugaccaucuauuauauaggguggguuuugaccaucuauuauauaggguuuauacgacauauggaaagcauucauuuauucacuaauauuucugugugucugcuuuuagguguugggggagugaugacgaauaagacugauguucuccaugcccuuuuucugugucaguugauacaauuauaugguuuuucuuuuuuaggcuauuagguguugauaggguugaguaacuuacaaauguugaaccagccuugcauaccugugauaaauaccacguaguugugguguaucauucuuucuacauugcugaguuuuaucugcuaauguucuguugagcuuuuguccauuuaaguuugaaagugauuaguuugcaguuuucuguuuuuguguugucuuugucugguuuugcuauccguguaaaucuggccucauaaaaugagaugggaaguauucucuccucuucuuuuguuuuuuuggaagagguuguauaaaauugaggcugaaucuuggugguugccacaaugacaggaacuauuucugugacugaauauauugggaauuccuauaaagcaauuauuuucuagggaaguggaaaaucaacuuuagccaaagcaaucuguaaagaagcauuugacaaacuggaugcccauguggagagaguugacuguaaagcuuuacgagguaugaguaugguaacacucuauauaaaucccuuuuucauuagaaagacaggaauguuauacauaaugcugucaaucuaauaaauacacauaucaucuagucuuuaacuuuucuguuuaucauuuagucauuaaaauuucuuuggcuuucuaauguuuuugauaaaauuucuaaaacucuccauauuuaauggaggccuauuuuuuuuucuagccagaacuuuuuguagacuacauuucuggaagugcucacugacaccacucugaaaaauuaguacuuagaauauacucuaauugguauaaaugaucucugaauugcuauggaaaacugggagaaugguugcuucaggggagagaaaguaggaggcuguggacagcaaugaggagaauuacaguucaccauauaacacuuuuguacuuuuaaaguccuuaacauuuacauuauuaucuauucaauuaaaaaauauugggaagauuuuacuuugaacaguuaauuuuucccccauggguaccgcugucauauaguuccaacuaaucaugaacuuguguauuuccuguucuuuguaaauuuaaacuuuguaacucaccaggaaguuugaagccaaauuuguguuucaaauauagcaacuccaggaucucuaggcagaugcauuugcauuugauuuuaaaugaaucuugaucccuuacucucacuuauguuuucccacauccuacuuuuuuuauuuuguuguaagccaucuaaaauucucaaugggaugaaacuggguauaaaugaauacaugcauacaggaauuauaguagcauauuccuuuucuuuuuucuuuuuuuuuuuuuuugagacagagucuugcucuguagcccaggcuggagugcaguggugcgaucucggcucacuauagccuccaccucccagguucaagcaauucucgugccucaaccucccgaguaauugggacuacaggugcaugccaccacaccuggcuaauuuuuguauuuuuuaguagagaugggguuucaccauguuggccaggcugaucucaaacuccugaccucaaagugaucugccugccuugguuucccaaagugcugggauuacuagcauaagccacugcaccuggccuccuuuucugaguuuuauaaaauuugauacuuuacugcacgcuuugagacuguauuaauugaaccauguugaugaacaaguuuuugugauggguauauuaauaaaauauagaucaaauuuuuauaguuaaaucaauaucgagcuuuucuagugcuuucaaaaggacaaccugaauuuucccagcacugaaaugauacugaaaccauuucauaucuucuguauuaaggaaaaaggcuugaaaacauacaaaaaacccuagagguggcuuucucagaggcaguguggaugcagccaucuguuguccugcuggaugaccuugaccucauugcuggacugccugcugucccggaacaugagcacaguccugaugcggugcagagccagcggcuugcucaugguaaaugcauccaccacuggcuuaaggucuuguucuuuugucagucagcauuuuuagucuuaacaauaaaucuacucucuucagagaauaauauauguguuauguuaaguguuguguuugaggccccugauggcauucuacaguuguccuauagacuguaauagcaaaauugguagaguaaaaacagugugaaaauucugcaacuucaugguuaguccuuuaggguuuuucauucucccuuacuuauuguuuaauuuacagauuuacucuuuuguucauuugacaaauauuugucaaaugcuugugcacagucuguauucucaaauucuaggagaaaaagaagggugaacaguauuagcgcagaacgauacuaauaaugauggcuacuguguaugaguagccagcccuuucuuggcuuucuuggauugcuuuguauucuacaugaagauauucccugggcuuuacaggucaauaaauggaaauucagagagauuaauuugaccagggugaccaacaaggagaugacagcauacacuaugcgagaaguauacacagaguaguguaggagcauauaaccuaaacugggggugaggugggauaaggaguuaucagggaaggcuuuuuggaggaguugacaacugagccgaguuuugauggaagaguagaaauuagcaugaaccaauuucaugcuaauaaagaagcaaaggaagcguggucuacaggcaaaagcacagagguacaggaaguaaugauauguuggggaauacccuguugacuggagcuuagagugcaaggagaggagugcuagggaggugagguuggaggguuuggcagcauugacuugcuucaagguucuuaagagcugaaauagauauaaaaugcaacuaagaguggcuuggauuauuauuaccuaguguguuaaucucaaauuuugaaaucuauagcaucuauaggacugguguuacuaaucuuacacucgaucuguuacuguucuuauacuagaucuauuaguccaguguuuaagggaguggugcagauuucuaggucaggacaggacucagauguacauuauuaaugccuauuucaguucugaccuucucauaugaaaccuuauaagaccugggguaggaagagauuguucuggaagucauaggaauaugaacuguauuuuguuuaacaaacaauacaguauggaaauuuaucacccuuccagaauauuuauuucagagacaaauuuuuaucauucguucauuuauuucauaagauccacgaguagggaaccucacuagacauugcucugaguauauggucugaguuugcaguaccucuugugucuccauuagauuuauuagguccucaauagauaaaucagggaauaacuagauggauucauuuuuuaaagacaugaaagagcgauaccauacauacugcaccuuaaaggucaaccuuagaguaucauuauuuuuaaugaauguauaauuuuuaaauuucauguuuacuuuuccuaagcuuuugcacuauauugcuuaauuccagcuuugaaugauaugauaaaagaguuuaucuccaugggaaguuugguugcacugauugccacaagucagucucagcaaucucuacauccuuuacuuguuucugcucaaggaguucacauauuucagugcguccaacacauucagccuccuaaucagguaauacacuacuuguaaggauuauugaauuaugucccuuuuauagaaauuauuuuucaauuuuauuaguaauucguggcuuuaaauuuaugcuucucuuaaugauuuuaaggauauguaagucaacauuuggugcauauugugcuagaggcauaaauuauaauuuauagccaccugaaauguuaguaugcgcuuuccaagaaaaugacuuuuuugaaaaugguauuucuuugaaugagaaagaacagagagaaauagauagauggcuuuuaaacacuucauuaauuaaacuuuuuuuuuccaccaucacauaauggcacuuaguccccuuugggaacucaugaggguuuuagugguagugagcugaaagaaauauguuccaggacuggcaaacauauucuaaauucuuuaaaauuuucaccuagcaucuacccuaaauauucagacccugugcuaguuaacugcuauugaagaacaaagguauuauaucuauuauuaaggauaauagaaugguauuugagauauuggucauugaauaugaauauguuuugagaaauaaguuuuauaggaaccaaaaaaaaauucuuaaaggaaccauauauuacuaaaaaugcuucuuauuggagaaagaaaugacaaucauuuauuaaugugauuuuuucacaacuuuauuaagauauaauuuaaguacaacaaacucacauaaaguguacaauuugaucaguuuuaacauauguagaugccaugaaaccaucaccacaauuaaggaaacaaacauuuucaucacuccagaagucuccuagcccuuuuacuacccauuccuccccugcuccauccccagacaacuaccaauuugcuuucugucacuauagauuugucaaccugauuuucuccaaauauacauucaaaaauauacaguugaauacaauuggaaauucgaauuuuguguuuuuuucuuuaggaacaaagaugugaaauucuguguaauguaauaaaaaauaaauuggacugugauauaaacaaguucaccgaucuugaccugcagcauguagcuaaagaaacuggcggguuuguggcuagagauuuuacaguacuuguggaucgagccauacauucucgacucucucgucagaguauauccaccagagaaaguauguuuuacuauuaaaaccugaacuuggaaucuucuuucuauuguggagaaauguaauuguaguaagacaagaauuaaauauauuccauuguaguauuugaauaagcaguuauuugaguagaaaauuaguguuuccagcuaagaugauggcauauuuugaaaauucauauagugaauauaacuaguaaaagaaguuuuguuuauuuuuaaacagaauuaguuuuaacaacauuggacuuccaaaaggcucuccgcggauuucuuccugcgucuuugcgaagugucaaccugcauaaaccuagagaccuggguugggacaagauugguggguuacaugaaguuaggcagauacucauggauacuauccaguuaccugccaagguauguuuaaaaaaagaaaaagugaauacuuacucccagaagaaccacuguauuauuggcuuuggcuuuaugugucagcuugcccaaucuccgugugagucaacaaguguuuacugaguuaccaaauaaaugucuuaacacuauuuuagguacuuuaacaaauuuuaauuuuauuaauuaauuuuuuauuagaauugagaccucacucugucaucuaggcuggaguacacucacagcucacugcaaccucaaacuccugggcucaagcaauccuccugccucagccuccccaguagcuagaacuacaggcaugaaccaccaugcccggccaacucuuuaauuuucuuagagacggagucuugcuauguugcccaggcagacagauuuuaauguguaugaugcagucuuugaugauaagaaacuuauaauggaaagcugaggugauaguuacaguaaauacauuuugauguauaauucuguuugcuuuaaucauucaaauuguaguaaagcaagaugaacugucugcugggauuugagcagaaauggauaggaauaaacuaggagguagaagaguuaucaagguucacaggacugaugggugaagcuagauuuccagacccgggaugucaguccuugaaaagcagacuuggcaggcauagacgaggcagauagcaggauaaaggagacaaauguagauuguucuucagaagaucagaugguagagucuaggagguaguguguuuuaaucagagaucugagaggcaaagaucauugcaugagaucagggacccaugcaaaggagugagaaaaaaaacuggguuaaggagccugcugcauggcaacuccugggaacaguggccacuggggccugggacauguugauugcagcccaggacuguuaaaaccagugugagagaacauggguauggaaguacuagcuagcaggaucaugaccccgaugcugggauggggcaucaagcauuaguacauggagauucaguacauccagaugcaguacauggagacuauaugcguaacugcugacuuugggcuucuuucagauuggagcagagguagaggugagugggaauauucucaauagagggaacuaaauaggcauaccuaauaaaggagaccaggauauugcagacaguagccucauguuuggcucaccuguucaaaaaguucucuuguucuugagcaguggugccuuaaaagguaacuugagaagcagucgauuauuuguucagccuggagacucuugggauauuuuacuaucuuugauugaauagauuuaaauguacacagcucucauaacuugccccaugaagcauauccaugaaaggcacuauacuuguuaaaagauugguuuguacuuuuuaaauguaguacuuuuaauaaaacaggaaaaauagaaguucugaugcaguuauaugcauuuuauauagaauguguucuuaauuggaaaaaauuugucguaguuccuuugaguucauuuacaguuuuuaguaggaauuguauuuucuacuguuguacuugcuguuacuaaagaaagauggucgugauuaccaucugaauuuuuuuucuauacauugaucuuuagcugcuacuuagucauuucuguuuagacuugagcucuuuuucauauuuuuuuuuuuuguuucucaguauccagaauuauuugcaaacuugcccauacgacaaagaacaggaauacuguuguaugguccgccuggaacaggaaaaaccuuacuagcugggguaauugcacgagagaguagaaugaauuuuauaagugucaagguauguugucuacuuaucuucuuuuuuuauuuagguaaaauuaacauaaaugcaguuagccauuucaaaguguaaauucacuggcauuuagugcauucacaaugcuaugcaaccaccaccucucucuaauuucaaaacuuuuucauuccacuccuccucuugcuuauccccuggcaaccauucaucugcuuuuugucucuauggauuugccuuuucuguauauuucauauaaaacaaaucaugcaauaugugaccuuuuuugucuggcuucuuucacuuauguaauguuuucaugguucauccagguaguagcauguaucaguacuucauuccuuugcaugacugaauaauguuaccauacuuuguuuauccacuuaucaguggugaacauuugaauuguuucuaccuuuugacuauuaugaauaauguugcuguaaauauucaugcacaaauuucuccacggauauguuuucauuucucuuggguauaaacugaggaguagaauucuugggucuuaggguaauucucuaacuuuucaaagaaccaccaaacugucuuucacaccaacugcaccauucccacuagcagugugggggguuccugauucuccacaucuuuaccaacaccauuauguuucucaauugugggcuagucucacauuuggaaagcuagugggagcagcgauccaucuauuaaaaguuguaugaaauugaguaaugagccaccucucucuuguagggcuuauuauguucuugcuuaaggcaaucuucaugcauugugaacagaauuauacauaaaugcucagauaaaagggcaaaccauucuuaaagggaguagacaacuagaggcaggagaccauacugaggcaggaagcugggguuuuuaugguucuguuacuuuugacuauaucucaccauugcuuuugucaaagugagacuaggucuaaguuuuuuucagguauaaggugagugugguaauuaaggggcaugcuagcagaucauuuuggguaaugcuucacaguccaccacuggugugucauuguggucgcagauccaguaucuuagcuguguaauuucagacaucagcaauauuaguuuaacaaagggcaauuagauuccaagacaaaggaaucguguauuauucuagccuuauucaaacuugauuuauaaaucaguuuaguaauuuauuuauuuguuucuguauuuauuuuuauuucuuugagauggagucucacucuauuggccaggcuggaguguagugaugcaaucuuggcuuacugcaaccucugccuccuggguucaagcuauucuccugccucagccucccgaguagcugggauuacaggcuaauuuuuguauuuuuaguagagaugggguuucaccauguuggccaggcuggucuugaacuccugaccucgagugaucugcccgccuuggccucccaaaguucugggauuacagacgugagcuaccgugcccagcucaguuuaguaauguauaacuggguuuuacccaguuguaaauuacucuuuugucguguuuuuuugagaacuggcaaugacggagaaacuaaaagugccaggcuguugccuuguuccuguuauuuugccuuaguuuuuuuuuuuuuuuuuuuuuucucugagacugagucuuguuguguuaccaggcuagaguggaguggcaugaucucggcucacugcaaccucugccuccuggguucaagugauuccugccucagccucccgaguagcugggauuacaggcgccugccaccgcacccggugaauuuuuguauuuuuaguagagacgggauuuuaccauguuggccaggcuggccucgaccuccugaccucaugauccaccagcuucggccucccaaagugcugggauuacaggcgagaaccaccgugcccggucuugccuuaguuauuucuuguucccuccucuaguccuauaguucucugacuguauugaggaaauguaauuaaauauuauuauguuaauagauauuuaugugguugaauauuagaaauuccuuauuuuggucacauauccugaucaguaguuggucuucuggagauagugauuuuucacuagagaugacuuuaggaccuauucagguuuuuuuuaagaucccaauuuaaggaaagacuauucucauuauugauuuugcuauaugcagggaaauuuauuucgaaagguuuuucaguuggcuuuuagggaagauuauauauucucuuuuuuuuuuuuuggccuuuucccacauguucuaaaaaugauauauucuuuaacuccuaugaaaauacauuguuucaguaauugaagaugcugauuaaagucauaucucuacacauuuuuuaaaauuugagauagaugggacuuugucccuucuuacaccauucacuuauucacuuggaaaaacuauuauccaauacuuauguggcagacacuguuucuggcacaagggauucagcagugaacaaaacugccuuuuuggaguuuacauucuacuaguggaaagcgacaacaagcagauagacacauucaguauauaauucacugucagaugguggugguaaguccuauguaggaagaaaagcaggguaaggaggcuuggaguaacuggagugagucauagauggacuugucaggaaaggguuucugaagaggugguauuugggcagagaucuaaauaaaaugaagcaacaagccaugagaauauccgggggaaaauguucugggcagaagcaucaagcauagaacuugugguaugauauuuauucuagcacacauuaauuuuaaaaauguauaaaagacauccauuuaaucauauuaaagauuuccaugauucauuuagacuuagucagaaaccaaauuuauauuuucuuuuuaaauaauuuuaucucaacucuuauuuuacccaauaggggccagaguuacucagcaaauacauuggagcaagugaacaagcuguucgggauauuuuuauuagguugguagccuaugaauguuuuuaaaguaacugacucuguuauuauuuaucaaucagugcuuuuuuuggucuuguuuuuugaagaacugauauuugaaaccugugguuuaugugaauuauuaauaagcuagaggacguggauucucuauuucaucaaauaauacaaaacauuuuagauauuaaauuuuggaaauuauuugguuuuguuuuacaauagaaauacuccucaaaguggaaucgaagugguuauucaaagaaaucucagaguagauucuuauaugaagcaaauaauugccccuaauuuaucucuaaauuuuguaaguucuaaauucuuuuuucccccaguuucuaauuuaucucuuauaagucaagaguccaucuggccaauuuaauuucagugaguguaacuauuuugcauauauuaaaaaacuguauaugaauacagaagaugguauuuaaggaugaaaauaauuauucaaaugugauagcauuauggggaguuuuaaaauaaaaguuacuguuuuauucuuccaaaaauuuuauuauaaaguauacaguuaagagaauauacauaaaauacauaugcagcuuaaggaagaauaauaaaaugaauacuucauguauucaccaccgaguuuaccaggaaaaagcauaaacaaaauaaaccucuuccacguaauuccuggguuaaagagaaguuauaguggaaaauauuugggagcaaacgauaaugaaaauacuauccauuaaaauuguuagauguugcaaaacugauuucaaggaaaauuuauaguguuaaauguuuagaaaagaaaaaagguuagaaguuaaccacuuauguaucuaucucaugaaauuaggaaaauuauagauauaaacuaaaaaauauguuaaaagggaaauaauaaagauaagaaugaaguuuaaugaaacacaaaacagagaagcucacaaagccaagauuuauuuuuugaacaccgaguacaauugacaaaucucuaacaaguuugauuaagaaaaaagaaagcaugaauaaacaauuuuagggauaaaaagggaaacaucgcuaaagauaucccagaaauguaaaagauaauaagggaauauuaugaaaauauucaugccaauacauuugaaaacuuaggugacauagacaaaaacaaaauugaccaaaauugagcaaaaaagaaacaaaaucugaguaguccuguaacuuaguaaaaauugaguuagaaaaguuaaagaagucuuuacacaaaucaaacaucagacucaguuuucuaggagaguuuugccaaacauucaaguagcagauaauucuggucuauuuuuggccccagaagauauauuuuacuugccaugcauuuaaugagauagcuguugauuuuuuucaaucaccgugacagguguuuuauauuagguguuauucgccagacaucuaguccaccuguugccagauauggaauuaauauucacuuauuuugaauuaaaauuuguuaauaaauuaauaaaacaaagucaaaguucaaauuauuaaaaaaguaaaagaaauaaaauauauuuuauagagagcccuuacaaaacaguaccaacauaaugagcuuuccaaauuuugaaugggcaaaauaaaugaauaggcauuucacaaaagaaggaaggguggccaauaaguauauauuaauauaaaaaugguuacuuguaauaggaaucaaaaguguuugacuuauugacuaagagucaguuuuuguuuugaucccuguuagucuauccagaaggcaugggucuuaauaaacaccuugaccucaacaguuuacugaauacaaggguaauuucauaugccuugccuucuuuaaggguuuguuguaaagauuaaaauaaauacauaaauauauauaaauacauuuauauguauuuauauguaauuacauacaacuugccuucuuuaaggguuuguuguaaaaauuaaaagaaguauauaaauauauauaaauacauaaaauaaauacauucauauauguauaugaaaucacuuugccaacuaugaagccugauucaaauaugaaauguuguuuguuuuucccagagcacaggcugcaaagcccugcauucuuuucuuugaugaauuugaauccauugcuccucggcggggucaugauaauacaggaguuacagaccgaguaguuaaccaguugcugacucaguuggauggaguagaaggcuuacaggguaauaauuauaaauacagaaauagaauguuauaacaaaaugucaucaugucaucagauuuugguaaaaaaauguucuuuuuuccucuagguguuuauguauuggcugcuacuagucgcccugacuugauugacccugcccugcuuaggccuggucgacuagauaaauguguauacuguccuccuccugaucaggugacaauuucauauuuagaguccaaaacccaacaaaugcuacacucuuuccuugugagcuuuacuucugccagguaauggcaauuguccuuagaagaccagcuuucuuagggaaaagcuuuagccacuguuugcucaaagcauaaaaagauucugaauuagaugcaaagccuuuuuuuggcccagugcaagucugaaaacuuuguaauccuucuguguuggcugauuggggaaaaaaaaaugcaagaaaccuaauguauuauauuuucacauuaucuucuguucaaagauuacauacuuccauuauccugucaaaaaaaaaacucugauacagaaucaagcaugugaaucguaagcauguaagcagguuucauagagauaauuuuucaacucuuccuuguccuguguuguuccaacucuuauucuccaauuuagaagcaaacaaauaaaugaaugaaagaacagauagacaaaugaauagucaaagguauaaaguaucuguauauauguuacauguagcuauuauuuaaauuauuuagauuuuccuuuugaaauaccuucuuggcacacuugccuaaaucuagaaaauaagcacugugugaauaagaaauuauuuacacugaauauuuuguagguuuuuggguuuuuguuuuucagacaaggucucacuuugucacccaggcuggaguacacugguacgaucacaacucacugcagccucuauggcccaggcucaagcaaucuccccaccucagccucccgaguagcugggaccacaggcacacgcuaccaugcccagauaauuuuauuauuaauuuuuguauagagauggggucucccuguguugcccaggcuuucuugaacuccagggcucaagugauccucccaccucaaccucccaaaguguugggauuacaggcgugagccaccaugcccagccuuaagaguguuugauuuucauucauuuuccuauauauauuauuucuguuggggaaaaaauuccaaggaagauaaauaguaggcuguugguacauuucucaacuuacuuauaaagcuuuuuagauauauaagguuaauuuaugaagaaaaucauaagauacacaauuuaagauaauauuuuuaauuuuauuuuuuauuuguuaaauaaauuuuucuccuuucaggugucacgucuugaaauuuuaaauguccucagugacucucuaccucuggcagaugauguugaccuucagcauguagcaucaguaacugacuccuuuacuggagcugaucugaaagcuuuacuuuacaaugcccaauuggaggccuuacauggaaugcugcucucgaguggacuccaggcaaguuauaugaggaaguuguuaugacauuuuaugagugauaaaagaaguacaaugucaaaauuuccaccuuaaaaaaugcuauuuuuuaaacaacuuugguaaaacuguauagaaacauaaauuuaccuuuaguugaauguuccauaguuggaauauggguuuugcagagaauuuauaauuaugaaguuugaugucuguuucuuuaacauuaccuuaauauuggcaaaaacauguugguguuugcaaggauauuauuuaaauugggauaccaugaauuaaauacuacaaacaaaaauaauuagaguuuuuuguuuguuuguacuuuaacuuuuaaaaaauaaucaguuaaaguuguuguuuugaagcucacauuguuccaaucuggccaauaggagccccuuuuguauggcuccuguaucuuuaugacauguccucaucauucuugaaucacuuccucacuuccagauacaguaaguuauucuuggccaggugcagugguucacgccuguaaucccagcacuuuggcaggccaaggcaggaggaucauuugggccuaguuugagaccaaaucaugguugcacaaacuguacccacuauggacaacagagugggaucuugucucugugaaaaauuuaaaaauuagcugggcaugguggcacauaccuguaguccuagcuucuugggagaggcuguggcaggaggaucgcuugaguaaauccaggaugcagugagccaugcuugugccacugcacuccagcauggaugacagaaugagacccugcccccaaaaaagaaaaauauucuugguuuaucuuguacuuucuguaucccagcccuagcaucagccuuuucucuaaagacaguauuaugauuuuaauauuuacaguagauauuugaacuguuacauuauagacuuuaccauauauuuucuaggaaggauuauucuauuacucuucuuuaccacauuuguuuggaaugucuacagaaccuacaguuucuaaaucagaaacucccuagguuuuugcuauuuuggcaagccauugaaguucuucccucucccuuuacuaccagaaagguguguauuuguagagcucucuauaaugagaaagcacucuauaacaugguugauucaucauuuuggaguagaaaaguaugaauggaaagucagagacauaaaaauaaagcccagaggucugagucuuagcuucauuacagacuuucuugggggaugguugguaaauuaucuacacauucuaucuugucuuuauaauuuuaauaguuaaauuuuuaccaugugccucaaaaccguuagagaauuaaugagcucuuugaaaaaugcuucuaaguuucuuguauugcucuaauagaaugcuaucuauguuauuauuuauuucugagacuaaaauuguuuacaucuuuaaacugguuguccuuuuguguauuuuaggauggaaguuccagcucugauagugaccuaagucugucuucaauggucuuucuuaaccauagcaguggcucugacgauucagcuggagauggagaauguggcuuagaucagucccuuguuucuuuagagauguccgagauccuuccagaugaaucaaaauucaauauguaccggcucuacuuuggaagcucuuaugaaucagaacuuggaaauggaaccucuucugauuugguaucuugugcagucaucauuauacaguucugaaauauaaagcuauauguugguguaaaguugcagugauuucucuccuaaccagccccacauauucuuccugguugguugguucuucaguaaaauagucuuguuucuugcuuacacuaauugguaauuugcauuccuuguuaagauuuucaagacagggcugggagcaaggaaccaaaguagcgcgugguugugauuaccuuugguuucuuugagguuucucuuaccuaguggcuuuaaaacaucuuuaggagcaguuccauuuuauaguaaacuuaaauucuguuaucaugaacaguugaggauaaugaauaauuugauacaauaauguaagaaauuccugaaaacaaaguguuaucugugauacuuuugcugcauaguaagcacaaugaaguguacugauaauguuucaacaggaaaguguuuugauuaaaugugggcaguaucacuguucuacuagcauucaacaucucuucuaaaaauuaauagugguucacuguaauuuuauugguacauguaacaucuguacauguguuugguuaucuauauguuuccugguuuuuuguacauuugcuuuauuaauuuaggcuuuuuuuuuuuuuuuuuuuugagacagucucacucuaucauccagacuagagugcaguggcacaauuauggcucacugcagccuugaccuccugggcuuaggugauucuuccaccucagccuccugaguagcugggacuacaggcacaugccaccaugcccagcuaauuuuuguauguuuuguagagacgagguuucaccauauugcccaggcuggucucaaacuccugggcucaagcuaucugcgugccuugaccucccaaagugcuaggauuacaggugugagccacuaugccuagccuaacucagacuuuaaaaauauaaaagcaauucauuuuuauucccaagaacaguaagguggugguuuaauuuuagucuuuaauucuguuuuuaauuuauucuauuuagaaaugucccagaaacuuaguauaacuuuacuuucugaaaaugaagaaaccuguccuugggcauuaguguguuggauuuaagcaacaaaguuaaaaaaaccuacccuguguuauggcaauuuucacuugauggugguucuauaacacagguaucagugaaccuuuauaaaagaugaacaacuuuucagcuugcuuaauuucaguuaauuaacauguauacuuaucuauguuaauguuuuauugcuuaaaauguuuaauuuuuauauuugguaaacagauaguuuuuucucucccccucuuccuuccaucuuucauuacuacaauuuaccaugcagagcucacaaugucucucugcaccaagcuccaugacucaggauuugccuggaguuccugggaaagaccaguuguuuucacagccuccaguguuaaggacagcuucacaagaggguugccaagaacuuacacaagaacaaagagaucaacugagggcagauaucaguauuaucaaaggcagauaccggagccaaaguggaguauggcuuuuucccccucauuauaauuguuaaaacuucuuaaaaauuguuucacccuuuugauauauauuucuuugacuuauaaacgagcuauauuuauaaacaagggaccagaacacauuaacucagucaugguuaugugcuuccuugcuuucaauguuucauuaucuuauaaggaagagaacguauggucucuugaaaaaacugacaauaagaaguaacaacuggacuaccacauuuuuuuuuacauccuuaauuuaacucuucgucaauuucuuuuuuuacuuaaggaggacgaauccaugaaccaaccaggaccaaucaaaaccagacuggcuauuagucagucacauuuaaugacugcacuuggucacacaagaccauccauuagugaagaugacuggaagaauuuugcugagcuguaaguaacagauucuguuuuggaaguacagcuacuauuacaagugacauaguauuacacuuaaaccuuuaaaguucguguuuaaaauaaaaauauuuugaauauuuaaaagcuaauucaaaaaauaugugucguagcuaugcauuaaaaaaccccaaaaugucagaaguacagaagucaaaauugaguuuucauuaaccaguucauuugauuauauuugaauuauucauaauggacucauuuaauuuuaguaacuuugggcugggugcuguggcucaugccuguaaucccagcucuuugggaggccaaggcagguggaucaccugaggucaggaguucgaggcaagccuaaccaacacggggaaaccccaucucuacuaaaaauacaaaaauuagccaggugugguggcaugugccuguagucccagcuacuugggaggcugagacaggagaauugcuugaacccaggagguggagguugcagugagccgagauugcaccacugcacuccauccagccugggccacagagcgagacugugucucaaaaaaaaaaaaaaaaaauuuaguaacuucgaagaaauaagaaggaaaauuaaaaguugaaagugauucuaauguauaguuuauaaaauuuuguuauaaaaauaccuguuuugccuucaaaauaauuuauauuaauauuuuauugaccucaagaacauuuaaauacauucagauuuauucauuuguggaccacauuuguuauacauuggauuuaaaggauccuugcaauugaguuuauggccaccuaugcaucugagacccauggacugggaaccauucuaggucaaugauucagugugauucaauuuaagagauguuuauuccuggucuuuagaagcugcuaccuuuuguuaucuaauuuugcaguacuuugaaguauguauguauguguacauacguuagugcuauguauuuauuaaagaagaaucagaaaacagagguaaggaaaaauaaggaaacaaauuucuguuaagcccaccaccucccaaagcauauuuguuuauaugcuuauauauguuuuccuauuaugguaagaacagucuguacauauugcuauauagcagucccccuuuauccacauacauccugaaaauuguuuuacauuuuaaauguuaacuacuuuauuguuuuuaaaugucauuuuauaguguagcuaugccacaauauccaauuuuuagacauuuaaauugcucccaggcaaugugguaaugaacauucuugcagcugaauauaugcacauaucuaauuguuucacuaggauagagguggaauuguauaacagggagcucacauuuuuuaaggcuuuugaaauguauugccaaauugccugccagauauacugcaccaucacuaacauuguguguugcaguauuuuucuaaacuuggcccuuuugauuuuagaaaaaugauaucaauaauuuacauuucuuugauuaaaguguagaaguuauaauuuuucauauuauucauugucauuuguauuuuaucuuuucuaacuugucucuucauccccuuugcuccguuuucuauuggagugcaacuuuauuuguaagaauucuuuuuaauuucugugacuggaauuuuuuuuucuaguuuguuauuucccguucauuucuuaaaauauaauuguguuugccaacaauccauuaucuuuuguuuuguaaugguaguauuuauacauauuaaauuaucucuuucuuuuuucagauaugaaagcuuucaaaauccaaagaggagaaaaaaucaaaguggaacaauguuucgaccuggacagaaaguaacuuuagcauaaaauauacuucuuuuugauuugguucuguuaaguuuuuugauggcuuuuccauauguuguaacaggaaaaaaauggugucuaugaauuucuucuuaauuuaacaaauuugguuaauuuauaaaaucacagauugguaaaugcuauaauuauguaaugaucaggauugagauuaauacuguaguauaaauugggacauuauaacagauuccauauuuuauuuccuaaaaucuaaauucagucuuuaaugaaauaauauuagccaaaugguggaacuaauuuauuucuuuugaggaaaagauaauaaagaauguaauuaaauuuaaauuucuuggaauucccaguuguauauucaucaccuuuguagcauuugacaaauuuuaugcuuagcagcuucuucacuguuuugaaauaaaauauccuauuaccuacugaua

SEQ ID NO: 6304 - RNA, 41509 nt, Homo sapiens; identical to SEQ ID NO: 6303

SEQ ID NO: 6305 - RNA, 41509 nt, Homo sapiens; identical to SEQ ID NO: 6303

SEQ ID NO: 6306 - RNA, 80510 nt, Homo sapiens
cccgcgcgcgccggcggcggggcagccucgcucuggcucgcgccgcgcccccgcgcccaguccgcgcgucagucggucccuagcgcggcugcggggcggagagcugcggcuggcccagcgcgcccaccugaggaggcggcgggguccgcaggcgucgcgggacgaggagaucggagccgggagacucgcgcagcgccauggcccccauuggccucaaagcuguugucggagagaguaaguggagccgggauccuuccagcaggcggggacugcggcucccgaggagccccgcgcggccccugccggcagcgcccaggccuccgagcgggcugccggcccugcgccccgggccugaggcuccugguccguggggucccguuauucaggcgccgcccgcgcgagaggaaggcuugccccgcucuccccucccucaccucauguuucaccccagcccucccccugcagcccgcccuccucccucgccauccuccuuccucgcggucccugucucccuuuucccugcauccuccuuccccuccaucccucccucccucucuucccuucacccccauuucucuccccucgccccauccuucccccuuccuccaccccucccucaccccacucucuccaucccgccucucccccaucccacccuccuucccccucuuucacccccaacacccgucccucuccuucaucucgccucuacccccugcagcccgucacccucccccgcacccccauccucacccccguuaccuuccccucaguccccucuccccuuccucgucuuuauuccuugagcgcccagacuccgcucccuuuuccugcagucccuccuccuccccacccuccugggugagucgugacgagcgagauccuggccugcguccuccucccccgccccgggccgcgccgcggucccuggcugcgagacccaccugggagacuaggcgcaguggcuuggccuggggaggagacgccuguuuuccggaggcugagcucugcugggccggggccaccucacuccuccccuucccggggcuuggcuuccagggcggggacuuaucaggauccugaaccccugaaaucacucgggagaugaggagagcuucgguguccgccgcccagcgccgcagucugcaaucucccugguugcggggcucugcccugccguggccgaacgcuucgggagcucagaccacgguggcagggaggaaaugguuguuuauggguuuggaugaaaggcaccacaugaauggauuuuuaaaaguggguggcggcgaguggcggccgcagcggagcgagggcugauggugggugacauuugcaaaacggcauccacagugcuaaauaagauuggugauauguguggaaaaacagugccuugucaauauuuuguccauuucuuuauaacaaaaaaaauguguaaggauugcuguggcuuuugcuaucucuuuggggauuaagugaagauuaaaacugggcuuuucucuguaggagaggauaagaaaggaaaaagaauaaaaugguggaaaucuaguuuccuuuccaaugauucucuccuaucguagcgcgcgcucgcuguggaaugcuuuuggccauguaguguucuuguugggcaccauagcuguuuuauuuccccucuccauucuuuucauugauauauaggaaauacuccuacugaggaaucuaguuguaaaaccuuaucucaccuauuacaucagaagaaaauuguuauaaaaacugaacaccaaaugaaacaaaauuuuaaaaggugcucaucguaacaccuucauuguacccaugcaguacggguucugauacuuguacucgagauguuuagggcuaggaggacccauagggauccucuaaugucaacaucucauuuuacccaugaauaagaaauggagacuuagagcaguuaagugacuugacacaaucaguguuaauuuggugaaaccuggugggcauuuccuugcaacauuaguaaaaaauaacuuucuucauuauucuguauguaucuuuucuuuccaauauccuuuuaaagcgugaaauauagaauagaauguuacagguuguauucuuuaaaauguuacauuuguacuuugggaggcugaaaugggaggauugcuuaagcccaggaauucaagaucagccuggguaacauagugagaccccaucucuauaaauauaaaaguaaaauaaaaugguauauuugaacacuacacauugaagauaaaauccucaaguguuauagaaaucaaguuuugcaucauuuugcuggaacccuuguuuaugcaaguggcuccauaauccccuucccccaccuuuaauuagaagcaagcauaaagguaaaaaaaaaucaauaugcaagcauggucagaauuuacuuucugaaauaaagcaaacccauuguacacaaagauaacaaagcaauuuuacauaaaauuggugaggauggcuaggugcaguggcucaugccuguaaucucaggacuuugggaggccgaggcuggcgggucaccugaggucaggaguucgagaccagccugaccaacauggugaaacccugucucuacuaaaaauaaaaaaaauuagcugggugugguggugggugccuguaaucccagcuacucgggaggcugaacccucgcuugaaccugggaggcagagguugcagugagccgagaucgugccauugcaugccagcauggcaacagagcaagacuccaucucaaaaaaaaaaaaaaaaaagaaaagaaaaaagaaaaaaaaauggugauuaugugaacagaguucuauuccuauaacaauuagguauaaauuuuagaagaaaaauguugaaauccuuugucaaugacgcagguuaauucuggcuucuaauuuuggauaggguuucuagcuuugcccuuuucucuaaaagaggcugaggcagaagaauugcuugaacugggaggcagagguugcauugagcugagauugcgccacugcauuccagccugggcgacaagagccaaacucugucucaaaaaaaaaagaaccuaauuauacauuaaaaacaaaaaugacaaucaaguagagcuuauuucagaaacacaauaguucaauauuagaaugacauuaagaaaugaaaauuuuaaaacuauauaaucuucucaguagaaacugaaaaacaaguuaaucugcuuuuaaaaacaaaacaaaaacuccuaguaauccagaacuaaaaggaguaguuuaaaugucccuguagagaaaccucuaaccuccccaaucccaucaggccucccuguaaucacgguucccuggacuuuccuuuguaauucuuaucacaguugcaauuaauaaauuauuuguacuaauuguaagaccauaaguucgcuggggguaagaacuagugucuagcacagugcugucacaacaaacucuaggaauaagucuaauaggaaguuagcaagaccuucauaaauggagaagaaugcuauguugcuuuauggaagaauaugaaaaaauaucaguucuugcuaaauuaaccuauacauuuaauaaaauuccuacaaaagucccaacauucaucuggaaugguaaaggcuaagcuaagaggagcuaagaaauuuuugaaaaaaaaagaaaaugggaauuuucaccuaccagauucaaaacauacuguaaagcuacgauuaccaaaacauuguagcacuaccagaugagagggaaagugaaaagaucaaugacauagaacaagaagucuagaguagguccagauaagaaucccauauauggcaaagguagcauuuuaagucagugaggaaaggaaagaaaacucaacauaugauauucaggcaguuggcuacauuuugauggggaaaauaaauuuacuucuguacuucacauguucacaaaaauaagucccauagggauuaaauaaauaaaaugauaaagguaguagauaauaacagauguacuuuuccuuauauuauugugcaggagcuuucuaaacauuauuagaaaacauuaaggaaaagacugacagauaugacuauacuucuauucaguaaaaacaccaaaaagcaauuugaaagacaaauaagcuugaaaaguaucugcagcauauaacaaagggccgauaucuauuuaucuaucuaucuguagagagcuuccuuaaauuguuuuuaaaaaaaacuaaauaaaaaauagacaaaagacaucuauuaguuaucuauuguugcauaacaaauuacaccaaaacuuagcagcuuaaaacaaugaacauuuauugucucagacauccugagggucagggucugggaggggagcagccuggcugggagguuguggcucagggccccucaggagguuacaucaaugggcuguagcuaucucaagaccagaccagagcugaagaauccaccuccaauggcacuccuguuguuagugggccucaguuauccagcaggcuguuggccggauaccucaguucuuugccacaggggcuucgccugggaagccagccggcuuccuccagagccagcgacccaaaagagauggagaccuggagaccgcagucucuauaaccuaauuuagaagggccaucaucacuuuuaccauauccuauccaucacacagaccaaugcuggcacaaagugggaggggacuacacaagcgugugaauaccaggaaccagggaccacuggaggccauccugggggcucucuuaccccagaaugaaaacaagagcuccagaacugggcuaggacacaguagaaaagcggggaggagagcaagcccagcaaccagaugccuucacuuuacacacuucuguauuugauuuucuucuuuaaaauguauagugugcucuacuuuuauaauuuaaaaaauaaagguuuuaaaaauauuuuuauuaacaggaaaacagagaaugccucucugguucugucuggguaucaccaaguuccccagauugugccaggcucuaagucauaauaagaaugaccaccuacugagaaccuaugaugugccaggcacuguccuagucacuuaaauauacuauuccuuuuuuuuuuuuuuuuuuuuuuuuugagacagagucuuacucuguugcccaggcuggagugcaguggugcgaucucggcugauugcaaccuccgccuacuggguucaagcaauucuccugccucagccucaugaguagcugggacuauaggcgcacgcugccacgcccggcuaauuuuuuguauuuuaguagaggcgggguuucaccuuguugaccagacuggucuugaacuccugagcucaggcaguccggccuuccaaaguguugggauuacaggcgugagccacugcgcccagccaaauauacuauucuuaacgcuaaauguccuaaguagauauaacuguccccauuuuagagaugaggaaauucagguacagauaaagucacuuaacagugcacacaaguaguaaggcuggaauucaaacucgggcuucucuggcuccaaaaggcugagcucuucauuagaccaguccccuugccccucgaugcccuguguaacccacuagaagaguggguaggaggaaagccaucaaucccggagcaccagggagacacacaaaaggcccagacuccgggacugaagaacugcugcugacaaaaauaguuauaaacauuccuguccauuugggaucauuguggguugguauuagaacaagcuggacauccuaauguuccaggcaagcagaagcucucugcuucagaccguauacuuucuaauaauguaacuagccaaagcuagucauaaaaauucugaaucacuggucaagaaacacauuuucucaucauccccucuauagccaccccuccaacauuuuccccugaugauugaauucuaagguucccucaccccugcuuuucucugccaggggaugaagugaguagaaggaggcuuugucuaaggacugugaacuccucuuacccucucacugcacucagcagcccgagaggugaguucaggcaucauccacuuagcucuucuagggccaaauuauaaguggaaagcaggagagaucagaggugucagacucagucuaugaaagacagauacuccucuuuuuccucaaccucccucacuaauccccacccccccgaauaaauacacugacaaagcguugaaaguugcacuuuccaagucaauucagucucucuuaugaaguggcuucaguauuuaucagguuauagauuaugaucaauuggucugaacuuugaaucuaaaucuaaaaauuauugcuuugcuucgaguaaaacuguaauaauaaaaacuaaaucuauugaucacuuauuaggugccagacacuguccuaggcaugucguauguugucauuuaauccucaaaaagaucccaugaguuacucucauuagucuucuuuuacucuaaggaaacagaggcugagagaguuuaggauaauuccacaagguuaucaauuugucguuauaauguuuguauguauguauguauuauuuugagacagagucuugcucugucucccaggcuggagugcaguggcacuaucuuggcucacugcaaucuccgccucccggguucaagugauucuucugccucugccucccgaguagcugggauuacaggcgugugccaccacggcuggcuaauuuuuguauauauauauguauuuuagacgggguuuugccauguuggcgaggcuggucuugaacuccugaccucaaaugauccacccaccuuggccucccaaagcgcuggaauuacagacgugagccaccgccccagcacuguuguuauaauguuuuaguaacuaacauuuacaucacaucaacaagugcuaaacacuaaacuaagugcuuuguguaugcuaacuuguugaaugucuauaguuacccuguaagagagguguauucccugcgcuuuauggaugagaacauugaagucaggugaggaaugugcgcuaggucccauaggugagaagaggcagaugcaggauuuggacccugguaguuuggcugcagcaucagucuuaaucucaacaccugucuucucagauuuggauucuggcucacaggcugcagagccuguacuucuuuuuuuuuucuuuuucccagagacagguuucuguugcccaggcuggagcacagcggcgcaaucauagcucacugcaaccucaaccuccugggcucaagcaauccucuugucucagcaucccaaguagcugggacuacaggcaugcaccaccaugcucaguuaauuaaaaaaaaauuuuuuuuucuucaagacgaaaccucgcucugucaccaggcuagagugcaguggugcgaucuuggcucacugcaaccuccgccucccggguucaagcaauucucuugccucagccucaugaguagcugggacuacaggcaugugccacuacgcccagcuaauuuuuuguauuuuuaguagagaugggguuucaccauauuggucaggaugaucuugaucucuugaccuugugauccaccugccuuggccuccaaaagugcugggauuacaggcgugagccaccgcaccuggccaauuuuuagaaaaauuuuuaguagagaugaggacucacuauguugcccaggcuugucuugaacuccugagcucaagugacccucccgucucagccucccaaagugcuaagauuaccuagagccuguauucuuaaccucucuuccuugguuuuugauacuugaaaaucuuuuuucccuaaauuuuuccaaaaauguacaggauccaaguggcagacagguccuccggauucuauuccggguucugccccugacucaugggugacacuggguaagucacaacucugccaacaagacacugaaacuugcacuuucccucuacuaauuauuuaauguacugcaaauccugcuugaccuuaaguacaggagaaauuugacuuguaaaaagagauaacuuaggccaggcacaguggcucacgccuauaauuccagcacuuugggaggccaaggugggagauucacuugagcccaggaguucaaaaccagccugggcaauauagugagaccucgucucuacaaaaaauuuagaaauuagccggccgggugcgguggcucacgccuguaaucccagcacuuugggaggcugaggaggguggaucaccugaggucaggaguugagaacagccuggcugacauggugaaaccccgucucuacuaauaauacaaaaauuagcugggugugguggcacacaucuguaauuccagcuacuugggaggcugaggcaggagaauugcuugaacccgggaggcagagguugcagugagcugagaugguaccacugcacuccagccugggcaacagagugagacucugucucaaaaaaaaaaaaaaaaauuuaaccaggcauaguguccccgaucuguagucccagcuacucaggaggauugcuugagcccaggaagucaaggcugcagugagccaagaucauccuacugcacuccagccugggagacagagugagacucuguuucaaaacaaacaaacaaaaaaaagguaacuuuaggcugggcgugguggcucaugccuguaaucccaggacuuugggaggccgaggcagguggaucaccugaggucaggaguucgagaccagccuggccgacauggugaaacccugucucuacuaauaauacuaaaauuagccaggcaugguggcacacaccuguaaucccagcuacucaggagguugaggcaggagaauugcuugaacccaggagggggagauugcagugagcagagaucaugccauugcacucuagccugggugacaagagagaaacuccaucucaaaaaaaaaaaaaaaaaagagguaacuauuuggcagugccucaaaaaguuacacauagagggacaggcacuguggcccacaccuguaaucccagcacuuugggaggccgaagcgggcaaaucacgugaggucaggaguuugagaccagccugaccaacauggcgaaacccuaucucuacuaaaaauacaauauauuagccgggcaugguggugcaugccuguaaucucaguuacuugggaggcugaggcaggagaaucgcuugaaccugggaguuggagguugcagugagcagagauugugccauugcacuccagccugggcaacaagagcgaaacuccaucucaaaaaaaaaaaaaaaaaaaaaaaaaguuacacauagaguuaccaucugacucagcaauaccacuccaguguauauaaucaaaagaaaugacaguauacauccacaccaaacucauauacaaaugucgcagcagcauuauucauaacagccaaacaacucaaaugccuaucaagugauuaguagaugagcaaaauguggccuauucauacgaugaaauauuacucagccaaaagaaggaaugaagcacugacauaggcaugaagcacucacauaggcuacaacacagaugaaccuugaaaacacgaugauggccgggcgcgguggcuccugccuguaauccgagcacuuugggaggccaaggcagguggaucaccugaggucaggaguucucgaccagccuggccaacauggugaaacccugucucuacugaaaauacaaaacuuagcugggcgcaguggugggugccuguaaucccagcuacucaggaggcugaggcaggagaauugcuugaacccaggagguggagauugcagugagccaagguugugcaauugcacuccagccugggugacaagagcaagacuuggucucagaaaaaaaaagaaagaaagaaagaaaacaugacacuaagugaaagaagccagauacaaaggccacauaguggaugcucccauuuauaugaaguguucagaguuggcaaacccaaagacagaagguagauuagugguugccaggggcugggggagggcagaauggggagggaucgcuagcagguacggggcuucuugucgggugaugaaaguguucugaccagcuacagggagccaagaucaugccacugcacuccauccugagugacagagcgagacccugucucaaaaaaguaaauaacguaaaauggcaaagcuuaugugaauuacaucugaauaguaagcuuucagauguuuaaaaaaaaaaagagagagcaagcuaacuugaaagguaagcuauuagcccaguugacacauuuguccugaacuuuucccuguaguaucgcuuaaaugcacaucaucaaggaaguccuuuuaaaagagugucaguuggaaacauuuacauugagacagaggacuucaauauuuaauugcauggccugggucuccagggaggagguugcuuaaauaugagcauuuguuuuacuucaaaguuaaauacaauucugugggugaccuguccaugucacaguuucuccaugcaacugagacaguuuagggggaaagaaaucaucccuaucugauaacagauuuacuaggauuuuuuuuuuuuuuuuuugagacagagucucacucugucaccuagacuggaguacaguggcacaguuauggcucacugcagccucaaccuccuaggcucaggugauccucccauuucagccucucaagcagcugggacaauaggcacacaccaccacaucuggcaauuuuuguauuuuuuuuagagauggguucucgcuguguugcccaggcuagucucaaacuccugggcucaagggauccuccugccucagccucccaaauugcugggauuacaggugugagacacuaugcuuggccuauuaucuuaagaaaauauccuaaaugugguuuuggaagaaaaaagaaaacaauuuuccuaggaacaauguaggaagguagaauagguauaaaagcaaaggugaggcugagugcgguggcucaugcuuauaauccgagcacuuugggaggcugagacaggcugaucaucugaggucaggagauggagaccauccgggccaccauggugaaacucugucucuacuaaaaauacaaaaauuagcugggcaugguggcacguggcuguagucccagcuacucgggaggcugagguaggagagucacuugaagccgggaggcagagguugcauggagucaagauugcaccacugcaguccagccugagugacagagcaagacugucucaaaaacaaaacaaaacaacaacaaacaaaaaacuaaacuaaaggcaaaagugacuuuaaaauacaaaauacucauccaaacagauguugcuguuacacaggaguaaaaccuuggugacuuggguugugccagcauugcuuucuuggcugcugaguuaugggaauagccaacaggucccaggaaaaaggaccccacagcagggagaugaggggcucaaggcagcaacuacauaccaacccguauggaagacuuccacuauuuuaguaucagccaaacugauguguaccaucaggauaucaacuuuggguucaagaauacauaauguugagaaauuugggaaagaccuguaacagucugggaccugagaagaugccauacauaugcaauuuaauuccacagagcuauuuguugccugccugccaucuauaacuauucuaggcacuauggggaauggcaaaagaaagaggacacagucccugccuucaaagaacuuaugacguauuauuuaacaaggaagcaaaacuuuugaccaggugugguagcucacgccuguaaucccagcacuuugggaggccagugugggcgacuguuuugagucuaggaguuugagaccagccugggcaacauggcaaaaccccaucuguacggaaaaaaaaaaaauaauauauauauauauauauauauauauauauauauauauauauauauauuagccaggcauguuggugcacaccuguggucccagcuacuugggaggcugaggugggaggauugcuugagccugggaaguggagguugcuugagccuagguugugccacuguacuccagccugggcgacagagcaagacgcugucacacacacacgcgugcacacacacacacacacaaacuuuuaacaaauaacuauaacaggccgggcaugguggcucaugcuuguaaucccaguacuuugggaggccaaggcgaguggaucacuugaggucaggaguucaagaccagccuggccaacauggcaaaaccccaucucuacuaaaaauacaaaaauuugcagggcaugguggcacaugccuguaaucccagcuacuuggguggcugagacacgagaauugcuugaacccgggaggcagagguugcagugagcugagaucgcaccacugcacucuagccugggcaacagagcaagacuuugucucaaaaaaacacaaaaaccaaaaaaaaccccuauaaccuaaugcagaaugcagaaagugccauaauaaagaacugaggccgggugcaguggcucacaucuguaaucccagcacuuugggaggcggaugcgggcagaucacgaggucaggagauugagaccauccuggcuaacacggugaaaccccgucucuacuaaaaauacaaaacaaaauuagccaggcguggucgugggcaccuguagucccagcuacuugggaggcugaggcaggagaauggcgggaacccgggaggcagagcuugcagugagucgagaucacgccacugcacuccagccugggcagcgagcgagacuccgccucaacaauaacaacaacaacaaaaaaaaacugaauggcgucuaaagagugaaaggagaaauuuauuugauuugauuugauauuuuuuuugagacagagucuugcucuaucacccaggcuggagugcaguagcaugaucucggcucacugcaaccuccgccucccagguucaagcaauucuucugccucagccucccgaguaccugggauuacaggcacgugucaccaugcccggcuuauuuuuguauuuuuaguagagacaggguuuccccauguuggccaggcuggacucaaacuccugaccucagaugauccgccugccucggccucccgaagugcugggauuacaggcgugagccacugcagcuggccuaaaggagaaauuucuauuccagauaggaaagagaaaaauaucuuguugggaaaaacaguauuaaccagaucuugaagaauggggacauucccaggaugagcaagcuauauuagaauccuuuuaaaaaauagaaguucuaaaaguaugacacuuuuaauuaauaaacuggaaacgaagacacaaucggaccacucaacaauagugauuuuuaaauuuuaaaugaauuaucuaaaaagacauaggccagacacgguggcucacaccuguaaucucagcacuuugggaggcugaggugggcagaucacgaggucaggaguuugagaccagccugaccaacauggugaaaccccgucucuauuaaaaauacaaaaauuagcccgacaugguggugagcgccuguaaucccagcuacucgggaggcugaggcaggagaaucgcuugaaccugggaggcggagguugcagugggcugagaucgcgccacuacacuccagccugggugacagagcgagauucugucucaaaaaaacaaaccaaccaaccaaaacaaacaaacaaaaaaauauacauucuacaacuguaguugugauccccuuucucauucuauccuguuuguguauuauuuucauggaaauacuugcuggaaacuuacuuauuuuacuuuccuuuaaaaaaaaaucacuuuuuuauuuuuugagacagagccucgcucugucucccaggcuagaaugcaauggcacagucuuggcucacugcaaccgcugccucccagguucaagcgauucuccugcuucagccucccaagcagcugggacuauaggcacgugccacgacacccggcuaauuuuuuguauuuuuaguagagaugggguuucaucauguuagccaggauagucucgaucuccugaccucgugauccgccugccucagcuucccaaagugcugggauuacaaacauuagccaccgcaccccaccaaaaucaguuucuucuauauuguguguagcuauucuaauuuauugaauaaaaugcugggauaauuuauuaauuuuucuuuguuuucuacuaaaagcaucuaaggauaugaauuuucaucugaguacagcuuugguugaaucccauagguuuuuuuccccugcuccauaguuuuuauuuuuauuuuuauuuauuuauuuuucagacagagucucucucuguugcccagguuggagugcaguggcaugaucuuagcucacugcaaauccaucuuccggguucaagcaauucuuuugccucagccucccgaguagcugggauugcaggcaugcaccaccaugccuggcuaacuuuuauauuuuuaguagagacgggguuucaccauguuggucaggcuagucucgaacuccugaccucaagugauccacccgccucggucucccaaagugcugggauuacaggugugagccgcugcgcucaguccugcuucauaguuuuuaauauccaauauuuuugccauuucuuuuuuuaaaaaauuauuauuuuguuauuuuagagacaaggucucagucugucacccaggcuggaguacaguggcaugauccauagcucacugcagccuugaccuucugggcucaagcccccugaguagcugggacuauauuugugugccaccgugccuggcuauugccauuuacuucuaaauauaguccuuuguuuugaaguggaugucacucucauaacuggugauaaguaguuuaaauuguggcaaaauuucccuaagaggugguuugggacucaggcaucaucaucaaauguaagagagcacguaucugccucuaguauccaagaagggcuuauugaacgugcagugaaagguuuucccucuggcuuuuuuggcgcacagcaccucugagacaaacaggugcuugaaagcuaaugaaauaucuuuaguggaguggucaggccaaauuuuauaguuaucacuggcaauguaacagccauaaauuuugaguccugguccugugcucgccuguacaggaagugcuuugggaauccccaguaugauccucuuuaauugccucaauuaguugcuucucugcgaggcuguugcaagagcuaaaguuagagugaggugacugagacucuguuuuccuuucagcaaguaugagguuuacuuaccuuuuuccaugucuuuuuucuuuuuuauuuguuuuggagggaggggugguggugggagauagggucuggcucugucucccaggcuggaguagaguggcacaaucacagcucacugcagcuuugaucuccugggcucaagcgauuccagcugggacuacaggugugugcaaccacaccuggcugauuuuuguauuuucuguagagaaaauacauguuguccaggcugguuuuggacucuugggcucaagcagucuacccaccuuggcuucccaaagugcugagaucacaggcaugagagccaccgugccugaccuuuuuugguuuuuuguuuguuuguuuguuuuuguuuuuuuguuuguuuuuuuuugagauggagucucacucuguugcucaggcuggagugcaguagcauaaccuuggcucacugcagccucaaccucccaggcucaagccaugcucccaccucagccucccaaguaguugggacuacaggcaugcaucaccaugccuggcagauuuuucuuuucuuuucuuuucuuuuuuuuuuguauuuguguauuuuuuguauagaugggguuucaccaugucacccaggaugaucuugaacuuccaagcucaagcagcauucccaccucagccucucaaagugcugggauuauaggcacgugccacagcaccugcccugaucuuuaacuuuuuucuuuucaacauccacccaucucuaucugucacuuuauuuuauuuauuuauuuuuuucuugugagauagagucuugcucugucacccaggcugcaaugcaguggagcaauccuggcucacuguaaccuccgccuuuggggucggggugcaagugauuuuccugccucagccuucugaguagcugggauuacaggugccugccaccuaguauccaaaaagggcuuauugaacgugcagugaaacgccuggcuaauuuucguauuuucagucacgacgggauuucacuauguuggccaggcuggucucaaacuccugaucucauaugguccucccgcuuuggccccccaaagugcugggauuauagguguuagccacuacacccaaccucuaccuuucacugaugucuacuaauuauuuagucuacgagcaaaccuuauuggaagugaaugagauauuaaguauuuauuacaguaggaaaaccuguuuuauucuuggaaagaaaaaaauuuagagggagauaaagaaaaguggagaaaaacaaacaaaauuaaaaaaaaaucuuuggagccuggaugugugaauucaaauucaugcagauuugaaucugagucuccaguagccaccccuuauuugguguccuucugagauguuagagaacuccaggaccauaaauuauagucuguguucauuucagcauggcucagcagggucugggaccaaguguuuucauucauccaaccaauauuugcgcugucucuacaugccaggagcugugcugcaugggcagcagagauaguaguguguaaguagaccggguccuugugggauuuagacagacaguggugacgcagcaggaaugugcccugacagggcaauauagguaaugcugaagcaugugggaagcccccaggaaggccugggcaugagcggggcagagugagaccugcaggaugaggaauuagccaggcaggagaugggguccguggggccugggggagaggaaggucuaagcuuggcaagaaaaugagaaaggcuguggcuggcuggagcuguggggaguguguggagagcagucggagaguugccagggccugcuuagccuugguaaggucguuuaucucucuauuccagcagcugugggaagcuacugaagguuuugaguuggggagaggcaugguuagaauugaguucaaaaugcuaucugguugcuguguggagagugggcgggaggcagugggagggaagaggcuguggugcugguccuagcuggggaugugauggcgaggauggugauuuaugccagggagagagcagcaguguugggagggggaccccaacuugaaggcaucuuaggaugcagaagggucaggucauggugauggcugugcaggaagaggagaggaagagucagaaaugaaucccaguuuucuggcucgggcggccaguuggaaggucaugcugugcauugagagaugaaaggcggagaagagacagguuugugggggaagaugagguuuuguaggcacaggcuucagguccuguggaccaccugcgggggaugcuaaugggagcaggcagacaugcuugagauuggcagucacccggugccagagugugggcaggucagaugcacaggagagugggagaagagggcugggaucucaccccgugggacacuggcauuuacaggacaggcccagggagagcagccagcaggccugagugucggaggggaaaggugaggcucacagcagugucuuaugauuuugugacucaugggacccaaccucaaacugagccagugcaagcugagccagccaccaggaggcuccaguuuaggaacagcccccacucucuaggcugggaggcuuggccgcuggaaacuucucaggaguuugccugucugugguguugccccuguguuuuagacaacacuugccuguguuaacuuccuugcucaggauuguuuuaaggaggaaaugaggaaaugguuauaguuagucgacgugcaaaacucugagcauuugggcuuuaugcuguguuaaaauggcaucagauuggcugagugugguggcuuaugccuguaaucccagcacauugggaggccgagguggguggaucgcuugagcccaggaguucaagaccagccugagcaauguggcgagacccugucucuaccaauaaauaaauaaauaaauaaaguacgaaaacuagccagacaugguggcacacgccuguagucccagcuacucaggaggcuaaacugggaggaucacuugagccaaggaggucaagguugcagugagccaugacacaccacugcacuccaucuuggggugcagagcaagacccugucugcugugguuuuguucuguguccccacccaaaucucaucuugaauuguaauccgccuaaucccuacaugucaaggacaagaccagguagagguaauugaaucaugggggcaguuucccucauacuauucucagauaaugaaugaguccaaagguuuuauaagcgucuugcauuuuuccugcuggcacucauucucucuccugcugcccugugaagaggugucuucugccacgauuguaaguuuccugaggccuccccagccaugcggaacugugagucaaugaaaccucuuuucuuugucaguuacccagucucagguauuucuucauagcagcaugagaauggacucauacaucauuucaaaaaaaaaaaaagauggcaucaaauuguagaaucuuggcucuggaaaggaucuuagaagaaucuaguccagaccgugacccagaguaggaagucagauugugcuagucuauuagcuugaucacauuggccaauuuuuuucuucucuguggcugcuggggauacaguauuaucuucauguuccacaccaguguagagucacaauggcaaguauaaaccaugaagaguguguggaggcagaaaggcuguggcucuggacucuaguugguucuaauccagucgcaguugagccucgugagccuccuuuauggcaguaggaacaaagcugcuucauuuuggcagugaagggaggaaaaaggaagaaaauuuaggcuuaaacuguuuuuggagcccccauacuggguacgacaaggugaaccaaaccccacuuaucucuucugucaguuucuucugagcauugguguggucaggauagcauuggagaggagcccccugcccagucucuggacacauugguauugaugguucuauuugcuaaggacuugaagaaaacaaaacacuggugguaagcaagagucacccuucgcucugggagaauuucacacuacaggcuuuaaacaauagacuacagugaggcauagcccuuaaaaaucacuuaaucugcagaccuccuuguauugggggucaaagugcugcuucaggauuuuaggaugaggcuauuacuugacuacucagaauguuuuucaguuugcuuucccuuagauaaucuuaggguggauuacccuggggggugacucuggcucauuccucaauaaucacuaauugacuagcaagaagaucccuuaaaaaaagucacgaggccaggugcgguggcucacaccuguaaucccagugcuuugggaggccaaagugggcugaucaucugaggccaggaguucaagaccagccuggucaacauguugaaacccugucucuacuaaaaauacaaaaaauuagcugggugugguggugggcaccuguaaucccagcuacucgggaggcugaggcgugaaaauagcuugaacccaggaggcagagguugcagugagcugagaucacaacacugcacuccagcuugggcaacagagugagacccugucucaauacaaaaacaaaaacaaacugauugggagcucucacccuguggaugggccugaccuggauaggcuguuuguuggggaacucccggugucagcauauuuagauuuuucuucuuggucucugauuccccagaaaggucuucuuuugucugcugucugggagauaaaggucuggcuaccagaauucugggaacugacuggaugagaugagcugacaguggguucucaacaagcuuuaugccccucuuauucuuuuuuuuuuuuuuuuuuuugagacagagucuugaucuguugcccaggcuggagcacaguagcaugaucucaacucacugcaagcuccgccucccagguucacgccauucuccugccucagccucccgacuagcugggacuacaggcgcccaccaccaugcccagcuaauucuuuuguauuuuuaguagagacaggguuucacuguguuagccagguuggucucgaucuccugaccucgugauccgcccgccuaggcuucccaaagugcugggauuacaggcuugagccacugcgcccagccaccccuccuauucuuuuaaguuccagaggcagcuggugcugccaguuccugaaacuuuugaggauucugcuguguacauuugguugguuuucacugcucccuaccaccagauaaggauuccgcuuucaugggccuacuaagucaguuacaacgcaucuauuguagaaaauaaggcgacagacucagaauguaaaaacacaacuuuaucauuuguaauaacugcauuccaggaaggaaggaggggaguagccaccagccagagacuggggaccaccacgcccgaguuucuuucuuuuuugagacggaguuucguucuuguugcccaugcuggagugcaauggugcagucuuggcucacugcaaccuccgccuuccggguucaagcgauucuccugccucagccucgugaguagcugggauuacaggcauaagccaccaugcauggcuaauuuuuguauuuuuaguagagacgggguuucuccauguuggucaggcuagucuugaacucucgaccucaggugaucugccugccuuggccucccaaagugcugggauuacaggcaugagccacugcgcccagcccugaguuucuuaacacagcagagccucuggcucuuuuggccacuuguuuuucuuucucacugagaggaaauagagucuccuaagagaaagaguuuuggaacaccacaaauccaggaauuuaauacugaacuagcccucagcucacuuugaagcaggaaaucaggugaggcuaaggucaugccuucugacuggauaaacccucccggacccaggagacauccucaccugcccggaccccgggaggcauccugacccuugcggaccccaggaggcauccucacccuccuggaccccaggaggcauccuuacccucggggaccccgggaggcauccucaccggagcaaucuuugguauagaacuuuuaacuaaauuacacaguguggagagacaagcuucagucauuucuccacuacccacucagugccuggcggaaggcaggcagcacagaccuucaucccaacgcacgaggggaauauucaaaucaugccuuaggggcacagggaagggagucagagacugccccgccugugauuuugauacaaguagacagaugaucugagagaacagccucuggucuagaugauuucaguggaaaagaagaagaaagauccauguggaaacuuuguaaacguuuuaugacgggaaaagacaaguguagcauuuagguaaagaagaccagcacagagaaaaccauuuaucauucuaacauaaaaugaucaaccaagagcucaaaugugauguaaugugagauaacagaaugagguggaaaauggccuagcaggggaauucaaaaacagcaaaucauggcauugcagaaugaauaaaccaauuuuacaccauaagaagcagaaucuucgcuauaaaauauggaaauugcuugagaaaucacgcagccugcauauucaugagcauuagugcuccccguguuucuuuuggauuuuucgcgucuucucuuccuggagcuccaccuccuucccgugcucgaucuuuggccccaaccccaaaaggauguuuucuuuuccugguaucuuacuguagccaguuccacagguuggggaaaggaagcccucuuaacacuggcccuuuguguguguggauggguggguggggcauuuccugccuucuggaagcuucccuggggcuuuugucuuauguggguuugacaucaauagcauggcugaauugaggguuccagagggagcgugagcuuauggccuugucauguugugugggacuaaacauuuccuaauaucucagaucuguagaccugaagcaggcuaaaucuuagagcagaacagauugggcuggucagaaucuuggacuugaaaauaagacagagcugaacuuggugacaugcaccuguagucccagcuacucaggaggcugaagcaggaggauugcuugagcccagguauuugaggccagccugggcaacauggugagacucauuucaaaaaagaaaagaauaggaugacugucaccaccauggucauggauaaaucaugugaucucuccuggauucaguuucuuuauaagauagacugcaucagaauuucucaguguuggcacuauugacauuuugggccagaugagcuugugccuugugggauguuuagcagcauuccugaccucuacuuguagauucccauaucauccccuagucgugacaauaaaaaauguauccagacaaugcugaccuuccucuugggggcgcaaaaucacucccuguugagaaccacuggacuaggugaucuuuuuuuuuuuuuuuuuuugagauggaguucugcucuaguugcccaggcaggcuggagugcaauggcgugaccucagcucacugcaaccuccaccucccugguucaagcgauucuucugccucagccuucugagcagcugagauuacaggcaaauacuaccaugcccggcuaauuuuuuguauuuuuaguagagacaggguuucaccauguuggccaggcuggucucgaacuccugaccucaggugauccacccaccucagccucccaaagugcugcgauuacaggcgugagccacugugcccggccccacuggacuaggugaucuuaugucuccugucugcugcuggguuucugggauuguaugaaacacuccauucuuuuccucucucuuuaguuuuagacucaucuuuaaguccuuagggaaacucccauucaagccaagagaugugauuuggagccauuaaaugcugcaucuaccaauuuaagaugcuagccacaucuuggguuccugccaagaucaagauacauauucuggguuucugcaguugaaggaggaauuccugcagccaucgcagagucuguaguaggagcacaagcuuuuuucggagacacagauguggcugggcggguggcucaugccuguagucccaguacuuugggaggccgaggcggguggaucaccugaggucaggaguuugagaccaguaugaccaauauggugaaacuccgucucuacuaaagauacagaaauuagcugggcaugguggcaggcgccuguaaucccaguuacuugggaggcugagacaggagaauugcuugaaccugggaggcggagguuacagugagccgagauggugccacugcacuccagccugggcgacagagugagacuccgucucaaaacaaacaaacaaacaaacaaacaaacaauaaaacagacacagauacagguugacaggccaagugggcauuaacagaugaggacugcugcuguugguaauguauaagggcaaugucuuuucuaucuuuuuuuuuccuggucagcuguagucauguaucuuuuuuuuuuuuuuuuuuuuuuuuuuuggagaugaagucucacucuguugcccaggcuggagugcaauggcacgaucucggcucacugcaaccuccgccuccuggguuaaagugauucuccugucucagccuccccauuagcuagggcuacaggcgugcaucaccacacccagcuaauuuuuuguauuuuuaguagagaugggguuucaccauguuggccaggcuguucuugaacuccugaccucaagugaucugcccgcuuuggccucccaaagugcugggauuacagacgugagccaccgugccuggcccaggcuucccaaauaacugaaugcugguaucacugugguguauaaaaaugguccucauuuuccaguccuuucuuuuaaagauguccuuauguagcagagcuuuauguggugagaguaguguuugcuccccuggaagguuacuauuucacaauuuuugucuuucuuugguauuuuugcuucaaaauaucaacauaacucaauaguguugaugacaauaagcuguugauuuuaagaagauaugaauuauuggauuuccacuuuugauugauuuuuccauuuguguguauuuuguaacgucacagcuccuuuuauccaaggaacguuguuucaggcaacauaaggaagaaauaauuucccuuuagaacugaggggaggugacugcugccucuaacauauacuuaggaacuccuauuuuucaucuccacuagcccugguuugagauuuuuuuuuuuuggagauggaguuucgcucuuguugcccaggcuagagugcaguggugugaucucgccucacugcaaccuccgcaguucaggugauucucccggguucaggugaaccugaaccugaacuucucccgcaguucaggugaaccucccggguucaggugauucuccugccucagccucccaaguagcugggauuacaggcaugagcuaccaugccuggcuaauuuuguauuuuuuuaguagaaacggaguuuuaccauauuggucaggcuggucucaagcuccugaccucgggugaucuacccaccucggccuccuaaagugcagggauuacaggugugagccacugcgccuggcugaaguuauuuuuauuuauuuauuuauuuauuuuuugagacagaguuucacucuuguuacccaggcuguagugcaacggcaugaucucggcucaccgcaaccuccaccucccggguucaagugauucuccugccucagccucccgaguagcugggauuacaggcacccaccaccacgcucagcuaauuuuuuguauuuuuaguagagaugggguuucuccauguuggucaggcuggucuugaacucccgaccuuaggugauccacccgccuccaccucccagagugcugggauuacaggcaugagccaccgcgcccggccauggcugagauuuuuuuuuacuaaucacuuugaagguucaugagucuuugcuuagagauuuucuggcuccuucacuuuuuggcuccaaaccuuauaaaacagggauauaaaauaaaaaaugggagucucucuugaaagagaaaguaaauagucauuucuguaacccuacccaguaucuuuauggacccgagguuaggauuugguuucucggauacuaggcauuuaucaucaggcacucucucggauauuggcaguaacccagguuuuguauguuacagcguuggacauuugagucuuaugcaaucuuugggugugcucaguaggccgauguaaucaaaucauuguuaacccaucucuacacguuuuaaagcuugugacaacuccaaacaauuagcccucacccuuuuuucucacuacccauuacccaaaaaucaaaccuaaauagagauguucucagauuauaaccaggcuaauuaguugucauucaacaguuacagggagugauacccagugcuugcccuguggcugacaauuugagaucucuauuuuggucucucccacuucccacaaauacaauuuagauauaaaauuauaguaaauuauucuagauaacuaauaguugauagaguuacugucuucaaaugaaggcacuauggaacaguuuuauauuaagcauaacugcauuuguuuuguuuuuguuuuuaaaaauuuuuucuagagacagggucuugcuuuguugcccaggcuggucucuaacuccuggcuucaagcgaucccacuuuggccuccuaaaguguugggauuacagccauugugcccagccaguuuuuugaguuugaauuuuaauuuuuuaucuaaaauucucuaaugauuuuagaaacagcuuuauugggauauaauucacauaccauaccauucacccauuuaaaguguauaauucaauggcuuuuagucuauucauagaacaguguguccaucaucacaaucaauuuuagaacacuuucaauuaccccagaaggaaacuccauauuccuuauauguaaccccuaaaccccccaucucuccugcuguaggcaacuacuaaucuccuuucaauuuguauggcuguaccuguucuggacauugcaucuaaauggcguuacauaauaugugguccuuuaugacugccugccuuuuuuugagacggagucucucucugucgcccaggcuggagugcaguggugcaaucucagcucacugcaagcuccgccucucagguucacaccauucuccuaccucagccuccugaguagcugggacuacaggcgcccgccaccacgccuggcuacuuuuuguauuuuuaguggagaugggguuucacugcauuagccaggauggucucgauguccugaccucaugauccgcccaccuuggccucccaaagugcugguauuacaggcgugagccaccgcgcacagccaugacugccuucauuuacuuaguguguuuuaaagguucuuuggucuuacaacauuuauuguacuucacuccuuuuuaaugacugaauaauacuccauuguguggauauacugcacuuacccauucacccgucaguggguguuugaguuguuuccacuuuuugguuauuaugaauaaugcugcuagaaacauucauguacaaguguuuguguagacauauguuauuuauuuauuuuuaaaauuuauuuauuauuauuuuuugagacagggucucacucuguugcccaggcuggagugcaguggcacuaugucagcucauugcaaccucugcccucuggguucaagcaauucucuugccucaggcucccgaguagcugggauuacaggugccugccaccaugccuggcuaauguuuguauuuuaaguagagacaggguuucaccauguuggccaggccgaucuugaacucuugaucuuaggugacccaccugccucagccucccaaagugaugggauuacaggcaugagccaccacgcccagccaacauacguuuuaaugucuuuaggauauauaccuaggaauggaguugcuggaucucuauguuugguuauuugaggagcugccggccuguuuuccacaucagcuguaccauuuuacauucucaccagcagugcaugacgguccagugccuuuuuaucuuacugcgcuuaagguguaauuccuucuuucucagacuggacuguaaauucuuugagguaaauacauugauuuauauguugcuuguauccucuauugccuucaagugguuaugugcauuuuauugugcaauugcuagauacuuuguuucucucagcgucaguguuuuacuuuguaaaaugagggugcuauaauucuugaccucugagggcuacugggagcuuuaaaugagaugauauauguaaaacacaugaggaacucucucacauguagucaaccuucaauauguuucagauauugcuauuauuaugggcauuuuuuuuguuauugagaguaaauuaacgauugaguuuuuucuuuauuuugaggagucuugcuuuguugcccagauuggagugcaguggugcaaucuuggcuugcugcaaccuccgccucccaaguucaagcaauuuuccugccucagccucccuaguagcugggauuacaggcaccugccaccaaacccagcuaauuuuuguauuuuuaguagauaugggguuucaccauguuggccaggauggucucaagcuccuggccucaagugaccugcccgccucagucucccaaaguacugggauuauagaugugagccacugugcccggcugacuuuuucuuuuuuuucuuuuuucuuuuuuuuuguuuuuguuuuuuuugagacggagucucacucugucauccaggcuggagugcaguggcacgaccuuggcuuacugcaaccuccgccucccggguucaagugauucuccugccucagccucccgaguagcugggacuacaggcucacaccaccaugccuggcuaauuuuuguauuuuuaguaaaggguuucaccacgcuggccaggcuggucucgaacuccagaccuugugaucugcccgccucggccucccaaagugcugggauuacaggcgugagccacugugcccgccaaguuuuuucuuuauaagagcuuugaaaaaauuuuggcuaagguuguaauaucucaaucagacacugguuaaaaaauuagcaguaggggaauuaucagaugguggaccuucuuccaagcccccagcaaguucauuaaacuguuaaauuuccuuugggcacugaucacucuccgaggcgaugguguuuauuucuuuguguuuauaggcagucucucccuuccacaccagaguguaggcauuuuguuuagcuugcucaucauggucuuucugaugccuagaaggaugucugccacauagcagcuguucaauaaauauuguggaauagaugagaaaaaauguaugcagagaaaaaauuagaagacaggagacauauuacaaaccccauggaggaacaauaaaucacuagauucuuccuuauuaggaacguaaaaauauuauuuaaaauaggugauaauagggccagugauagccaacaggguuaaguacuguuguaaacacuaagcuaagugcuguacaggcagucacuuauuuaauccucacgauaccccuaugagacauuugcgguccuucccauuuuacagauggagaaacugugacacacagagauuuaauaacuugcacaaaggcacagcuaaugaguggagaagcagggaguugaacuuuaaccaucugucuccaaaacccauuugaaucccuuugcuuuacucugucaaggugaucauagcaauguagcacaacaaaggacagcuggguucagugucagagucuagcccaugcuagagccagagagacgacaugugcagugggaagaacaugcggacagggguccagagaauaguugcucaugcuagagugaccaauuaguggcuuacccacuccagauggcugucuucugcagggaguaucucaauccccaaauugagaccugagaccugggaccuggaaccuggccuuagcugaucucugagguucuuuccaauauuaaaguuuucaagccccaaagaagaauaguugaaaauuacuuugccuccccaggcuacaaggugacauagaucaaaaaauuuuauuagccuccuguguuaguguuuauguuuacaauaaaguccucacuaauuugauuggaauaaaucagcaggucuccauguagagacugucuuaugaauacauuuaaggagauuugugcaaauuauuguauguucauacuauggaaugcuauguaguuugaaagcaugugguaggucugugugaaaugauacaagagaaagucuauaauauauugaguagaaaauguaauugcagaacaauguguauacguguaauaucccaaccaaagagcuguguacaugugcauaccuccccacaccuggguguaugugcccaggaaaggaucuguaagggcacacccgaaacuguuaguggcuguuuuccccgcaagaguagggggaaggagggaaauuucacccuguauuuauauaaucuauuguuugauuuuuuuuuacaagaaugugcuacuuuuuuauuauuaagaacuacauaggcugggggugguggcacaugccuguaauuccagcuacucgggauccugaggcaggagaaucgcuugaacuggggaggcagagguugcagugagccaagaucaugccguugcgcuccagccugggcaacaagagugaaacuccgucucgaaaaaaaagaacuacguaaaggcaaaaaguuaaagugguuuauaauuagguuaccaauaguguguguauaaaugauauuuccaagaaaggaaacuugagaguacuuggaaggcuuguuuucaaguauuuguaccauuuccugcaaucuuguugaacauuaacuuauuccaccugggaaaaugcaguuguuuaucaaggagacccuucagccccacacgagacauucagagaaacuugguugcugucuuugcugucaggaaagaggaagacuaccuagacauguugcuccagagcagaauuuccagcaguagauugaaccuucggaggccgagucccagcccaguguaaacugguaaagagugagcccucuuccuacaaucugguuauugcugcuguguaaaaaguccucuugauuuuuauguauuuauuucuuaucugcugccuuacuaaauguuuuaauguugcuaaucauuuugauuucugcagauauauaucauuauuacuaauauuguaacucauuuuauuuucuaaucugacugaauuuuuggauacauguuaaauaauaacaauuuuaaaauacagaccugugugcccuguugugacuaaaaugccuuugacuuucuaucggccucugcuugugcuucagauuaacucacagauagccaggggccacucucugcccucucagaaggggacggggguccuuauguucaacuuuauauuuucuuucuuucuuuuuuuuuuuuuuaguuugagacagggucucacucuugcccaggcuagagugguacagcagcgucaucuuagcucacuguagucucugccuuucaggcucaaagggauccuccugccucagccuccugaguagcugggacuacaggcgcgagcuaccacacccagcuaauuuuuguauuuuuucuagagacggguuuuugccauguugcccaggucaaacuuuauauuuucauuuaggauucguauacauuggugcuauagugccauuauuccaaaaauguauucauauguuuaccgcaggucagagaaguuuugaaauuuuuggugaaauauccauguaguuugcuaucugaauaucuuuaugauuauuuaaaaacuauuuuaaacauuuguuuccuuuuuuuuuuuucuugaggcagagucuuacucugcugcccaggcuggagugcaguggcgugaucuuggcucacugcaaacuccgccucccagguucaagcgauucuccugccucagccucccaaguagcugggauuacaggcacccaccaccaugccuggcuaauuuuuguauuuuugguaaagaugggguuucaccauguuggccaggcuggucucaaacuucugaccucaagugauccacccaccucagccucccaaagugcugggauuacaggcaugagccacugugcccggccacauuuguuuccuuuuaagaggauuuuuacauuauguuaaaaaucuugauugguagaaguuauauuucauaauuuucuucuuccuuuguaugaauaauaugcuuuuauagugaugucacaagaggugccuuuugcagagugccucauacgugucacuggacuaaguaagcauuuuaucucauuaaucuucacaacaggcuauuagaguauuauaauuuuaauuuugcagaugagaaaacugaaacuuaaaauguuuuaaacuuggcaaggcacgguagcucgauagcucacgccuguaaccuaauccaagcacuuugggaggcugagguagguggaucaccugagguuaggaguucgaaggcagccuggccaacauggugaaacccugucucuacaaaagacacaaaaauuaguugggcgugauggcgugugccuguagucccagcuacuagggaggcugaggcaggagaaucacuugaacccgggagguggagguuguagugagucaagaucucgccauugcacuccagccugggcgauagagggagacuccuucucaaaaaaaaaaaaaagucccaaggucacacagccagcaaaugccugaaccuggaugucagcccuggucuaacuuuagcgcuuccuugggcauuuuugggggugauuucugcuugagcagccagcauuacccccucagaccccuggaguucagucaagaggaugccuuuuagaagaacgucuacuguugagucagaauaacucuggaaauucccuguacucuggauugguaaaaagaggcagggaguugugggcugagguuggacucucuuaguucccucagcagcaugaaggcaacuucucccaaccuggggaaaguggauccuggugccucuguccugggcaguguggugcucuggggcuacuguguggaaucuuggaaucgccugugguguugacuuugguugcacuucuccuaagcuucuggcucaucuaauauuagucacgcuacuucagguguuugcaugugcccugggcucagggcaucgggcaucuggcauaugucacuguggagggcaguugugagucccuccugggcugugaggguggggcuucauagggagcugcaagccuugagcagucccuguagcgaucccuggagccuguguuuugggacuccaguugaaauauugggugcauuugaagaugucccagaucaucuuagaccaccggccauuuuucucaggacauggcagagauuugccaagguugggagucacccaggaccuagaggaugugguugagaagggaccugcuuucuuacucauuuggccaugagggaagcagaguccaccagggucuucaguauuacggaggaacugaagcugcuccggucuuuuaaacacauccccguagacuagcugggugguggagcaggcauuuggcuguagauacacaugguuugguaugcggaaguaagaccuccuggcuggacccacuucagaagucuucauuguuucucuccacaugaagaggacuuaggaaggagaugaaaugagauugccagggauugugaggagguagcccaagcuacuugauucuuaaugcuaaacugagcucuaauccuuguuuccuuuucaguauuggauuagaaaaauguagggcaggauuagaauuggcuguuaacaauacccaggacaaacauaugcccugagaacuuuggaaaggaaauaacuuccuaggaaugguggcagcugcagugguaauuuauaugugucuuuuaacacuuguaguacuugguuuuaucuuuugauuauaucucugccuuucccuaucaaaaggcaacuuaaguguaauuuuuuucagugaauuuauauuaauuuuuaguggcaagaaaauauauucauccucaauaauauaauacauucaaauaaagagugaacuauacuguuuucugcugucauuguggcaaagauuaaaauaaguaaaccucaagauauuuuaucaguuaguauguuaauuuggagagccacauaguacugaugagggugggagacauaauuuuggaaaguaauucagcagaguuuaucaggaccccagaacauuuagauguuuuaccaacuuauuccauacucagaaagcuacccuaacggaauaauuugugcuaagaaaagcccuggccacaaagauggucgcugacacauuauuuugagagcauuuuucuuaugcagaaagcuugggacaacauuggaaggcacaaauuggcaaguaaagguuaauuauaaauuuauugcacaaaaauaagcuuuugguaugaguuuuucuaauuuuccuaugcauaucugcuuuaaaaauaguuguagcaugcuuuuuucacccuuagccauauauuuugagcauuuucuuccucguuuguacucauauaugaaaacucuaaccuuaguugaaaccagccuuccuuucuugcaccuggacagccgaacauuauugggaaaaaacauuacuaagcugccugguuuaacuuuaaauucacagucaugaccaucaaauuaguccuuaguacugucuguaaaugcuaaaacauuuccacaguaaauugacuuucccaaucucugggaagauauaugauaccuucuuucuucaaagcuuccauauauaacaccccuuccccacucuuagccaaugacuucaucuccaacagggaaaccccucaccucugccaccgugucuccaagcccaucuguggcuuuccucuccuucacacaggaugccuccugucccaggucaagcuuuccucuuguaucucagcuccaacuccucccucuuccucagggaccucagucuuucauuacuccauccucucuccugcaucgucacucuccccuucccuuuugacuuauugccagcaucacuaaaaaugcuauaaucuuucacaucuuuaaaaacaaacaaauccuacccuugcauccaugucuuuaucuacccuguuaguuuuuaugccuuuucucugcuaccuuuuaaagcaaaacuccuuuuuuuuuuuuuuugucacccaggcuggagugcaguggcacgaucucggcucacugcaaacuccaccucgcagguucaggcgauucuccugccucagccuccugaguaguuggcauuauaggcacgcggcaccacgcccggcuaauuuuuguuuuuuguuuuuuuuuuuuuuuuugagacagagucuugcucugucaccaggcuggagugcaguggcgagaauuggcuuacugcaaccuccgccucccggguucaagcgauucugccgccucagccucccgaguagcugggacuacaggcccgccaccuaauuuuuguauuuuugguagagacaggguuucaccauguuggucaggcuggucucgaacuccugaccucaugauccacccgccuuggccucccaaagugcugggauuauaggugugagccaccacgcccggccaaagcaaaacuucuuaagaguuguugucugucuugucuuccuccucucccauuuuagucuggcuucauucuuauuauuucacugaaacgcucgucaagguccacaaagaccauguccauccaucucacugcuccugucagagucauuuucugcagccuucccuccugccucuauuugauaaguccccaguguuucacuccagcugaggcugugcuuccaagcccaagagcuaacucuagcuaccuauucagcgucuucccuugaaugugucuuagccaucucaaucuuaaaacaacuaaaauagaacuccugauguucuacagaccaguucuccuuccucucaaacucucugaaugcuacaucaauuucuuggcuuaaaccaaaaaucugggaguugguuauguuucuuuucuuuucugccacauccaguguaucagcuagcccuguugguuuuaccuccauaguguauaucaaaucugcccacuucucaccaucuccucugccacugucaugccuggacuguuggaaaggccuccugacuccacccccugcuuccauucuugcccccuccuucuugucucucuguagcacaucagauuacauccuuaccuuccauggcuuuccaaugccuuucagauaaaaucauacuccuuaucaaagaccacgaggcucuguaugauccggccuccaaccucagcguauaucaucuucaguucccagaaaaugucaaucucauuuuccuuuuuccacaagacuuuguacuguuccuucuccuuuuccuaguucuuggcugacuucuuccucgucagguccaacuugcuuagaguggccuugccugacccccuauuuaaguaggcugcccacacccuuuuaaaaaaucguagcaccuuauuuauuuaauucggagcacuuaugagaagaugcaauugcucuuuucaguuaguggccgccuccuucccuagagcagcagcuccacaggagcugagcagcacaguaucuuguucauucgcaggguuuagcacaauggcuggcaaguagugguuacucaacaaauguuuauugagugaaagccugaaagaaugaguacauauuuucccaaauuauuauuuccaauggguucauaguauuccauuguacaaauguaaccuaauuaaguuaaccacugcccuauuauggauauauugguuucuaguuuuucacuacacugaaacaugcgaaguaaucuaaauggcuauugggaauauuguugaccaugaacaauuauucaggccuuaaaauccuagaaaguguuuuuauuaaaaugggugaguugaguacauuaagugaaaaaagcauaauauaaaauuauauaucuacagcaugauuuuuuuuuuuuuuugagucagagucucccucugucacccaggcuggaguacaguggcaugaucuuggguuacugcaacuuugccucucacugaagcagucccacuaccucagccuccugaguagcuaagacuacagguguaugccaccaugacuggcuaauuuuuguauuuuuuguagagaugggguuucaccauguuguccaaccuggucucgaacuccugggcucaagugauuugccugccuuggccucccaaagugcugggauuacaggcaugagccaccgcacguggccaacaugaucuuaacuauguaaaagugcauagaaaaagcuaguaugaaauaaaacuaaaauguuaauuaugcauuucaaguugacaugauuacagauaauuuuucuuuuagauuuuuuuuuuuuuuuuuuugagacaaagucucacuuugucauccaggcuggagugcaguggcuagaucuuggcucacugcaaccucugccuccuggguacgagcgauucuggugccucagccuccugaguaucugggauuacaggugcgcaucaccacaucuggcuaauuuuuuuguauuuuuauuugagauaggguuucaccauguuggccaggcuggucucgaacuccugaccuuaagugauccgcccccaucagccucccaaaguucugggauuacaggugugagccaccgcgcccggccugauuguuuuguuuuguuuuguuuuuaucuuuuuuauuuauuuauuuauuuuuuuuuuuauuuuuuuugagacggagucuugcucugucgcccaggcuggagugcaguggcacgaucucagcucacugcaagcuccgccucccggguucacgccauucuccugccucagccuccugaguagcugagacuacaagcaccugccaccacgcccagcuaauuuuuuguauuuuuaguagagacgggguuucaccauguuaaccaggauggucucaaucuccugaccucgugauccacccuccucggccucccaaagugcugggauuacaggcaugaaccaccgcgcccggccguuaucuuuuuuauuuuaagacagaaucucgcucugucaccaggcuggagugcaguggcacgaucuuggcuuauugcaaccuccgauucccugguucaagugacucuccugccucacccucccaaguggcugggauuacaggcaugcaccaccaugcccagcuaauuuuuguauuuuuaguagagacgggguuucaccauguuggccaggauggucucgaucuccugaccucgugauucacccaccuuggccucccaaagugcugggauuacaggcaugagccaccgugccuggccugauuguuuuuuaagcacaugaguaauacauugaauuuuuucuuuucuuuuuuuuuugagauggagucuggcucugggucugucacccaggcuggagugcagugguguaaucuuggcucacugcaaccuucaccuccuggguucaagcaauucuccugccucagccuccugaguagaugguauaacaggugcacaccaccaugcccaacuaauuuuuguauuuuuaguagagaugagguuucaccauauugguaaggcuggucucgaacuccugaccucaggugauccacccgccucggccccccaaagugcugggauuacaggugugagccacugugccuggccagaauuuuuccuuuauacuuuucuguguuuuccaaguuuacugcuguguguguguguguguguguguguguguguguguguguguguguguguaugugauuacugugauucagugauuacugaagauagucaaaagcagauuuaggaaccaucgagcccuagagaauugucuaacugucugaaccauacaugcugacaacagcucuugcccuucaaguugcuccagguguguguuacucagguuuacagaguagcaagaguggacuuuccuauggagccuccacagcuggucaggugugugugugugugugugugugugugugugugugugugugugugugguggucuagguaacggggcucauuaaaauggugauuuggggauaagagugcucuggagaugugcucaggguuuugaacauuucacaacugcuccucacaucuguuuuuagagcuugaggagggcucauguggccugaggcauugucacagccuuuacccacuuaacuuuaggcagugguucucaaaucugagcccuucuggggguucaugaggucaaaacuaucuucauacuaagaccaagaugugguuugccucuucauucucauucucucacggggcacagcgaaguuucccagauguuauauguuucaggacauacuggcugcagaagcagaugggagaagccagaaguagacaggagaaugucuaugaggccagacauuaaggaggguugcagaaauguaaaacaaucccagcugucucccuaaaaauguuuuauuaugacaaauauauuuauuuuucauuaaaaugcaauuaauguaacauaugaguuuauuaucuuaaaugaauuaauauuguuaaaaauuucucaguuuaguuuccaauacaauaauuaagagcguaaagaaguuaugagaccaaaaaguuugaaaaccacugaauuaaggagacaggaagagaacuuucuuuuuuuuuuucaauuuuugagacagagucuugcuuugucacccaggcugaagugcaguggugugaucucggcucacugcaaccucagcucccgaguagcugggauuacaggcaugcaccaccaugccuggcuaauuuuuguauuuuuaguauagaugggguuuccccauguuggccaagcuggucucgaacuccugaccucaggugaucugcccccucagccucccaaagugcuaacuuguucaucacugaaucccuagcaccaauuacaggugugagccaccaugcccggcugagagcuauuuuuaugguggguugguuauggcucaguaaaccaguuggugaauugcaugauucagaaacacaaagccuaaggugggaaaugaccuuaucuaacagagagguguagacgucuuugauauuacauuaauuuccucucucucucucucuuucuccuuuuuuagagauuaugcaugaugugauaaagaaggucaagaagaagggggaauggaaggugaguagaaaguacaguuaaugggcuuaaggugaguucacauggaaaaaucagaaggggauggaguuggaggaaaguuguaggcaggaaugagggcuuuugcuguguccagagaguacagaaugcuccuggauuggagaaaggugaucugcucugccucacauuucauauggucuugguuaagaauucuguuugucauaaagcuuaucuuaaagaccaccuggucaggcaguuagcaguggaacucuuuuguucaaacaaaauauuaccuggaacccguuagauaaagcagaggaagguauaauucugcuggcucugggagaggaagaagaggcccucuugccccuuuguggccauaaagcaucuccauggaguccauguacaguuugggcucaaagcccucaucuggucuauccucauugaacuguaacuacauaagacaaaaauaguaagcucguuuaaucacguaacauugacaggagugcuggaaacuauaguguacuugaaacaaguauuuaagccaaucaaacugagagugggccggguuccuggaaugggugguacaggaguggcaccugcugcccccuaugcaugaagucagcauuuuaaggacugcuugguugucuaaggcugagaauuauacuggccagaagagugugcaguuuuacuugauuuuuucugcauguugcugaagaauuuauaccaaccuuucuugccaucaagguuuccugcagucaaaagcccaugcaguuucaagugcauugggccuaggaacaacagagcugauuaguacaggaggauuuugaagucucacccggggccuuuguuuuaaccagcacaucuguccucgccacccagaaggggaggccgugcagugggccuccccaccgcauaccuuuagcauaccucuuuagcauaccuuucucacuuacccuucccaucagugacgggcuuguagacaugugaauuuuaaacuaaucuugaggaagcugccuuauauaauaaaaacuaauugaccccuguacugcagcagaaagcuuucucauccacacuaucugcccugaugugucuuccuccuguugcccccuucucaguuuauagcauuacaaaaagagaggauaaauagccuuguuuuaacugccagcuuccucuccacugugggcugaaugaagauaagaaagguuagcugaagaguugcaggucugaagcuuuuaggccaggacuggaacguucuuguucuuccagccuagacuaagguacacuaugucccagcugacauguguguuaguggcacaguucugaugaugcuuuucaucaaguccccacaugccagaccacaugugcaggcgcuaguguucacucuccccuuaaacacaagugcaugccgugaaaaaguacucacuaauaugauuaugucugaauguuggagcuauagaugauauuuccuuuauuuauuuauuuauuuauuuauuuauuuauuauuauuauuauuauuauuaugagaugggaucuugcuguugcccaggcuggaguacaauggcgcgaucucggcucacugcgaccuccguuuccuggguucaaacauucuccugccucagccucucacguagcugggauuacaggugugagucaccacaccuggcuaauuuuuguagagacgggguuucaccauguuggccaggcugaucuugaacuccugaccucaagugauccacccgccucagccucccaaaguguugggauuacaggcaugagccaccaugcccgacugauuuuuuuuccuuuuuuaaauggguauuuacuuugucaugggaaauaaaaacuauuuuuuuuuaaguuuauaaaauuacaucagugagaggaaacucuaacuccuagaaaguuagguuaggguaugggagguacaagugagcauguguccccgugggcuucugguccauaggaaauaugguuucuucuguauucuguacuucuggagcuccuuuuggagucugaugcgguaagcugagcgagaaucacagcagaugccaugaagcccauacgcuguucucuuuccuugcaggugcuggugguggaucaguuaagcaugaggaugcuguccuccugcugcaagaugacagacaucaugaccgagggcauaacgagugagcaugcgcucugcacuugagcagugcuggagccuucucucuguggcgggcuuagcucuuuccuauucauuauuaucuccuuugauuuuagauucuuccagcaaccugugugcuaagaccagaagcuccugagaggcgcaaggcuaucuuguucaucacugaaucccuagcaccaaauccagggcuagaugcucauucaaugucuguuaaaggaaugccaaaagaaggguuaaaucaagaaagaaaaggcagcccacccaauagaaaaaaguucugagcaggcacuuaacaaaagaagaaauccaaauggccaaucaaucuaugaaaauuguccacugucauuaguggucagggaaaugcaauucaaaccagagugagaugccgauauagauucaaaauauuagaauauuuaaucucugauaaugccaagugacggugaggagguagaaaaauggaaacuccuacgugauggaaugucugcugguguagccccuuugaaaaccacuuggcagugucuaguaaaguugaagguaugcauguccugugagccagcaagucuguggucagguguguguccuagacaaccucagguaugugugcccaggauacaugugcaggaauacaugugcaguguugcucauagguuccccaaguggaaaauaaccaaaacguccaucaaguguagaaugguuaaaucaguugcgugcaauuacacaguagaauacucuacagggaugaaaaugggcgagcccugagcgcucacaguaacaugaaugcaucugaugaacaacggugagcaaagacagcaagacacgaaagaccacugauagugagccuucauuccacagaguucagaccgcagagcucagcuguguuguuuuaaaaugcagauguaagggguaaaaccucaagagaagagcucaccauucaagggaggauaaugauucuguuugcggggaagagaggaaaugguguugauagaggggaaugugagcuggagccagggcacuuuuguggugcugauuggguuucguuucuuaacugggguagcgcuuauuuagacauuugccuuaugguuauuuguauguuuauguuuuauucacgcuuuggaaugugugcuauaacuuuuggugaauaauaaggagcaggauugcuggaucacaugguaaguaugcuuaguuuuguaagauacugccaaaccauuuuucaaaguggcugaccauuuugcauucccagcaguagugaaugagaauuccuguugcuccacauccuuaccagcauuuggaguugucaguguucugaauuuugagcauucuaccagcuguguggugguaugguauuguuguuuuaauuugcauuucccugaugaccuaggauguggagcaucuuuucacaugcuuauuugccaucuguauauuguuuuuugguacagugucuguaaggucuuuggcccguuuuuuaauuggguuauuuguuuucuuauuguugaauuuuaagggauauuuguauauuuuggauaacaguucuuuaucagauaugucuuuuggaaauauuugcccucagucuguggcuugucuuuucauucucuugauggcaucuugcacagagcaguacuuuuuaauuuuaaugaaguccagcuuaucaauucuuguuuucauggauugucacuuuggugucauaucuaaaaagucauugccaaauccaaggacaccuagcuuuucuuuuauguaauccucuaggaauuuuauaauuucgcauuuuacauuuaggucugugauccauuuugaguuaacauuucuaaaggguauaauguaugugucuguauucauuuugguugcacguggaugugauuccuucauuuuuaaaaaacagauccaguauaucuaucagcagaagcacaguccuguaaauggcauacacaguuuuuuuguuuguuuguuuguuugagacagagucuugcugucucccaagcuggagggcaguggcgcaaucucagcucaccacaaccucugccuccuggguucaagggauuauccugccucagccuccuaaguagcugggauuacaggcaccugccaucacgccuggcuaauuuuuguauuuuuaguagagacaggguuucaccauguuggcuaggcuggucucgaacuccugaccucaagugauccaccugccucggccucccaaaguggugggauuacaggagugagccacugcacuuggcacacauacacaauuuuuuaugugacuuuuaugucauuuagugaccuaagucaguguguuuuuuguuuguuuguuuuugagacagagucuugcucuguugcccaggauggaguauaguggugcaaucuugacucacugcaaacucugccucugggauucgggcaauucucgugccucagccucccgaguagcugggauuacaggcaggcgccagcacacccggcuauuuucuuucuuuuuuuuuuuuuuuaguagagacaggguuucaccauguuggccaagcuggucuugaacuccuggccccaaguuaucugcucgccuuggcuucccaaagugcugggauuacagacgugagcuacugugcccugccccaagucaguuuuaagacuaggcuugccccuauuuugaguuuaugauguuauuuucuucauugaauuuuugaaacuauuuuuuucgucuaucaaagcaaaaacagacaaaaaacacaaaaguaaaggagaaaaacacuaaauggagcuaacaaggaucuaagaaaagagcagugaccuccuguccuccuaucucccauccucggggucuauuaccccagaggcagccaccucgcccuucauucuggacaucuuuuuuauuuuucuacauaaaugcuuguucuauuuucucuugauucagugauauuagauauuauuaacugacuuccugugggagauggggauucagagcucuccacuauacacagacucuugccuacccccaaaagugguuuuuaaaaaauguccuuauggccgggcaugguggcucacaccuguaaucccagcacuuugggaggcagaggcaggcggcucacaaggucaggaauuugagaccagccuguccaacagagugaaacccugucucuacuaaaaauacaaaaauuagccaagcauggucgcacgugccuguagucccagcuacucaggaggcugaggugggagaaucacuugaaccugggagguggagguugcagugagccaagauugugccacugcacuccagccugggcgacagagcaagacugucucaaaaagaaaaagaaagaaagaaggaaagaaaaaguguucuuacuuaacaaaauuuaaaaguuagcaacccuauguugaagcucugaaacauuuuggggggagauauuaguggccuaugaaauuaaacaaaucuauaaccacugguaaaguagauguuuggggauuuuugguauuaauuugaacauuauuuaaggugaaagucuuuauaaauauuccaagucuuuauaaauguuacaauccucuaaagugaugcuuuuaucugcuuaaaugaucugcauagaaagaauggcaccuguauaauugccuugcucucucaaugccagaggacaguagguaacacauuuuaagcauuaccgggugauugguaagauucucccaaaagcuguucuuuccaggugaagucccugacauaacuguagaggaaacaagcaaaccaaagccuaugguuuguuuuaaccaaauagaacauuuaaucuuugcacuauugaaggaagcaauauuguauagagaaugugguuggaaugcccucauuugauaugcagaggagagcaaugaaacuauccagcuguugauaaauaaacccaacauggaaauuccaaaggaauugggauuaucuagggcagaugagacaaagcugaagaagaggcaaaggacccauucuugacagaauuagauaucauuuuccauuuucucucagaacagaucaaugaauuuacuuaaacugaaaugggaagugagaacuaucuagugugaagauuucagauuuuucuuuguuguuguuuuugucguuguuuuugagauggagucucacucugucacccaggcuggagugcagugguacuaucuuggcuuacugcagcuuccaccucccagguucaaucgauucucccaccucagccuccugaguagcuggaauuauaggcacauuccaacaugccuggcuaauuuuuguaguuuuuuaguagagaugagguuucaccauguuggccaggcuggucuugaacuccugacaucaagugaugugcccaccucagccucccaaagugcugggauuacaggcaugagccaccaugcccagcccagauuucagauucuaacaucuugggcauguugagaccauggaauucacucccaaggaacgugguaaccuuaaggaaugagugaaugauuccccccggucccccacuguagauauuuaucugcaacagucugaagguagccugucuauauugcuucugguuuuauggucacccaucauguuuucuuauucacuguggguuguuuuguugucuaguuguggaagauaucaauaagcgcagagagccgcuccccagccuggaggcuguguaucucaucacuccauccgagaagguaaaccuuccaccagaggaggacucuggcuaagguuagauggacuggcuugggauuuauguggcacagacugucugacauugcuagguuaagcacgcauuuaacacacugcucuguuuaagcaugcaauccacaaugggguggggucgggggugguguuuaugcagugagaagugaugaauguauuaagcguucuuaaacacagcagcugugcagaaaaccagagccuguguuccguggcccuggaucauucuaguuuucccccuugcacucccucuucagguaggacccacucugucuaauuagcaguccaccuccagacuuugguauuuuaugcuuucauuuuauuuuaucaauauccaguuacuguucacauuuaccugucuuauaauuuuggagguuacuucaaaucacuauccaaacaagguccaacuccuugcuucuggguaauaguugucuuaggcauguuuucuuuuguuuuguuuuguugguuuuguuuuguuuuuugagacgaagucuagcucuguugcccaggcuggagugcaguggcacgaucucggcucagugcaaccucugccucccagguucaagagauucuccugccucagccucccaaguagcugggauuacaggcacccccccgccacacccagcuaauuuuuguauuuuugguagagacaggguuucaccauguuggccaggcuggucucgaacuccugaccucaagugaucuaccugucuuggucucccaaagugcugggauuacaagcaugagccaccacucucagccuuuuuuguuuuuuuggguuguuguuguuguuuuuuguuuguuuguuuuuguuuuuguuuuuuuuuguuuuuuuuuugagacaggucucucuccaucacccaggcuggagugcaguguugugaucacaguucacuacagccccgaccuccggggcuuaagugauccucccaccucagccucccaaacagcugggacuacaggcacaugccaccaugcccagcuaauuuuugguagagauggagaucuugcuauguugcccaggcuaguggcaaacuccugagcucaagugauccaccugccuuggccucccaaaguguugggauuacaguugugagccaccaugccagccuuaggugucuuagucuauauaaauuuccuccaauuuucacacuuuuuuuuuucacuuugaaaacuggcuuacauaugaauuucuacagaugcaauuaaauugccaaaaggucaucaauaugaaucuccuggaagguuucugccggguuuccuuuuuugugggugucuuccuaacaacuaauuacaguggcuccaaagaacugauacugucauuccagaaugagcuaagaaggccuuuguucaucuaaacucugaaauaguacuaauuuuaaguccucaggacuugguuauggccaaacaugaguguuagaauuaugcaucaaaaauccccugauuuugugcaaguggcuugaagccauuggauuuaacucaguucagauacaggucccauuuggcucuagaauuggauucaggucccucuuuuucccccccauccacaguccguccacucucucaucagugacuuuaaggacccgccgacugcuaaauaccgggcugcacacgucuucuucacugacugugaguacaaccaagagcuguccccagucccaucaggcagguuagcauuucuguacagcugggcugagccaaaacuaaggcaggucaagagggaagaaauggguuguuaccaugcuugucccgaucugcugguuucucuucagaagauaaauugcauaagagacaaaaauaagugcacgcaaauacaaacccacuagaucaugcaguccuuccugcugaaaaauagcacacaagcaccucuucucaggacugacaggcuuggugcugagaaugaccuuccugaggcuuggcauuucauuauguagacuuccaguuagcacuguaugcuguaguauguuuccaucaauuuuucaacuacaaagauauuccaauccaguagucuuuguauuagauagaaucugcaucauuacccuagaauuaguuuucuuauguuuugaggauuuuaugcucagauccuagcggagaagcagagggagaugaauugaccuggacagcuacagaguauaaaacaguaagaauucacccagagaucuucucucuagggauaaacucccacagcacucaccacugagaaaguggaaaggauauagcagaagaaggauuuuggccgggugugguggcucacgccuauaaucccagcacuuugggaggccuaggcggguggaucaccugagaucagaaguucgagaccagccuggucaacauggugaaaccccaucucuacaaaaauacaaaaauuagcuggauaugacagcaggugccuauaaucccagcuacucgggaggcugaggugggagaauugcuugaacccaggaggcagagguugcagugagcaagaucacgccauugcacuccagucugggugacagaaugagacuccauccaaaaaaaaaaaaaaauccugauaaaaugaagagcccacuguacaugugcagcuguuaaaugaaccagcaaauggacaggaaagccaacugucuuuugucauacuugcagcuuguccagaugcccuguuuaaugaacugguaaaaucccgagcagccaaagucaucaaaacucugacggaaaucaauauugcauuucucccguaugaaucccaggugagccugaguagggggugcaaaggaaaucugcauccugucuuauucugagaggguggggugggaccuacuaaagaguugaggagggaagguaccaugcucugaauugccaaaugacagguuagaaguggauguuuacugaauggaaauaguauuccauagggccugcccccugcccucaucuuacucuccaguuguuucugacuuugcuucagccuugugccuuucuuugugugcauuucauccuugcucucaguguucacuccugucggccgacuccuugaauaaccacuaaguagccaaucagaaacgagcuuggaaggagagcgaggguggggagcagaagcaucccaucugcugcgaaggagacuguuuuuuacguggagauaaccucagcuugucaugugcugagagagcagauggcagccuucgucauuagccguuaacacuucaggugccaaaugccaggcccauaaagcacucccuuggaaacaaacaaaauuauuaaacaaauaaaggugaagcugauugugagagaacagacacaacuugucucgguauuuugagaguuguuaaaaugucuucucuuaccagacaaggaaacaaaaaccacaggacuuugaugcauuuuacggagcuaaaagaugauuguggcauauuggaucuuuacagaucagcuucgagacaccagagagugaccuauucuuagagaaggagagaugcauaauauauagugugaacauuuaaaaacaggcuuccuucucacuuggccuaaagccugucacccgcuugggggaaggaauuuuuuuuucuucuguguguuccauccccaccuggauagaacaaaauccagcuuuagcauauugaacaaucuuauauuucagaaauuuuaagaaaguaaacuauuuuucgaauaccauuuuuuaagauuaagguaguuuauauaaacgagaauuuaagagaauacugauaacuggaagacucagucauuuaagagagaaucuucaacuucuagcauacuccaaaaaaaaaaaaagaaacagaaaaagaagagacaaauacggccaggcaugaugguucacgccuguaaucccagcacuuugggaggccaagacgggcggaucacgaggucaggagaucgagaccauccuguuuaacacggugaaacuccaucucuacuaaaaauacaaaaaaauuagccaggcgugguagcgggcaccuauagucccagcuacuugggaggcugaggcaggagaauggcgugaacccgggaggcggacccugcagugagccgagaucaugccacugcaccccagccugggcaacagagcaagauucuaucucaaaaaaaaaaaaagaaagaaagaaagaaaagacaaauacuuagaacaugcuacugaagauaagguauuauuaaauccauaaauagcuccuuuauuugcccacagucacagcacaguaucuggcuugucucuuauuuauugaaacuaagcuuacaauuuccaguguagucucacacuaaucccuucugcucuccuccuggccuugucacuguucuccaggcacccuagguacacacccgcccaagguccuuggcacugccuguucccuccauguggaaguccccuguaaacaucccaccuucaagcccuugcucagauguuaccuucucagcaaguccugguguccucccuguccagcccuccuggacauccuccccugcucugauauuuucucauauacuugccaguuucucaggaccacacaauucacuuuucauuauguuuauugucugcuuucuccuacuagauugcaaacuccuugaggacauggauguuuuggucacuaauaguucccaaguguuuagcacaugggcacaugguaggcacccaguacauauuuguggaagaaacgggaacauauucuguagacucacugccagggucagagaauacucugauaguucacaauauguauuaauacuuuuucuccuccccaggucuauuccuuggacucugcugacucuuuccaaagcuucuacaguccccacaaggcucagaugaagaauccuauacuggagcgccuggcagagcagaucgcgacccuuugugccacccugaaggaguacccggcugugcgguaucggggguaaggcagugcaccagucugcuggaguggccucccgugugucccccaagugaggagcuggccuggacuccuccuccggccuuaagguuccucugacaguugucucaagaagaucaggauuugagcaucucuuacuucaaauuacucuuccagugguuuuguuaucuucucaauguuauagugaaauauaauaauacaugcagaaaaaagcauaaaucaacuauugaauaacgaaaaugugaaccucuauguaacugcaacucaggcugccuaccguuuuuaauuucuuucuaaucuuuaaaaacaaauacuaucuuuacuaaagauguuucagaguaagauaaaauacaaagagaguaauucuccaaaggacauguuccucagauuuuaucaagccacgcauuucucacuugcuugcugagugcugggggcaccugaagcugaagacccagcccaugaucagggaggaugggugggaugugccuuccagcguguaugugcaugagagaugcaccccugcaggcucgacccugcgagauaggacaggccaagugcuggggacagccacaguagggagagggcccuuugagccaagggugaagcccgucugcagaccacaggugacgauaggcucaugaggagagagaggccagcauuuugugugcacaguuggcucuugcauuugguauaaacaaaaacuugggaguugggaaaauguggggcacauuuggggaagauggguaguccagcacaguguauguguacggcaguggcgugggaugaagccaauucuggaggucuuggaugacagguuugggauuauguccuucggugguuaucacuggaaaccuaugggggauuuggacggggaugaccacaguucucugggagagugaaggcuggaguauaagcaggagucagggcaaggaaaaaccagaagggguggcuaaccaggaggccacugcaggaggaacaaagggccuggucuuggagugaugggaacgggguggacagguaaggacagaaucugagagcgugcagagguggauucggaacugccagcagguuaguaguagggcaggaagggcuuaggcugccaaggcauugugccgugguaaccaagagcuugguggugccacggaucauggguucacccauccugugaccucauugucuccuggaaguuguggccauagaaaaacaccuuccgguugcugucccagugccuggcuucccuccacuguugguaaucauggacaaagccagccggcaguuaagaaaugggaccuagguggcaucuccugacugaccugugggagcucaggcugguagcagggcugcugcagugcugagacuggccaggaagcaggcagccgccgccccagcaucaggucagguggggcccagggagugcugucagacccagccauggggaaggguucaaagguucucacauuguucuggccaugccagcugaaaugucacucuccaacaaacacaacaaaacaagacccaagagaaugugaacugagggaagugagaaucaugggagucaggcugggagccugaucguggcaaaagguucacugacuggucagggcccccaguggaagugcggcaguuuaucugaagcugcuuggaaagacaucuguuuccacuuagaucauucuggauaaaagcaauaagaaaaucacuuacuuaugguccaggcacugagcuaaguguuuuauuuugcuuuuccuuucuaauuauacucucauuguaaaaacacgaauacagacaaugcucacaucuccccuaaccccgcugcacugcuuggcuuccuuucccgggggcagccagcaccaucaugggugcugggugguucaugcucugucaccccuccuuugucagggaauacaaggacaaugcccugcuggcucagcuaauccaggacaagcucgaugccuauaaagcugaugauccaacaaugggggagguaagucuggcuuggaccacgugguucucuuuaccaaggaccgcaguguuugugugacagucccagagacagcuugguucuguugccacagagcaugugucagugcugcuuuuccuggggacuggcuuccagugaaaugccugaagccccuggggcagggccaucuacauguguucaucguggccagggugaccaacuuguucuguuugccagggcuuuccugguugcagcucugaauggcccaagucccgggaaacccccagaagcauaauagcaaaccagaaaaucgacagacacacgcuucagagcucauucagcauucacugguuuuuacacaugcucuguguacagcccugugcguuuuacacauggauagauauucacugguuuuuacacaugcucuguguacagcccugugcguuuuacacauggauagagucauguaaccaucuuacaaucaagauacagggcuguuuccucaccaccuugauuuuaaaacugaaaggcccagguccugggaacccgcuuagucccaggcacacuggagggugguugccccauuuguaguugaacuugggcaguuuccuacagaaacucacuucggcuccuagcguuucauaucugccccuaagugcgcuugcuaugaaauagaaacacuggagucuuuuaggguauuuuuggugaucuugucuagcaguagacuucugugcugcguuaguaacuuugcaccucagaguuugcuuccugcugcccuccuuuacaagagggguucgcuagguggagaagccggaguuggcuggguggcuugugaagcaucucccuguuuucccccagggcccagacaaggcacgcucccagcuccugauccuggaucgaggcuuugaccccagcuccccugugcuccaugaauugacuuuucaggcuaugaguuaugaucugcugccuaucgaaaaugauguauacaaguaaguauaguguuacagaccccagaguguauacggcucugcacaugagccaaaaauaugucuagaaaaagaacggguuuuuuuguuuguuuguuuugagauggagucucgcucugucacccaagcgggagugcaguggcacaaucucagcucacugcaaccucugccucccagguucaagcaauucuccugccucagccucccaaguagcugggguuacaggcaugugccaccaugcccagcuaacuuuuuguauuuuuuuaguagagaugggauuucacugugcuggccaggcuggucucaaacuccugaccucgugauccgcccgccucagccucccaaagugcugagauuacaggcaugagcuaccacaccuggcagaaaaagagaguuuuuuuuguuuguuguuuucuuaagacgaagucucgcccugucacccaggcuggagugcauuggcgcaaucucagcucacugcaaccuccgccuccuggguucaagcaauucuccugccucagccucccgaguagcugggauuacaggugcccaccaccacaucuggcuaauuuuuuguaucuuuaguagagacgggguuucaccauguuggccagccuggucucgaacuccugaccucaugauccgcccgccucagccucccaaagugcugggauuauaggugugagccacagcgcccagcaaaagagcauuuuuaacccuaggaaaaacgguucauugauacagccuugcaaauuagccuguaaguucuucugcgaguuccccaaauccauguggcauuucuaggcaggaacucaugacuuguccucuuuuuggggaggacaagcacuuuaggucuuugguucccagcucacagcaccucaggucauagccuacuuggauauguuaauauugauuuuuguguuuauguguguaucucauucagaguugaaauuuuuucuuucuguuuuauugguucugccucucuggaggcagaguugaaacuucuuguuuauagauccugaaauaugaugaugaugaaauauaucaacagaaguuucauacugaacuuuccucacagaggagcuguuuucuucauuuguaaaaaacauuuuucuugguagcaaucaucagaaauuuaguuucuaaaaaccaguuuuuccuuuuguggaaccagacuguauaagaaacagacuguaugagaacagacauuguucucauggcauuuaauagcauccaucauaaagauagugguuucaaaaugaagauucuaaaaauaugagugaaucucgguucucccuguugguagcuauaauuugugccuccuccagcuguucacgauuucccaugugauuggugcugagggccuauugcaggcagcugcuggaagcuauuuaggcgccacacauugaggaugacaucccagugccuuuccagagggacagaugugaucuuugccuuuccccuauaaauaacuaaacucauguaugaccugacuucaugcccuggaccagacagcucagguggagcuuguaucagcugacccaaaagauuuuaagacagaauuucaaauugguugacuuugaagagagcuuugaaucucuccuacccgaggaauugcagcccgggucagugcugccacagcaagccuggcugacagguccaauguugugacggcacuugugaacaucuggcagcugaggguggugagcugcugcugcuguaagcugaagaggguucgaugaauguuguggagacagugcacuccaccugagucccgucuccauucuagguaugagaccagcggcaucggggaggcacgggugaaggaggugcuccuggacgaggacgacgaccuguggauagcacugcgccacaagcacaucgcagaggugucccaguaagagcccccugcccccuucuccagcgaggcgccucuacccagcugcuauugaugaugcguucacucugggcaccucgcgggggcucaucacugugugaauucguuuucuuggcagagucaccaacaugcuaacccguaaugauaaaucccuucuguucucugagcuugagcuacuccgacuucaugaaguuagaaaaucaauucuguauuagggcugcuuuuaggauucuuggaaaacauauguagcucucucagaaaaaugcauuacaaacauuaaaaauuuaaagcuaguucauucuauugaaagacccaaacaccacaguauacaauuggacuuucuuuuuuauagcugguauacagccuucccuguuuuaccuacaguuccugagcaauagcugaugucucccuacuaaacuguauccagcucugaaaauguuucagaauguuucuaauauuuaaacauuguuguaagaccuuuaagcuguagauaaugauucugcuuuuucagaaagacauauucugcuacagugaguuggugauauauucaggaaaugcccaaggaagagugagaaaauaauacagccuuggauaguucuguuguuuagagaagaggucucuaaacuuuuuugaucacucaacuuaaaaagauacuaaccuguggccaggcgugguggcucacaccuguaaucccagcacuuugggaggccgaggcagguggaucaccugaggucaggaauucgagaccagccuggccaacaugguaaaacccagucucuacuaaaaauacaaaaauuagcugagugugguggcgugcgccuauagucccagcuacucggguggcugaggcaggacaaucacuugaacccgggaguuggagguugcagugagccaagauuuugccauugcacuccagccuggaugacagaguaaaacuccaucucaaaaaauaaaaaagauauuaacccauauuucaguaaauuaaauguauuuaugaauuuaaaauaugcuuuauuguacuaauguguguauuuacagcauaaauauauauguuuguauauuuuucaaacaugaauuauguuucacuauuuauauuccaauauaaauuugaaaagaaugagguaaaauaaacauaaguagauauucuaauauuuucuucucuuuucuccuugaauaaucugguacaccccacucuggagaccacugguuucaaauauuaauuagaaaagcuaugugucucucuucucucuuagaaaauaacuucuuuuucuuuuucuuuuucuuuuugagacugagccuugcucugucacccaggcuggagugcaguggccugaucuuggcucacugccaccucugccucccagguucaagcaauucucaugccucagccucccaaguagcugggauuacagaagugugccaccaugcccagcuaauuuuuguauuuuuaguagagaugggguuucaccauauagaccaggcuggucucgaacucccaaccucaggugaucugcccaccuuggccucccaaagugcugggauuacaggcgugagccaccacacccggccaaaaauaacuuuaaaugcauaccuuacuggcaggaaaacucaccacauacuccuaaaggaaaaauugcaugacuccuauagcauccauagcaagguccaugguguugcugugaaacuuagcugccuccuuuuaucuuccagggaagucacccggucucugaaagauuuuucuucuagcaagagaaugaauacuggagagaagguaaacccaugccagugcucaaaugcccaguaaauuagucccugcuuucucucuaagagcagggaagcugccuccuccaaacaggacuaguggguuagcaaggccauaucccucucuuaguuuauaucauuuugccuuauuuuuauuuugcuuuuauuauuauuauuauuauuuugacagagucucgcucuuuuucccaggcugaggugcagugacaggaucuuggcuuacugcaaccuccgcauuuuggguucaagcgauucuccugccucagccuccugaguagcugggauuagaggcacgcgccaccaccccuggcuaauuuuuuuguauuuuuaguagagacgggguuucaccaucuuggccaggcugguuuuguacuccugaccuccagcuauccacccaccuuggccucccaaagugcuaggauuacaggcaugagccaccgugcccggccauuuuuacauuuaagauacagauccaggccgggcaugguggcucacaccuguaaucccagcacuuugggaggccgaggcaaguggaucacaaggucaggaguucgagaccacccuugucaacauggugaaacccugucucuacuaaaaauacaaaaaauuaucuuggugugguagugggcaccuguaaucccagcuacuugggaggcugaggcaggagaauugcuugaacccgggagguggagauugcagugaggcaagaccaugccauugcacuccagccugggugacagagucagacucugucuaaaacaaacaaacaaaaaaaagauacagauccagagccccuacauuuugauauuuacagagaacugcuuuuuguuacucugaugguuaauauuuacucuuuuggaucaugauucauuuuaagccagaagaaugaacugugagaccuuuuuuuaacuugugguaaaauuauaaucuaccuuauuuauauauauaaaauuauauauauauaauuauaaccuaccuuauagaauuuauaaccuaccuuaccugggccucucccuauccugccuguuuaucagagguggcacaccugucuucgucaagggaaguggaauuaccaaaauacaacucugguuguguuacucacuugcuuaaaaccauuuagggacuucuuguuccccuuagaauaacucccaucugcaacacacacacacacacacacacaccccccuuccaaagcccagaucaucagccccacaggccucucucuggucucaucucugccccuauccuuguugcccugccuccuugcuccagccacaccaguguccucuugccucagaccuggccagguucuuuggcucaggcaucauuuccucagggaaacccuccccgggucccuacccagacuaggcagaugccugugccacgugcacccacacuaccuggugaguccccucgaagggcccugaucucugcagugcuuuggcuccucuccuggaugcucugauucuccgugaauuagagauucuuuuuuuuuuuucuuuuguccuuguaucuccagcaccuaauaguuccugguauauaguaguaauucaguaaauuuuuguuggguaaauggaugggauuagauggcccacacagaaagcacacagaccugucuugcccauugggugcagauucccacccucugugaccucccugugcuccucccguccacguagccacagucuuucugccaggaggaagugcaaacuugaugcuaaggcugcuugagcugaggaugaagaaaagcagugaauagaaggauuuuuuuuccucagcaagaauuagcucucaacagcuuucuaguccaauaagcauagaauaaaauauaacugcuagacuucagaguucaguucccaaccuauaagacaaucauauuuggaucaaaaaaaauuuugagccagaggccuggaaaucuaaacacacaugauuuuguguuucacagauucauuuugaguguuacagagugugcgcuugggaacccuagugugggcagcuguccuguccugugcccacuagccuugcaaagccuccuaacaucagggccauuagagugacaccaugugcuuuccuuucccuuacagaccaccaugcgggaccugucccagaugcugaagaagaugccucaguaccagaaagagcucagcaagguauggcagccccaaaucaucuguuugaauaauugaguagaaacagcugcaaaaagacuucucaaagcccuacuacucuaauugauucauggaaauucacagauuuaguuaucuucaauuuuuauuagaaaagaaaugaaaggcugggauaggcaccuuauuuccugucacuuucuuuucuccucuuuaucuuuuccuuccuauucccuugcuguuggcaggaggccucaguuccucaccacaugggccucuccacagggcuccuugagcauccucccaacagggccauuggcuuuccccagagugagccaucugagagagagagugcuaggaggaagucacaauaccuuuuaugucccgauccuggaugccaugcauuaucaguuccuccacauuguuuguuagaagcaagcuacuaauuccagccuacaguuaaggagggaaugaagcucugccuccuaaaaggaggaguaucaaagaaucuguggacacauuguaguaauaaaaccaucauuggcugggugugguggcucaugccuguaaucccagcacuuugggagaccgaggugggcagaucaccugagaucaggaguucgagaccaaccuggccaacauggugaaacccugucucuacuauaaguacaaaaauuagccgggcgugguggcacgugccuguaauccuagcuacucaggaggcugaggcaggagaaucacuugaacccaggaggcaaacguugcagugaaccgagguugcaccacugcacuccagccugcgcaacagagcaagacucugucucaaauaaaaaccauggugccaccuacccucauaaaggauuucuccuuugucuuaacucuuuuagaaugugguuugucccucucuuuugacauguaacacuuucuacuuugugauguuuguguacccgcuuguacacacuuuuuaccuccuuucugaggcuagcgacuccuuggugcccagugguguuuuauacguaguaggugcucaguagauguugcaugcauccaugauuagucccuuggucacaaacuguugugcuuuuuccuaguacuccacccaccugcaccuugcugaggacuguaugaagcauuaccaaggcaccguagacaaacucugccgaguggagcagguaggacucuccuucugccacggcaaguuuuugccaggccuauuuacccagcagaauuuuaacaucugcccuugaacauccugcagaaucauaggaaauagagacgggaaggccugcuagaucaugcugucucaacucuggagccagugcgguuccacuguccaugguagggacuagauuggucuggaaugcugugccguuuggauuuugcaugccuauuuugaaaggcucuguuuucccuggaaugagugaagaaagaugugugggguucugagcccuacauugacaggacuggcagaauuuuauauucugaauguguucuacucuugccauggccagaccagcuuuggagaccucgaggcugacagaggguagagcaguagcaaucagaaauuugcccaaagcaucccugaucacaauugggauuguaaauugagaauuugggguuugaguucugucucugucacugauuauuugaugugccuguuucuuuguguuucauuuuuuucaucugcaaaagggaaaucauugcugacauuuuucaagguugucuuguggagucacuaauccuggcuuagauucauccuaauucuucaaguguuucaacauuauaaaaccaugguucaaauucuaagcgaagagaagauguuaaaagauucugaagccggcugggcgugguggcucacgccuguaauuccagcacuuugggaggccgagacgggcggaucaugaagucaggaguucaagaccagcuugggcaacacagugaaaccccaucucuacuaaaaauacaaaaauuaauugggcgugguagcuggcgccuguaaucccagcuacuuggggggcugaggcaggagaaucgcucgaacucgggaggcggagguugcagugaacagagauugcuccacugcacuccagccugggcaacagaacgagacucugucucaaaaauaauaauaauaagauuccgaagccucagcuuggccucuuuucauagaaaaaaacaauucaggaucucagugugaagcuaagauuucaauccucugguuuggugugacaggcucaguuuaggauuguaagcccuguccuguaucuuuggauauuuuauaaggggaagcagcccugcuaaaauccaucaauuuuauaggggauuauagcaaacacaagguguccucuugaaaagaaccugaccaucuagaaaauaggucauaccuaaaucaguaaaaauguaguuugggauuaauuuuggaaguuuacaaauuuucagaagugaucaaaaguauuguugaacuaguugcauuauuaaaaucauguccugcuagucaaaugucuguugaggcuggugguaggacugaaaggugaacggccugugagagguguccugccuuccugggacacagacuggagagagacuaugaacucgagaucagaauuuguauggacucuugggaucuugagagaaaaaaagagagccuucaggcaaccuccuaagagccacaaaggaagcugcagcugugaguccugguuggcugagaccagcgugcugccuucucuggaucugagucuugccugcaucaugaagcggggccaggaacuuguguucacuucacucuuuuucaugucuaguucuuuuucagcccauaucuuccccuucaucuccugggguuuggauuugcugguuugggggcucuuuuuuucccuuccucacucaugaaacaugguagaaagauuaaaaacacguuaaaagccuggagcaguucaaacucaaaaagcaugugcuucaaugugaggggaagcagaauggaaagaaucuacccacgcggaggcauccuaaaaucccagcacuuuucaugggagggaagcacaucccuuuaagucccgcucccucacagggccuuguaccucuagagggccuaccaagauuuagucuuuuuuuuuuguuaugagccagggucuugcucugucacccaggcuagagugcaguggcgcaaucauagcucacugcagccuugaacuccugggcucaagcaauccuccugccucagccuccugaguagcugggacuacaggcaugugccaccaugccuugguaaagaugaggucucugcuguguugcccaggcuggucucaaaacuccugggcucaaaagauccucccaccucagccuuccaaagugcggagauuacaggcaugagccaccgcccccagccaggauugagucuuuaucugagaagcuggcacaaguacacuggcacucaccuacagugaacagccuacuuuaaaacaagaugguaaaucauugugguuucuguugggcaaguggcacucagggcuuuuauccacccucacugaugcugugggagacaaugcugaucacacuccugcuaacuacagugcauuauaagaacagaagcaccuguuuaagaccuuccccaaccaagguggcaguucuagacauuuguggauccugaauuuccuaagaacuacuguuccuccacacugucaccagagagauggagccaaugagguguguuuuccuuaggaccuggccaugggcacagaugcugagggagagaagaucaaggacccuaugcgagccaucguccccauucugcuggaugccaaugucagcacuuaugacaaaauccgcaucauccuucucuacaucuuuuugaagaaugguagggcugugggaccuagaggaaggcacagacccugucuuggggaaacugagacaacugagaaagaggaaacaaagcagagaagucauuuaaaagacauggacuggggaaggaaaagaagauccuaggggcccuuuuuguuuggggaaaugcaguguagucagaucguugcagcuagaggcugaaugucccccagucauuguagaguuaauaaaugguauggaguagauggaagaggacagggcuggggagagagggaaagcugcuuggccuuguggccaguuuaccagagcuaugcccaucacguauuuuuaacuugcaucacauugguaaucucugccuuuaaagaacugacuuuuacccaguucaaucacaguuucccaggaauguccauuguacaaaagauagauaauaagacucuuguccaauuugaccuugauucagggugggggugggcagggguugcugagaagccggggggcagauggaaacacagacuauaggggcagcugcugaugguccucacucaggcagaguggcuggaggggaaucgggauccucguguuguccucaccuauagugaaucugaugaggugggggagcaauguccacuaacccugaggggagaagggccaccauccggccugucccauugggugcaugggggcuguguguggugaucgggugucuugugcccucaggcaucacggaggaaaaccugaacaaacugauccagcacgcccagauacccccggaggauagugagaucaucaccaacauggcucaccucggcgugcccaucgucaccgauguaagaggccagcucagcuuccgggggaggugggaagggagcuggcagaucugucugcuucugcucugacugacauacagcaucucugauacacacucguacgucaagagagagagacacagaaucagagggauaaagguguaaagcuauauauaaaucagagacacaaagccaagaaccuagacgucaacagcagugagucauucacaguugugaaagcugagaugucuuggaaccaaaccauaacagggguccccgccauuuuaucugucuugucucagggucugucuggccucaccuuuggacagcuuagccucaguguccccugugaagaugagaauaugacacuuagagcuagcaguuuggccaccuuugagucuucugcacuggguugguucagagccaagucagggcagguugucugggaggccuggaccacgugaugugcucuagaagagguggggugaagccuccaggacccuugcagaggacucugccaugaaccuugccugucacagccccacugugugcuugucuucuauaggcacagcacuaacaaagcuaggguugcaaauauucucccucuggaaucuuauagacaaaacuguucuagugccaccagaccauagcccuguaacuagcaggaguuuggcauuuuuaaacccuuguucacaagagggaucaaaaugagaauggagaugugcauucauucagugcaacugugcugcugaaauccaauacggcaugcuccaagcaguaugcccuccucuaauaggcagcaaacuacuguuucaacugccuggaguuuuuucuuuuuucuuuuuuuuuuuuugagacggagucucgcucugucgcccaggcuggagugcaguggcgcgaucucggcucacugcaagcuccgccucccggguucacgccauucuccugccucagccuuccgaguagcugggacuacaggcacccgcuaccacgcccggcuaauuuuuuguauuuuuaguagagacaggguuucaccguguuagccaggauggucucgaucuccugaccucgugauccgcccgccucggccucccaaagugcugggauuacaggcgugagccaccgcgcccggcugaguuuuuucuuuuuaauggcacuuacauacuugaccuauguuugcccuuuuuuauaacuuuuuuuuuuuuuuuuuuuugagauagagucucacucuguagcccaggauggagugcaguggugagauuuuggcucgcugcaaccuccaccucccacauucaagcaauucuccugccucagccuccugaguagcugggauuacaggugcacaccaccacgcccggcuaauuuuuguauuuuuaguagagacgggguuucgccauguuggccagacuggucgugaacuccugaccucaggugaucugcucaccucagccucccaaagugcugggauuacaggugugagccaccaagcccggccuuuuuaugacuaaagaacaaguuugcuccagguucccaaaagggcacauuuagggcuauuccauggaaaaccauccccccaccauuacucuuugccagugcugccucuggguuccuucagggaauuuccagagaguagcagaggucaccuagggcccaaguggcccugacucagguucuaaccuggugugugugugcaugcaguccacgcugcgucgccggagcaagccggagcggaaggaacgcaucagcgagcagaccuaccagcucucacgguggacuccgauuaucaaggacaucauggagguuagugcuggggcacagggaggaaaaaccaggcccagggcccuuggcuugucagccuggaugcuuccagcuucaccugcggcgaggugcugcugacuucacagguacugccuccacuugaggauuugcauccaggccuccuucggcccucauggugccccuugccuggggguuucugaagagcugagagacugugaagcacagccccagaucuauuuguuguuaugucuuggaggacucagcuccuauaauagagacuccucuagggugccgcauccagagggguccaaguguaucucaaaggucagaugagugacaucacaucuccacacaggugcaguggcucagcacacuuccccagcacggcccugccugccccgcccugcccuccuccugcuguucccuaccugagccuccacacaccagcaaaucggauucugcuccucuggccaaagcagccccuugccuggcauauucucaccccuccacuccccuucccagauccugcuuuccauccaagccccucuugaaucuuaccauuuccaucugccgccccaccugucugaccacucagcacacaggggccuccccuggacuccuuagugcacaugugccucuuggugccucgggucgccuuuuuguuuguugguccuguccccucagcugcugugucaucugcacagagccucuagugcagcagguguuuuugcaguuguuggcuggaagguguauaaggugguggccaccgcaguagcccuguggggucacucccuucucuccuuguagcgggaagagacccugcauagaauccugcaccacuagaucuuuccaacuugauuagugaacaaaacuggggucuagagaaugaagggguuuuucucgggaucccuuaguuaauuccuggcagcccagguguuccuauugaauuguacauuaauauaaauguauuuuaaauauauagagugagucagcucccauuuuuaaaauccacaaacuaaaaggaugggugaacaugaaacaucuagaaaccaauuauaucucuuugcuuguugggauagccaaccccucugucucauuccuuccuuuguucucugcucccuuuugcucccccuccucuccgauccccuaaagagacauguguaggcuucaugugggagcuguaaagaagaguguggauuucuaggcagcaggagguagauggugagaguccacccaccagauaauuagacacuugaaaaacggaggggguaaggcuucuucaugcaggagagacacugcuugugccugguuucuacaaggcugauggcaaguaucaggaauuuauuggacagaaugcaucauuuauaaaaccucacauagauuaugaaagugaauaaacuggaagagaagcaagaaaaaacuucucuuaaaaagcaggcuaucucaguguagcagcuaguuacaaagcaucugcuauaacugagcccugugcuaggcaccucuggccgcagggaagggagcucugguuguugcaaaccuggccauggcuuugccaagugacauguucuacagaucaucuggccuugguuccuaucagcacuuuucagacagauggcaagcuaauaucugucucuuuuccuucuaggacacuauugaggacaaacuugacaccaaacacuacccuuauaucucuacccguuccucugccuccuucagcaccaccgccgucagguaggugaaaaucccuuagcaaggacagaggggagccagcucugguuggaugucagcucugcggcagacccacuguacggcugugugaucuaccagagcccucucgcugcugcuccccacagcugcagcgugggccaggucugcacaguggucccacggcccuucccccuccagcaucccguuccucucugauucaucccucacaccuccucccucgcucacucugcaucagccaugccagcuuccucgcacuucucaaacagucaggcuuacgucugccucaggaccacugcacuugcuuuucccucugccugaaauuaucuguccccagauaugucugcaugggcugggcacaguagcucacaccuguaaucccagaacuuugggaggccaaggcgggugaaucacuugaggucaggcauuugagaccagccuggcgaacauggugaaacccugucucuacuaaaaauacaaaaauuagcugggcaugguggcggacgccuguagucccagcuacucaggaggcugaggcaggagaauugcuugaacccaggaggcggagguuguggugagcuaagaucgcaucacugcacuccagucugggugacagagcgagacuccaugucaaacaaagaaaaaauaugucugcauggcuugccucuuaucuccuuuggucuuuaaucaaguguuaccuucuccaaucuucccucaccacccuguuuaaaauugcagugcaucagcguucacagcuuuacucaugcaguccaaguguggagcagcccacaugucccccagcugacgaguggguaacacacguggucucuccacacaguggcuccugagaacagucagggcugagcacgcacucgggaugguagaguuagcagcucgagagggcgacccuggcacugcagcugugccacaccuggcaccccaggaugugcacaucucugucccuccucuccugcuuuccccaccugucuucucuuuugcgucucuucucucuguguucacuuuuggcuucagcugggccagaggccugugguggccucugugucauugugcagcccuucucauggcagcagagguaaaacguuuuuugccaaauauggcauaaaauacaaaaucccaaguagcgccacagucaggcugggugaugagaaugggauaucaaaugauugcacaaggaaagaaagcaacugugagauucucuguuggcccaaacggugccccaaacggugucuuccugguuuggaaagugacuguaaagcugucaugagucaggaagaaaggcgacgcauugcaguggccagaaaggacuugcuccuuucaucucauuuuucucauuuucuuaaccugggaacaacccauuuauuccuguuucucagucaaagguaaagagcuauugaaggaagcccagguucagagggaggccccucugggagcagccuugccacugaaguacucuuccucccuggcuucgccgcaauuuccaggaggcagcucagggauggagaagccuccccaguggugcccggacaggguuccagggcuucccugugcuuggcccuauagcacagagcucuucaucagaccaggauuugggcucacuuccuucuccccaccugccccauucaaugaugaccucuuggucaaggccugugucuccuuaggaugugguacuggggaggcccuggccuccaagaggcacucacucaguacauguuuucaagggaucuaugugccagccugaaggcagaucuuagacugucaucacugugcacugacagcagagugucccaggcaagcucagaggcaugugugacuugggguagacgucugcaugagccucuagcagggggaugcuacagaacuugacccagcaaacgucagagcugaacugauccugucuguugccugcauguuucuaagagugacaaggucacagcagcacaggcauucauagugacucuucuccugggaaccaauccacuugaaaauugcauugcagugaaauuucagccagcacucacuaagcaucuacacuguuuggggcacaaguguacagaccuaauaaguaaacaaaccacugggguaugaagcacuagaugccgugagugcagauaaacugacugacauucucuuucucucucucuuucucagcgcccgcuaugggcacuggcauaagaacaaggccccaggcgaguaccgcaguggcccccgccucaucauuuucauccuugggggugugagccugaaugagaugcgcugcgccuacgaggugacccaggccaacggaaagugggaggugcugauaggugaguggccgugcuuccagcggaaggcgccgccgcaucgcaccucaacuccauuccacgcuuuggugucgcauucugucauagacucccuugacccacaaaacuuagucuuuagguaacuguggacagcagaagcuaggggcaaaggguucccuccuuggucugcccugcugcaucucucaauggaaggcagccucaugagguaggaagugccugaucccaggguccggcagacucaggcucagauuccugcucugcaaacugcaagugggggaccuugagcaagugguucgagcucuccaaccauuuccuuacucagcaaaacaggaucagucauacucauucacagccuugaacuaggcccaagaugaggucugucagucuccuggcauuggccucaugcccaggcaggaaugggcagugaauggcagucaaucgcugcccugucagguggagauggacagacagcugugagcaggugcugccugaaacuacugccugaccgcuggacucugcccagggcucccccagccaccuccaaccacuuucuaggucugccaugcccuuucucguauuuccuguucguuucccaaaagagaggaagcgacuuguaggagcuagcuuaacgcagcaggagccuuuucuccuuuuucgugccuuuugggggcuucuaugauguuuagggcuggaagaagaugaacgagcuaagaaaagucuugcuuucuccagaugccucccuuuuuguccuguuuugcccuuaacaaaauggaggguaccugccagccugggagucccucucaacacugucuggcaagaagcugucauguucacuacccuggcugggcucuguccucaguggaaacaggcucacgcugagcaaggagugaggccagggcucuuggccuccuuuuggaagggggugugcucugcacaguggggaauuauacucuccagggccaaggauggccucucaggccacuuacacaugaagugcuacagggagaggcccugagcugccccagcugggaggcaucgcugaccuucucccauaggugcccaccacuggucuuaaucccaggcacagucaugaucucgauaacaaguggugguuuuauaccuccuauuuggggugagcaagucgcagcacccccccccucccaagcuauccaagugagcagacuccauagaccaguccacauggcuguuucuggguuuuucaagauggaucuggggcugucagccgccucucugauagcacaauccaguggggagacuguaccuccccaccgcagcccucaagcuucccgugucaggucaccagcucuccacauaacuguuuuucccuucuguuguguagccccggugauaaagcucucugcucccugcuugcauauguauugcaugaauguagugaguaauucugagcccaaacacagcuuuucuggacagaagcugucacagccaggcuuuggguguaaaucuuccccuucaucuuuagaccugacuugagguuccauauaucgggaggugggaaccuggggguaugcaguugcccaugaagauucauggaggggccucgcgcagacagcugacguccgcuguguggccuccccugcuuugugcaugccagccuccuugcuaccauguguguucaugcgcgcuuguguguguguguaugcaugcgcacacaugugugugugucuugcuuucucauaccucauuggcugcauaaaauguaggccuaaguuggcauguuccugugacguaccuuuguucaagcagucagcuggccucuguucucccacagguucuacucacauucuuacucccaccaaauuucucauggaccugagacaccccgacuucagggaguccucuaggguaucuuuugaggaucaggcuccaacaauggagugagagccaaagaaacaaaguaaaagcagcuuauuacagaaaagaaacucuuccacucugaagggcuuucuuugauuauuccgucacucuuuuucuuuauuucuuccuuuuuaguuuauuauuuauuugauuuuguuucaacaagaaaaugcuugcaguucucaacaccgauugaaaauguguccagugcugcccucacagcccugccaugaacccucugggcucugaccugcuggcucacccaugccuuggguuccgcacugcuuagucagacgccugcaggcugcuggguggaaacuaaaaaugauaaugacugcugugaacaguugucagagagggagcugaaguuuugggggaugccugaggcacagugcccaacccugcuggucugggaugaauuuguggcccccacaaggaauguagaguguccugguugugcugggugugggggucugagagcgaggccaguggacauucagggaacaccauguccaggaaggcaggcggugguggagauggcuggucgugagggaagcuuggcaggcaauguagaauagaccccaggucaguggcagcuggacggauggugugaauaccuuuuuccuaggacaggcacuucucaaggaauaaguuaaaagggguaauugggucacaagccgccaucugcuuggggaaccccaaucuuuagcgggaagagcuuuuguuucauguuccucugcaggaaacggcacuuaacagucauuugcucuuuuacuaauuacuuuuaauucuguggauccuuucaagaguugaguagucauaccccucucucucccacugaagucccuugguaaggucugagagccugucaguaguaauguauuuuuuuuuuuuugagacggggucucgcuauauugcccaugcuggagugcaguggcucuucacaggugugaucacaacacacugcagccucaaacuccuggccucaagagauccuccuaucucagccuccugaguagcuggcaccauaggcccauaccacugugcccagcauaaaccuauuauuaaugcucugugugguuuuagagagcaucuucugucucccaccaagcuuguuacccagaaccuauugucugcuuaguagacuauccaaauuuuauuuuauuuauuuauuuuuauuuuuauuuauuauuauuauuauuuuuuuugagauagaguuucgcucuuguugcccaggcuggagugcaauggcaugaucucagcucaccacaaccucugccuccuggguucaagugauccuccugccuuagucucccagguugcugggauuacaggcaugcgccaccacaccuggcuaauuuuuuuuuuuguauuuuuaguagggaugggguuucuccauguuggucaggcuggucucgaacucccaaccucaggugauccaccugccucagccucccaaagugcugggauuauaggcgugagccaccgcgcccagccgacuauccaaauuuugaucuucaaaacuguccucauucccuccucucucuuuccauccuucagauacgauagaaccuucuauguguuuaaauggcagccuuccaucaucacaucagugacuccuuagcuuguuacauauucuuucaugaggccauauuuuguguaccugacuuuguguauaucauugacaauggacccuggaaaagccccuucaccugagcugagauguggcccagugagucacagagcaugaguccccugugagcauuggagagagaccuggacucagagccaggaggacuggccucuacuccagcuacuccaugggcaccuguguggcugugggaagauacccucgcucucuggccauagcauaggagcacagggaggguggaucgugugcccccaggcacgcaggaccucugacauucuguauauucagugauuacgauuugugccucaaaccaugcaguccugcucacucucucacucucuggugauccucaggggaauggcccuucagaaccuuggcuaggugacaucagaagcugcuuguguauguaaggaaaauggggcuuccuccuaagguaggaacaggaggcuacgcuguuuaucuccuccucucucccuuccuugauaugaaugucagggcagcagugugcuaaggaacugaaaguaguugggaacccagaaaguggaccugguuauagcccuaggcuauagcucccauccugccugggcuggcccucccuagaaagcaaggccaguagguggugaauaaaagccauuguuuuaaaaaaaaucauuccuuagaagcacugauagguuguaaaucagagacaucugguucugugugcagacugcagguagguggauggauuugcugcaguauguauuuuaagacuucuagaaagacaaauguucagucgagucugcagcaauagcagaccacuugcaggaucugaaagagcacagacucaaacugcaaaggcuccugcuaggaugaguucugagcuucccugcuucagaacaagcuucuccuuugcagaguauuuuccuuugcguuauauuugcucagcagaggucucagcugccaucaaaacaaagagaacguaaacagacuccguauauuccuggcuucugaaaucauuugcugagugguguuggguuuuagagcauucaguuaagcaaggcacagagcccuaauaccagugaggucagaaagcagauuaaggucugacuugcccucuucuguugugaucguccaggugaccaaaguacaggacagugcagacugucagaaaacuugaguguccuaaagaccaguaucauggcagcauaucuuuugugucuuuuuuucuuucuuucuuuugagucaggguuucacucuguuacccaggcuggagugcaguggcaugauuuuagcucacuucagccuggaccuucuggguucaagugauccuuccaccucagcucaccuaguagcugggaccacaggcaugcgccaccaugccuggcuaauuguuuuguauuuuugguagagacuggguuucaccacguugcccaggcuggucuugaacuccugagcucaaguuaucccccagccucggccuaccaagugcugggauuacaggcaugagccacugcaccuggcccaacauaucuuuuaggagaggaugaguuuuccugcagcaaaugagaggguucucagcagacaccgugcaugggugauggugccaugcccugucuucccagcuccucucccuccuguagcugacgcuggcucccccgaggucaggguuaaccaacaacucucacuaaauccucaccagucaucccuccacauugucuaaaaaaugaaaucuuuugauuagauuuucaccucucugcucugguuaguuuaugauaaaaguacucuucuuuggggaaugcccaagagacugugagaagcaaaugugagagagcugaagacuggaucaagucuuugcaguacaugggggccacuugggagagaguugguggguuuuuauauugauuauuuugcuucauuccagauuggggucagguauguuucauuuuucuuugggacucagauuugaaucugaauucagagcccaccuauugccuggcugcuauucaagcauccaccugcccauccccuccccucccaggggccacagggucccgagaaucaagagccuggaggcacugcuucuggaccugucugugccacccacccugagcaagcaccugacugcucuggccuucacgugucccauguguaggaugagaagggugggccggaucacaguuuuccaaaccuggcuaaugaucauacucaccugggcugcucuuuaaauguacacauuuucuggcgccgcccugcauauucugagucaguaggucugcuucagccaaacucaagaaugauuggaccagcuagccugcaagaacacuuuugguuuucagauucuguccguguagaaagaaggauuuugucccaucagagcuugcggugucuggcccacagcuuugaaaacauguagacagucauguagaugggccucaacuuaguuuuuagagaccacuguuuacauuucauaaucguccaguuauagggacuaaauaggacccucagagcaauagggcccacuugcugcuuuauucuggaaaaccaacauggucagccaucuguggauucaaaaugagaacugugcaaaauguggauuauggacucacucagcuuaauuugcaauguuuaugguggugaaaagcuugaccaauuuauuaaaacaacacagaugacugacuuugaagaauuggcuuucugaugaucagcauuuacaccagcuagucugguccccuuaaagaaaccacguaggugaaggccuaggccacagccuguugcugagggucuucgaggcuucacugauugucuccaauacucaguccuagaauuauuguucuucagucaagacugggagcaaugaauggucagugauuaaauaauaucagagacuucuagugcauuaauucccuaaccucucuuuggccucucccaaauccuagauuuacauaucagcaaagauagggaggacuuuggaaucagcaucugaucagaggaaccccuucggaugccuccuuuaaaaugagucugcccucuuauuuccuggagucauuuggauggcuaaggagggccuuggggacauuuucucuggcacgugcgcuccuugcuguugcuuguaacgaggaagcucccaagcgaauccucacgcucugcaggacaggcugucuuucagcaucuggacacgugggcuacauggaguugcaauuuggagggcccccauccuggcaaugguucacucuucagaguuuggggcaagccuuguaauaugcguccuuucuccucauuuguacagcagccuuuggccucuuuuaggacuagcaggaggaguggugaggucacagaaaugaguggacuucaggggaaaggagugcuauaaaaaagcccagggacacacuccugaaaccugcaucgcauuugcugaaggggccucaggucugcagaaugaugagucagcuuuccagcgcagggccccuacaggcugcgugcacagggcaucaugccgaggacaaguuccucacucagcugggagugggcagcuggggccugaacugcagagaaagggauguuggaagaacagagacggcuuuccaaguuucugcuagucuggagugaccaggaagggcugcaguuccagcagucuucggucagcugagcgaguaguuaguggucaaaggcauagggacccugguauuggagucaugcccagugagccagccaaagccuucuuuugccugcccuugggguggaaauccagcauccggugguuuccgcuccccugcucccaugaaggcccauuccuuugccacgucuccagggaggcacauuuucaaguacgugucucuuuuguucaguucuugucucccaccaggaccuuucuuugaagcacacugcugcaugcgugcaggccucaugcucacccacacaccaccccggucaccucuguucuguuuaaguccauguccaaaccacacgacccaugcaucuuuuuuuacugcacuuacuagaucucucucucucuccuuaugacaaagacuuucauuuauuuuuauuuuuauuuuugcaguagaaguauaucuaauuccauuagcuuaaauuuuugcaagcauuucuaaucucuuacaauacgcggucucugcaagguaaggccucagguccccuggcccuuucccucucacaccugaggucccacccaccagggcaguaccaacuggcuggcucccagaggucaguggauucucccagggggcuuugccuaucaacuuccucucccaggcaccaugcuuuccacacauggucccccuaccaacucuggccccauuuucagccuuucccugccuugccauguuuggaauuucucucccuggcuucaccuggaguuuaagagugaauuagaaacgcagcugcccaucaccugcagauggcucugcacccugauggugaggcagcucguuccuuggugcagccugggacccugccugagccagaggauguguuuuguuuauccacagcccccaaauaucucccaggccuauugcgacgggaccccaaccccaauucugacuccccucccugcuuccacuauacccagaccaggguuggggaggggggugggugcagaucugggaaucgagaagcgcaggaaaggaaguguuggaaaccagaacuggcaagcucacugucuucucugccuccuccaggauccacacacauccucaccccacagaaacugcuggacacacugaagaaacugaauaaaacagaugaagaaauaagcaguuaaaaaaauaagucgccccuccaaaacacgcccccaucccacagcgcuccgcagcuucccaccaccgcccgccucaguuccuuugcgucuguugccuccccagcccugcacgcccuggcuggcacuguugccgcugcauucucguguucagugaugcccucuucuuguuugaaacaaaagaaaauaaugcauuguguuuuuuaaaaagaguaucuuauacauguauccuaaaaagagaagcucaugugcaauuggugcacagcaggagaaauuucuggacuguuaggaugaauggacgccuucuccccguuauuuaagauuugugaccuuguacauaacccugggugacgugcacauugcuuggguauggaacgguagaaauuuggguguuuuuaaaaccuuguuugggguuguuccuguccuuguugagaaucauagagaugucuguguucuuggaguauuucacacugaggacuaaucugcuaucuucauuccagucccuaccccucagugccugcucucauccaaauaaccugggaggugacaaucaggauaucucaggagguccaagguggaacagaccucuuugccuuucccagcgucucauacccccgguagugcagcuguggguggaggcuggggugucugcacgaagucaggccagcguccuccuccacagccugucacugcccccuccccagccuguguccacagugcugugaucccgagggaaguccuccagucuaagucacagugcccugacaggugagaagcaaacucccgcuggaagccuccaucucuuuggaaaaacaguuagucuggagccuguggcccaggcccuucuguccccaggcaucaucccaacagcucauuuucccuaguccgccuucguucaagggucaggaauggaccagaacagauggguucuggaggccccugaacagagggcuauggcuguggagaagguucuuggcccguuggacucacacagacccuguacccucucggcaagcaucuucagucagauuauccucaguuucagauacuucauaauaccuuguguuguguggggucauacaucaucguguuuguaagagaagauggucauuuuauucucuguauaaaacuuagcucuaaagcagaaacuaaagcagcaaaugcaggaaggcugucucgccauccucaagacucagcagcucucauucuccaguggugagcacaccauuugugcugcugcuguugucgugaaauauaauaacaguggaagucacaaaaauguccccugcccagcccccucgccgcccuugaccuccugcaggccauguguguauuacuugucuagugauguccucucaaagugcuguacgcgagcucggcgccaccuccgccucccuuucagagccugcuccccgcccucucugcucgcugcauugugguguucucuucucaaggcuuugaaaucuccccuugcacugagauuagucgucagaucucuccccgucucccucccaacuuauacgaccugauuuccuuaggacggaaccgcaggcaccugcgccgggcgucuuacucccgcugcuuguucuguccccucccucggaccaaacagugcucaugcuucaggaccuuguuugucgaagauguugguuucccuuucucuguuauuuauauaaaaauaauuuaucaaaaggauauuuuaaaaaagcuagucugucuugaaacuuguuuaccuuaaaauuaucagaaucucaguguuugaaaguacugaagcacaaacauauaucaucucuguaccauucuguacuaaagcacuugagucuaauaaauaaagaaaucagcaccccuucccgguguccaggggg

SEQ ID NO: 6307 - RNA, 80510 nt, Homo sapiens; identical to SEQ ID NO: 6306

SEQ ID NO: 6308 - RNA, 12754 nt, Homo sapiens
aagugacgcacgaggugcugugacucgugccagcccccuaaucugcggaaguggagugcggggagugcgccggaagagggguacggaagugcgccggaaguggggugcggaggugugcagcgcgcugucagacuggcucgcaggcggcgcggccggcggacccguucgagacagcgcgggcggcucggguccccuggggcuccgcagcaggaggacgccauggacgacaaggguaaaucaagacaggccagggcugcuaggcuacagcagcgccguucagggguccccccaaccucucacauccaggcugagcucccgaagagauuucuuuugaauuucaggcugcuccgcugguuguguuuccagagucacaacuaaaucccucgcgcugcucuuguuuucagggaugcgcccuggcaguaucugcaggcaucccucccacacauacgcuccuucccagugccagucuccuuccugccuuguuggaucugucauuaaaauuagaaugaauaaggcauauuugaugugcucaucuaguaugguuauuaagugaaaaacaagggcaaacuaauacacuuuucauguaaagaaauaaaggggaguggguggaacuccauguauaauauuuguaacauauauguguaugugaauagacauguauuagcauagacugucuggaggggugcaggagaaauuggcaagaugguugacucugggauccucucagauuuuaggaccaaagaggcugaagagagaaugacuuuucaucaucauuuacucgggcuuaauuuuuaggccuugcacaccaguagcuuuuuuuuuuuuuuuuuugagacggagucucgcucugucacccaggcuggagugcaguggcgcagucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggacucccaaagugcugggauuacaggcgugagccaccgcgcccggccaccaguagcuuuuucaaaauaaaaaagagcucuugcaaacagcaaagugguauuuucucuauucccaucaacauuuauugcaucccugaaaccaaauacccuaaaaagaaaguauuuuuuaaauuguuugcuucuuaaagucaacagucauuaacaagcucucuugccuuauaggcugcuaaaugaauuaggugaaucacuuuuuucccuuuuuccagaguuaauugaauacuuuaagucucagaugaaagaagauccugacauggccucagcaguggcugccauccggacguugcuggaguucuugaagagagauaaagguauauagagagucaucuguuaacacucugggacuuaggauagucuuuuuuuucuuuucuuuuuuuuuuuuuuuaaagagacggagccucacucugucacccaggcuggagugcaguggcgagaucuuggcucacugcaaccuccgccuccuggguucaagcaauucuccugccuuggccuccugaguagcugggauuauaggugugcaccaccuuguccggcuaauuuuuuuguauuuuagagacaggguuucaccauguuacccaggcuggucucgaacuccugagcuuaggcaaucugcccgcuuuggccucccaaagugcuaggauuacaggugugagccacugugcccggccguuuguuuuuuuugagacagaguuuugcucuugucucccaggcuggagugcaauggcacaaucucggcucacugcaaccucugccucucaaguucaagcgauucuccugccucagccuucugaguagcugggauuacaggcaugcaccaccacgccuggcaaaauuuuuuuuuuuuuuuuugagacggagucucgcucugucacccgggcuggagugcaguggugccaucuuggcucacugcaggcuccgcuucccagguucaugccauucuccugccucagccuccagguagcugggacuacaggcgcccgccaccaugccuagcuaauuuuuuguauuuuuaguagagacgggguuucacuuuguuagccagaauggucucgaucuccugaccucgugauccgcccaugucggccucccaaagugcugggauugcaggcgugagccaccgggcccggccaaauuuuuuuauuuuuaguagagacaggguuucaccauguuggccacaguggucuuaaacuccuagccucaggugauccguccgccucgcccucccaaagugcugagauuacaggcgugagccaccauguucggccaggaaagucuucuaaugacucuuagaaauguagaaagugagagaugcauguuugccugcauaaaguaguaauacagcuccaagcucagcuucugccuucauuucagaccuuucaaucuggagagagcucuuacguugucaugaaaaggaucccuuucauaagugaaacagacuuugaaucgagagugacuauguuauauuguguuaaccaugaugcguaaauuucaguagcaguucagcuuuauaaguguuuauuaggccuccaccuugugccagauucuguacagaugcuacagggaauauuccagaauaaauucugguauuaguauuauuuauugugauccccuaauucagcacccuaaauguaagcaucuggguauagcaugaaaucuuguauaagcaaaauaauaaugcagccuuuaaucugaagggcuugccuagagacacaugucuuuaaggcaaccuccagugucuucccauuguucuuaaaauaacauccaaacaaccuuagccucacccauaccaccuugcagaccucaucugccgcugcuacuuaaugucuuuccaugccucagccucccaaagugcugagauuacaggcgugagccaccaugcccagccacccagcuuuauuucuaugugugcuuguuuacuauccgcuuccucuauuacaaucaaaacuccaucacagcagaacccuaccugucuuguucacugauguaucccuagcaucuagaauagugccugguauauaguauguaccuaguaaauauucacugaaugaaugaaugaauugaagauacaggucggggcuguggcccuaaugugaacaucacauuccuuguuggaucauuccaggggagacaauccagggucugagggcgaaucucaccagugccauagaaacccugugugguguggacuccucuguggcaguguccucuggcggggagcucuuccuccgcuucaucagucuugccucccuggaauacuccguaagugccuguucucccugggguuaccuuuccacuucucuguuuagugacagacauucucagcauuaacuggaucuucccuguccccucaguuugcucuuuucuuccuaggauuacuccaaauguaaaaagaucaugauugagcggggagaacuuuuucucaggagaauaucacugucaagaaacaaaauugcagaucugugccauacuuucaucaaagauggagcggugaguggauaaucaucauggugguaaggaggagcaacgguuucgaguccgacugccugggguaaaauccgggcucugccacucacuugcuguggagacuugaacaaguaacuuaaccugucugugcagcuuucucaucuguuaaauaaggaugacaauaguaccuaccuccuuggguuguugugaggauuaaaugaggcaagacauguaaggggcaaggggugugagggcuugguauugugccuggcacuuaguaagugcugcaugaauguaggucuuguuauuagagaugguugucauuguaaacaggcagagagggacagugggacagcacgugugauucuugauuuauuuuauuuauuuauuuauuuauuuugagacggagucuugcucugucacccaggcuggagugcaguggcgcgaucucagcucacugcaagcuccgccuccuggguucacaccauucuccugccucagccucccgaguagcugggacuacaggugcccaccagcaagcccagcuaauuuuuuuuauuuuuaguagagacgggguuucacuguguuagccaggauggucucgaucuccugaccuugugauccacccgcuucggccucccaaagugcugggauuacaggcgugagccaccgcaccuggcccugauucuugauuuaauacaguguuuuacuaaagaaguauuuuuaugauuguauguguaguaaaucugaauuaacagaacagcucuugucacugguuaacacugaggacuuucuuagugaagguuagcaauagagggaaauugagggaaauuuucuuuuuaacuucauuuuagaugcuauuacagagauguaaagccacgcaguguuuauaagugaggaaagacaggaggugcaaguugaaccaucuuccaguaaagguguaaugaaacuaucauaaugccccucccaccagcauacguccuuuugccaccuaggccuccccugaucauaaaaucauuuacuugcauuuugacucuuaaaucuuguccuccauuuuauuagccccuucccaaccuuugaaguauguuauuaaauaaauggcauaauagaugugagugaaacuuguagaaaagccaguugcaaacgaagccuuuuuugggcaaguggaggcaagguugugacuuccucucgcuggggccuucuccuuccacagaccugcugugccgucaguauugugcggguuucguuugcucuaguguagugugguauguauguacuuuaccugcagucaccuacucaggacugauuuagacaaaauuuauagcagagcugcucagauuugcacaugcagaggagucagcuggggucuuauuaaaugcagaucgggauucaguggguuugggcuaggguccacgaaccugccuuccuaacggguucucaggugagacccagaaaggagcuagagagcugguucugcccccuugucuuauucugucuucugcacucuuccauagaaaagagguuauggaggcugggcaugguggcucaugccuguaaucccagcacuuuggaaagccaagacacgcagauugcuugaguccaggaguucaagaccagcccgggcaacauggcaaaacuucaucucuacuaaaaauacaaaaaguuagccaggcgugguggcacacuccuguggucccagcuacuugggaggcucaggugggagaaucaccugaacccaggaaguugaggcugcagugagcugagaucauaccacugcacuucagccugggcaauuggagugagauccugucucaccaaaaaaaaaaaaaaaaaaaaaaaaagagguuaugggccuacugugguggcuuauguguauaauccuagccggagguucccuugaggccaggaauucaacacuagccugagcaacauagggagagaggcccugucucuacaaaaaauaaaauaaauuagcuagucacaguggcgcacaucuguagucccagcuacugggguggcugaggugggaggaucguuugagcccaggaugucgaggcuacagugagccaugaacacugcacugcacuccagccuaggcaucagagcaagaccuuggcucaagaaagaaaagaaaacagauuaugucuaagugucuacacauugcauccacgccacagauagguugugauuaccccaaacaguguuuauaaauucaaaaaaauuaguuagccaucauuucaaaauuggauuuuugaaacaucaccuggucuggcaaucuuggggccacaugacgccagcuggggcugaggaguccuggcccuccuuagccuuuucuuuuugagacagagucucacucucuugcccagacuagagugcacuggcaugauuauggcucacugcagccucaaccucccaggcucaagugauccucccaccucggccucccaaguagcugggacuauaggcacaugccacugcauccagcuaauuuuuuuuguuguuauuuuuuguagagaugaggucuugccaaguugcccagacugguuuugaacuccugggcucaggcaguccucucaccuuggccucccaaaaugcugggauuacaggcgugagccaccacacccagccuucuguagccuuucgcuuugcugcuggccccacccaaccugcugcagugacuucugcuaccuacuugguuccuguaggccugcgugugcaaaccaugucuuagaaauaggaaaaccaacccaagggaaccucauggagccuucagcuauccaggcuuuuguauccuuuggguaacacugugugggaguuccauuucugcaccugcuacaggaugugagaccuggcagaaacuuuuuuagcuugcacaugggauggaaacuguaccaucaggucuccuuucugguugugguugauuugugagaaaguguacagagaugcuuagggugucgggaacacgugccgcagugcagagggugugagugagcagcaaggagccugccccuuugacaaagcuuucucgguccacagacaauauugacucacgccuacuccagagugguccugagaguccuggaagcagccguggcggccaagaagcgauuuaguguauacgucacagagucacagccugauuugucagggcaaguaccuuucuguucaguuaugugcccagccauaauuuuacagagcaaacugcggauuacaguccaacaggaucagaaccagaaugugcccccagcuugccagcagucagcacugccuuucauuguaccuuuuccugccuuuggaagaaaaaucacugaauuugcagcaggccgcaguauaugaucuagggguuucacuuaaguaguuaacuccguggaagagcagagauuguauugaugaagauuuuuaucaaggaauagguaacuuauaucucccucucucuagacgauaaucaaagcaaaacuuccuccuuuuuuccugaauuuacaucucuuacccagagucuaagaguauaguuuuccaaaaauacuucuuucuaaagaacucaaauucuuguuuccuuaguccaaaguauugggaucugccccuuaacccauuaguauuaaugugaguuucaagcaaacauccacuguccacauuaggugacauacaucacugugguacugucuuguacuuucucuaacguucucaaaaugucaucuucaguaagaaaauggccaaagcccucugccaccucaacgucccugucacuguggugcuagaugcugcugucgggugagugcccaucuuccccagccauaaucaccucccccaccccaugcuggcuuacagcaaguuuucagauugaaaguuugagucccguucauaaagccacaccagguagcguccuacuucuuaauuaauagcugcccuaaaccagcaagcuuguuaugagguugugauagcauacaaagaagacagagcuguaggauguuggggagagugggaguugugucuauagcuuuauggcuguaaguguugaguuuguuguuguuguuguuuuuguuuguuuguuuuuuguuuuuuugagauggagucuugcccuguugcccaggcuggagugcaauggcaugaucuugguucacugcaaucuccaccucccagguucaagcgauucuccugccucagccuccuaaguagcugggauuaccggcgcaugccaccaugccacguuaauucuuuuauauuuuuaguagagaugggguuucaccauguuggccaggcuggucucgaacuccugaacucaggugaucugcccgccuuggccucccaaagugcugggauuacaggcgugagccaccacgcccagccagugcaaaugcauuuuaagagcaaaguacaaaggucaguugggaucagcagaggguaaucagggcucuguauuucugugaagaccuggcuguccucaguggcauacugggaugcuuugucucaccuagaagaugcagcuugugucgcaaagccaagucacauguuccugggauugucaguguauuucccaagaaaaaacaagaguagugaucucuuggaaugaaaacaagauagaugauuaaggaaauuaggaauguguucaaaaguaaggauuuugaggaauucuacuaauugcucauuuuaaagacuaaauuggccuucauccuaccagaaagauucuuaagguugggcacaguggcucauaccugaggcagguggaucgcuagaguucaggaguuggagaccagccugggcaauauggcgaaaccccaucucuagggcaugguggcauaugcuguggucccagcuaccugggaggcugaaaugggaggaucgcuugagccuaagagguagagguuugggcugagaucaugccacugcacucuagccugggcaacagagugagaucuggucucaaaaaaaaaaagaaagauuuuuaaaacugcauaacacuuuuguccaacuucagaucucaucagauuuuaaaauuuuguuugguuugugcugaaguagaaaagaaaguagaggauaccacacuuggaaggaagacugcugugucaggacauucuugcuucacuuacacacauauguacgugugcaugcgccgggcggcagugugaaguguaugucucauuguagggucaugaccagaaaacaccccugguaacaaugccaggggucuaucgcguguuaagugcgcuuuaaaaaaaacagguaguuaugggaggaacuuaccuugauagaaauggaauauugaucuuugcagaugaugaugcuacucguuagagccaagaaaauaaagcaugaaaagcuuuuuuuccccuuagcuacaucauggagaaagcagaucuugucauaguuggugcugaaggaguuguugaaaacggaggaauuauuaacaagguaagagcaucaguucuccccaguucccugcucaagacuuggaggugucuugcugaccuaggacaccacagcaguguugauuaugguuccuucuaauccugcuucacuucaggacuucaucaugguauugaguuguugcccauuucccguaagucauagcaaugggcaguccaguuucagucaaaucuuuuuuagauugaucuacauaaaugaagacaauguaauuuggucaggugugaugccuuauaccuguaauccuagcaauuugagaggccagggugggaggaucacuugaggccuugaguucaagaccagccugggcaacauagugaaacccugucucuacaaaaaauuagaaaaauuagcugggcgugguggugcuugccuguaguuccagcugcccaggaagcugaggcaggaguaucacgugagcccaggaauuugagguugcaguaaguuaugaucacacuacugcauuccagccugggcgauggugagacccugucucaguaaaaaaaaaaaaaaaaaaaguguaauuuauauuuauacaaaauuggcuugaauuggaauugggguuugucugguuuuugcuuuauuuauguguauauguauguuuuauuuaugcauauauauacacacacauaauauauauacacaaauauuuuuaaaauauuauuuauauauuuacauauaaaguauguauguauaaaauacguguauuuauauauaaauauuauauauauuuuaaaauagagacacauucacucuguugcccaggcuguaguguaguacagugaucauagcuuacugcagucuugaacuccuagccugaagcaaucuuuccacuucccaaagugcuaggauuacaggcaugagccacuguggccggccugucauuuguuuucauuuuaauugagcacauuugaccucaauuuauuacaaucucucucuccauuauuuaauuuagaaaagcuucaugaaagcuuuuuuuaguuaaaauauauguaacauaaggccgggcguaguagcucacgccuauaaucccagcacuuugggaggcugaggcagguagaucaucugaggucaggaguucgagaccagccuggccaacauggugaaaccccauaucuacuaaaaauacaaaaaauuagcugggcaugguggcgggugccuguaaucccagcuacuuggcaggcugacgcaggagaaucgcuugaaccugggaggcggaggucugcaggcagaguguugagucacaugguaacuauauauuuaacuuucagaaacuaaugauuuuccacagcagcugcacuacuuuacauucccacuagcaaagcacaaagguuccaauuucucuacauccuugccaacacuuguuuuuuuaaauuuuuuuauuuuuugagauggaguuucacucuugcuguccaggcuggagugcaauggcacagucuuggcucacugcaaccuccagugcccggguucaagcgagucuccugcuucagccucccuaguagcugggauuacaggcaccccccaucccaccaugcccagcuaauuuuuuguauuuuuaguagagaugggguuucccuauauuggccagcuggucucaaacuccugaccucaggugauccacccaccucggccucccaaagugcugggauuacaggcgugagccaccacauccagccucuaguggcuguuucuauauccuuugagaaacauuuauuuuuuugauuccaaagucagaauuagauauaucuaauauauguauuagauauauguauaucuauauuauauacauaacuuucuauugcuguuuuuuaauuguuccuuuauuguaauugagacgaggucucaccguguugccuaggcuggucccaaacucauggguucaggugauccacccaccucggccucccaaaaugcuggaauacaggcaugcaccacugugcccggcccgcuuuucuguggcuucuacuucagaugcacucuagagcucauccauuccauuuucugccuucccagauuggaaccaaccagauggcugugugugccaaagcacagaacaaaccuuucuaugugguugcagaaaguuucaaguuuguccggcucuuuccacuaaaccagcaagacgucccagauaaguuuaaggcaagaguuuuacauauuugaagggguacuaaagucuaaacagaaaccuuuggaaauuguaguccuaagaauguuccaguaauuuuuucacuuccuauugcuacuuuccccaacacuuggaauacaaagauaaauuggugauuggacucacacauuugucccuagaacuucagucuuucagucucuuuaaguagcaccauagauggguggagaggaagcccgaagcugguggguaagucccagcuuugggcuuaacugagcucagcucccaucaccacaacuuacaaacugugcgaguugaggcaaguccuuucauuucaaccucugaaccgguuuucuugucuguaaaauggcauagcaguaucugacagggucaugaggauucuaagauaaucuuagcacagucccuggcacgcugcaagcucucuauugugacucucgaucuucccuugagaggucuggagaaguuaauccggcaugagaaugaggggacaugggauuuaaguuuguuacacuacagcucucagccagcacacugccaugaucuggcucauggccacaacucugcccucgucucuaguguccugcauagcuuaguuucucccauuuucagagagcagucucaggaaguagcacacugaucacucacaccaaggcccuaccaggucagagcacuaaauauucagugccgacuaauguguacuucucuccucaguauaaggcagacacucucaaggucgcgcagacuggacaagaccucaaagaggagcauccgugggucgacuacacugccccuuccuuaaucacucugcuguuuacagaccugggcgugcugacacccucagcagucagcgaugagcucaucaagcucuaucuguaaccugugagcccuuuccugccaaggugcagcuuacguaguugaggcagggugaguagcugcuugacaccccagugagucaggccaaaacugagauguguuuaaugaagauuuauggaguaaggacuuaaaaucauacaucuuggagaaccuuucuuacucauuucagucccaucuaaaaaugugucagcuauucuaaaucccaacuuaaauuguucuuacgguuucuagaaacuuuccuuuucaguuuccagaaauacaaguuagauaauuggcuacuuaacugaugaaagaugagcccaaguccaccugucuucauccuccccugcacuccagacugaucugccuaaagcacgcgagaugcaggcgaaaagcagccacaccccucugccacaaaugaccaacagcuggucaggacguuacacgcggugccuuguaagaggcaagaaacacuugcugaaucugcaucuggcuuccagugguaagcacauuccucagcaggaucaagccaaacaguaaaaacuaccaagagaacacgaggaaggcagaaacgauguuuagcaacaguauucugcaugguucacugcuuaagaaaaugccuucuggaauauuuguaaacugaaauucuguauguguaagagauguuuaaauauguuuggguccuaaacagcuuuuuaaaauuauacuugggaauaaauucagcaucuuuucaaauaaacucuaugaaagacgcuga

SEQ ID NO: 6309 - RNA, 6683 nt, Homo sapiens
cucgcccgccccggaagugcaaacuguguggucuggcagguguggauuccgccggugaaggcugaaggcagcuaccuuaaagaugccgggauccgcagcgaagggcucggaguugucagagaggaucgagagcuucguggagacccugaagcgggguggugggccgcgcagcuccgaggaaauggcucgggagacccuaggguugcugcgccagaucaucacggaccaccgcuggagcaacgcgggugaggccggccugccuccgccggcgaaccuggccccugucuguucccgaucccagggcugaaaauuucccaggccucacuucgcguuggcuccucuuauccucucucuuuuggacuguaggggagcugauggagcugauccgcagagagggcaggaggaugacggccgcucagcccuccgagaccaccgugggcaacauggugcggagagugcucaagauuauccgggaggaguauggcaggucaggcucacguccugggcuccugguuggauccagugacacuuuuugcacgggccccucuaccugcucggagacuuuauuggagcugaacagcccuuguuaccugccugaccacuccuccccaccucucucuuugggucuuguugccucuauagacuccauggacgcagcgacgagagugaucagcaggagucccugcacaaacuguugacauccggaggccuaaacgaggauuucagcuuccauuaugcccaacuccaguccaacaucauugaggcgauuaaugagcugcuaguggagcuggguaagaggccugaucgcugggaaaaugggacuggucacaggcacauaagggaacagaagccucugaagguuguucauuagcagagaugggagauuagcugucuucugguucucagagguuuguccuccuuccugauuaggaaauguugcaacaggugacaggaccaaaguaauccucucuacuuuuccuuacagaccaacccuugauagacuacagaucuguggaguggaacagacucuauuaggacagaguuuuauuuucauuguaaagaaacaaaaugaacucccuagagagccaaggucgauagaccuccuucacuaucugaauuuuuauacacacguacacguauaccauuucuaucccccuugucauugcgguccaagugacuugcagauauucauuguaaucagaggaugaagaagcugcuuccaaauugcucccccauuuuuucuucucuggccagucucucucauguagaaguguuguggccaccuuuuggaggaagacuucuuuuaggccgaagcucucuuuacccuauucucagcacuuuaggauuucccagauugccauuccuuggcugaaucuacugucuucaaaaucaguuguaaggagcucuguagugacagaggugguucauagguagggguacuucuggaagagggcaggcagaaaaucccagaggaguggggcuuuuaagaaauugugacauagcugggcaugguggcucacaccuguaaucccacaacuuugggaggccaaggugaguggauugcuugagaccaggaguucaaaaccagccugggcaacauagugggacccugucucuauuaaaaaaaaagaaauugugacauuucacuuuaagcacauuaacccugugguaccagggucugcuaggugggcagugcaugugaagggcagacaucuuuuuccguauacgcguaauguguguuugugauauagcaauuucauauauauauauauauauauauauuuuuuuuuuuuuuuuuuuuuuuuuuuuugcaaaaccguucuuacagaagggacaauggagaacauugcagcccaggcucuggagcacauucacuccaaugaggugaucaugaccauuggcuucucccgaacaguagaggccuuccucaaagaggcugcccgaaagaggaaauuccaugucauuguagcagagugugcuccuuucugccagguaaggagacugcuggaguugcuacuaagaaaaaugaaaaaugaagaagaaauaaacgagagauggguagggccauuccaaccuugaauugauaagcaagacuuugagacacugagaagaucaaguaaaacauuaagugaauuuucaagguguucguccugugaacauucauaaauagugguuuaagaaaguuggggccgggagcgauggcucaugccuguaaucccagcacuuugggaggcugggcggguggauuaccugaggucaggaguucgagagcagccuggccaacaugacaaaaccccgucuccacuaaaaauacaaaaauuagcugggcgugguggcacaugccuguaaucccagcuacucuggagggugaggcaggagaauugcuugaaccuggaaggcagagguugcaaugagccaagauagcgccacugcacuccagccuggacgacagagcaagacucugucucaaaaaaaaaaaaaaagauggcgagcugcuggguucaaggaaagauaacuugauucuuuuaggaaucaaagcaggguaaauuaccuuggggaugacuaaugcuuggucugaccucacuugauccuaaguaaauaauaggucucaaaaaggaaauauguaaggaugcagguuguuuuaaaauaaugagccaggagcuaucuugucagcaaucgugauuauauuauacaugcauguuguauuuccaguuuuauggcugcucuggugcugcuguggagcauuagacauuuauuagcuuccccugggcuucccuacagcuuaccagagcuaugagagucugaaaaaucaguuguccgaaaaaugaguuaucuauuggaaauuaugugcuggauaugcccauaucacacaauuccccagauccaguuacauuugagagcacuuuucacuauuucucacucuuucucuuagaaucagccuuucccucccauugcagggucaugaaauggcugugaauuuguccaaagcagguauugagacaacugucaugacugaugcugccauuuuugccguuaugucaagagucaacaagguggguauaucuggaguuauguugaauucaugaagauuauguuucuaaaauauugauuuuuaucuccuccuguaauauccacggugagagaauaaaguuucuagcaccuuucaaaguacauacuuaggccuuuuuaaucuguuaacugaauuucuuuucccuuuuuucugcaucauuguuccucucuuggaguagccucuaaauuugguugaagcauugaaaagaaugaaguauuaaauagaacuaaggcaagagugucaguuucuagggauuggcuacagggcuccugccuuaugcucaaagagcuuggcaguuguggauagugaaugaaaaagauuccuggcuucucagaagguauggcaucucaauuuccagaaaauaugggacugagagcaguagguuuugcaguuucuugucccauuuuacauucauucuuuccuuggaaaccuacuuuuaagcuagaacuuguauugagccagggaucccuucaccucuaccagucugugaccccucacgauaccaauucugaggucuaagcauuuagcuuuuuguggccaguggcccuuuuagggcuccacccccaggauggcucacauuuuuugucuugucccaaaggugaucauuggcacgaagaccauccuggccaauggggcccugagagcugugacaggaacucacacucuggcacuggcagcaaaacaccauuccaccccacucaucgucugugcaccuauguucaaacuuucuccacagguaagugugucugucucuagcuagaagccagcagaaaagaaggaagccaaaggguaggcuugaacucugggacuucaaccaccucacuccagggccuccauuuaucugcauuuacucaauggauuacacccaguggaggcuggaaagaaccacagaagucuugauucaguaaaacaguugagaguucucagcugucaacuuuaggaagucaagauuguaaggacaauauguaguugggaaagguccuuugcuuacgauugccaccacucccugucgccugaccauuucugaaaaugccaagcagguugaaaguaggaucauagaaucaguuuuguuauuguugcagggccuguccuuuguaaccugaauacaagcaaggacuaagugaagagccauuucaucagugauagaagcuauuugcuuugaaaacaucaaccuauuuauaggucucuauuuuuuaaauugaggugaaauucacauaacauacaauuaaccauuuuaaaguauacaauuuagugauaucuaguacauucacagcauuguacaaccaccacucucuaguuucaaaacuuuuucuccacuguagaaaaacacccuguacccauuaaguaaucucucccuauuuguccuucuccccaucuccuccaaucugcuccugucucuauggauuugcccauuuuguauaaaaggaaucauauaauaugugacauguugugccugacuuuuuucacuuagcaugauguuuucaaaguucauccauguuguaaugucagaauuuccuuucgaggcugaauaauauuccauuauaugaacauaccacaauuuauuaauccauucaucuguuuaugggcauuuggguugguuccagcuuuuggcuuuugugaauaaugcugcuauaagcaucuguguauaaguuuucuguguggacauauguuuucaucucuaggguacauaccuaggaguggaauugcugggucucuaguuuuuauaaauuuuuuccuuuuuaguuccccaaugaagaagacucauuucauaaguuuguggcuccugaagaaguccugccauucacagaagguacagaagcugugugugcaugcgugcauguguuguguguauucgggguuugugugugcauguguuuuggucuuuuuguuguuuuguuggucaguagaacugaaugcugucaaguuguguuuuuuaucauacuucuuguggggacuguuuucuuuagaagcucaaagugcuugaggaccugaccaaguccauguuaauuuguucugagacaaauauauuuuagauuuguuggggcuauuguggguuggaucauuuagcauugucuggguuuggcuuugcaugcuguuugagauauagacaacaaccaguugggaaaauguaccuguuuuccugcuauaaggagucauuuuggugaauugacucccaaaggaagcagguugugaaauguuccuccuuagaaaacucaccuguagccuggauagucucaugucuugggguucuuuucucuggcuucuucugaaggcagcagcucagcucauuacgcgugcagccucaucagcaaggguggccuuacacaccaucugagagcaacgcauaguaguugguugggguccuaguuccucuuggaaguugauugacuucaucccuuuauuuaaauaaacauucaaucuucaagaaauaguuauugagcaccuacaauguauccagcacucuucuaggcacugaagauaaaacaaugaaugaaaaagauaaggcccuguucccacacauucuauuguggaagacagaugagaaaguaucaggucaugggaugccugaggacaagcaaggcugaugugguagaaaguggcuaggggccugagauugaggaagggucuuaaugagaugacauuucagcugaguccugaaugaacagaguccaccauaugaagaucauaguuuucuaugagcuggugcaggggcuuagccaguuagaaaaggauggccauacauggcuagacaguaaugagcaagggggagagugguccaaauuguaauucauguggugugucagggagggcccagaucuuaaacuucaauccugaguuugaauuuuauucugagggcugugcagaggcaugggagaguuguaagcagggauugucaugaucugaagucaucucuucugguuugcauuuuuccauagcuucccguccuuggggagcuaauaugccugcauucucgagccuggaaucuauaugcuacuuaauuaugagagagggagccucaguuuuaccuuuagcaugugugcuugccuuucaggggacauucuggagaaggucagcgugcauugcccuguguuugacuacguucccccagagcucauuacccucuuuaucuccaacauuggugggaaugcaccuuccuacaucuaccgccugaugagugaacucuaccauccugaugaucauguuuuaugaccgaccacacguguccuaagcagauugcuuaggcagauacagaaugaagaggagacuugaguguugcugcugaagcacauccuugcaaugugggagugcacaggaguccaccuaaaaaaaaaauccuugauacuguugccugccuuuuuagucaccccguaacaagggcacacauccaggacugugucuugccuuucagaucuuaacagagcagcagggcuuaacuuguugauuuuggagccucuuagugaccugguugcgucugugucaggaacuuaaacuuucugguucaguaguguguuaaacauaacacugaauaccuuacugggauacagauuuuugcucagaaauggcuaugacacuuuuucuaggcucuaccaauaaaagccacuugaagguucca

SEQ ID NO: 6310 - RNA, 3794 nt, Homo sapiens
guaacgcguggcucccuugggcuggcgggaggggccggaggcucgcgaggggcgggggcggcgacggcggcggagcguaggggaggggaccggagaggaggggaugagcacacgggagaggagaagagggagacccgccgccucccucccucccuagcugacuugcucccucccgggcugcggcugcugcaaaagccagcagcggcagcgggagcuguccggaggccggcgucgaggugagacccgggcagacugaggcugcggguaggaguggaccgaccgacggcugacgccgggcggacugcacgggaaugcgggugucuggagggcuggugguggugcugggcgggcugaaccaucgggaggaggcgccagcccaccgaaggcgagggaagccccgggagaggggcugacaggggaucgaaggagauaaccaggucccccagaaaggggcgggagcguccucgcccuaaacgcgcagcaagaaaacccgcaccgccugggagcccagggaggaggggaggaugcagagggaguggaaugcgaaugucggguccucugcccagucggccugucggagugcuauuugcacagcucguugauuuuggggugcugggaucugagagucuggaucuuguuggauggacccagggagagacccuggagaagguccuguuuacaaaaggguuaaucuuccccagggcucuccaagcagaagacuuugaguagagcacuccucccgcagggaugucccacccuaaggcaaaggaaaccccaacuuuucuuccucucccuagaggcagugcaaggcuggcccugagacaggaauguggcccaauugggccugcagugcugagcgcccucuucccuccucaccccaagccuaucuccuccucuuccaggguuugccgcugucucugcuauuccauccuccccauaggggcucucuccccucucccaucucaagauggcagccagcagcucugagaucucugagaugaaggggguugaggagagucccaagguuccaggcgaagggccuggccauucugaagcugaaacuggcccuccccagguccuagcagggguaccagaccagccagaggccccgcagccagguccaaacaccacugcggccccuguggacucagggcccaaggcugggcuggcuccagaaaccacagagaccccggcuggggccucagaaacagcccaggccacagaccucagcuuaagcccaggaggggaaucaaaggccaacugcagccccgaagacccaugccaagaaacaguguccaaaccagaagugagcaaagaggccacugcagaccagggguccaggcuggagucugcagccccaccugaaccagccccagagccugcuccccaaccagacccccggccagauucccagccuacccccaagccagcccuucaaccagagcucccuacccaggaggaccccaccccugagauucugucugagaguguaggggaaaagcaagagaauggggcaguggugccccugcaggcuggugauggggaagagggcccagccccugagccucacucaccacccucaaaaaaaucccccccagccaauggggcccccccccgagugcugcagcagcugguugaggaggaucgaaugagaagggcacacagugggcauccaggaucuccccgagguagccugagccgccaccccagcucccaguuggcagguccugggguggaggggggugaaggcacccagaaaccucgggacuacaucauccuugccauccuguccugcuucugccccauguggccugucaacaucguggccuucgcuuaugcugucauggugagccccaugggacccuagcccaggccugcuguggcucccagcuucccgccagcgcugcaauagagccucuggaguaaucaugccuuccuuccccucuccucucugcauggaucccaccuccccaauuccagggccuuuguuugccucucccuaggaccuaacccucugagccaccacugcccugccccuuugggugggagggauauggaaacacgugucacacagccucgcugaccugugcccuccucccccugccccuucacuccuccuuccucccuuacccgccaucuauggggcuggccucucucucuucuggaugacuuuuccaccugaucccuucugggcuggcuucuccugaccccggcuaugugccuccaccccucgcccuaaccccagucccggaacagccugcagcagggggacguggacggggcccagcgucugggccggguagccaagcucuuaagcaucguggcgcugguggggggaguccucaucaucaucgccuccugcgucaucaacuuaggcggugagugggggcuugggacaggcaggggaggaauggaaggguuggcaagggcagcuuuacuaaccccugccccugcucucuccugucuguccuccuuaccucuccuuugucucuccuugucucccccuccccccgucuguccuucccucuccucucccacaguguauaagugaggggcucugccccgcaucccaagacuuuucuuccuguugggagcugccuugggcccaucccuccccuggggggagcccaacugauggcccuggcccccaccccuaaggaccaagggagccugagcggccuuguuuacagcuucuguccugcuccugcaucuugccaggcuccucugccaacuguaggccugccucaucccugcacugguuccaaccucccugcacuaaugccugcauccccuccggccucuuggcccccuaucccugcacuucuggaaaccucccugcacucuggaaaccucccugaacaccuccccaacucugcgcucucagccucccugcaucucuccuggccucccugcacuucuuccagccccccaaauucucuggaccuccacccuggccgccuccucccaacuuucauugucuuggcaucucucaacccucaguccucucuuccuucccuucuuuaucaucuccccuuuccucuccacgucccgcccccuuccucuuccugccuccucaucucccuuaagcauccucuucuccaaccucccgucaccguuuacucugcaaaauugacagcacuuagacgaggcuugggggcagggagcaguguugggagagggcuccccaaccccaggcucggacuguucucugcugggaccacccagggucggacacccaagggugccuggcaggucgcagaguuggcaagccgggccucguauggggacucgggugaggguggcgaguacugguuccgaacgcacgcaggggagaagggagggacgcggcgcugacccuuccaggucagcuggaguugacccgcccaccugggcuuuucaaccccaguccgcgaguuucuuucuugaaggugugggggcuagauucauucacgugcuucguaaugaaauaauccaaaaaauaggaccaaagcgcccacuggcaggagcgagggcggggcgccgcgcucuauaauuauuuucuaagaugaugggggagguuuguugcacgcgacagcccgcugaggaggcggggaccgagcuacaacgcgguucggauuuggcggggguuuuuuuccuuaaaaaaaaaaaaaaaaaaaaaaaaaaagucugggggaagaaaaaaacuaaaauucuuaaaaaaaaaaaaaaaaggcuauuaucaaacugauuucucccuuuuuguaugccggaugcugcaugagucugaaacaccaauaaacggagacugcaugaga

SEQ ID NO: 6311 - RNA, 3794 nt, Homo sapiens; identical to SEQ ID NO: 6310

SEQ ID NO: 6312 - RNA, 3794 nt, Homo sapiens; identical to SEQ ID NO: 6310

SEQ ID NO: 6313 - RNA, 21383 nt, Homo sapiens
auccuacccugugccgcagccgcaucgccaccgcagcccggcagagccgagcccggcccaggccccugccccugcccggcccucggccagucgcccccggccccgcccccgcccgcaggccccccgcagcggccgcggcgccccccggcgcccccagaccccggccuccggcacagaggcgggagacccggagcagcagcagaggcaggaggacuaggaggaggaggaggagccgucgcaggaugaaggaucggacucaagagcugcggagugugagcuuggggguggggagaaugggggggcgggaccccaauauugggggagcgcguggggauggagugggggaggugcugggacgugggggcgaaggaugagaucggagguugguagccggagcaccccaguaucuucaggcgccugaugucucuccagugaaccugcauuuuggggacagugccuggaagggguuggaggccaugaagacacaagggggcaggagaggucucaggggccucgaacaccccgcauucccaggagggccccggggucuggucuggggaugggagagaguggauaucaggagaaaccggaggagacugucauccccugggcagguuugccaaagagaagcaugggggcggugacugggccaggcugagagucuagcaggacccagauucaggggaugcuacggggaaggacacagguugggacugagaugccagcaccuggcagugaaugaagugugugugugugugcacacgcgugugucacucccuauagggagggggcaucucuccgagacagggagggaagagguggccuccggagagagccagagggccagggccugagacagggugacccagaggugggagauggggaugcagaggagagggccauggaacacgggccgugcucugcuugggggaacuggggcaccccgggcagucaagggcugaugcaggccccaggucugcaggccugaagaggcccggcuccaagagucuggccaggcagucccugguuuuggggggacaggggaaggacugcaguggaggcugcuaccuggaggaacuggggagugggguucgaugagaaugguuucaggggcagggaggacgcugggguauuuggagaaaugaccuggggcccgaggaggcagcacugacaguccgcacugugcugggcuggugguguuauguuaauaaggguaccggccccggcugagcugcccaaugcacugagccuuuacagggaacugguggguuguuaccccagggguuauuaccccacuugacagaugaggaaacugagauucaggcgugggaagggacuuguccaaggucaccaagcaaguggguggggggcagacugcaaucuggguuuccugucugcuagguugacacaggucucugcuuuucuggccuuugaaacagaaguuucagcacugggggugaagagcuguccccuggauuuggggguggggacccagguuacagacagacgagaagaagguguuuggaggcaagugaccgcugucucuggggacagacagguugccaaaugggaagcaaggaggagcugguggcugagggagggaauuuuaaagguuucuuuauuacauuuuuacugaauauacacucaggcaugaggaaagugacaguaauaauaaacauuguuugaaguguuuuaugcauauucacucauuuugauccucacagcaauccuaugagacugguuaucucauuucauagauauauaaauaucuuuuuagauauauagauauauguuaucucauuuuauagauaaggacacuaagcucagagagguuaaguaauuagaccaaagucacacagcugguaaaggcaggauucaaacccaggcaggccggcuucagcaucggugcugucaauuccccuccucaguuugcagagcaggcuuucauccgugaugucauuagagccccacugaccuccuggcaaguggacggggaggcucuuucauuuuagaguuggggaaacugaggcccagagugguugaauaacuuuccaaaggucacacagcuagcaggugagggauccggacuugaacccaguuccccugcuaccaggacuauuccaugacuccaaaacccagggaaauggaaguggguugggaucaggugguguggaauugggguacaauucgagaaagagggagggaaaaggcuaagcgggguaagggggaggcaggggagggggaggccucaugaaugagucaggggccccugcucagagguaaggaauccuguuggcuguggcugccggaggugguguggaagggugaaggggcugaguggaugugguggcuuugguauuagucacagcucagggaaacuggagauucaagagggggcgggcggggugggaaaagcugacagauucagguagcguaagggucucccugcuacaguugaaagcaaggagccugggaugcaggagacaccuggcagggugugggggaccuggaaacggggucucugagacacugggagggaugaggcaggggcgguggugggaggggacauuagcccaggggacugauugucuuuccaacaguaccuuggcauucccaagggguucucaaguccguuugucacacagugguuucgggagccagacugucuggguucaaauucuaauuuugcuacuuccugugagaccuugggcaaguugcuuaaccucucugguccucaauuucuucgcguaugaguugggagaaguaagagugccuguuucacaggguuguccugaggacuggaaguaguuaauaugcaucaggugccuaggagggggccuggcgcccagcagugcugugugucuguuacccagcagauggcuuguuuauuucucuucaacaccacacaagcccccugcgaugggcaggacauggccccuauuuuauuuuggaguacauugagggccagaggggguaaaaaaaaccugacuuguccaaggucagauagcuuuuaaugguugaggugggcuugaaccaggguuuucugcguccaguuuaccaggcaaccuugguuggugcuaggcugguuguggaggcugugaaaaggaguuaaucagcuaaauaggugucccagggucuaaggagugaagccagaguggggcuccagaggaaagagcagagugagugagguggagaggaagguggguuaugggagaagacaggaggggcacagggagggcugaggucugagacgcagcuguggagucgggugggagaagugcggagacacccugggaggaagguggggccugcacugcaggagccugaaucugaggcuggacaggaugaaggcugcugagggaccgccccgugccccaaaggcccucagguaugaggcaggcacaguaggugcuuuagaaacgcagcccugaaaucacagggugcagagaccaacgaacccugggugauggauccauauccuccagcugcucugggcugccuuuauuuauauuuaaaaaaauguuuuuagagacauggucuuccucugucaccuaggcuggagugcagcggugcaaucacagcucacugcagccuugaccuccuggucuccagggauccuccugccacagccucucgaguagcugggauuacagaugcgcaccaccaugccuggcuaauucuuuuugcuuuuguagagauggggucuauguugaccagacuggucuugaacuccuggccucaaaugauccucccgccacgcccucccaaagugcugguauuccaggcaugagccaccgcgcucggcuggcacugggcuucuuucugcuauccaaacacacaaguuuaccccuguccaaggaccuucgcgcaugcuguucccucugcccagcaugcuguucccucugcccugaauucuguuuccccagcacuguggcacaguuggcuccuucaggaccuagcucagaugucaccuccccagaaaagcccugcuaacuguccuguagaaauccuuccacaaucccccccaauucccaugucucucaauuccaucuuucugcuuaucucccuccugcuauucagcacaaucugaaauggucuuguucaccucccauugucugccucccccacuggaaugccagcucccuggaggcaggcccuccucgccugucuucuucaccaccacaucgccagcagcacccagaagaguaccuggcacaaaucagacacauccguuagaugaaugaaugacuccaugaagcagagggaggaugagaaaggggcaggggguaaggcaggaaagauggaggagagaggucagggugagagggccaggcugcucagggggagggagcaaggagaggccccagccagggagacagauggacugaagcagagggugggggaaagggcgcagggggaggcugcugccuccgaucaaacgaugaugcuugcaccccugaggagcaugggaagcccgugugugucagugcuggggcacgcauauguuuacacacacacacguacacacacgcacacucucucugacuuuucugucacccaauuccagucucuugccgccucuguguuuuugucaccgucucaccaucugucucucuggucacugacuugcuggcucucacugucacucuccuccuuccgcuucuguaucuguccuugccgucgcuccacaucgacauacacacaaggcccgugguggcucugguguggaagaccuggacuuagggggccccugaggaggucaggcugcagcuggaggcuuggaucugaugugcgcaguccccaggugcuucuggaaggggcucaggggcacugcacucucucauucaaucccucucaagugcucaaggagcugugcgcuguagagcagagugccugaguuugagucaucccaucagcugugugaucuugggcaaguuacccaaucucucugcgccuccaccuccucaucuguccagugagaauaagaauaugaccucauggaguggucgugaggauuaaacaagagaugcaggcugggugcaguggcucacaccugucaucccagcgcuuugggaggccaaggagagaggaucucuugagcccaggaguucgagaccagccugggcaauauagugagaucccaucucucaaaaaaaaaaaaaaaaaaaggaaaaagaaaaaaaaagaaaugcaaagcacuuguaauaggacccaacucgugguaaucagcacauauauguuacauccucgauuugcacaugaggcaacugaggcuugaaucguucaccuguaaccugaggccaccauaaaguagacuggggcacauuugaucaucuuuuccuagguagucugguuugcccacagccugcuuucuuuuuggcuggccuaacuucuuccagaaauggaugcuguacucauuacuaaauaugcaucacucagagcacggagggcccuucagagcagggugggcacuugcaccagucugcucauuucagugaugagggaacuggggcccagggaggagucuaaguuugccuggggucacacagcaagacagacggaggcugggagggauggccuccuguccaagcucuuccugcagcccugggccccuccuacugauuuucuguccuggcugcaggaguucagcaguccugaggacauggcagagugggcuuuuuaggaccaggagggacugccaucugucagcaggacagaagggagagagccugacauuuagugccagacaguccuggguucagguccuaccucuggccucauuugcugugaagcuuuaggcaggucaggcaaccucucugagccuguuuccuugucuguaacauggaaucagccggugguaggcauuguuaccacucagcaaaugcagagacuaggcucagggguagagccaaauggucuucuaacagcugaccuggggcaaguucuuuuuuuuuuuuuuuuaagaaacggggucuugcucugucacccaggcuggagugcaguggcacaaucacagcucacugcagucucuugaccuccugagcuccggggauccuccuaccucacccucccaaguagcugagacuacaggugcgcaccaccaugcccagcuaauuuuuguauuuuuuguagagacaugaucuugcuauguugcccaggcuggucuugaacuccuggguucaagugauccucccaccagagccucccaaagugcugggauuacaggcgugagccacuacaacuggccugaguuauuuagcucuaugccucaguuuccccaucuauaaaagggggcuauaauaauaccuccaaggggacuguuguaagaaugaaauggauagauauauguggagcacauagaacagugccuggcacauuguaaaacaucaucuaaauauuugcauaaguauaauuauguuggccaaugguccuuacagaguccuaaugaagauuaaaugagauaacaagaauguaagacuuacgcaaaaaauaccaucaagugcucuuguuuugcuagguuguccggacacagagccuuccccagauugggacuuagcaggcgcucacugagagggaaaguaacugggagcggaaagucagugggggagguagcccagucuggagccuaacagcggucuuugaggggcuggaugcccaugguuuucuggcccuauguggccugggugcccuugggcaagucacucuccuuuuaccccccuggcuuccuguucccucaucugugaaauggggacgaugauguuuaugcagcuuuucucucagggcugguggugcugaggaucaaaacggauuauggauguaaaaguguuuguaaaugguagaggauuauuagcucccagcucucuuuguauuuauuauaccaaauaaaccacacuugggccuucuaucauucuuccugucuugagggcaaacaaauagguagcccagggugcuccagagaugaaccuaagggagguggcuccaagaacaacaggagagauugaaauuagauuuuaggaaagacuuccuaacauuagcauggggaagggagagacacagagaacaggaaaguccucaggcacccgggccagggagaggccgcaugaccugcgugaggcugguggcugagugagugguugaagggagagaaagggcagaggaaggcuuuuggcucuaggggaaggaggccuuguagcacagcuggauuuugaggacagagaaagugaagagcaucaugguaggccgauggguccucagaggugagcccagcaucccagagccucucaggguccccaacuuaugccaccugugccgccccacuuucugggggcagcugugagccaagacagaggaaacucccuuuccaggcggaugguugggauugucuggaaauucaacacaagugcugaacacauuuuccgacacagugugggcccagcgucugugugaagacucccuggaguuccauuugggcugggcuuagcagggaggcugggguggcucaggagcguggagcuggaggccccccaggcugugcuggcuuuuccuggggcuguggggcacugcugauccugaguuuuggcuguguggacugcaccuaggucccaucuggcccugucuagguucaaucugagcugucugggaucugucugggauccgugugagccucggcuaguucagucugagccugucugguuucuguuaggcccugucugcguuccgcugggacccuggcaagcucuucuuuuuggauuccaacugaguacacccccagguggaugcuguuuggauccugucuugauuucacccagccucugggguuuggauucugucugagcucuggcuggguucuuuuuggaaaucagaaugaacucuguauacauuuccacuggggcugaucagggcuccagaugucauuaagcuugauggacucagauuuugcugucagaccucugucccaagcagagaaggacucagguguguguagcacagggcaccuccccuacagccucuccuguccagcucugagugugugugcagacaugaggcucggagaagcuggaagaacaagcccagugagcccucccaaauguccucaggggugcagcugaaagccaguguguccacacaugucagugcggcucagcugugagucugcgugcgggugaacgccagcaucagugcaucuccgugugggugucgggggggccuauuccugugugccuugggugucagcucuucugucugugucucgagucugucugucgguggcaguggugcuguggguggguaaaucucuuugugucucugagcccugcggguggaggguugagcagcugcagguugcaacugggaaauccaagccagcaagaguaggugggugugaaguuggaaggggcuggaugaaagcaagugaauccacugcgagggagagccggcugggaggggagggagagugggcgggaagaggggggcacagggcgcgagggaggucggggugcugcccguaucucuuauccagcccucacugcuugcucaacuuggcgccugccgcuggcagugaagugaccuugcacaggggacaugucuggucagguggggcaggagaggaagagaaggaguaaagugagaucugggcaggagagcaggaacaguagggagauccaggcucccgggacucuaguccaggacccuucauggagcccagggucaguuacugcaagccugacguugagccguuguugaaauauugaaaucaucccuauuggcuggucaaggcuggcucugcgcccccaaggccacauccacccugagagggggucuuuuuccaauuccuucuaaggaauccuuugggcugacaaacacuuuuggugccuuugccaucuacccugcaugggaccccucccaggaccccuccucugagccuagagcugggagcaccugugugugcauagcagggagagggugggagagcuggagagccagccuuggggacccagguagggccugcucauggacucagccuuccuuguccccaggcgaaagacagugaugaugaagaggaggugguccacguggaucgggaccacuucauggaugaguucuuugaacagguaaugggccuccaaggcccccagccccagccccagccccagcacccagccccagccccuagucccaccgcccagccucagccccggcacccagccccagccccagcacccagccccagccccuagucccaccgcccagccgcagccccggcacccagccccuagccaccgacaacuuccuuuucccugucccccacuucccugcuccugcacccucccuggccuuuuaucagccguucuggggcugguccauuccccugaacccuggcugguuccccuggaacccguuguuuggccugacagcuuggcuggguauagccgauuuucugcuccagguggaagagauccggggcugcauugagaaacugucggaggauguggagcaggugaaaaaacagcauagcgccauccuggccgcacccaacccagaugagagugaguguggcugccggugacuguggggugggaggagaaggggccugggguucccacccagacaucucacuugcccucgcccuccccucagagaccaaacaggagcuggaggaucucacugcagacaucaagaagacggccaacaagguucgguccaaauugaaaggugaggaguacaaucccucaaccaggaaggaaaagaauuguggguggagcaugguggcucaggccuuugggagggcgaggcggggccaauugcucaaucccaggaguucaacaccagccugggcaacauggcaaaacucugucucuacaaaaaauacaaaaauuagcugggccaguuugggaggccgaggcgggugaaucacgagguccggaguucaagaccagccuggccaagauggugaaaccccaucucuacuaaaagcacaaaaauuagcugggugugguggcgggcgccuguaaucccagcuacucaggaggcugaggcagagaauugcuugaacccgggagguggagguuacagugagcugagaucgcgccacugcacuacagucugggugacagagagagacucuguuucaaaaaaaaaaaauuagcugggcaugguaguacgugccucuguuccaacuacuugggaggcugaggcacaagaaucgcuugagcccagggggucgaggcugcagugagccgagaucaugcugcuguacuccagccuggguuacagauagagacccugucucaaacaaaaaaaaaaaaaacaaaaaacaaacaaacaaaaaaaaagggacugggcgugguagcucaugccuauaaucccagaacuuugggaggccaagguggguggaucaccugagguuaggaguucaaaauccuaaccaaauccuggccaaaauggugaaaccccaucuguacuaaaaauacaaaaauuauccgggcaugguggcaggcgccuguaaucccagccacuugggaggcugaggcaggggaaucacuugaacccgggaggcagagguugcagugagccgagaucgcgccacugcacuccagccugggugacagagcaagacucuuucucaaaaaaaaaaaaaaagaacuuugccauccauugagcaaaacaggccuuucucuaaggaauuucuacaaaguuccaggagccagauuauuaaacagucagaaagcacaaaaccccagcuuucccccuugcuccaguucuuuggagaaagauauaugauaggaaaugagggaaaggagacugucuaaauugcaucugagcccugcugguuccaccagcaugaagguucaccagaaaaaggugaucuuccgaguggcuucgauuucauuaaguccucaucucuccugagcaggcccccggcauggcacagagcacccagugggugggcccagcaaaugccucugaaucgguauccuuggcucaggacagauuggacuuguguggcugacaucaggggcuggcgagcuuucaagagggacuugccaaauguucauuuauucacucuaauuuaaggacuugggugcugguaauaaccaccuucccccaaagcaccguggguugggaaccuccuugucugcucauaccagggaaauagcaguguuacuggcaugcuguuuugcaugcuccugguaagucaguaucagaaaacauaugcugagcaccuccaauguccgaggcacauugcuaggcuuuggggaagaggagcuauaucagcuaccuggccuggagaacacugaccuuggcccagagagagaaggguaguaacuccaugcccucuggacuggaggggaggccauaugugagccucagauguggauuuguaaaaacaagcccuuuguacucaggagagucugcuggauggaaacugucugaaucugggagcauguuaagugcaaauccaggcagacagagucuaaccuccaccaucagcucacccuggacaaguccccuacucucagcuuccuuaucaguacaguaagacaaaugaaagcaauuucaaaauuagcuuguuuugggggugggggguggagggcaucaaaauacuuuuuuuuccaaagucauacaaagaaucccaauauauaaaacauaaaagucagguuguucuagcugagcuggagcugggagcaccuaccugccugaccucucuucauucucugcaacagccccugaaauuccuucucagaaacaagguuccugcuggcaguuuaaaauccccugggcucaaugguuucucuagguccaucaagccuugaccuugaacacucucuguaagacccuggggagggcucugugggugagggguucaggaauagaccaagaaagaagcuggaaaaguggccgugguuuagagaagcugaccuuucagaccuccaggaaaggagagaggauucucuuaguccucuuccagcugguggcaugagcucaggcuuugggugugaccuugagugagugguuuugcccacuggaaacugaguuucuagucuaaaacaugagcugauaucacugaacucccaggaauguuguaaaaagucaaugagauccuguaagagaccccucccuccggacuugaccccagccccaaggcugacagucgggccccaaucugggccagccgauuccaauaucccugggccauguguugcugagccagagcugucacucaaucgggggagccuuggggugccauccggccccguaccucccccacugccaacagaacggaggagugaggcucuuaggaauggccuggaggcuggugaggucugagagggccggugauucaucccugcugcauuuucugaucucaccgagguagauuuugccacaaucucuuuuuuagaaaaucggaacgauagugucaggagugcuugauccagaagcaggaaucucaguuaaucugugcacuuuuccagaacguccuucagaagugggaauucccggaucggggaucaccuuacagggcagggagagggcugcuuucucccuuggaauauccauguguuugcccuugaauuccccugggaaagaggggccacuagaaccugauccaccuggaggugacugccuuccaucagaaaaaaggcaggcuguguucuugcccccuguccagaggcuguaggaaguagggagcaccccacauacauggccccuucacgcgggcugggccggcacgcccucauggaguuggacaggaauuaccacugaugggacuuuccaagacccaguucugccacuagaacaaauagcccccuucugucuggugacccucugacccucaguaucccuuccugccugccuucggaacccccucaaacgucuguucgucuguuuaucugcuggcuccuaacaccacccuggggcaccgcugcccgcaacucgcccuggggaugacguuucuccccgggccuggcgcugccgcgggguguugaccauucguacgccccggacccucgccccaugugccccgggucucccgcccaucgcugcgcccucucucccgcagcgaucgagcaaagcauugaacaggaggaggggcugaaccguuccuccgcggaccugcgcauccgcaagacccagguaggaggcggcagcccauugggggucgggucgggacccagcucgggaggagcccaggcuggaggccggcgggccagggccaagcaccggcgggggcguggucagggagggcuggggcggggcucugggggcgaggcuagagcgggcggggcccugggcggggcucucggggagggcggggucgagccgcaucucagcgcaguagcagugucucuagcugguguuggccuaagaugggggugccgggcggguagggaaccaugaacuugucaggguuugggaucgcggccagagcugaagaagggaccguaaacuaauucagcgcuuccuccuuauuccgcccaugcacugccuccucaccugccucggucucugcucccugacucccucccugaucccugacuaccucccugauccgucuguccccccacccccaccguagcacuccacacugucccggaaguucguggagguaaugaccgaauauaacgcgacccaguccaaguaccgggaccgcugcaaggaccggauccagcggcaacuggagaucagugcgugugccccccaccccaggaccccgaacuccuugaggcugcccaagcccccuuccaggcauuuccucucuggagggggccccuggcuuaaggcggcgugggagggugggccccagguccccgccccaucaccccaccucaggcccccaggcugucccagcccccgagcagggaguccuuucuucccgcagcuggaaggaccaccaccaacgaagaacuggaagacaugcuggagagcgggaagcuggccaucuucacagaugacgugagccgcggguggggcgggcucugcuuuuggaaaauuuuugccuccccucccuaaguucagguugaacuaagguccuaaguccacccuggaaaaaugagcagcgggaagccugagccgggaacuggggaauuccaugggagcggagcaggaaggcacccccaucagaugacggagucguucgugugccaggcacuguucuaagcacuuuccaucuucacauucacccaccaacucauuuaauacucacacauccccuucgaggaaaccccauuucacagaugaggaaaacuggcccagagagaugaaaucacuuggcaagaucucagagcgagggagagggccaggacuugaauccugucuaguuucagagucagaacucucgagcccuaggauacacgacauacucugcuacugaagcaagucguuucaccagagaacugauuugccuacauuaaaagaaauuuuuuuuaauuaaaaaaaacuuuuuuucuuuuuuuuuucuucaagacggaguuuugcucuugucacccaugcuggaguacaguggcgagauuucagcucacugcaaccuccgccuccuguguucaagcgauucuccugccccagccucccgaguagcugggauuacaggcgcccaccacucggccuaaaaaaaccuuuuuuuguagagauggggggucuuccucuguugcccaggcuggucucaaacuucugggcucgaauaaucugccugccucagccucccaaagugcugggauuacagacgugaaccaccgaauccagccuaauuugccuacauuuugaauauuuuuuuuaaaacaaguuuuaguuuugcuuagguuuuguccccugugcugcccuuguccuuuuacauaugaaaggaugggcuggccgggcccaguggcucaugccuguaaucccagcacuuugggaggccaaggcagguagaucaccugaggucaggaguucgagaccagccuggccaacauggcaaaacucugucucuauuaaaaauacaaaaauuagccgggcaugguggcacgugccuguaaucccagcuacuagggggcugaggcaggaggaucacuugaaccugggaggcggagguugcagugagccgagaucuugccacugcacuccggccugggcaacagacugacacucugucucuuaaaaaaaaaaaaaagaaagaaaggaugggcuuuccccgaaccuaguucuuguuucucucaguggacuuuugccccggccugcccacuccugucuccguuucuguuucugguggcaaaaugacucugguuaaggguucuagaccagguuuaaaggaugcgcuaugacugucuuaaaaguuuucagcucauuguuauuuggagaacugaucuuuguugaaaacgcauugagcagcccggugugguggcucacaucuguaaucccagcauuuugggaggccaaggaggauggagggcuugagcccaggaguucguagaccagcccgggcaacaaagugagacccccaucucuacaaaaaaaauguuuuuuugauuuaaaaaacaauuucuuuuaauguaggcaaaucaguucuauggugaaaccugcuuuaauuagccaggcaugguggcgugugccuguggucccagcuacucgggaggcuaagguggaaggauugccugaguacaggaggucaaggccgcagugagcuaugauagcaccacugcacuccagccuaggugacagagcaagaacuugucucaacaaagaacaaaaaccaaaaaaaaaaaaaaaaaaaagacggggagacugaacacuguccaaacagccauuguaugauuucggcuuauagaauggucauaggaugagcaggagaugaggggagagggagucugggccuugacugcugaagggaagguguggagccuuggguaguggggagccauggcaggcuguagagcagaggaguggcucaaugugguaagaacagugaguaauuugggaagugagucaccuggcugaggcuggguguuuguggagaggaggcauaucugacugugggucacggucucuuccccacuggcuuucuuuuuuuuuuuuuuucagcauggucucacucuguggcccauguuggagugaagugaagcaaucauagcucacugcagccucgaccuccuggggucaggcaauccuucugccucaguuuccugaguagcugggaccacaggcgccaccaugcccagcuaauuuccuuuuuuuuuuuuuuuuuugauagaaacaaagucucacuauguugcccaggcuggccucaaauuccugggcucaagugauccuccugccuuggccucccagaguacugggguuacaggccucucccuacugacucuuuuuuuuuuuuuugagacggagucucgcucuguggcucaggcuggagugcaguggcgcaaucucggcucacugcaagcuccgccucccggguucacgccauucuccugccucagacucccaaguugcugaaacuacaggcgcccaccaccacacccggcuaauuuuuuguauuuuuaguagagacggaguuucaccgcauuagccaggauagucuuggucugcugaccucgugaucugcccgcuucagccucccaaaguucugggauuacaggcaugagcuaccuacugugcccagcccugacucuuuuuuuuuuuuugagauggaauuucacucuuguugcccaggcuggagugcaguggcgugaucucagcucacugcaaccucugcccccccggguucaagcaauucuccugccucagccuccugaguagcuaugauuacaggugcccaccaccacaccaggcuaauuuuuauauuuuuaguagagacgagguuucgccauguuggccaggcuggucucaaacuucugaccucaggugaucuacacaccucccaaagugcugggauuacaggugugagccaucgugccugaccaauguguacauauuaacucacucagucuucacaaccacccugugaggugggcaguguuaugauccacauuuucuagguggggaaacugaggccaagagcaggugaauaaugugccuaagguuucagcuaguaaaugacaccggauuugacccuggccacuccacugcgguggaggcgcucauggcggagaagggugauuguagcucucucccucgucacccuagaucaaaauggacucacagaugacgaagcaggcgcugaaugagauugagacgaggcacaaugagaucaucaagcuggagaccagcauccgcgagcugcacgauauguuuguggacauggccaugcucguagagagccagguacuggcucugccacccaugccacucugggagccucccugggccugagguccccucuuccagcccagcccccaucccucccugugcaugucuccucugucugcagggagagaugauugaccgcaucgaguacaacguggaacauucuguggacuacguggagcgagcugugucugacaccaagaaagcagugaaauaucagagcaaggcccggagggugagcggggcaggcggccuggggguaggcgggggagcccaaggcugagcccgggcugaggugagugauggcagcgggcgggaggccuuaucucuggcucugaccucuuccuguuucuguuuucucuccccucuucucccugccacccucugcccugucugucccugcaucuguccgugugucgaucucucucacugucugccugucucacuccucuuucugcugcagaagaaaaucaugaucaucauuugcuguguggugcuggggguggucuuggcgucauccauuggggggacgcugggcuuguaggccccccccacccuucucucucccagacccuucccccaccacaucgggagcaauacccccaccaccccuuucacuccauccccugcuccaggcucacucccaaaacagacccaggcagccccacccccacggcagacccuggugucccuggaccucaccgggccauggaccccccccccguccccgcacguagaucgcagcaggcgugauuacacaugcacaccaacaugcaugccgccggcacaugcucgagacguguggacaccccagcgugcgugugcgugugaugugugugaugcaccagagcacccccuccacccccaccuugggugugugugcguggucugagcuucccccuucaccggggcuguuguguagacugcagccaaguguaacacagcaguccaucacgcccucucuguccucugugaacagugugugugcgugcgugagaccacagaucuguggacacaccauuuguguacguggaauuuuguguuucaguguuugaaccuaaugcaacagcaacaaagccacugauaccugagcccuuugugucugcuacaaaccaggcaggugguguguguggacucacacucacauucucagaggauccagggaggcccagguacacacaggccauggcagacaccccaugucuuuguuaccccaggggcuguggcaugucccaggagggugugcauguguguguguguguguguguguguguccaggaugugccugaaguauugauaggucuucucagauagagcccuccacacuguggacuggacaccuguuuugggagggcacagaaauguguauuucuugcuaccuagaaugcagcuguguguguguggcgugcguguguaugcacguguguguguguguuaggggcucucuacauggugugcuuuuuaauuuuuuuuuguuuuuuguuuuuuguuuuuuucgagacggagucuugcucugucacccaggcuggagugcaguggcgcaaucucagcucacugcaaccugugccucccugacgcaagcgauucucaugccucagccucccaaguagcugggacuacaggcgccugccaccacgccuggcuaauuuuagaauuuuaguagagaugagguuuugacauguuggccaggcuggucucgaacuccugaccucaggugauccgcccacuuuggccucccuaagugcuggcauuacaggccugagccaccacgccuggccuacaugauguguuucuguccugccugaccuacaugguguguuucugcccugcguauuacacacacacacacacacgugcgugcacacacacuucuaaggacguggccccaucuggcuuugucucuccaguuguccuugcccugccccccuccccagaggugcugcccagugcugguguggccacacacggcuacaucauugugcaggcagagcucccugccugcccagccucagggcucugcaugcucacaccuagauccucaucuuccuccaugucucugcccagcauagccccgagccccuggaagcugguaccccucagugugcucacacguggcaaggccgagguggccccaggcaggggccauaccaggcacaaaccaugcacgcuggcaugggugcggggaucacacgaaugccuccuggaaggaaagggcuacuuguaggaauguuacugaugaggcaagaugccaaggacuucccugcagggaucaaagaucaggacacgaccccuuccucacacacccaccucagaccugggagaggacugugugucccccacugccccaucggaugcucugggcucugccucagggaacucggguuuggggaaaugucuauuucagaaguacuggaguggccaguguggcaguggccacucagggugggcuggguccugagacccauccccgacaccucuccugcugaacccucaggcugcuccccacaccagggugugacugagggguacacaggccuggauuucuggugugaggaaggggcuagcaccuccccuguuguguagccagcacaggcacaauuuguggguuugguggcagguagguggugcgugggagaaaggacaguguuagagguccccacuccguggucuaggaucaugaaaggugaacacacaaguacacaaaugugccaugcccuggcauggggcuuaugugugcacaggcaaggcacucggugugugugugcggaccccagggucccaggucaugugaagcguacgugugugugcauuguauguguguguacauugugugugcauugugugugcauguggccaaacagaugugaccucccagaacacaguaccccuccaccucuacccgagcucagacagccgagcucucccuuguccugugugugugucaguguggccacgugcguaaccccaggugggcuguccugagcugggggccugccugucccuucccagaacgccccucugcaggacaggaagucugccccaagucuggccacggcccuccugcucccaucucgggcugcuugggagacaucagagcaggccccagcccccaguccccucuuccggccgccuggacaggacccccauucagcccagguguuuccggaagucccacggccuuggggccacaggagaaggguugaagcguggcuggggcaccacuccccccaccuggaguggcauugggcccacagcugcccaucucugggccucagguggaccaggggaucucuaagggucugcugugcccuuucuaugcguccuccacauccuaugaugugccugcuuguuggcugcugucugugugcguccuggcauguugucuggaggcuggugucuuuugcauguucuuggacaaaugugugcuaccugcccaggcgccugcaaccauugagcccacaugugccccacgugugcccugcggguggucccgggccuggccagggcucagugcuccucuucccccuccucccuguucccaccccucaugaagcacacugcguguccaucccauguacccgugggucgacacacgcucuugccacgcccugagcguguacacaugauguguucuaugcauucacccugccccccagcccgcccugcagaggacaagauggguggccccggcucccuuuccccuaaccgccccugcccgcugugcagccgugugcguuggcguguguuucugugucacuggcgugucacgugauguagccguguuugcugacaugagccccugcccccuucucuguuucuccguugguuucuagagcucucucccuccccuucucagaggggacaggacuccuggggccuggcuggggcccagagccaggccgcccucuccuguuagcccucagagucccauuucuguuagcccucagagucccauuucuauuggugaccaacuugcaaauggauaaaacacaggaaaauccugccccccccuuccucccugcauguccuguccccagagccccccaccccacccugggccaggucaggcccugugggacgggagaaauagcaaccaauccaacagcggg

SEQ ID NO: 6314 - RNA, 129979 nt, Homo sapiens
cccgcggacaccaggcaggcccggccgggugcgcggccaaggcccgcuccccgcguccccgggcgccgcccccgcccgcggcugggcuccgagagacgagugggagagcgagugcagcgagggcgagaggcgagccgagcaggccgcccugcccgcggcccuagcgccggcgcgaggagggggcgccgcggcccacccuccuuccugccuggccgcgggccggccgggccgccgcgccccgacccccauggccacccaggccuccgggccgcgaagucgcagcgccagacccaaggcccccgagugagcgcgggcgccgaggugagcagcgagcgccggggcgcggggggcgcaguguauccugccccggggcgggggcggcgcgaggcgucgggauccuaggccgggugaugagccgaggcggguucggacgccgagcgcgcgcgcuggguggagaugugggguccgcgggguccuugcuuugugugguguggggggugcgcgaggucaccggauggacgucuggggagcugcagggugggggcgcccugcgccgcggcugagggucuucugggggaugugcggccagcugaggucgggugggggcaugggggcgcgaggggcgaguguggcaagggaucugcuugcgccgaggcgcggagucuuugcggagcgugggguggggacguggggugcauucgcggggcgccgggggcggaggugagcuuugugagugcguccgaggugggggacggggagcugacuuccccaugcgugacccgggcccggcguggccaucgcuugggagucagggccggcgaaggccgugcguggcgagaugggugcucgggcucucugcggugucccuacccgggcagcggccccggggccugugcgcaggccccgaggccgggcaggaagcggcccccgcgaccuggggagcucuguagcggccaggcccgggaggcacgggcccuucggggaugacgucacgggcgggggccccggacacgcgagccuugcgccccacagacggcggcgcagcccgccgcccuuuucgaggccggcccccccucucacgcgccuugaaggcagggaacccgggaggaggacaugggggccgagugcggcggggacaagggguggcaggacgcgagggugacauuuggagccuggucgcgccaggggccuccgugguggggcggaggggaagcgaaacaccagccaggcccuaggccgucgcggccccagcuuccuggggcgcccguuuucccggcuagcaguuuucuuucuuggggcucuuggucguuauccaguccacgcaggggccggagugcgggcugccgcggugcucuccugcgcggagcccgggcuggcgggggcgcggcgggccucgggcucugaauggaugggagcgaguguaacaaugcgccggugggggcugggggaggggaggccgcgcgccugaauggcggagccggccgggcgcugcuccgcgcgccgcacacucucccgcgccgccuuccccgcgguuucggcgggcccggauucagggacccacucgggaucugcacgguuccucccaccaauacugucccccgccccccuuuuaugucuuuccaaugcaguaguguguugagaauucaagggcauuacaucugguugcaauccaguuucaugccgcugccgggcuguuaagaccucgcgcugacgucagagcaggggaauuacuucuuuuuauuuuaucuuuuuuuaguugucugcugcccugggaggagaggcggggguggguuaggcuagcucugauguggaggcgccagcgugaugggagccccgagcugggggcucugcuucucuuccugccccugccccccuccauucuccauacaguccucgcucugcucagggucaggcccaccccagguggggggcagcccucgcugcagacugaaugguggccccucccugcugaccacacagcuggguuuucagaggcuuuccugggacguggcccucgggaucuagaaacuggaaaggaaucuucuaguuucccaccccucccccucuugacaggcaagccgguauauucggggcccaggagcaaggaaaaguggccuuuugcgugacacagaaguggacacaucauucugaucucagggcaggcucagccccauaacucuggcaaaagcucucacaagcaaaagccuuggagaggaggagaauguaucaaggugagauccaggccccagaagccaacuguggagugggcaaaauaggaccuuucccaccagccuagcaucccucuggcuucuguggagauaaagggaacucagggguacuggagcugccuuucucuuccacuagacuguggggcucucauaggcagggacccugucuuacuccucuuuguuuuauuuuugagacagggucuugcuguguggcccaggcuggagugccuuggcacaaacacagcucacuucagccucaaccuccagggcucaagcgauccuccagcaucagucuccugaguagcugggaucacaggcgcccgacaccacacguagcuaauuuuaaauuuuuuuuuuuuucuagagacaggggucuugccauggcuggucuugaaguccugggcucaagcgauccucccucuuuggccucccaaagugcugggauuacaggagugagucacugcacccagccuuacuccucuuuagacucccaagccuagaccaauugcuuucaaauucuugcccgugaccuauaguaagaaauacaucguagguaacuacacaggucacacuguauauagcugaaacaaaaguuuacugaaauaacucccuuacugugucugcuggucuguaauccuuuuuguucuuguguauuuguuuuuuuuuuaauuacugauugcuacccacgaaauuaauuuugcaauccacugaugggucauacccagaauuugaaaaaaacaagccuaggaaaugaauuugccaucuauucaugcaacaaauguuaauugcaacccuaauaauuccucucauguuaaacuacucaaguaacacuuggauacuugggugaaaaaugcaaauaagccagaaauauauguaguaaaaguaaaaguucccuuggcacccucccugcagguaaccccaguuaauaguuugaacguauccuuccagacuuuuuguuacucacuuaaugcauauauauauauauauauauauauauauauauauauguauguauguauguauauuacauauaccaauccaugcauaguuuucuuuuuccccaagugaggacauacugugggcucuuccucggcagcuuccuuuuuccucuccguuugucuuggagagguugguuguguggcgaaguccuucagggcaaguucuggguugacuccuggcuccaccacauacugaacaggccauuuaccucucugugccucaguguccccaucuuuacaaucaggagaauaacaguacagaccucacgguacugaaguaaagaugcagugaguuaauccauaugaaguuuagagcagugcuuuugccaauaaaugcugauugcugccgucauuguuguauuguuauugcuguucuaucuccauggcagcccauguuugaaaugcauugcuuuccacagcugccuguggccauggcaugggugucuuuuuccuccccuauccaacguguggcuccacagggagggaggaggugcaacagcaacggugugcgcagagcagcgucucugcgggagaggcaccugggcacugggcccaagggaacagggauuuuccaaggacccacuguuuccaaaguucugugcuuaaugucgggguccaagcaggaagcaucccugcacuugaccacaagaaggucacagcccagugggugauugggacccagcucauagccaaggccucgaccagagcuggaggcuuccuggaggaggggccuuugagcaggugcuucaggcacggcgagguaagagugagaggagcauuccuggcagagggaacacagugagcagagcgagucuuuggaagcuggaagggauguggccugugugcuguagccaaacaagaggggaggacuuggcucagaaagaaugguggcggaagagguugggcuguugcugggaccuccucacuggccucccugccuccauccuguccccucccaggugcuggccagcagcacugucagagcgaucguucuaaacccagcagauaaccuccaguggcuccugcugccuuaugaauaaaggucccaucuguaguucuucccaugcuguccagggccauuucugguguccucugccugcccuguccucauucaguccuguccccuccagccacagcuggcaccuccuuguuaaggugcagccaugugcauccuugccucugugcaucgggcugggcuguuccuuccaccugggaugccccucaccuuccucccugccgccccagaccaaaacagacguccugucuccuccuccucugaccuccgaggcagaaugagucaucucccuuugucuauacucguggcauagcguuuaucacggaauuaucggcaauucugccagugucuguccuccccaugaggcugaagcaucgaggccugaaagcacgucuccuugcucucuccggcccagugccaagggcgaggccuagaacacaggacgcucagaaaugcuuccuggcaggagggccaggugagguggagagggugagagccccaacauugucucccgugggccccuuugaucuuuagcaagggcaugcucaggucuguguggaucuugugcugucagccuuuagaugaguggggugaggggcuugguggggucggggggcagggggagguggcgggcagcuuccccaggcugcuuccugagggggcugggagaaacuggcucauccuguuccccagugauugaggcagagcugugcccuguuccuggugggucacuggggaucugagauuggaaugugacaccagggaaggggaggcagggugggaggcagggcuuggagguacaggcuggggcuuggcuggcaaaggacagauuucgcuccacugguucuugaacccgugugugugugugugugugugugugugugugugugugugugcacgcgcgcgccggggaggggagagauggggaagagaaaaacaugagggcagagagguggaguggggguggaggaccuggggaguggugagcagggacagggagagauggaaguggggggacggcaaggagugagggagaaguuccugcugcugcugcuggagaguaugaagagugugcuuagggccaggaaggaaagcagccaggcgcaucgucucacaccaccaucagccaugccuuccuucgucuguccagcagacaacccuaaguguucucuugcuuggcuccaugcuugcauggccccagacaggagcaagccugugguccaggcuucgcacccuugaagucuaggggccaggugaacaaugagcauccgguuucuuucuuuuuuuugagauggagucuugcucugucgcccaggcuggagugcaauggugcgaucucagcucacugcaaccucugccucccggguucaagcaauucucuggcucagccucccaaguagcugggauuacaggcgcccaccaccacgcccggcuaguugagcaaccucuuucugcacaaagugaucaggcugggggagagaaggugcccagaaugcugugcagaggcaggagaggaggguggagcaggcgagcaugggguagggggcagggaagccauguguuaggcacuaugguggggagccaggacugcuggggagucuuccuuuccucucuggccucggucucaucuguaaaugggggaagaguggacugcucuugcacugauggucuguggacccaagucacccacuccuugggcaugagaaaccagggaccccguggagacagcugauagaacagggacagcaggcaugcucagagcgucugcaggcccauggucagggggcuugagggagaacaugcagaauccaguggagcuuggguucgccuccuagaguucccuucuuggagacugugcucaucuggaaggcgagauagggucgggguaggggaaggagcacuggauucggaaucaggaaaagugguugaguuuuaacugcagcaucccucgggcaagucacuuucccucugugagggucaguuuccucuucugucaaaaaugugaacgggcuuuguuguaagcauuaaaggugagcuggggcgccguggcucacgcuuguaaucccagcacuuugggaggccgaggcaggcggaucacuugaggucaggaguuugagacuagccugaccaacauggcaaaaccccaucuccacuaaaaauacaaaaauuagccaggugugguggcccaugccuguaauuccagcuacuugggaggcugaggcacgagaaucacuugaacccaggaaauggagguugcagcgagccaagauagcaccacugcacuccagccugggugaaggagacucugucucaaaaaaaaaaaaaaaaaaaaagugaguguugcuguguuuugucaucuggaaagcaaggagguccuauagcuuggggccauaaacaggcuuuggggucacaccagccuggguucaaauccagguaccagcugcucacuguggggcuccauuucccuccccuuuaaaaugaggauaauaggcagggcgcgguggcuuacgucuauaaucccagcacuuugggaggccaaggcggguggaucacuugaggucaggaguucgagaccagccuggccaacaugaugaaacccaucucuacuaaaaauacaaaaauuagucaggcguagugucacaugccuguaaucccagcuacuugggaggcugaggcaggaggaucacuugaaccccgggggguggaaguuggaaugagccaagaucgugccucugcacuccagccugggugacagagcaagauucagucucaaugauaaauaaauaaacaaaaugaggauaguaacaggccccuccugguugcugcugcacaguuccucagcugggauaucauugcugggcuguuaggcaguuguuuuuuguuuuguuuguuuguuuuuugagauggagucucgcucugucgcccaggcuggaguucaguggugcgaucccggcucacugcaaccuuugucuccugaguucaagugauugauucuccugccucagccucccgaguagcugggacuacaggugugcgccaccaugccuggcuaauguuuguauuuuuaguagagacgggguuucaccaugcuggucaggcuggucucaaacuccugaccucaugauccgccugccucggccucccaaagugcugggauuacaggcgugagucacugcgcccagccuugggcaguuauuuuuauugcuaaagugcuuuguauguagaagagaucaccauuaugauuauuauuuuuuuuuuuugagccggaguguugcucugucgcccagacuggagugcaguggcucgaccucggcucacugcaaccucugcccccuggguucaagcauuucuccugccucagccucccuaguagcugggauuacagguacgcacuaccaugucuggcuaauuuuuuuuuauuuuuaguagagaugguguuucaccauguuggccaggcgggucucaaacugcugaccucaggugauccacccgccucagccucccaaagugcagggauuauaggcgugaggugagccaccacgcccggccaauuauucuucuuccauucaugccaggucacaucuaacccuuaccuguaauaacauuggccaaaaugaggaguuuggugcuuauuucuuuucuagccaggucaaggcagauggauugagugggucuuuuuacacauggggcgggugagaauuacuaguuuucuggccagaguuucuguauguaaagggacuuugccccagugguguagguggaccccaggaaagcauccagcaacuugugacuuuaguggcaguauaaccacaaacucucauucauucguucauuuauaaaucacguguagaacaccaggguacugagaaaacagccaugaaugagaugcagcucuaauguagcauaguggguaugcauauguauuuuggacuuugccuggguucagauccagggucuaccacuugcgaacuuagccaaguuauuuaucuccuuuacuugguucugucaucuguaaaaugggggaacugauagaaucuaccucauaggguggucguuuguucaaguccagcaucagguacauagaaagugccagagcauggcccuuccuccauuguugcuuuuauuucugcccugaaggaucucauggaccagcuuggugcuggaggaggucacccuggccaggcuucucagugacgguuggcauccagaaaggggugccaaagccccccaacuccuugaaucagacccuucuauagugaucuaaagcugcuucucugcuugacuguuggggccugaugcuggggagguccugugaggccuuauugaccugggaaaguccgccuuugucuggcgccaggugugcuugauuuuagaaggaauuucauuccuagccgggcaccguggcucacgccugcaaucccagcauuuugggaggccgaggugaguggaucaccugagcccgggaguucgagaccagccuggccaaacauggugaaaccccaucucuacuaaaaauacaaaaagauagcugggcgugguggugggcgccuguaaucccagcuacucaggaggcugaggcaggagaauugccugaaccugggaggcagagguggcagugagccaagaugaucguaccacuguacuccagccugggugacagagcgagaccuugucucaaaaaaaaaaaaaaaaggaauuucagucucaaguaugaaagcagaaaguguuuccugauugaggacuccucaccagccggaggcagcaggacugccugccucugugugucuuuaggcagguuccucaagcucccuaagcccguuuccuccuucaucaaaggcgaaaguaauaguaccuauuucauaguuuuguuaagaggaucaaaugagauagggccucuaaagcacuuagccaguccugggcacagaauagugugcuuaguaaauauugugccuauuagugauaaucagaauucucagacaauguaaaguaaaaaccaccugaaagauuucuuaggagcuacagcuucauagagaugugaaguuguaaaccucccagagcccaaguggacaaagaauuguuacagcagcuggagagacaggagacccagagaagcuuaacuccuguagcaaagucacccagcauucuggcuuggggugggcagggauggggaaucagagcuggcuuucagucuggugcucucuggugcuuugauagugauuccuucagcaaauagcuaugggcaaacagcauugaugcacagcugaggucauaugggccugucuucuggaagcuucuguucugauagggaaaaugaaauuucuacaugaucaugaugagagguaaaauaaaaucacauguucuauuagaaggguaaagucaucggguauucacucauucaagggggcucugugccaggcuguggagcagugggucucauucgggggcgaucuugugucucaggggacacugggccaugucaggagacauuuuugguugucucagcuggggaggugcugcuggcaucuaguggguaaaggccauggaugcugcuaaacauccuaccgcacaaggcagcccccggaaccacacaccagcuggccccugauguccaugugccgaggguugagaucccugucuugggaagcagcaguggccaagcagauggagccccugcccguuugaagcauagagcgugguaggugagcagacguuacagaaaugauugccuagauauggauuuauuuguaaugugagcuaugaaggaaaagguagcgggaagaaagagggaugcgagcccuucuacucuuuuaagggagggccuuuggggaggucuuuccagcugagggcacagcccaggcaaaggcucagaggcagaaagugcaggaguguguuguggguggggaggcuaccaggcaccuggugugugcccggggagaagucagaaaaaggccuggccucggggggcccaggaaguggcuuccagagguggggagaaggcaaaagagaggacuaaacccuuuagucuguuugagggaacuccagcccccagcauguugcucucugggggauccagcagggccaggugggcagugggagcacccuagccccaggugcuaccuuccagccuggggccaagccuuuucccuuucucucauuugcagcuuucugauaggugggaaagagaagcaggaaaaaagagcagaggaaaaacaauauuuucauuucaaacacagauaggggugagggaggcgggaaguaaucugguuuaugauaccuuugagacaagcacagaaaauccccaccguggcccgaaauagcacuaaaacagacguuuugccaaaucagacuuaauugaguggcucucuucuugacuccagcaggauguggcuggagcuggcuuuguucccuuggggugacacuguccccuggggccccugcccuggcuaauuaaacaaagaggaccuggucuccuaggcaggacaggagccuggggagcugaacuugacagcccuuggccucugccugagagggccagaaaugguuacagggguugggaaggugggggguuccugacaggagggccaacugagugaaagcauuggugggagaggccugguuccucuaauaugugaauaucugucucuuuggaugcugaaagggauggagaaaagccagcauugagugccuacuauugugccaggcauugggugguccucgcuaagucuuauuaacugcccuauauccauuaucaaggaaacugaagcacagagagguuaagugaucugccugaggucacacagcaaccaaguggcagagcuaggauuagaaaucacauccgcaggcuccaaagccaggcccugccugcugcuuacccccuuccccauguuagucacucauccauucgggagcuaauuccuggcuaugaaauaauauugugaccuugugggaagugaaggcuugcagucagacagccaugagcuuggcuucugaccaaagcaguuuuucuuuucaugguuuucucccucagaaccuccucuuuccucaucuaucaagugggcauaaucaugccuuuauccuggaguugcuguaaggguuaaauucagcacagaaagggauggaaggggaaggaggagguccuugggccacccagcuuggcagggugcaauaaaagaguccuagguagagggagccaggcaagauugcaauaucucugugccuaucaguguuggguuucuuuauuugaaaggggagagagggcagacuccacucugcagguagagaaggugguguggaaugcggguauuuauuuuucuuugccugugaaagcccuguuuucgcucaggcuguguagggcuucccgacacugccaugggugcgcacaucugcacacucuggggugccugccaugcagaggcaucugcccagggugggcacugagggcauccaccaugugacgcccccgugcagccuguaagcucucaucacagugccugggauaccugggaguccccagaaagagugaggaugggugagggccaugaaaccagggcaucauuccuccaccuccucugaucaggcccuccuggucccauucaucuccuuaucuccuggcagccaguggguugcugggaaggcaggggcagccuuccugauugacaaacaaaacaagcuugaucacaaaaggagaggggagacuggcugggccucuccagcuccccuccccgugccccaggcaucuuucuugcuccacccaacuggcacccuacauucuaagaugcugcgagggggcuccaaagccauugucgaaggucaggccacccaggcuaggagccccuugcacuggggagguggauucaaggagugaugggguugccaugaggcggcgcuugcugcaauggccgccccuccuucccuucagcuggcugggcaggcagcuuggagaggaagccaggcggcagguagcugagaaagacaucggauccagggggagcagcagagaaagcaaacaaacagggcuuuguguggcugcagauuggcggcucagaagggaagccaggccugugguagggggaagggagaggaaggaacgggagaccaggccauugcucugggccagagaucggcggcuggaccagcccgggcugggcggccgggaaguagcgagugccacuacguguggacaggcaucuggagucacagccuggccgagucccagcucugccacuucacuccuuaacagaucugggcuuguuugcccaccuaaucugggcagucauucacacguaggacucgcuggcuuaggaggagagucaccuguccuggcccagucagugucugcucucauccuacccuugucccgucauugcuggcaggacacagaaucaaagggauucagggucuccugggagcugcuagccuugccgggucuccugggagggcagcgacuucugcuuagaucugugggcacuuuggagucuuugaccggggaggcagccgugcugaggggaaacggguucucugcccaauaacggaugccugggguguaggugggcagaggcuggcaucaggccugaggaaccaaacugcccccuccucgucgcgguggagacgcacgaggugcggggaggaacauagccaggaagacgggccuuccuguggggagggaggggcaucuuuucuggggugugagucacauucuggaucccagcgagggcagcccccaaccuggcccaccucucagagggcugggagggcccgggccucgaggaaaggcauagguaggagcugucaggccagacgcccgggcagcuccacgcucgccuccgaggccauuuccuuuccucucuccccgaccucgagaaggggcggcgagagggcaaaugcccgcgcuuccugccggucccgccccuccccgcccgcggcgcccaccaucuuggccgcgccggagccuccuccgcgguggcgucccacaggccgcggucggggcccgcgacgccgacgccgggagggggcccgggaccuucggggcgcugaggccaggcggggggcgaggcggggcgggccgcucgcgucgccauggcagcgcccggcccggcaugcuucgcggggccgcggggcggggcggggugcugaggccccgcccccuggcggaucccgggucuuuuuccgggaacgcgggggcuuccagucccagcguugcggccggcgcuugcggguuaccgggccaggcggcgcgcaucucugggccucguucucccacucccuggauguuuggggauaaugaaagagagucugugcggguuagccucgggacgggcucugcuuaccgagcccggcaaccccacggcaggggccucgggaagccgcuuccgagggccaggauaauggggagacuggaccccuaccgcuugggggcuauuaaaaguggaggccaggcggccucucagcugcagucucugggucucgagcucuuccccggaacuguccaugggucagugaggaccuacccuuugcccuagggcaggagaaagaagggggccgggacugcacaccucacccgguccaggccuggacccugcaaccucggccggccucccuccagcccaggagcacaggccuccccuaguuggcagucguuggacugucuggcugggaggcacauuccuaccuccugagcucgggcaccccgccugcccugggggagccucuuccagaacuuugcugccaacacugcccuguccccacccggccuucucgugcccuaagucccuaguuacuacuccacagccgccuucuuuccccuggucuuucucucucucuuuuuuuuuuuuugagcuagagucucccuuugucgcccaggcuguagugcaguggcguaaucuccgcucacugcaaccuccgguucccaaguucaagcgauucuccugccucagccucccgaguagcugagauuacaggcacuuaccacggcuaauuuuuuuguauuuuuaguagagacgagguuucaccucguuggccaggcugguuccaaacuccugaccucaaguaauccucccaccuucgccucccuaaguacugggauugcaggugugagccacuaugcccggccuccccuagucucuuaagaggcaccgauucagcuacccuuugucaccuccuaccuguacugaguaggcagcuaaauugaaugucggccuuugggucuccgaagggaggcuguaugcugguugagaggcuguccucgcgccuuucucccuccucacccagggcacaugcacaaagaggcugagaaucggcuacaguugcagcagaagagacucaggguugccaucggaaagaacuucccaguccuaagcauuuuguucuuagugaaauugucagauuauugauauguugguuguagagauauccaaaaauacaagaaaaaaguaaaaacuuuauaauuccaccagcaguauauaacuacugucaacauacuuucuguagauguaugauaaaccacuuaugauacaucuacggagucaugcuguauauuugguuuuguaaggcacuuggugguuuuaauagcuuuuuucucacuauaaaaggaggacaggcuuauuauagacuuuuggaaaauaugacaaauuaaaaaaaaauucacccguacucucagucuccaaaggcagccacaguugucuucccucaacccccccaccacccguucaugggguuuuucgcuuuguguuuuuugucuguuuagguaugccaucauuacuucuguauauagcaguugauauuccgcuuuucuuacuuaaugcuguuuaagaugcuccugaaccacguucuugggagaacuuccgagaugaggcagacauuucugggggugauuuguuggacuggcuguucacuuucugaguuuguccucucccuaccuguagccccccgacagagcccuucuccauugccaguaaccaaugauaugcagcuugggucaggggguccugcuugcugggggcccaggaggcugccuaguguggacagggacaugcaagacucauggcccgaugcugagaucugggcuccaauaguaaggggcuuuacucuggcccagauaugccagguuucagggaggucucagaccuuggccucauccucauucggggccuccuuugccugggcacacucagacccgaggccccuugucgauccugugacccaccuucugcuuugacuuccuaggaguugguuucugcugcccuuggcuccucagccccucuucucuagccucucucuggaggcaugcaggcuuggcaccagcacagccucccucugcccagcugccccuuggcccuagcuacaagcugcccuugcccugaccuaucccuacugccaggccugucucuucuccccuauuccagaacgguucaauucuaacacauccaagcccugcgugaaacaggccuugggaaaucacaguugccagggacgguuuggcauuuaaaaggcauccaaggcuuuggggaaaaagcugaagagacaagaggaugcagggcccuguaucagaacagcaucuggauuuacuggauggaaaaaucacagaaugccccuuuccucgggaauaacaguccuggccgaggggcagcggguguggcaugggcacgccaugcccugccuggccaccaccugccaucaccgcuguguacucucagaaaugaaaagauuagggaaaagauuagggagggacauugucagccugcagccaacggcccgcucuaacagguuuauucaguuguaaaauauuuaagaccuguuucacuuuaccuguauccaggaggcagccaggcuggggccgagauugaugugcugaacaugauuuauuuaucuggauuugcucuuguggucuggguguuaccuggguguggaauuuaaccaaaugacaagauggguuugcguguguuccugagcuuggggauuguguguguguaaaaagugaguugggguuuguguacauggcaggggguugcuguuagguggcuugugugucuguuugucacugggaccaacgugugguugugugugugucugauuuggggaaaugagcugaggguaugggugcuuacacaccaggcaguauccacagcaggucacacguucuuuguguguugggggcaccucuguguguggccgaguagcuguuugugugcauguccuguggugugagaccuggaucucucucacccacuuuucaucagugguggggcauugcgcacugacugaguugcuggggcaucugcuuuuccauccggcccugggugagcacugacaacaccugacugucuuccaguagaacugggccuuccugcccugcaguccagagacuagagggaguucgguggucaaggugguccaggcccacagccauagcccuaaugcaaagcauggcuccuacuccagugcgcugcuguggggugacccugcuccuccucccuggaccucaguuuccucuucugcugcagagggcaggcgcccaggucccuguggcugcucucacacacgggcuucuggguggcucauggcaggcuuagggcauugggcugggguuugucuccugccacucaagaguugagucccaccaguacucaagaacagcaaggaaugaugggaaaaucccugcuuuggggcccaacucuggauucugggcguugucucugucccccaucuaggcccagcccuggcccaguagucaggaaagcggcagacaacccuguaacagcccucggucucccccuccccccacaccccuuuauauugaaugugucugucacuacuuuccuaaugaggcugcugagggccccccuggggcagauaccuuugcagaccggaggugagggggugggccagccucagggucaggacaggaaggggagcugagcccuuccccugccugcacccccaggccagcucagcuguggaggcauugaggccccucucagccccugagccagcugugagugggcaugagagcuuggggagguaggaaagcucaccccaggcacugaguuuucuuuggcgcugugacucuguaguaauaauacuuccaccuggucgauaucuauguuuggaggccuacugugugccaggcacugagaucagccaugaucuggauggacacacaaaaucccugcccuugagggagguguggccaaaggaagaaagacauuaaucaaagaaucaagugaucugagucgugcauucaugcaugggaaugccggcugaucacaagccaagacagaggccaggcagagcuucucugauggagacagggaguccugugcuuagacugggggcugauccaggcacuggguaaaggcucagccgggauugaaggaaucaggagacccagauucuugcuguguggccucaggcaacugcccaccuucucugggcuccuagaggcugguggcuuccuucuggcucccgucaccucugaguggaacucaggcaguauaugucuccucuucagugcuuuuugcgcucccugccagggcccucaagacaucugucggcaacauccuugacuuuggaaugcuggaggcacugccccaggggacgccuggagccaagcacagcaccgcugccucaggccccaccugccaguuccucugggcccuuuugcucucacagagccaccuggaucgaagaaagccuggaaaacauuaaauugaagaauuaguccccuauuuugccccaaaauugcagagaaaagcauuuauucaugcauucacucauucauuugcuugacuaguguuuccugaacaccuaguaauugcugggcacacugcacuccauguuggacugagauggcaaaguggugguccuccugccacguccugaccacagaccuguuuugaaagcccauccauugucggggggccgggggggggggaaucaaaugaauugccagugaguaaucguugagugacuucauuuccaauuuccaguuuacauuucuucuggauuauucuacccugcuucccccggccacaguugguggagauggcuacugucugccggguaggauggcccacccagcccaccagcuggucacggucccaucccccaccacuccaccccacccugugccucuccuggucaugucacacaugauaguguggcuuccuaguuaugagcccagccucaggagccagacugucgagguucaaagcucacuguggcuugugggaccuugggugucccccuccaagccucagauuccucuuguguaaaaugggaucacaagagcaaguauccacuacuccuggggcucuuggggagauuaagugagaaaauuuaugcuaaauccuuaaaacucacauaagccuuggcugcuaucguuguugaauaaaugaaccacuugcaggcugagaccggggcugugugucacauggcaccucuaggccucaguuuccucagcugcuucuuugggaaagcacaucugcucucuagguugggccuccucccucguccuucaaagaccuauucuuggggccugggcccugugaaaccucuggcucucggacgcagccuggaaccccugagacgaggucaagcuccgcggcccgccuccugucgcccggccccaggcgggacugccuuggcaggacucgggccgcgagcuggaggcgcggcucccggcucggggcuccagcggccgcgccccgccgccccucggcguucgcgcgcagccccugcggggguggccgccaucaaagcgucuucucguucuuaugcuaaugagccccauuaaagcuuaauggcugcgaacgcgcggguuuaauugcaccugcccgggccugaggcgcggccggccgcggaagcagcugcgcgccggccgggacggccuuaauuaccuggaaaacgacgcccggcggggaggggaggggaugggagagaagaggagagcagcggggccuccgcgaggccgggccucguccgccgaggccgcaguccggccccucucguccucggggcgcggcgcguucguuucauuaauuuaucgcccugccucggcggagauccgcucgcccgcuccccggcguucaaccgcgccggcuucgugcucccccgcgccgucccccggccaucuugggcuuggcauucaaggcccuucgggaccgcugcugccacugacccagugccacccugcucugcacgaacaauaauaauggugguugcacauuacgugccaggcgcucuugaggguugaaugugaccucgcagagaccccagaugccucaucucggccuuacuccccucgucuuuagaagcugguaccucugccugcaacaaagaccccucucccuccucgcucauccucccugaaacccaccccugcgccuccaacaagaugagccccuguccuccugggaugggauuggggaugggucugggcccuuuguugaggggugggcuagcccauggugaagguugucuggguguguccucccucuggacugacauuucacugaggccagucugccugacugcccuaucucugcaugccccugccaucucccuggggauggcccugggguugugggggcugcacugcugcccugagccuucugccuaggcagggggcugugagacugaugggaaccucagggaaaccuugagaccuaaugguauucucugugggacuucccugugcuccuccccaccccaucaagugauccugggauaggcgccugccccuccucucucccucauucccuucucucacucuucucuuuuugcagagggaaggaaaacggaagagggaauagacagaccgcucaugcaguuuuuagaugguccccuuucccuccccucucucuuccauguccccuuguacccagccccucuuuuuucuuucuuugaagaccgcaucuugcuuuguugcccaggcuggagugcaguggugcgaucauggcucacuguagcccucaacccgugggcucaaacaacccucccaccucagccucccaaguagcugagacuacaaggugugcaccaccaugccugguugccccuccuuucugccccuuccagucccaucccuccucccuuugugcgucucagagaccaaagccugaagcauugcacagugcccacugggaggccacccagcccugguccugccugugucaggcaaugcugagagcacagaggggagucagacuugggcucugcccuccaaggacuccagucggggaggcagcgcucgaaaggaauacuuguccucuaauggaaaaaggaccaauuuaaaggaagcagagaacagucuuugagcucaaacugggaaggcugggagaggcuucuaagcucagccuggaaggaaggauaagugugagcuaauuggcaggaauagcauuccagguagggaaacaauuggaguucagcccuggcuagggcagaacacuggcugacaugaggggagagggaguaagggacaaccacagaaaaacugagcucacuccaaaguguggaggcaugaggcuggagaggugggcagaggguccucuguugccuagcaaccuucacugccucccuauugccaagaggaccaaauucagacccuucaguuggcacaaaagcuuguaccacccaccucaucccaggaugcagccuauuaucuucagcuggguuccucacuaccaggccaagccucggaugaugauugugagccuacuguauaugggaaggggggauaagcagugaccccaucagggcuaauagcaguggggccugcugcccaacuccaugccccuucucccauucuuguccccagauguccuugcagacaaaauggaggugaaugggcaggcugccaggagcgucagguggcaucacagccggguagacagucgucacugauuaaugaggugguagaaaccuagagggaggucccuacuggcaugccucgggguucugcccuugcucuggucaaggcaaggaaugaggcucacagggguuuagcaccucccugccaggcuaugugaaacucuugguauccaguaguuuaucaccagccaugagguggcuucucuuaauaucucauuuugcagaugcagacacugaggccagucggggugaggagugagcucaaagucacucaucuccgagguggcaaaauuaagccucaaacccagggcugugugacuucaaagccuguguuuguaacugcggagcugugcggcaucaguaaugcaucugcugcugcugccagacgugaggagguggggcccugccuuucaacuucaucucucugacagugguuagcacuguacuuuacguguaguaagugcucaauaaaugcuuguggacuggaugauuggggcaguaagcagugagcagggcucagaagcaguggagaggcuccaucacucuuccucccaaccugcaccuccacccccaggaguuggacagcggcuguaaggggacuuggagacucaaggcuuccaggcagggagugggcucacaggaggcuagggaggauccaacuuccuguccaggucagggucaggaggacagccgcgcccccuacugccccgcugggaggccaggcugacguaggaaggcugcacugcaagucagaaucaucagcaaaaccuggggaauagagcgugugaggguuuccaugcaggguggggacugcuuucugaucaagccccuaggccaaaaaccuuuggaagggacucucugagggcagugcauucuuguagcgucgggagcaggaguucucccauaaccuuuuugggguggggacccaccuguggcucuggaaagguguuggcuccggcucuggggcucagggggagggggccauuggugggcaaaacaagcauagugaaaacugaggcucauagagguuaaggucacagagcagagcugggucuguuuucuuuuuguuucuguuuuaguugcaacaggggcuugcucuguuugccgaggcuggagugcagugguaugaucauaaaucacuguagccucgaucuccugagcucaaacgauccuuccgccuuggccucccaaagugcuaagauuacaggcaugagccuucaugccuagcugggacuguuuucaaacuccaccaaccccuuuucuuuuguuccauuccacucugcccagaaccuucgucuggcuucccagagggcccaaguccuugucuucagagguccuggcuggggagccuuagagcauggucuucccucacuccaggcuucucgggucucccuauuggggacugaccgugggagcagugagccacugugcaccagggcagcccggcuccucgggggguggcccaagcagucagggcggcaggcuugaugggccagggccuggggacucugccaugguggaccauugugcccuugccuggcuugccaggaaaguggagugcgugugcucacccuugcuucugaggggccuuccugaggcagaggcugucccuggacacccagugcuguugaggcagcuggggacacucagaccaugguggacaaagacuugaagucucguuucagcccugcacaaggugugaccuuggcuccagcacugcucccucugggccugucucuuucucagcagaaucugggacuggccacaucaucuccagggguucuagcauuggacgccugaaaguggacaacauggcagugugagggggcucuuuguggugggguggucagaauggcccuccauguggggggcucuuugucuccccagggcaguccuuaaccaccagccagccuccccaggcacccgugccgggcagugggguguguaaaggccuggcacacacagacaggaguuccgaucucaacuccauccucaugagcucugugaccuuggugagucccuuuucuguguagccuuuaacucucaucuggaacgcaggauaugcauaguccugacaucaggacguuaccaugaguaguaagugaaacucccacuucagguccuucgccugguguccagggcaugggaggagcuaauacguggccucugcugcuuguguuguuauugguggugguguuugagauguccuuagagauguuggccaaaguuuccaguuccccacccucccaagcccguggggaaauugugcuuccuggugguuuuugggugggggggccgggggagggucaugugaccaguuauggcccgugaggugugagcagaagugacaugucccuucuaggccagagccuuucauggccaugaggauccacagaacucacuuuccucugguagaccaaagucaagguggcaacugcucagugagagggagccucccugcuaccccaguggaugguagugugaaggauaaaccaacuuuuguuguugugagcccuugagauuugagaguuuuguuacagcaacauggcuagcacauccugacugauucuucaucaucaucaucaucaucacucaagccugucccccggccagggguccauccaggagaacaacagccauggaggagacccgucaaaaaauagaacuuuauuaccaaucuguuucuauaauuguuugacucauuuucucacucauuuguuugcuuuaucaccaauuucuuuacaucauuuauuccuucaaaaacauuucuuggcugggugcagugggucacgccuguaauccgagcacucugggagcccaaggcaggcagaucaccugaggucaggaguuugagaccagccuggccaucauauagugaaaccccaucucuacuaaaaaauacaaaaauucggugagcugagaucgugccauugcacuccagccugggcaacaagaacgaaacuccgucucaaaaaacaaaaacaaaaacaaaaacaaaaacgagccaggugugguagcacacacuugcagucccagcuacuugcaaggcugaggcaggagaaucgcuuauacccagcgggcagagguugcagugagcugagaucgcaccacucuacucuggccugggcgacagugcaagacucccucucucaaaaaacaaacaaaaaggcugggcacgguggcucacgccuguaaucccagcacuuugagaggccgaggugggcagaucacgaggucaagagauggagaccauccuggccaacauggugaaacccccucucuacuaaaaauacaaaaauuagcugggcaugguggcgcgugccuguagucccagcuacucgggaggcugaggcaggagaaucuccugaauccgggaggcagaaguugcagugaguugagaucgcaccacugcacuccagccuggcaacagagcgagacucugucucaaaaaaaaaaaaaaaaaaaaaaaaaggcaacaaaaaccaaacgccacuugaccaccuguuucauaggcccugagguagcgcacaggccagcagggagcuauggaucauucugcagagccacggugcuugcccagaggucagcagcccuaugggaugcuugggguggggcgucagauuugcagagcuggggcgagggaaggaauggcacuugggggagugggucugcuggagaaaggccuacagguaacaggaagcacuaggcaguuggguccggccagcagggaugggaccguguaguggccaagcuggagggggacuuuggucccugggucauggggugugcagugcucugcacugaaugaugagagggcaugcauaggugaaacaagaggccagcugcugaagggaggaagaccagguaggcagcugggccaaggauccagguggacaagggcuggcaugggucugaagaggaagagcagggccagggaaagcccagggcuggauggccagugguugugagcugcaccagcagccagagggagccggggacuggauggggguggcccugugcagugacggggaaaguuugagggaucagaguagaguuggggcacccgagcggcauccaggggagauguccaggauguaggguggugaauggacaggacauugaagugagaaucaccccuccugcccauagacaaaccauugguuugaggguggggccugcccugggagccgggaagcacacauuucuucucugugugggcucaggggaaaaaaagaauugaaacucccacaggggaaaaguuuuuaaagauuccaccauuggaaugcuggucuuguguaacaggaauguuuuaauccaugcauuugaaacacaguuauugagauccuacugugagcugggcucugcccuaggugcccaugggugagcagacagacagcgaucucugcccuggugagcuccuuccugucuuagugggagacaggcagcuaaugacgagcaaucuggggcaugcuccuuaguccuaagcuacucaggaggcugaggcaggcagaucgcuugaguucaggaguucgaggccagccugggcuacauagcagaaccccgccucuacaaaaaauacauaaauuagcugggcauggugguguguaccuguauucucagcuacucaggaggcugaggugggaagaucgcuugagccccggaguuugaauccagccuggguaacauagcaagaccuugucucugaaaauaacuaaauacuuuuaaaaagaagauagauguagugagaaaaaaaaguagguggggaaggggcucagggaugggggagaugcgugcaguuuuaaauuggagugccaggaaaggccucccugagaaggugacaggugagcaaagacucgagggaggucagugaaccuugcaaugucaaagggaagggcauugcaggcagagggaauagcagugcaaagguccugaggcaggaacguguuuccauguugcaagaacagcaggggagccacuguggcuggaggggacugagagaggggagaggguuccuggaagacuguuuguuuauuugagacagggucucacucugucacccagguuggagugcaguggcaugaucucagcucacugcaaccuccaccucccaggcucuagugguccucccaccucagccuccugaguagcugggaccacagaugcgugccaccaugcccuacuaauuuuuuguauuuuugguagagacggguuuuugccauguugcccaggcuggucucaaacuccuaagcucaggcaauccaccugccucagcuucccaaagugcugggaucauaggugugagccaccgugcaggccagacucuagcuuucauucugagugagcuggagacugcaagaggcaggcuccaagcugacuuacuaucucacaggcucccucaggaguugagggggccagacagagcuugaaggggaguagaaggcuccuggaggcucuggcagaccucagaagcugcagccacaucgaccaagcugaccccacccaccaucuccaaggaauggguuaaugggcaccccaggccucucaggucucugccucugccuugcuccuccuccuuccuccugcugccacccucugauggugcuucagccugugccauuuuucuggguccucuccaaguguauauugacccugagguggcagcaggaggggaggcaggcccccuccccaggaggagacccccuugaugaacucugagaagcugguugcuuagcaagcccuuuuuucuccaacaauacuugugcuaaucagccuagauugaaugagcaaggaauuggcuuuugcaccuuccuguccucucuucucauauauauauauacacacacacacacacauauauauauauguacauuuuuuucccuuagagacagagucucacuauguugcccaaucuggauucaaaguccuaggcucaagcaauccuccuaccuuagcuuccugaguagcuggaacuacaggugugugcuagagugccuggcuagggacuccauucuagaaucauggaaucuuagggguccccuggguugcaucuugacucagugagugaguggguuacuuuuucacaucccuccuuguacaccuccugugacuccuggcagcucacucucuuucuagcgacugagggccucuggacaaggugagggggacagagcaaugguccagaaguuagaagacuguggucccagucacaggcugggcaccauaaguggacaccauaacugacccauccuccuuuugugcucaaaugcugcaguucauccggaaacaaccaaaacauuccagcuucacagcugccaggguuuggaguugaacccugugucccgugcuccugccaccccugcuccaggcacaaagggaacaguucgucaguccaccacgggccuuuccuauccucaguugcagagugggccaggacaugccgcuuuacagaugggaagacugaggcccagagaguggaagggaaggagaggagcccauuccaggcucccggccugggauuuuucccauaugcuccagcagccacccggggaccaucauuaugacaaugaugacugauggagggccuagugugccgggcacugugcugagagaccccaaggagggcguagcaucuguguccacaggaggaggcugugaggcugagaguaccuagggagagcagagcuggagcuggcugggcucuggccaugcggcuuugcuguuugcugucugcuguuugccguaucaaggggcgauacucaggcgggcuccucucagucucucuucuuuggucucaccucuacucagaaaagcccuuugcuggcccccaaauacuccuaccccgacucucuucuccaccccuccaggcucccaaggccccugccugccucggccucccugcuggguugaccacagucaguccuggcuggaagcugacccucuccacagcugccccaaaauacaugucacaguggggcauuugcaguuccagccugggcagcugcccacuaggucucuuuccuucccuucccugggucugcccccaggccccuggccucauucugguccugagcucccuucucugggccaaggagcugcugggccucggggagggggaaccccagcacuagguccaaagugauguagcagggccacugucugugccggggccuggagcuuuccucugaaccuuaaggggcccccagaucagcuccgugcgggccuggggugcagcuuccagaaucuuggaaaccuguuuuucauggagccagauagaaugagcacccaggaggaggcaguuccaagagcuggugcuucaggaggaaaccugcacagcagacaggcgugcgcacauuccuagaugcuagcccuguggcggcgcaccucacgcucauucacaguacacggacaugcucaccugcccaccauggguggucaacccuuggacacccacacucuucucacacccucacacacacacucugcaccacucgccuagccccggccacgcucaugucaggauucugaagaccucgagcacacacagacacgcaccuggucacgugcacuuucacacauacacuuggcaccaggguggcagcagcggaggugacugagaagccugcuuuucacagagaaucagaacccagcgggggcuuuagccacaaaaaaagagcauuucaaggagaagggcugccugcaugccaagcacacgccccucaccuacccaggaccccuugugggagcugagccccauggagaccccgggguacccaucccacccuccaacauccaucccuacguggauauacggccacaguugcagcugcggccaugaggagggguuuuugcuccuuuuuagcagugcuccaucccccaccccagaguacagggggcugcccagagacccuccuggcccugggggccugugagucagaggcugccagugguggccuuucggcuguugcuggggaaauggcagcacaguggccaccaagacuaggacucccuggggaggcccugcuggcccuggcacugguggcuuggccucacccagccccaccuggcagaugugccccuuguggcuacccaaggacuggcccccuccucauuucagagguggagaaacugagguaaaaaaguggagacagccagggcaccccucccacaaggcccugccucauuugagacagagcccucugggaagccugugcauucuguagguggggaccuuuggggccauuuuuuccagaggcccagagagggccgucuucuugcccaaggucacacagcaaguucauggcauaagcuagccagccucguacuccagagcucuccugagggcccccaugugucugugcggggguguugauggggggcaggugggagggaggagguaaggcugauuuguuucccagccuccucccccuccccugcucccuucucucccucacacgguuuguuuggagaaugacucacaggaaugcagcaaaauccugauggaugggaaggcagggccgcaguacccggaaaaccucuccaggguagggaggcggggcugagccuuggggccugagaggcuggugauaggggagcccugcaugcagguggggcgacugaggcccuggaagaacucuggucacguccuggcuggggguugucccuccucgacagaaacacacaggcccuggcugccgcagcaccccuggagcacccgucccccaugauuuccaucuuuguguccccgaggcaucuggugcacuguagcugacaaacacaugcauuuuggcacugagugugacccaagucagacccuccugugugugcccugucccccagguccucccagcuccccggaguuggggggcgggugcuugccauucaguccuuucagaggcagccaagggccuacggcaugcuggacacugccaggggcuggggaggcugggauggagcuggagggaagugggagguguacacgggauggacaccuccuguguauguuccaaaugugcuggaggccucaacaggucuugguacaaggugaggcaaaccuuagaggaccuaggaugaaguuucacguaaaggaacaguggcuguaagggcucccagaaaguguagggacccugggaaggucccagucuuugaauaaaggugggugggaccuuauugguagcuuggggcauuagggcccagauaucaggcagcagcaugaggugaggcccgggcucugucccagggcaagcccuccuccugcgcaccacaucuggggccuccgaggagggacaaagcauucaacucccgggaccugugggugggaauguccccaggcccagcccuuuagugccugcugauggcugucacgcgguguccggcccugaugaccagauauguguuuucaagagaagcuggaauuuggauuuuuaugugaacucuccugauucucaaaugcuggcuccguuaacaaaaggcacagugugguuuaaaccacacauguccgcaggcagaggaccaccaguuucuaaugucugcgcuguggggcgcuuggguuuuugcauuugguucuuuuacauuccuuauuuuauuggaaacagcccaaauagucacugagcugcaacucugugcuaggugccggggcucuaucagcgaauaaaacaacaugugacggagcugccauuuuagugggagaagacagugaauaaacauauaucaggugauauguguuaggaagcaaauggaagcagggcuccagaacagagagcggcugcaaggccaagcccacauuuggguggaaggggcagcuagugcaaaggcccugagguggggcuaugcuagguguguuagaggccuguguggcugcagcgggaguggguggggaagugggaggaggugaggucagaagguagcauaggucaaauggcauaggagacugugggcugugguauaagcuugguuuuaagucuuaugugaggugggagccauggaggauuccuagggagggagggucaggaucagacuugguuuaacaggcucugucuggguguuguaauggcugaguggggcaaggaugggccuaggaggcccagaaggggcuauugcacuugucuggcugagugaugaugcggccugaacaggaaggggguagucaccagagggugaccugaggaaacuguggucaagccucuccaugguguaaacaguaaacacgauacugauucuaaggacuugguaguaacauggaaauggugacuguguauaaugcuaugugaaaauaggauuagaaaauuguacauuaaaaacacaccagcccagaugcaaaaggcugcagaucauaugauuccauucauacgaaaugcccaggacaggcgaauccagagagacagacaggaggugagcaauugccaggggcuggggguggggaaauggggggugacugccuaugggaacagguuucuuuuugggagggggaugaaaauguucugaaauuagguagcagugauaguugcacaacuucaugaauauaccaaaacccugaguuguccccuuuaaaagggugaauuuuauagugagugaauuauaccucaaaaaaaaaauuuuuuuuaaggcauguccagauuucuaaccaaaauuggaugcacauagaaaacauugcaaggagcugggcgugauggugccugugguccccacugcuugggaggccaaggcaggugaaucaccuaagcccaggaguucaagacuagagccugggugauauagugagauccugucucuaaauaauaauaauaggccagcugcaguggcucaugccuguaaucccaguacuuugggaggccgaggugcacggaucaccugaggucagggguucgagaccagccuggccaacaugguaaaaccccaucucuacugaaaauacaaaaauuuagcugggcguggugauacacgccuguagucccagcuacucaagaggcugaggcaggagaaucgcuugaacccaggagguggagguugcagugagccaagaucuugcuacuguacugcagccugggcaacgagagcaaaacuccaucucaaaaaauaaauaaauaauaaaauuuuaaaaagauuguaaggaaauauucacaguaauugucauagggugaaggggauucuggauuuuguuuguuuucuguguacuuuucaauuuuuaaaacuuaaaaguaggcauuucucucuaaaaucauaaagacuuugugacuagggccagagaugggggauccacuuggaggggcucagccucucucuccagcucuuguggauccauucagcugcauggcuuucacuugggagguugggagcaggagcuugcucugguccgcgucucugaccuucuggaauuccauuccugcucacauggccuuggucaagucacaggaccagagaucccagcggcccuccccuggagagugucccagccgcccacgaugccuccacccagaggcugcccuguucugcuugcaugccuucagccgcagguugcucaccaccucccgagcagcucccuccuuccauuucugggcagcccugccugcuagcaagcucuuccuuauauggaggugaaaucugucuuccuguugcuuccucagcucccucucugaaccccaguuucugggucugcagaagggggcucccaggccucucccugccuaccuuggccacugggagguucugaagagacuggaggaccagcagcccagagccugugucgguggucauucagcucucgggacaaagcgugggugggccugugcccugguggcauaaccaaguaggauuuccacauucagugucuaggccaucgcugugaaauuggaauuugauacuaauccuggagauugaaaacucaaaccucuccauaggccaggagggaaugauaaucaucagugcuaacauuuacggagggcuuguggcguggccaacucugagugacguuuaugcacucauuucuauuuaucaccagcaaaucccgggcccugcuguucuuccccauuuuaaaggugaaaaaccugaggcucagaaacguaacgggaagcagcugggugcgagccuccuggcacacauugugggagugcugugggucgaauaaggaagcugagcagcaggcagccucuccccugcagaagggcacagaagcaggacuggaaggaaauccugguugugggcugagcucgggccauccacuugucguggugggugaagggucugguccgcaggucugcucuccaagcugccucguugcaggugcugacuuugggaggauucuccuugucucggccuaggagcuuucuugcucagcuuggggagagagguaguaaugucgccuuccaccucauggacuucccaguuuagaaugcugcuucccaucccacccacaucacccucuguuagguaagcaggagcagaaaugcaguccuucaucucagcucuggaaacggguucagagaggguguagaacugcccaggggcacacagccaggacaggcccaagccaggaauugcacugggggugagcaggggauggcuuuccuggcuuaagguaugugggaggccaagagccaucauuuuucccaauccucuccuggagagccaggggacaucugaagccaggggcucugccuguuuccucugcacugucccugugcugggcugcucugagcugggcacugguguggaagguaaauaagcagccccaugacaagcugugagaccgggcagugguuugggcuccacccaggcccaugccucucucuucugcuugcagagccucagugucugcaucucucaaaugggcuaaggacacucaccucagaggauggcugagaggauuccauguggggugcuuggcagaguuagcuccagcucugcaugccacccccucccauggugcagccaccuggguuccaccagggcauucugggaugacaccagaccgggaggagaagugcgaggagugguguggucauuggcgucuuuccucugccucugccucccccggccccuuccauucacaugguagaaauucagauagcacagcagcaagugucccucccgcuccugaccuuccagcaguuucuucuccauccuuccaggagugaucuccacagauucagaugccccccggaaagggcuuuccauucaaaguuuccccuggacucauucuggccccagagaggcugugcccgauccgauccucgccccuuugcgggugugaacuuggaggcugugagagggccaaguugccccugggaaucguacauauucuguuccacauccuccuccuguuguccguuccgugcccuccuaugucaggaguggaggagugcuggaaggcugugcaacacacuguuacccauuuugcagaugacaaacuauggcggggggaauggguuucccuuagcagagagggaauuguccaagucaugccaaagacuuaagggcaugucauagccagcuugaguccaggcaggagcuguagccaccagucgggacaaagucaggggacuugagaggucuucacccagcugcggccaggagaaggccuggaaggagcaucccugcugccaucaaguccagggagggcagaagcccauggagcucugagcugaguugggaaguggcuggaggggucacuuguggggugguuaagccacccagagauacccaugagcccuggggccagggaacaaaagaugugugaaggcaggugacugacacuuggguguguguggacuucuacauagagaaaucuccguguucuugcaugugcaugugucauuuauauguauacauguguauauguguauacaucucugcauguagcuguguguguaugucuauaugauugcaugaguguguguacacacagauguauaugcccauguuucuggaugugugugcccagccugagggggggacaggguucuguacguguguguguacacgugucugugugcauguguaugugguuuugugucuuuucauguguguggugccugugugucugagugcacauuguauggagggucugggggcugcguaugagguaacugugugauucugucugacucuggguguguuuuguguugggugugucuacgugugugucuggcccacaugugucuggcccacauaugcuggcccagggcaggauggaggggccuccuguguggugcugcuggacucuguuguggucaccacggccccgugggcuuagcguggggcacugguggggcugauguugccacuuaaccucagggugggauggcauggagcaggcccaucccgaugucccuggguggccugguggaaugugcccacgggaugcccaccacugggggaccccaccagcguuggggcugaggcuuaggcuguagcaggcuaagagguccgucuauagcaguggcuagaugucuguggcuggggccugugccugaggucagaaguccauuuguggaagaggcugggagucagucuguugcugggauuggggagggaucacagggaccagggucaagagucagaauguggcugcugccauggcuaagggucagucuguggcugcaguugcagaucagucuguauggcacagaagacagguuaggccucagccacaccacuguccccagccccuugguggcuuccuggcccagggguaaguuugagcccugggaacaaggggcagagagaagaaagcgccugugaguccugcuaccaagcaggccugggcccagcuguucccauggccauggcagagaaccccagccagcccaacguguccagaguguguggcuucauuguagccaggaaccaagggugcccaggaccgugccagggugagcagggcagugcuucccaagugagacugagagaagaccccugccugccucucagugcauuuccucaggcacccucuggugccuaacccuguggcucuauaacccuccuucucucuucuccuacccuucuuuccccucuccuuuaucugcugucauccuccccacuccccaaucugucuuccuuugcagcugcccuguccucucuuucccccagccagccuccugccccccaccugggcccucugaaccccagggccuugccucuuuuaaguucagcagauuugacuucacucagacgcuggcgcugaggaaggaagaugaauacccauagucuggaugccccaggagaaggaggcugcauggaggcccagucacacgccugcaggcgggggccgucuuccuggagcccauguccagugaaggguccacagcaggggucaaggggggcuuagacucggauucugcccuguuugagccugaagcugcacugaccucaugggauggccuccugcagucaaguagggaaggauggacagacacacagaugacagggaaaacuacagacagaaaagaucaaaggucguucagaucaaaagcaggcagaagacgccucggucuuggcccagcaccagcauuccugugcagaccccagcccagggcagagacugagauguacucccucuccccucucccccugcuuccccuggucgggagguggccaccaaggcaagccuucugccgucacuccagccagaaccugcaugggucggggugggugggccagauuagccuccauccuggaaucaggggaguugggacacugaggggacauucaaauguuuggaacauuugaaaauguuccaaaaauguaagagaacuuggaucucuguacucccgaugcucuccacccccaucagcuaaaauaucaagcucuuugcuuucaaagaaaagcauuuucucgaguguuuugcucucaguuucacaugguagccccagcuugcucaggaagugcuuggcguuagaggguuuugauggggagaaaagggaacagggcuguaguuguugaaggaccaugccagccccaugugggcagggaugccuguucuguucccugcugucccacagugcccugaacaacgccuggaacaugguggguuccauaaacguauaccaaaggagauaugugugggcaguuggucugggagacaaaaccggauccaugggggcaggagggcuggcagcugcagaccuggaucaacaugcucauaaaaaggggauauuaaggcugggaaacugggaaggugacugggguagaugacccccugcugacucagacagggcacagcuccugguacagucauuaaaaauggggccucuucagcaguuuucuaagcuaccacauuggcaugaagggcauuaauguguuggagcagguacaguggaggcugaggaggggcaggguuccuuccugaggcauuugcucucccaccagccccacuagcaugaauggcagaucccagcagccguauccauccuucuugcaaguugcucaggcaagauacaucagugaauccugcuaacccugccuucauaauaaauccaaaauccgaccccuucucaucggccccacccuggccaggccucaucauugcccaccuggacuaguguaggaugcaggcuucugugcuccugcccuggccccacaucugcccucuucacagggagaaacucugaccacccaagggaaagcgugucccaucccugcucaaaacacugcagaaaugccucaucucguucagucuaagagccaaagucccuacaauggugugugugcaagccccuguagguguggccccccguccucucugcccacaucucuuucugcucacuccccucaagccacacuaaccucuuggccauuccucaaaaaucccagccuggcugcugccucagggucuuugcacuuguucuuccuucugccugcacagcuuugcccccagacagcugcaugccucacuaccuuugucugucaaguguguucucaaaugcucuuaaguaugagcucugaccacucaguguagaaaaacagccccugcagaugcucccagcccgcuuccuuggcuuuauuuauuuuuccauagcacgcuucaccuaagguaacauacuacaucauuuacuuauucauucuguuucuugucugucaagacuagaaugaaagcuuugucucauuccuugcucugaauccucaacacauagaauggagccuggcaucuaguaggugcucaguaaauauguaccaagccaauggaugcauacuuuugccaccuucaaguuacgugacugggagcaagugcauuuccuggaccucagugauccagucucucaaaugaggcugacugauggggcggggggagauacauagagauuugaaguugcugccccacuacucaauaaacauguggaauagauguuaaaaccuggcccacaucugaccucaggccugcaggcuuccagcgugaggcuuaccagaccagggcugagcuugaaugcgacuucugggucuuaguguaccagccuggccugaugggccuccccgucccuuguuuccaccugggugucccugguggccugucagugagccuuguccuuggcuggcuccacugccugcauucccuaggacccugcuuagaguccccagcccucuacccacccugccucucuggucaacagcuccuguuuacuauuuagcucuggaauggcaucuggacacacacuugcaugaaagcagcuauugagauagugcuuggcaaacaaaagggcugacauguccagaccuagguucuccagaacacagccucaccucaccaggaaggacugggcccuuuaaaaccugugagcaccccuaccaucccagcgaggagggaggauccuaauuccccuggggcagacucuuggugaaaggugaaaucagaaccuagggagcaggaagccugccagccaggcagccuccucugcugguguuccagcaacauuugugggugcugggugcugguugcuggcaccaugaucccauggaauccugccaguagggucugauggaguaagcaaggcuuugggguccaugcacacuuagguuugaauugugagguugccacuccauucugcugcacugccacacgccaugcacugugcuugguggaggugagcaaagaaucuugaaauugagagucggaugggauccgauuguguugcuguggucuuggcaaguucuuugcaggcucucagccuggguuucuccucuaggggauggucagauccugaccuugggguacugucuugugacucuccaugauaccacuuguggaagggcccuggccaggucaggguuuccaucacccucuggcagaugugaauggcagcccugcugaaucaagaucccuccguaccacugccccaggagcuccagggaguccccagggagccagggaacaagagaggccccuggaacaaaugacaggcucugcccuuuuuugagauaagccacccaccaccaucccaucccucuacacccauccccagaaucuggaaucugugaaggguacucacugagcgaccuggaaucugugaaggguacucacugagcgaccuggaaucugugaaggguacucacugagcgaccucaggugagucuuccgacauguccuggcccugauguucuccaugcuccaccccacccccauuuuauccaggggaacuguuggcucaaagaagagaaaacuugggcuuggucaggcuuaugggaggagggcuugguuuaacuucauuguuccaugcauucacucacucauucauugaacaagugcuuauggaauguauaccaggaaccauuccaaauacggaagauacaccaaggaacaaacagacaaaaauaccuaccagauaccuaaauauguaaauuacaugguauauuagaagguagggaacagcauuccaggcagauggaucaacaagugcaaagguccuaaggugagagugugccugcugaauucaggaacugcaaggggcaaugugaguggggcaacaggcugggacugagggcaggaguugguggggaccugauugugugggcugucaucaaccaccugggggacuuucuccuccucaucacucagaaacugaggaggggagggaagacauuccagccagguuggugauccccagcgggcauuugggcuuuuccguugccaccuuaaugguauacacaaugcgcaucuccugguucacucagcagccucaggacugagugacccugguccccaagacagauauugaagacagagacuaagcagucugacauuuuaaauauggggagccccgaguggggcggggcugcccaggaccuuagggauucacuucugguagggagggcugcuaccaggcuucagggaaugccagaaaaaaggugcccgaggcccaccuggcauguaaugaugggcaggauuggcuguaggauguauagagacuuuaguaugggcaggguuggggguuaguagguggagaagggagauugggacaucauugagcagcaaaacccaagugugacagguggucggugugcuccugccagagcagaggggccugaguaggaggaaguggagguggaggccgaggagaaugagacagacagacucacuggccagcgggagaaaguggugggacgagccagggcugacacaucugugugaucccuggugcaguaacuccgguagauggauggacacguggauggauagaaagguggguggaugcagcgacggauggauggaugaaugaaugaaugaaugcaugcgugggcggugagcggccgggagaggggcgggccagcugagcgcucaaucacagccccggggcucggcgcccgccagcugcacucagaaccccccucaccguggcccugcccuguggcgccuaauuacgugcccccagggcucuggagcggcugcugggacugcagcgaagaggggcccgcgccaccuccgccaggcuccacgcgccggccuugagugcgcuccccucggccgccgggaaaccuagaggcgcgguuuggccccaagguccccggucccgcucuucuuugucucggccuaguucucggcugucuccgggccgcgacccaccucuccuggcgguccuugccgcaugcuucugugcugcgccagaaucaucgagucucaguucucgcugccuucccggccaguaggcgucucccccagcuggggagggucccccaaacccugugcuucuaggaccgcggggccggcaagcggcaggaucuccaagcugcgucucugaugcggcuaggggaggcgcgcgaugaaggccccccucuucuccgccuucucucuacgccccaccgcuacuacacgucgcgcugcgccgcgaccccggcgcugccuguuggcgccuuaagcggcucuucugccgcggugcgauccccgacgccaggaggacuaacccccacccgccaggccucagaccccacgcagauccagccacacacgcaaccgccugcagauacccaccacagcccuuuaaguuaacccaaagccccguacaggcgcacugccccuacaugcgcagccccacggccccacacacccaccagcccacucgcaaacaggcccacauggccacacaacugcccucuggacacucagccccacgcaggcacaaucccauauacacacaaccgcacacaggcgcaaucccacccacgcaguaccucacggagucacacaaccccccuauaaacaaucgcacagacacagccccacgcagcgccacaucauucagucaaacugagacccagaaacacauucacuagcuuguauccagacccccccccccaagccccgugacauucacucguaggacagaccagaaauauacagccacauugauacacacacggaccuaaacgcacagccaagaccucacccgcaggcucguaagucacuggaaaaauauuaaagcguucccucccuccccuccucuaucuuugacauacacacgccugcgcgcgcgcgcacucuuacacucacaccccccgucccuaagcgcgucggagccucgcagcgggugaccccgaggccccgcggugagagccaagggagcgucuccccggcgcccccuccucccgcucccuucccgagcucaucucucgcccccccgcccgccuccuccuucccugcccccuccuccuccucccuucccccgagucuggggcgcgggcugcgcgcagccaagcccccucaucgcgcgccccuccccgcgcgcgccccgcgccagcaucgcgcuuaccgaguggaugcggccacggggccgucucuaauuaccuccugacccccggcggccugugaauaauggcuacugagggcgcucgcaggggcugcuaagaaggaaacgcggggcgcgagaggcgcggcgcgcgcgggagcgcgagggaaaggagcgagccuggggccguugcaagcggcuggcgagagaaaggauucgugcgagcgcucacauuuguuucucccaaggaucucaucuggccaccgcguucuggaagaggcgagagggagagcgugcgcgagaggagagagacggcgggggaaagggagacggcgagacgcgcagcgccggcgcccgggagacccaggaggagcccgcagguauuguuggcggcggagcuuuguguuuucggcgggcugcugugggcgccagggcuccccgagcccccggcccgccgccgcgcgcagaccugcccggaguccggggcugcaggcuggggucgccgcccgccgcggacaccccucccgcggcgccaggaucuuggcuggaguugcggauuugcauguuuggggguuuuccacgcugguugagggaaucggucucagaagaaggaauuucuuucuuuccuuuuuuuuuuuuuuuuuuuggccgcuuuuggccacaguuugguugugcuggggauuccccccuccccuuuccuccacaaagcauuggugagcggucuugacgaaugugguauuggcggaaggcauggggcugagauggcggggcugguggccacggauggggaggcgagagaugccagagaaggaaggaguucuguucaaguucgcaaucugcgccccgaagcuggucggaccggggagggcgauccgcgcguccgauccugcuccgggcaaccgaugggaaacuucccgagagcgcggccucccuggggacucggcgccccugacgccuccaggcgcuuccucgggccgcugcggccccuccucgccgcccgccagcgcuuaaggucgcgcucuccccacccccgccuuccucccuuccucggcggcuuccggaucuggacagagcugcaggaguggcuucaaacacuuccccuggagaccccuccccacuccccgcacgagagccugcccaguggccccccugcccugcgccccagucucacgcgcggucgaguggccaggcugacaaugaaaucucgcaccucugccggggggagugggguggggaggaggucccuccuggggcugcugacccugggccucgggcagggggagggggcuccugggggaggggcuuguuuugguuagagacgucgaccugggauggcgccggggcagggagggggcuggggggugggcgcggcgaaggcggcaggcuuggguucgcggccgggggucguggauggcagccccucuugggcuuggugauuggcuggugacuucaggcacgucgagggccccuccaaccucagccuccuccccucugguacaaugcgggcugaaagaggugaucccgagggugcugugcuugugugacgaaguguuugucuccugcgauccucagcagacgcugcuccggugacccggagauccggacgccucgaccccucccucagggccgggaggagaggaggaugaagggggaggagaguggugggaacuucuccuuucccauugaggccaugggaagggaaugcuagcccagaaaauuucuggggaccgcaguucugaggcggggacucaauccaaggggggaccaccgggucagaggcuucccggcacgcagaagcccccagauuauuuugcuccaucgggggaugcagaggaaggggagagguggaagagcgaagggcuagcuggacuggcguugcggggguggagagcccguggaaaucagccuuaauuggauucccaggcaagcagccaggcuaucaaggugcccccuccccuuuuucuuccugggguagagagccagguccagagacaccaagcuggcaacccaggcaggugaaggcaauuccucucccuacuuaaaaagagaauuccugggggagaggggaggcaccuuuugagagggaggggggcggcuagacuguguucaggcuguucugucucuugguccaggaauagaaagaguuaacccucccccagaaauuugucagcccccacacagcagggaaacauuguuggacccucugacaugcuaacagugugacaccggcugacuggagcuagcagauucuagacccuggacucccccuucaaagcccaacaggacucggcuggguggugccuuguucagggaccuugugggaggcggaaaugagagcccagagagggucaggcagcaaagcaguggccuuguggcccggagggaagagggguuacaagccagggccaucggaaacuggaagggaagucgccaugggucugggguagagggaagggagaggcccuucuacccuuugcccagacuccugagcaaggcuuugcccugcuccccacccuucccacacacccacucagcugcaggccuggccauuaaaugugggugucugacccauagguuggaccaugagacccuaguggcugagggaggccugggugaggcucugggaggcaggacugaaaccagcaagggauucacugcugcucaugcccuauggcacaacccccuuauuuauggggcugccuucccuuccccagaccucgaguuuccguuuucaagaaccuuuuucuuccuaucuuccuuagggcccccagggccuagcacacagcagucacucacaguguccuguauuuguccagcuaaauggagugaaugaaucaguggugaaugaaugaaaagggaaaguuucucaauuggaagcaucuagcccuugugguuuuuuuuaaaccuuuuugaaauauauauuguaaaauagcauucacagaaaagcugaaaaaaaaagagaaaaauaagguuauugacagucuuagagggcucugacaauguuaguauuuugauguaguucuucccaguccuuuucgacucggugguugguuuguuuuuuaaagacuuugucgucauucucuauauucagauguauauccugcuugcuuugccggcauaaugugagccuuuuccuguuuuguaaccaaugcuucauaaacaccaugguuaaugucuucaggcuuuuccaaucaaguggauguaccauaauuuacuuaauauuccccuuuuguccaacauucuggauguuccugaugaaugauguaguggauauauuuuguauagcuuuucuugauacuuaaaaugauuugcucaaaaugccacugcugaugccgaaggcuccgacugccugcagugggagaaacggcuucucuaguuuuccuuggauaaaugggacacuauuuuuccuuccccacaaucuagaaccuuccaucagagccgaaaagagccuuggcaaugaaucaccuaucugaccucccuccuuugacagaagaggaagccagagcccagagaggggaagcgagucccaaggucacacagcaguugcugggcuaugcagcagcgaagacccagcuacugauuugccauguugguuuucgcaucugaaaagauuccugaggucuuuaaggcugacccugcccauuucacagauggggggacugagaccccaagcuuaccccuggugccgccagcuggagccccagacaggcuucucggcccuccugggccacccccgacuggguguguucacgggaucuggcggcuacaggcucccuguugcccgccccaccugcccaccacaguuccccuuccucuuugccaucccauucuccagacaaaaagcugaggauccaaagcagaugcagugagggggugggacuguaggucucuggggacccuagugguugcguccuugccccaugccucaguuuacuugucagagaccuaaccuuggaucuguucaggagcagaggcagauguuggcacagauaugagguaugaaggaguggugugggggauggggugcaccuuaaaaucucucucuggcccgagauucaccccaggagaccccccggggagaagggaaggagagagagagggaagaaagaguugaagcagagacaguauuccccaucagaggacagggacuuucugcccccuccccugcagcacaccaaccauccgugugccucugauccugcuuguguauugcuuaagggguuugugugccuuccagcuugggcauguguugugcaugcgugccucuguguguguguguguccgucccuguguguguccccucuguggugucagucucugaucccauuugugcauuucuggggggaagggagggugcccccgagcucggucuugugugugcgcgugcaugcaugugugcaugucugugugugagcacacuguuuccuccuaauggccccaggagggauccaggcaucaggcuuuugugcugcuucaagguuguggcugggugggcgaagagagggaaggccuucgacagggaggggugggguugagggaggcaaaagaaaaucuuaaaagaccgucuucccucuggucuccaaggagaucaggcugugaaaugauccgcacguuaauuaaaaacgauuauauccugauugagccauuccugcucacaucccccagccagggagaggaagaggcugagagcagaggaugcaaaaugggguaggguccaauggcagggcauagccagguggagccacagcccacggaggggagcacaggcugggggagucaagugggaagguguugaggggcacgugcccaagucugauuggagcuucuccuuugaauuuuagggacugucuuccagugguggucucugagaucccaggaguggguggcagccacccagccccauggaucuccacucauaugccaggcacugagcuuguuguuugcacagauccugcaagucagcgcuugugguuccaguuuuacagagaagugacaugcuugaggucaugcagccaggaguugggagccccagauuggacccaguccucugaccccgaggcccagaugcccuucauagcuccuagcugcccccagauucccaccaugagccccuaccucugcaggaccccugggaggcuggggccuaccaugacaagaacuucuccauggcgccccugaggugguuccuugcugagguccgagcagcacagggcugggcggcugugauguccauucacguggggagcugggugacucacuagccuggagcagccuugggcugacucaggucaccuuugccaaccugggcaaggccugccucgccccaccuugcuccuccccaacacuggcucaugguuccacagcagaccagccacaggugccccgugaggcucaagacacuguauccacacugcuggguaccugugccaugucuuuucuggaaggagucugggccuggucacgcugggccuugccugguuaucugucugcuguaagccuuguaaggacuacggugguagaaaagaguagugguaacaauaaaccagacgacccuccaccuccaccccagcaucagguguugcgggguucacaagcguggcagaucucagcauuugugggaccugccugcugccauaccucugcccacucccauccacccaugugccaccucuguguucccugagcccagcuucuccgagaggaggagacccacuguggcuuggccacacccagaagcaagugagaucgcuggccacgagugggggcuuuuucugcuucucugagccucaguuuccccuuuguauaauggggaugauagcuuuuuccggagaggacugacaagagaguaaggaaaaccaggucaaguuuguucaagugccuggcagcccuggaacgcacacagaggcccauuugugcauuugugcaacuguccauccguucagggcacuuguguguugccacaggccuuggguuugcuggcuucuggggagggacacacacugucacauuucagugcuuucuaggagacagucuggggcucaggugacugucaucucagcaugagccucuagggggcaaagaugcucacuggacccaccugaggcuauguuagcaaagguagagugggagaagggagagauguuucugcugggguagguccuagugagauuugcugaaccuggucccacaucuuagcaggagccagaaacaguaucacgaggcaucagaggggcgggcagaacaggaagucagcauccaccuguuccccaaggcagaacugggagagaggcaggcagauguucacucauuccacaaaaagcccuuugcacugaagcaggcagagagacccugccugcgcugggucaucccugcaagaugccaccuuucaggagaacaguuuuugugauguugguaucugccuuccuccuaaauauccccuuccugcccuucccagggccugaaaugcuuccguuagucacugccgaggucagagcauggaaggcccugauuaaaaugcaaacuguuacuuggaggagugaucagaagaugaacucauguuugcauaaugcagaggccacccaccccuaggccccgcagggccgggcaggcagugcugaugggguugugguggcugccuggcccucauggggcgcgguagcucagcucugccagggcagcccauggggaugcagcccauggcgccuguugcccacugucucaggaacaggauuagauguugacaugacacuuccuggucuguauauguugucaccuaauucagcagcaccccuacgaccagauuuagaccuggggccacuagugcagccuccuggcuucaaugcugcugcccagugaucacugugaccauccugcaauacaaguggggcagggacggcaaagcuggggcucccagaggggagcuccccugcccaagucuaggccagugaggcccugccagggcugaggugucauaugaggugcugucaccagacugggggaccgaggcacaagaugagacuuuguuggcccaggaggguaggcuggaggaggccuuuccaaguguggcacggggcggagaggcagagaagcuuugccggugucacucuucugugggugucccagccacaggggccuuacuucgggcccacucgcagccugggaccuugggcuagagucccugaguggccgagagagagcccuuucuaggaagcagggcaggcgaugcccaaggaggcaggcucugcaggagcugggaacugccagagcaucaggcauggugccagccugguaugcuucucauacccacccagcccuugguagcccuccuagaggugaggacgugggagcagaggggccacacacauagggugucgggaccagccugaaccgggucagccugacccugcacuuggggugccuggcggccaggccuguccugcacaucugauucaugccucguuuacaggcuguguuucauucccuucaguccuuccacagugucugcugauggcgccaagguucuggcccagaugcccuggcgaaggcacccaaagggacaggggcugggucuccaaggggaagcauuuugcugcagaaggaaggguguuggcugcaggacacagcaugccagaggccuggggguguggguggcgagcaggugggauuggggagguggaggcagggacugaggccaaaaaggagucugggccuugacugcuugaaggguuuuaucuugaaggcagugggaaaagaugggugcucugggcagugagcaccgcuggagcaaagucucggcagugggaacacacagggacaaugaggagaggcuuaagaggaucagaagaggacccagguggggccucaguuuccucccugagaacuccugaguccucuggggugugggcuggaugagagcagccucccuccuccuggagcugcugugcaggccuagaaugcuggucuagagggaagcagggaccugaccaucuccccaaccucuugccuaagcccagagcagcucggccuagcccugcauccccugugagcugagcacugggagggacuguucagucucggcugagaaguaggugaugguccugggggacugauaauuaaagcucagcagauuauaauucccugaaagaaagcucagcacagagagggaggaacagugcccagagccuuggcacaggcuggaggaggauugcugggggagguggugguggggggaauaagaaugauaccuggaaccaucguguucagagcuuccucucggugaggccuccuaggugcccagcccugggcacuuugcuguuuccagucuucagacccuccuugccaaugaaagguuccugccauccccauuuuacagaugaagaaacugaggcuuggaaaggucuggcaacugugguucaaggcccauggcugguaagaagugagccugcggcuaaacccugggcuguguugggagcguuggccuccuuacugagaagaaggcacugcuuaacucagagagaggcugucugauggcagaguccugggcaggccacaggccugaagcaggaacagguuggagcagggaagaccccucaggacauuccccauguuuguggccuucugucugggagagggggaugggaucaggggucacacuguggugacuggaucugccauucacuuagucaccuguugugugaugccaggcaggugacguccuuccuugggcaucuccucuauaaagggcuuguguucuccugggguuugcaggcuucuuuaagaaucucuuccucccucauuaauccuacaggucccaacugagccuguucucaugccaggagcuccuggcacacuccuuucaucaccugccggagcugggcucuauuaucaucccuauuugacagaagagcacaccaaggcccagaggcuacugcugccuggcggucagccuucuccucaccaguuaaaccugcuucgugcaguccugcugcccagcuuguugcuccugccugucuccuuggcccugccuggaagacccucacuuucccaugcccugugcagagccuaccaccuccucugccaucucuuccacagagaggccagggcuugagcacauaggccagagguuguccucuggcaaugcccccaggugggcgcuguuuggccagcccaggcuuuuaaaaauaacauuggauuucacauaaaaauucuacauuuugcuucccugaaaaaaaaaaucaggucggcauugcagggccacacacccacagggcacuaucggcagagcuaccaugggacugccaccuucugagucaccugguucccugcaguucccacucaugugccagcugggcccuggcacucuggagcuugccacccugcuuagaccuggguuccugcccuggcauccuggcuuucccugauccgaggcagauucuaucuuugaagcucaucuaguaaaugucaaaacugagaaacugauuccaaacugggucuuaguguuuucugagaauucuccaggccagaaagaaaaagaaagggugcaccagaugcggggcacugcguggggaaagauaaggaggugugaaaggaugcagaaugcuuggggaauaauaccauguucuccuugccuguuaaguacuugguuggcaaugccugaauacuaacaccaaucagauucugcuuguucuauaagaugauucauucauuccaggcauucagaugacccucacagcaucccugauagagcaccauugugggugcuuuuauucucauuuucagcagaugagaacacuggaucucagggaagugacauggcacgccccaggucccaguaagggcaggacccugacaagaauuccgacuccugacucccaguccagugcucguucucucuaagacacuggaaaaauuggcucuuaggugggcuucuuucucuggcacauuuuuuaaaugcuccuuuaguuaauaugcaggagggauuuccauguucucguacauaaccuuuugcugaagugacaacgugcgauaaaagggucccaggagagccaguguaauuugggcugugagggacagagaauaccaaugcagaagccucugcagaaggccuggcugcuccugggggcugggagacccggggcccccucaccacccaaugcaaaggucuggccaucuugggcccugggaccacguguacguucugauucgucuuccacugcuugguuuauuuuucucacguuuuugggugaggaucuugguuccuagaggagggaggucuaggcagagagaaaaugagcauccaggacagggggagagauugaggaggaugccugaggcagacguugaagccuuguuucuagucaagcacuggcuaguugggggguaucagacaaagggguccacauagaaggcaaacugaagggcauguucaagugcuguucacgccugccuuuagcccccaacgaccaaaagggggcuuggcauagcgagacccucucucuacaauuuuuuuuuuuuaauuuagccaggcaugguggugggugccuguggucccagcuacuccagaagcugaggugggaggaacaccugagcccgggaggucaaggcugccaugagccaagauuguaccacugcacuccagccugggugaaagagcgagaccuugucucaaaaaaauaaaaaguuggggggauguuaaggagguuccaguuaauuguggcugauucuaaauugggaggccuaacaaaugguacuuauccucccgugggagcagaccagggcuaaccaaggccgcugggaaugggggucauggagacagagccccuuuucccucccacccaccugaaggcuccaagaacuuccacugcagaggugucagggacggaccuggugcagaccagugggcccacaccugcuuuccuaugugcgggucagagcguguagguguauuacaugccugccugugugucugcgugugagcuccuuggacacacacaggggcacauaucugugcuugcauguuuguacaucuaagugugugcguaucuguguguucugacaccagcucgcgacaccagcucgcccuccacaaagcuauuuccaggccccauuccccaagaacagccaucucucucuccuuucccaccugacauggggcagggaggagagaaucuguuugaaaucucaacaggacaugggcuuugcaccuccagagagcaggacuugcuuguguggacagaggugacauagaaagguuucaguuucauccaaauagaaacuuacuuuuuuuuuuuuucgagacggagucuugcucuguugccuaagcuggagugcaauggcaugaucucagcucacugcaaccucugccucccggguucaagcaauuguccugccucagccucccaaguagcugggauuacaggcucccaccaccacgcccagcuaauauuuuguauuuuugguagagaugggguuucaccauguuggucaggcuggucuugaacuccuguccucaggugauccacccgccucggccucccaaaguccuaggauuacagaugugagccacaaugcccagccuuuuuuuuuuuuuuuuugagacgggguuucacucuuguuacccaggcuggagugcaguggcgcgaucuuggcucacugcaaucuccgccucccggguucaagugauucuccugccucagccacccaaguagcugggacuacaggcgugcgccaccacgcccggcugauuuuuuuuguauuuuuaguagagucgggguuucaccauguuggucaggcuggucucaaacuccugaccucaagugauccaccugccucagccucccaaagugcugggaauacaggcgugagccaccgugcccagcccaaagaugcacuuccucucauucagaagugauuuagaaguggccugggcugcuccaggagguagugagugccccaucuuagguggguaggugugcaagcagaugcccaaccugugccuuccucucuuuuguggucccuucuaagcgcaaagugccuagggcuguguaucuccuggcggcaguucugagguggcccuauuuugccaacccagccugguuggagggacugacagggcuucugccccuagguguccccugaacuuggcccacaaaaggccugaggaauauaggggacugugauuguguguguggugugugaugugugacaguggacuuguuuguguaucuguguuaugugugugcaucuguguaugguguguguacuugugcggguggggcuucaaggguugaguguggauauccauguugugagugugcauugcgcauggcccuggaggauggggggacauuucugggcuguguggguauugacugugaacugugaguaugugcacuugggccaguggagguguuuguggcuagaacgugucuggagggaacugugcugagacccccaccgccucuguccugguucauuccuucccaccccaggcuccucucauggccccugcccccaggucagaccugggaggcucucagucaucccaaacucugaccauucaugcucucccucccagagaccuuggcaccugccagcacugcucuugacuuuguccuugcucugggauaagagcaggcccagcagauggccgagaggucccaaggaacagaggaacaggcggggaggaggcccagucacugcuuagcuucucuguaggagauguagaaggaagugggucuuuguguuucugcagcaucuggaccagauggagagaccuuucuggagauggcaugcacacuuccagauaggagcuggaacauuuccagaaauggaauguuuuuagaaaugagacaugguguuucuggagacaggaugaggacguuucuagagaagagaugaaaagcauuucuggaggaggggcauuucugaagaugaaaugagaacauuucuggagaugggagagggcauuuuugaggaguaaagaugaggcuuuucuggauucugagcauugcuagagauggaacauuucuggaaauggauucuuucuagagagaaacuagaauacuucuggaagugguguguuuuugaagaugaugcuggaguauuucuggaaauaaaauagggcacuucugaagaugagguauuuuuggagcugaaaugcaacaucucuggagaugggauauggcauuucuggaaguggaacauucuuggaguuaggguggagccucaguagaccacuggcauuucuggagauggauuacauuugaagaugacggggaauauuucuggagauaagauggagcauuucuggaaauggaacauuuuggagcuggggaauuucuggguuaaaaugaagcauuucuggggaagaaacaggucauucucagagaagggacauuuuuuggauugaggaugggacauuucuagggaaggaguuuucugaagaugagggggucauagcucagccuggcuguuucaaggccacuugaggaggcaauaggggagggucucaggggcccagagaccccaccugugguccuuguuuugcacauggcccgagggagggucuugcccagacucacuccugcugagcugcagagugggcuucugaggaaccuuuccagaaugcagccuuugccacccccuggcccaaaacccuggccugugcuggaauacuaccagagggaggccagagcugcccagucuuacucuuggggucccuaccugcuucuggugggguccuggcagccucuaggcucaccacagggauaggcagugacugaaugguuaaauuuaauuuaauucaauuuugucaagccagcugaggcuugcuccccagcccccucugccagaagccuguaccuuuccuccagucccccgccccauaucccccuaccauggggauaccugaggguggccuuauugcagcagacagauggaggggggcuacaaggcugaacaugggcaaggguccagggcccuucucgggcucagccugauuucagggcggggggccccagccaccuccgccuacuccagagaagcagauauugaggccugucaccacuugagcaggccuggagccccagaguaauuauuucucuuccuuaauugaaauuucagccucagugauccagccucagaaguguaaggcaggcacagagacccugccccugguggggggagggggcgccccccacccuggccccagaaggagggaggcagugccaucccaggggggcagguggcuucacaugcuggugggugggcaugagguggacggcugcuggucaaggaggcagggucaagggggccaguauggcauaguauggccugagcacucaguauggccugaguauggcucaggccaguauggcagcugccaugggaagguugggccucucccucugacuccugacagaggaaggugaggggguugaucuaggcuaagguagcaugagggagugaguaccaggagacugcugccuccucccacaucuggcgggcacugaggggugggcuggggugggugaggggcuauggugugaguggggcgggcuggcuggcggcaggcccaguuccugguucagggcugggugaggcggcuggccuggcggggcgggguggggugggcaggagggugcagcugaggagccuguuuucccggcugcugcggucaggcugggaggagccuccgccaccuggguggucccugcugcccuacacggccuugggccuggccugucugcgggugaaggcgggggcagaggacuccagggaccagcaggaaacugggagaagccaugggcuugaaaugagccugggguccaccccuccgugagcuucucaagguggcucugaggugcugggguaaacguagcaacugccagcuugcagcugugugugucugagcucaggcaacccaggcaccacacaggaagcugcuguacucacuggacccugaugggcugcagagggccagagagucuacuugugggcccuucugggugucagucuucuccaucuggggaauggguuggcuuggugggaguuuucaggccugcauuaccuucaaagggcucaugcugcaagcaugggcuguccucccuguuuuuauaaguacacgggccccagccuuacccagacagcccagcacgcugcccguaguauccuggggaagggcagcagcugucaucaguguuauuucugagguguguuuuccuggcaaccaggaaauuucugucagugggaacagccugcccaaggccuccuccaccccuggggaagacaaguuguaugacaagggagacagaggcaauucaaagugaagaacgggagugaggccgccuccuccgugcauauugcucacacacuggggcagccacgugcccaguaaaggcucucuugaaaaccguggagauaggagccaagcucugcaaggcccugacuagcucaccugaccccuggcaucuagaagcucacagccuauucuugguggagguguggcuauggcugcccuccaaggaggggaagacagagauggcuggacaggaugggacaagccagcccccaggagcuggggaagcgaaggugggugcaaaugaaaacgcagaaucccauuugcaguccauuugcuuagcagcccugaccaggagggagagaaagaagagggcagagcagggagagauggggagggauaaggauacagagagagaaucuggcagccaggggucagggagccuuuggccguaaggccugggaugccugcugcuuacugaggcuguggccccuccugccuuccagagcuaagaaagcuuugcucugucucagcuccagacaccgcauccccaccacacauuccagcaccugccugcuuccccugaccucuggcugccccacagaccccaucccuaccuccacuccuuggggauuuugaggucuuaugccaccacuccacucugagcaggcucagucucccuguguuggugguggugcgggguggugagagugguccuggagcagugggaacuacccggaggccaccuggggugggucccaggcaccaguccagcuggccagugggccacgggggcugaccuugucaccuugggcccagauggagggcagcggugcucggcccuucccccaagcacauacagccgcugagcuaacaugacucaccgcguggcagcucccucuccccacugggaguggggauggaagccuccagaugcugcagccccacccugagggaaucacaggccaggcugagcccuuccaaaguggggauagcuggggaucagacaucagcauccauugaaggggguguucacccgcaugggguaagcccugugccugggacucugggcuuagugcccagcuagggccuugggagacccuugggcuucucugugcucagggggaaaggagcugugcagccucuagggguccugccugccccaagcugugcuggugguccaggcccccuuuggggaggacccuggccaggggucccuagcuccuccucugucauccagagaacccuuaggucccaggggcuggugguguuccucuuccucagaaacacuaccugcaagacuggaacccuaacacagccaccucuggagaguugggggucacccaucucuucuuugcuccccacccacccugguggaagugguucaucugcucugagcccuaaagaggaccaggugggaaagaggccugaugccgugcugggggcuucgaauagguacaggcacuucucuaagguugcuguguagggcaagaaaaucagcucagagagugaaugaauuugccccaggccacguggccaucagguggccuggcugggguuugaaccugucuucucagagcaaagcugacuuggcugcaccucccuggacuucagcuuucagggagggagguccaggcagcaggagccugggggacaaugcuauuuuucauauugauuuuuguauugaccugcauccuguugcccaccccggcaagccccaggacagaucccguuuugguuuucgccagaacaaagcaggcugugcuagaccugccaaagcagauacuuccucagagcaggugaaaggaaacucaaucuugucuuuuguuacucaaggagggagugagggaauggcuuugcccuugaacagggaggccgugggcgggugggaggggugggugaggcaguguggggagagggcaggggcacacauaccugagccgagacaccacccccgcccgccgucagagcauccggaguguggugaccauguuaguauucagcacaagcgcgcgcgcacacacacacacacacacacucgcgcacgcacacacgcacgcucacacucacacacuuaagcgcacacguacacgcacgccuuucuuuccgucucuccccaccacccuccugaguccccucuaaaccaggaagguagcaucugaccagcagagaaaaaaagagagagaaaggaaaagagaaaaagagagauuagugggaagaaaauccgauucuggaguuaccuuaguuaccagcuccuaaugacucgcagggcgggcucggccaccuuccugagcagggggacccucccucccgggccccuccaucaccccauuaauaagacggggcccuuguucaugaguucugccacagaaagggaagaaucaaggacuuuucaauaagagagaacucccugggugguuuugaauaguugcuuuuuguguggcagugcgggacucguccucggcucucugcccuggccgccucccucagcuggcucugucuggaacugccugcuccugggucuccagauggaugagcuuguuucuccgggagcucaauccuuuauuguuccugccuuuccccuccugacacccucagcuuagcagaggccacaggcagccuuugcgucucaggaaagcaagagaauccccgaggugguucuaaaaaggcuuaaagcccgggaguggggcucagcaugaaggaaacaaaagcacacuccccacauccagggugcugggccugucggccagggccaagcucacggccguugcuucggugccaguggaaggggaaugaauggaggagagacugggugagggagaugacgauagaacaggagggagauggguaaauccguuuuaucagacgcugcauaucuuaggaaagcacauuucagcucuuuuggcuuuuggcaagcugguccuacccuuuaauuuucuaauaaaaaggaauuacguuugcugaaaaggcaguaaccagcuucaugucagugucucuuguggagaccauaauucccgucuugggugccugccggcucuggggugggaggugggcuucuguggccacgggugaugauauucaggagucaaggggcagggacgucagggcccacagcagaugccaggcagugccacauggcuuugcccugcuugccccacccuggccuguccacucccagcccagccucugaucaugguuccaggcucaccacagacagggcuggcagaggcucccaagacucacaauagacacuuaaugaauauuuguggaaugaaugaaggaauucuuacugccgaggccugagguagcaggcaaguugcucagagggucagaucuugguuugaaugaaugaaugaaugaaugaaugaacgagugaaugaaugaaugaauaaaggaaugaauguucuccagagucugaaacuaucuaucuggaaggacuaaccuccaaccaaccccacucucccuaagcucuggcacugaauucacuggaaacuuugccaaaaauaauauccccucugcuuuuaacaaauaauaugcacucguuuuaaaagagagagagagagagaagugugugaagucgcaaguucauguccaugcugucccacaccugagucccccagagccaagggugggcacccuuagaagguccuuuagaccuuccuccaggcucugggaauccccugcauuucuuaucugguuuggggguccuugcacacgcacuguucuacaacccuauggggccccucggccaucccuguccccagugagaucuggaugugguucagaccucccugggcugcagagugucccuuccugcucuccaaccugggaacaggagccagguauuuauguaagucucuguggggugaauguaggaaaacauuuuugcuauuacaacucccuucauuccagucccugauuuauugauuuuugagacagggucucccucugcagcccaggcuggagugcagugacaugaucacagcucaccauagccucaaccucccaggcucaaaccauccuuccaccuuagccucccgaguaguugggacuuacagucacaugccaacauacccggcuaauuuuuaauuuuuugguagaggugggaucucacuauguugcccaggcuggucuccaacuccuggguucaugugauccucuugccuuggccucccagagugccucccaaugggcucacaccccagccccaguuuuaaacaagauccugaaggcagaacacucaccauggguaggcacuugauaaaugguagccuuugugauuugggaggaaucuguacccagugcuaugcuugguuccacauccuaagcauugcuugugccauacuauaugccaggcccccagggcgcaggaacacacgguuccagagggguguggaggccccugaguggcagcguccaggagcccagucgcugccccugcccgcagcagcccaucacugcugguauccagccuccuucagacugguguaugccacuggaaacuccaggacaugugcgcagcagaccccacacacgugguuucucuggggcugccuccugaccccaaugggcaggcaccaggucucugaagcucagcuggcaaauguaggagcagcccaggauuuggcugguugggcacaugcacggcucccguccuaggaccugacuuaaucucaauccuuagagguggccugggaaucugaauuguuacuagccucuuggcugccauggaucccuuccaggaucaggaacuggcaugaggcauaggagggccaaggacaucuuuuaggcugcauggagcccggauccacucugcagccccuggcugggccguaggagagcgggcaggcucagggcagggaggggagcuaaaagggaauggaggggagaccagcaggagcucugucugcccgauucugguuugggcugugagacagucauugcauuuuuuugcacaguucuggccacacaguauuuaagaggcuuugccuacagaccugagugacugugugaaugguggcacuggugcauacggggacgccugaggaggaacagauuugggacuuguccaccuaggacucccugugggauugccaguaucaccccucuucgucauuaauucccagcuugccugggggaggccaggggguagcaugggguucggguuccccuaggguucaaacaccagcccaucugcccuggguggcccuucccugcuaagagccucagucugcuguucuguaaaguggguccagccauuucuguacccucaggguggccaugagggucaguagccagaaaggcaaggccccacacagaacugguucacagaaauagcaggcaguuugucaggggcagccuuggcgugguuuucauucaaaaucauuuuuuaauuccaaaagaaaggaaaugguuguaaauaaagaagggaaggccgggcacgguggguggcucacgccuguaauuccagcacuuugggaggccgaggcggacagaucacgaggucaggaguucgagaccagccugaccaacauggugaaacccugucuuacuaaaaauacaaaaauuagccgggcgugauggugcgcaccuguaaucccagcuacucaggaggcugaggcaggagaaucucuugaacgcaggagguggagguugcagugagccgagauugugccacugcacuccagccugggugacagguugagacuccgucucaaaaaaaaaaaaaaaaaaaaaaaaggaaaacuguagaggcacauaaacaggucagaguuccugucuaggcuucccuagaggucuuuacuuuuacuaguguaaucugagucuuugacucuguuugugggcauuuacauacacaauuaaaucuuuacuguguaccuacugugugcugaaccccgaggauuucagaccuugagcccugcuguuaggggcucucacaguccugguggggagacugaccccuaagcugauaaaugaccccuccauggggagugggccuguaaagugaugauggaagaggguccacaaaggagggaacuaacuguggguuggcaggacagggaauggggaucggggaaccuugaagggacauggagugugaacugggacuccacagagaucacaaguuuuuagguagaagaaaggagagggaaaagcuuggaagagcauauucuaaggaaagggagguauuugggaugugcugacuuuggagucccugugggauggccaugaucaacccacuguagggagccaccaagggguucuggaucuuggaugccaggccauggaguuucuguuuuauucucuaagucagggagccauugaaggcuuuuguguguguguguguguguguguguuuguuuuuguuuuuguuuuuuuugagacagggucuguugcccaggcuggagugcaguggcacgaucucggcucaccgcaaccucagccuccugaguagcugggauuacaggcacgugccaccacgccuggcuauuuuuguauuuuuugguaaagacaggguuucaccauguuggccaggcuggucucaaacuccugaccucaggugauccacccgccuuggccucccagagugcuggauuauaggcaugaccaaccacacccagcccugaaggcuuuuaagcagggagguaagugagcugguccagcauguguuuuuaaaaacucuuucuccagcagagcuuacagaagggugagcaggguguacccggggggcuuguguggaguccaggccaggcagggacgguggccagcggguggaggaagccgugaggauguggccggaggagaggggcaggcuugggcccugcgaggugggugcugcccugggccaugauugggcaugaguggggagccgagccauaccauggccggggacagggacugggugcguuguucccacaugagcguuguggaguuggcaugcauugggaggcaucccucugggcucagccccugccuaccaggccaccauugccccuuucuuggccagcagauccuccaccagcaccugucagccccgagcacuggaaacggcagccggcggggccuuugugcuucaggauuccuucuccagggacacgggugauagccaagcccggcagaugcccccgggggugccaccgugcccccacucgccaucuccgaugcucagcugcuccccagaaugaaagaccuugucacaaagggaggcagggagaggaugcgcuuccgugccgcagcccaucugggagccaacguuauuuuccugauugaaggaaacaucuguucaguccucuuucagagcgaggcaggcagcggacugggucggucuggcucugggcaggagguagagaaccugggcugagcccagagccccugcccuaagggguuuaagaggagcuaccaccguucucugucccucccuaaacugggaguucaggagcuccugccauccccuuaagaagccucggucacugccucccccaaggaugggggcugcuggggcaaaagccaucgccugucccagagcaccauauguguuuucuuuuuuuuucuuuucuuuucuuuuuuuuuuuuuuuuuugagauggaguuucgcuuuuguugcccaggcuggagugcaauggugcuaucucggcucaccacaaccuccgccucccagguucaagcaauucuccugccucagccucccaaguagcugggauuacaggcaugcaccaccacgcccggcuaauuuuguauuuuuaguagagaagggguuucuccauguuggucaggcuggucuugaacucccgaccuugggugauccgccugccucggccucccaaagugcugggauuacaggcaugagccaccacgcccagccccauguguuuucugaggacuccuucauuauuucacacacacacuagagccauguuuuugaaagauacggcugccaaacaaacugcauuuauuacauaaugauuaauucaucgcccccauuucuuauuaaucaaagacauccauaacugccuaucugagcuuugaguuggggagagaaccagcggggccucaagcugacagccuucccacccagaucaggggcacugguagauuugugucaguggagccucauuugggguaaaugcacaguaccccugagguuucuagaagaaauggagacagcucacagacccccacacgucaccuccccaaaccccuggggcugccugggauguuuuauaaccccuucuccagccagcccugagcucaggcuggcugcuuggcacuuagccacuggcugacuaguggccugucagaggauguggaagauggggugggccagucccuguugcuggaggcugcaauuaguggcagccugggaaggagacugaagccugggcugaggucaggaccacugggcagagcuugaggugagggcaaccgacauagggcuguccuggcagcccauccugggcugagaacgaauucuaggguuccaggggcauuugacacgaggccggccacacucugagguuaggggcuuuuucaaagauaguuugguggcaggggccuagaguauggggagugccgacugauuggguuggagcugcccucuugugcuuagucgcuucuagauggaggccacaggagugcuugguagguccagguggagccaucaauugucagacaugcaaaaaacuugaaaagauaucucaaaagggccagucuggcugggcacaguggugcaugucuauaaucccagugcuuugggagguagaagcaggaggaucuuugagcccaggaguuugagaccauccugggcaacacagugagaccccaucucuacaaaaaauuuaaaaaauuagcugagcaugguggagugugccuguggucccagcuacuuggaggcuaaggcuggaagaucacuugagccugggaggucgaggcuacagugagcugugaucgugcgacugcacuccagccugggcgacagagcaagaccaguucuaccuggcuaggguggccccagagucauggcggaaggcgaaaggcaugucuuacaugguggcaggcaaagaaugaggacacccaaucuucuuuacucauucaucuaacacugacuguguggccuggcacccaccaggaaugucccugcccucaaagucuuuacaggcuguuggagauggggcagaugcccaaauaagucauuguugucccagguagugccaugccaggggccauccagggagcugagggcccaguaaaaaggcacuuaaacucaaaugcauggagaaggggacagccagggugugauuagggaagacuuccugaaggaggugcugcuccgagaagguugauugggugguuuuuguagggguuuucuuguuuccacuuuuuaaauaacuacuucaugccacaugcuauuaggugcuuuucacauacaucgucauguuuaauuuguaccaacaacccugugagauaggaaauagcuuccguauguuagcagugaguaagcuaaggaucagagaggggagguugcuuggacaacuggcuuagccaugauuagaacuccaauagguucuuaaaugaugauagaaaagguguaggaggaugggagccgaggcuggcauaccuggcagaagaaacaguguacgcacgcguaugucgguggggcacugugguguggagggcugcagggcuugguagcacuggagugagcagaggcgagccugaaagcuggcggcagggaccucaggggccaugacagguaugugagucaagggagugauguggucccgcuacaaaucacugggggcuucagccccuaaugggaccuccucuagcugcaccccccucccugccugugcccuuuuuggcaccugguggcaggcacaccucaaagaacugcugcaucuguuccugcuucugaccucaggagacagcagcagggcuggcauggagcaucagggaaaugcacaacaacacaucagccccugggggccuccuggaucuccccacgaauccugcaauacccuucacaaccauccccguccagaaagaggcugaauggcggccagcaucugcccgucagcagagaguucccgcucuuagcaccagcucgccugagcugccuccagggacaguccugcccgccuccccagagagccagugcuuccgcugccgccuaauagcucucccggcuggagacgacucuugauauuuagccugcguggcaggagccuuaauagcagcaacucucccucccugcuccugccuccugagccccagagacagcucugcucaccuccuagccggcauccuccacgcacugccuaggcaucaggcggaggucuuucugcccacucuugguaacaucaaggaaugaaugagcauccaggagcacuucgagugugcuauuuucuccucugagauucagagaugcccuuugagaggcuauuagcauggccacaauuuaaauaugaggaaacugaaauucagagaggggaugugauggagauggcucacuuucgcuucaucuucccccccucuugguaccaggaaguggaccaugcuccuucaggccucaggaucuuugccucugcuggucuuucuugccuggaacucucucuccuccuucucucucauagaucucaucucagagaagccuuccugcccugguuuauuuacuaagguugguccuucuugccauacuguaagcuccaugaaaguggggaguuccccuaccuucuguugcuccccucuguauccccagcacccagcauagggcauguagcuccacuagggccucauuaaguauuuauugaaugagcaaaugagugaauggauaagcacaugccuguacuaguuaggguaagaucagcugcagcaacaaaccaaccuagcauuucuagauggagguuuguauuuccggaggauggugaguauuucugguggguggagguuuccuccacauggcaauguggccggggcauggucugcaucaagcuggcuuaguguggaggguccacccuggaaggagauaucacuugcauucacauuccauuggcuggagcacagucaugugaccaugcccagcugcaaggaaggcugggaaauguaguccagcuguggcuccaaggacggagaacagguuuucgugacuccaaaucuucccauagguugcuguauuggucucucuaaucagcagagccaaccguuaccgaguccuugucacuauacccuguuguaagcccuuuucucaaauuaguccauuuuauucuuacaacagcccuacaggaggguauuauaauuagcccaguuuacugaugagcaggcaggggcucaaaugacauguuaaggggaaaauacccauuagaaacaugaugggccgggcacgguggcucaugccuguaaucccagcacuuugggaggccgaggcggguggaucaccugaggucgagaguuugagaccagccuaaccaacauggagaaaccuugucucuacuaaaaauacaaaauuagccgggcaugguggugcgugccuguaaucccagcaacuugggaggcugaggcaggagaaucgcuugaaccugggaggcggaggugagcugagauugcaccauuguacuccgucucaaaaaaaaaaaaaaaaaaaaaaaagaaaagaaacacaugaugggugucuggagaugcagcagccaaaggcugagacccucaccccugacuccaccaaacauuacagauauucaaauagacaggccaguguccagaagaaauuuaugcgggcugagccacaguugcuggccuuuguuuucucugguuuugugcuuguccaaggguggggaggugguugaguacaucucucugagggucugggccagggcucagcacuucaucauuucagcuguccauauuuggagggcaucuguuuccuuccgccuuccacagaggaggaagauggguacacauguggcuaguaaccauuagccgucgacuuccgguuuugucuuucuggcucuuuaugauugacaagugcuggcauguuggccuuucugccccuuagcagcccuccaugcaggaaagcgggagggagggguguguggccagugcuaggauggggucuguauggaagaguagcuccaggaaguggagccucaucaaggcagguagcccacgcuucccgaggaggugacauuuggucgggcuuugaaggcuaaggugggagucugucagacugaaaaggaaaggcaugccaggcagaggggccugugcaaaggcuaagagagccuggcuucucggcuccugugucugcuuugccccuagagcuugcccagaacagugaccuaagucugagauccuuccgacccacacugcagagggaaugucuccuaaaacuacuguuuaucucaccucaagcugguguuuuccccuuguccguagagaaggaaaggguagcaaaaaaagaaggaaggugaggagggaaagugaacagagagcgacuggacugagcaccugcuggcuugcucugcugugucacugccauaacucuucccuagcuaugcaccguggccccuugcucuccugcgggcacacuacugccuugggccuuugcacgcacuggccgccuguccugccugcagugcucuuccuggagagccacagggccgauuccuccuucuccuuagagucuucucucaaauuaccucucuugaugaggccugccagaccaccuuauuuaaaacuacgaaccuaguacccguuccccuuagcgaauguuucccccagagcacucagucgcgguguaacgcccuguacaauuuacugauuuauguugcugcuuauuggcugccucccuuccgugcgucuccccaacuccucccauagaagccaccaagggcagaguuuuuuuuuauuuuuuguuuuuuuaaucucuuauagugguggaucucaagcacccgaacauaguaggcacucaauaaauguuuguugaaguaugagugaauucagcccugggcaaaacgugaccccauuucacagacuaggaaguggaggcccagggucuugcagcccuguggggagagggcugcccagcgccccgcaggagccucccgcccggcauacccacgggccagugccgggacugggcgcggggcggcgcgcgggcgcagguagccauggugacagcgccccagacuacucguauuuccugccuuuuguguucgcacaugccccagcccccagcccgggcagacgccccugauuggccgucacacugcggaggggcggggcggggugagcggaaaggggcggggcugaccugugggcggggcccccggggcgaggcuggucuuguacuggcgcgcgcugccugugauuaacaggcgggcgcggccgcgcgcggcuggaaaggggcggggcuuccggaacagccgccccgggagccugggauaggggugagugcuccuugauggcggccccgaacaaaggacgccuccagacccgggcuuccuguccguaguuuuucuuggcccuuggagucugagagugagaggccugcuaggccagcgcccccuaauccucauccggccguggguggccaggcacugcagacguguccccgggggccgaccaccuuacuugccacgcuggccccucccucuccucaccaccacagggccuuugcacgucauuccuggacacucuuaaaguccuucuuuccggccgauuccucacccccucaggaggcucuccacacagaccgugaccugcccugccuggcacuccucugcccagcguuuauaucucuuuuugugcacucuccgcccucaucacacgugugccucagggcagggcccugucuguggccuggcacacaguaggugcucgguuuguguuguugaaugccuccauucaucagguugccugaggcuuccuugguggguggugccggcuguacuggcccgggacuugggaggaagggagacagaugugccuucagacccagacacagaagaguuugucuccaaagccagggcacugggucagugucuggccuggaccccaggcccgaggagccugguuuggugugugcccuuggugaauggccuacugugcuggccagacaggagccccaggggcuggcccugccucaggaggaaggcagggucacagacacaggcuggaggggccuggagugagggcugcucaggaccccugccgaccagaccugggagccccagcaucugacucuucguuuguguauuacuugcugugccuuguccuggcuugacaggguuggaguggggguuggagugguagagcagcgagaaaaucuccacaccccuuacccccauggcacucccacaaaacaaaagggagcuaaacucaugaaaucggcuucacgguuauacauggauagccuuuugggaguugggugaucucugggguauauacauuguuuccucaccaacaccaaaagaaaaugcaauuugagccaagcuaauaacaauguauuaaaucagagcuuccugagcuuugcugggugcuauaaaccaccccgaaguuuguacuaggagcagauuccugggcucaggccacccucaaaucacagauuuuaagggguggggcucaggaaugcccuuuuauucaaacugccugugugugguuuugauacucagucuuaaguccaucauuugagaaauggaaugacagauaucugugucucagaacacauuugaacuccucuccaggcucuagaaagucuaccguucucugccccagacccuggcuccagauucaagucuagacuggaggaacuguggauccuuugggauuuggaaaaaaguucuagacccucuucagaaaaaugugcuuguccacacacacuucaacuuugcauuggaucucaaggucucauaccugggcuggguggucuguaaagcaggggagaccuauuuggggaaaggccuccaugcugacacucaccugaaccuagggccaaaguguaugguuguacaaguuguacauuguacaaggaucccuggaagaaaucgagccacuggccagcugugcagccuggcaccuggggugucuuccuguuuuguacaaaggcauuuuaugccauucgccuaacccaaucuuuuuuuuuuuuuuuuuuuuuuuuuuuuuugagacagaguuucgcucuugcugcccaggcuagagugcaauggcgcgaucucggcucaccgcaaccuccgccuccuggguucaagcaguucuccugccucagccccccggguucaagcaacucuccugccucagccucccgaguagcugggauuacaggcaugcgccaccacaccuggcuaauuuuguauuuuuaguagagacgggguuucuccauguuggucaggcuggucucuaucucccgacuucgggugauccgccugccucggccucccaaagugcugggauuauaggcaugagccacugcgcccagccucccuaaccugaucuuuaauuccccuccugccucccaugacaacucaaguuaguggcacuaguaaaguuacagaaauuaugugccuuagccaugggaaaccggcccucuguaaacuguuauuaaagccauaacaaauaauauccgacagccuguaccuacuaguguucaguuccugguacuccagagcccuaagcguuuuugggcagugguuggggggcugccaccaggccucaacuuggguuaggaagauagggcaagggugcaaggcccgucucugcacagagggugggagagaggaguaacuacauaguaggugcuugguaagcacuuucccagucuacauucauuggguccauuuuauagaucaggaaaacugaggcucugagagggcugguaauuuggauuagagaaggcccaccugucuggagcggcuuuaugaacacaggcuuuggagugcgacagcggggaggucaggagaggagaggaaauagccauagcuguacccccacaacauucacaccaugccucccccugaaggcuuugccugacguuuggacuguuuagagggcuccucugagcucccacagccugagccuuccugucacggugcugccacccugguuuagcaggccuguuuacacacugucaccccaagagccuggcagcaccccagugcuggacugugagcccuccacacagggcccagcgcaugguguguaauacagcucuauggaaugcugaguggcugauuaagugggcucuagcuucuggcagcuuugcucccuggguggauggggcgggagugaugcagaaaggagagguguaggccuagaguuaggagggcagggagagcacugggcacuggaaccacuuggcagggugaguuggcauucccuguuugccacgaccuuggggucacccucaccaacuugccccagcugggccugacugaagggcagggggccuggacauuggagcccagggagggcagagggugguagacucaggagagagcucuuuguuugggggcauuucuccagcagagacccuuagucccuccaaggagcauguccuccuccaucagucaguguccuagccagcaggggugcguccccccagauccuucccugcuuauccuauccugggcccagccaugcuuucucccauggggucaugucauccugacccucagauuuggcugggucgccccagggcucucugacaaagcccagcuccuccccuggcacccagcaucccucagacccggccuacacccugucaagcccgccuucucuucaccccaaggccugccgugccucacagcuugggcagggcuguacccucugcacacaucacccuucccuauccccaacccucucccuuuagugauaaauccagcuggccgcucuuugcagcucaccagggaccaguguccccagugcggcccucggugcacccaguccuuacgugagcccuagccaccauggaaagccaggagggccuggccagccuccauguggggucugguugguuauugcagggccuguugggacugccugugucccuguuccccugggacaggaguucuggagccugcgaaacuuaagcauccaucaugggaccuggcacgggggugccuggccacagcaggagugaaugaauuuuuuuuuuuuuuuuggagacagaguuuugcucuuguugcccaggcuggagugcaauggugugaucucggcucaccgcaaccucugccucccagguucaagugauucuccugccucagccucccagguugcugggauuacaggugccugccaccaugccuggcuaauuuuguauuuuuauuagagacaggguuucuccauguuggucaggcuggucuggaccuccugaccucaggugauccaccugccucugccucccaaagugcugggauuacaggugugagcacugcaccuggcaugaaugaauuuuuuuauuuuuggaaacuccuuugaaauaguguguuugcuuuccacugucuuguucuucaccuuuaccucccuuacguauaaagguagaugcagucaaguaaagugugcuagcuucaaaucagaaaaucuccauagagucuuccgcaaauccuugagcgccuacuacgugcuaaucugucccaggugcucaggacacagugugaacaaaauagaccaaaaauccucuuagugaagcagacgcuugagucgggggcacuggagaaagcaaaucaguucgucgguaacgaggcagggaaguggacggggaggaagaggggcuucugugaaggugugcuuggccaggccucaggcuucccaccuguucacuggggugaugugcuugcccggugggaacgguauucuguucaugacuguugccauuguuauuaaccgcaugcccauugccuuucagaguuugugggcccucucgggcagcccccagagggugcugaaugccgggcccuguguacacuucacccuaucuccgcggggucaggcuggccaccuccauuuacagaggagcagauggaggcccagggagggauaggguggugucacaugcuuggagcgggguccagggagagcucuuggcucccugaggcagggagacccugagcccagacacaccccaguuuauaaguggggacagcuguggagguguugggugcucagcccugggccuggcuucucuggccugaagacggcagcucaucuggcugcagagucaggaaagauuuccugagccuggacugagaggccaagguggguuugcggaggcaggagagagcuccagaucaggaggcagugugggccaagccggggggcggcaggaugugagcacagagagggcagcaacccuucuacagaccaguucaauuccaguaaccccagccugccguaggggugggggacagccuggcugcagcggggcccaccugccagugugugccuugccugcgcuccaccuucccccucgggcacugcggcuuucuugggacagcaggaccccaguuaaacagcccuguuuccugcccagccguggcugccgccucuucucggaggauuuuuuuuucccacaacucaacaaccacuaccacuugcagcuaagcagaagggaaguuaggacucgcauuuugccucuguagcgccuguaaucagccccacacagcccccgccgcaggcgcccaucagugccacuuccggagacuacuugagauacaccugcucacgcuaaaaggagaagcaguaauccaucaaaacaaccccaggcgccggggcgggagaggcugagacucaguuuccccucccauggaacagggcaguguugggcaucugaaguccccacggguccuggcauucuggaagaacacgacucaguagcuuuccccuucugggccucgguuucccugucugccaaaggugcagggagaugagcucccagcucaugccucugggccuccuaccucgcccccacccucaucucucccuuuccagagacauuauaaaucaaacggcuuagaacguaaggcaucagaaauucugaaaccuucaucuauuauuaacgcugacaguaaauucccccuccgagcguuuuacauagcaacuguuaccaagacucggugguggagcugcugcuccagcggccgcaucccagcagcuccgggcaggauggcagggccgccacaagcccuaccaacccggccaccaccugggcacucagcaaacccucuccaggggaugggcggggagggagccuuuggcagaggaaauggguggcuuacagcugaaaggaggucccagcugcuuuuggugagcccugaagaccccagcuccugccuaggugaagacaaggggcccugaagcucccaggccuucagaggcagcaccuauggacagggacgggcuccgggagccucccuuccuugcugcccugguuagaggaagcuugugagauggaggacaggaaaaggcuucguaaacuggaaagggcugugcagauguuguuuaccgacucacccaccugucagcuagacguuccugagugccuguuucucugcaggcaguaucugggcaccagagauuuaaaacaaagacaaaaggcccaaucccugucgcaucuggcuugguaggagacagacgcgccaaccccuaauugcaguugugcaaugaucaacguauguacgaggagcauacucagggcggugaggauaucgcagagggcccuucacgggggcugaugcugggcaggguuuugaaggaugaacaggggagggucuguguguucuggacagagggacugguguaugcaaaggcccagggguaugaagcugcccagcugacagguggauuacaggcugaccuguuuugguggggaggggggcugguagagggagcaggggucagagggugcaggaccuugaaugcaagcaagagaguuuuuacuuagagguucuggucgccauggaagguuuucagcugaggaggaacaaagauuuggguuuggggaguaucacccuaauugcgcagauaaggauaccaaggccugcgcaggugagaacaccugcccaggcaggaagcaggggaggcuggcugcucucugcaagcuguuaagaugcaccugcuguauguccauccccacauggggaaggguggugugaccucagacccugggacagcaugccuagagaagaagaagcgggcagggagcuugugggcucuugccaggucagaguggccaacuacgaggaguugucucacucuuugcaucuccagaaaucaggacacaaguugagacacagacuucagcccagcuauggaugcguccguuggcagucucuccaccuagugacaaauaauauauauguucauugcagaacauucagcaaauagaagucucaagaaaauaauguuucccugcagucucaccccaccacccccacccucugauggccaggucacauuuugggcccaguugcuccagaaccagguacagauacacauuuuuuaaaacagaaguugcaucauguucuuucugcauacccucagugaccugcuuuucgcccuucauacgcuggaauaguuccccaugucugcacauauuucggggugagguuugccaagagccacgcuagccagaggggacccagcugaccuagaauguucggugcuugucuucaagggcagaggccgugccuggccugcccacugcugcacucagcaccaagcauggagacaggcccccaguggaugcugaaugcagagcugugaaaagaaguggaagcuguguccgugaagcugaguacaaguuggacagagcccacuaggaugcuguaaucuugaucuggggcuaaauugagucuugggguaagauuugugcuuauuaagggcucuggaugcuugggguaauagauggaaguuuuucagggagggcuuccuggaggagaugggcuguagaauaaagcagaagggaaauaaaugcauaacuguccauucacucaucuaacagacauccccagagggcucccuccuggucagagcccugugcuggacaggacuaggcacccagacagaguacugcccccaccugcugccagcccugggggaaagacagacaagugcccaggucacuguggcugugugcucgagcagugcuguaaugguggaaggguagacagugaggggccaacuuuacugauagcccccacuuuacugauaucccccaccuccuagccaaagaaguuggggauugauuuaugggagggagcaguuuggcaucaaggugugccuguagaugauggacuuagagggcucaggagggaagcccauacauccugcauacucgggaugggcuuggcaucagggucaaggucacccagacuguacccagaaguuuggcucagcccagugucccuggccugggaacuccuggaugccgaggguuuauggcagcucaguuaguggccuagcccuggguccccgccauggagaggggccccugacguccaacguccacucccagagucccacaccaaggaggcccccagccccacccagaagucaaaggguguaucuuuccagagucuagaagcuggagcugcuguggggccugggccuuggucuccucggcugucaaaugguggcaccacccugcagggaacguguggagcuaaaauaaaauguguuccaggugcuggugccacagggcuuagggccacacugcagaaaacccuuccuccugcuugguccuagcugcccagggccaggccaagaaaggcuucaggaagaagcccccaccuccuagccaaagaaguuggggauugauuuaugggagggagaaguuuggcaucaaggcgugccuauaggugaugggcguagagggcucaggagggaagccccgcagauuacccccuugccaagaaccuccuagaacugcauacucaggggauaggcagcucauucacagugaaaguguuuuggagucaaacagaccuggguucaagccccagcucauucacuucccagcugugugaccuuaggcuaguuccuuguccucucugugcucagaguccucaucuuuacaguggaaaugauaaugauagaccaguauuguccugaggguugaaagaggcgacccauaugugagugccucagcacagggacuggcacauaguaagugcuuggcaaaugaaaaugguucuucuaaggcuuuuuuuuuuuuuuuaacuagugcccaaggaaguggggguggcagauuccucacuggucucuuagguuccuggcacacaugcagccaccagauugagccucuggaaucguaccaauccauuuaccagcccacgucauuagcuuuuucugagcaccuacucugugccaggcacaggggcaccaugguggaacuggaagcagcaggcucgcugggaggcugacagcuguggauccugaccuguggaguggccagugccccgggggaugguggaaggggaagaggguaucuagggcaggcaucaguuggaaagucacagugagauuugagaggaggugaucccugaacuagugacaaggccuacuagcauuuugccaggcaaacuaggagcagguggaaagguugggaggcacaaaagguugggagacucccagagggugccaguagcuccuuguaagucauuguugcugggcaugaaauuugggagcuggggaggugggugggaauccccugugaaugccaggccaaggaggcagggacagugucugauuggugacuggggccugggcagcaucugagcagggaacacaguugagugggagaaaggugguggucacugaggagcgagggcagguggggggauggaaaggucucaggacagggggcccagcagggagggaggcaugggagggaggucucagggcauccaagggacuuuugguugaaccagaaguuccugagugugagcgcggcccagaaacagccacaggccucaucccugcacugggcucgaggcuggagugccaccagcagcuacccauccauugggcaugcgugugucugcuguaugcccugacaagacagauggacucugcccucacggagcuuaccagugcagagagaaaagagagugaauaaauauacgagggaggugauuuuggagagugguaagagcuagggacuaggggaguucccuuaggcagggcagucagggagggcuucucagaugaggugacugggcucauuggagaagacccaggaggauggcgucccaggcggagggaacagcaugugcaaaggccugggggucaggggcauggcaugugugaggagccagugggagccagugugguuggagugugcaugggagcggggugggaaaugaagcuggggaggaguaccccuaaccuuagacagcuaagagguucaaauuuaguugagggaaaguucugacucuacccccagcagcaagggagcuuccccaccaaagcaggagaucuggcucucagcauucacuuuacuuuccugugugaccuugagcaaguggcccacccucucugggcuuccagagucuguggcaacacagaggaaagugaggugcuugcucagagacucgccagcugugacuggccagggguuugaucccagucauuucugcucuguggugggggacuugucgggaggggcagguagaggugagcucaguagaaccaagagcccccaggacacagggcauccaggaggccugugcuuccacagccuguucacuccuucaugcacccgccucccccuccccacugcacuccugcccacacugcccacuccccaacccccuccucucucuagggcugaaagcaagaggcucccaugggggcuggcccgaugauuggcagagucgauaaaggccacuuggaaacccuccugcuccaggugguuccccgcuggcauuuguagcugggauuccgaggccagagcugaacccagagaucauuuaucacacagccucaaauggaggcuuuucuggaaaaaaaaaaaaaaaguucuuucucugagauuccaacuugcauugucuaaaacagguuaauuggcaacaccguuucccccagauccuucccugcauccccccgcuuuccuggggugggaauggcagccccuggaaguagagaagggggacagguuuaagacacgccgcauuuucagagcuugcuagccauguggagacugccagaggaauccuagagauccacccagugaccacggcugcugggcugcacuuagcuuugugauccagaccgggagcugccugugaagucccuccccaaggagcuggaggucaggagccugugugucucacucccuuccuugcuuguuccuaugggaaaugacaauugaccacugauacacgcccgcccucaaggagcugcuggcagcagcaagaggggugagcugugcuggggcagagggggcaccgagggacccugggagccaaaagacggggccagcccacucugccggaguggccaaggagcaaaagcagucugccuggaaggcaggcagggagaagugugcugggcacagguacgggggcccaggucauaaaagaaccuggugcauuugaaaagcugugagaucccagcaugccuggaguguagaauccacgggacucauagucagaauguuucuguuucacaaagccagagagguugggaggguccaggccacaaaaagccuagaaugccugguuguacuccucaagauaggcugggcgugcugcauaacaaauauccccaaauaucagccccuucaaacaggguuugacccucacucaugccaggucucugaccagacagcugggaaacugcucacugaugucacucaggaccugggcagacagaacaacagccauuagggcuauuuucguggcacagagggagagagacagguguacagaugcauggagcuuccuaaagcagcauguggcacuuccacuugaauuucacugcaaagugggccacauggccauccuccggacaucuuuaugggcuagugacacgcuugcugccuuuggcugaggaggacaggaaauauuuggugguggugccgacacugaccacaaagaccaagaagguucagcacuuuacccugagcaaggugaggagccuugggagggauugaguagaguaggcugcagccucauuuaguuuuacuuuuuaacuuuuuauugacuugcauacagagaagagcacgaaucauagguggacagcugaugaauuucugcaaaccaaacacacucggguauaacugaaguucagaucaagaaaaagaacaucaccagcccccagaugucccuuaucccccucaucaggcauuuccugcccaagaguacuuuugucugccuuugaguuucacagacaugaaaccuuuucuguccaacuucuuuuccucuuuuuuuuuuuuuuuuuugagacaaaaucuugcucugucacccaggcuggagugcaguggugcgaucucgccucacuacaaccuccgucucccgaguucaagcaauucucgugccucggccucacaaguagcugggauuacaggugccugccaccacgccuaacuaauuuuuguauuuuuaggguuuugccauguuggccaggcugguccugaacuccuggccucaagauaucugcuuaccucggccucccaaguagcugggauuacaggugccugccaccacgccuaacuaauuuuuguauuuuuaggguuuugccauguuggccaggcugguccugaacuccuggccucaagcuaucugcuuaccucggccucccaaagugcugggauuauaggcaugagccaccgcgccuggccuccucuucuuuuacuauuuaugagaccuaucugugcuguguguggcagugguuuuucauuauuguguaguauucuauugugugcauaugccacagcuuauuucucccuccuacuuuugaugaacacuuggauuguuuauaaucggaggaucuucgguggcuugcgccuguauucccagcacuuugggaggcugagacgggaggagaguuugagaccagcccaggcaacauagcaagaccucaucucucaaacauuuuuuugaaaacuaaaauaguuggaggaucuugugaauauaccugccgugaacauucuccaacacauuguuugguuccuguauguggaguucccauucaaugugugccuuggaaguggaacugccauggucucauuugcauuuaagaagccucuacuggacacacagaagagaccgagguacaguccaggcaggagguggaggggaagguaugugggcccagcccuagggcuccuccaccucagaauccagaaacauccccagcguggacuugucuuccaggcgacuugggggucuguauuguacacacaagaugaaaaucguguaaagcaaggcccagacacaugaggcugagugugcagccccaaacggcaagacguaggccuuacugugugagucacacggugguguuauagcacauucuaguacacaggcaagaauaguuguauaauauuugaaugcacugaacucacuuccaccagguacacgugugaggaaucucccugcaagucacccguuucacaagagggaagacggcccaucuuuuaagucaggggaggggaccacuugcccuggggccucgggcugggguucagccugccucuguuccccacucuuggacacacaggaugaagggccccagugcugaucgcucacaggggugguaagacuuacccuguuacccucuugggguguggcauuucuuagaagccaagcauggguaauccuuugccuggaaugaagccaggagaaugguggggcuucaggcucugguucuagaagacagggcuucuugggagcugccccuggagccucccagccugagcgguaggugcuggagcuggugccuuugaacuuggauucaucacagggaagaccugggguccaggccugguuccgaggugcccaggccagccccugagcagccaggcggccuucuugugaacucacauuguagugucccgugcagcuguccugguccugcaggaugcauuccccacccccaagcccuuaagggcuguuggguuuuguuuuuaagaaacauauggccuaguuguuacuuuggcuggccuccccaagccucaugucucugagacccccacuccuaaggaagggggccaggcauugaugggggugucugggaagccgagggaggaugccugccaguuaugagaaagaugcaucuuugucgcagacacauguggggcgcucuauguaaauuguuucagcgccuaacaggaagaagaaaaaugaggcuuugaugcgagccaccaccucucagccaggcguggugucacucaggcgcguccgaggccugcuucuauuaaggagcuguaagcucuucucaggccagagacccagggugcucucugggcaggagguggcucugcucugucugccgaacucugggcgucagcacuggggcgugcuggggccucaacccagccccaccuccaaggcaggcggagagcacugcugauggauuccccagcacugcacugugcgaggcccagggcggggaccccagcaggcagcgugguaggguuugcuggggaugacaggcaggcgcacaggcggcggcacuguuaggccccaugugauggccacagccuggcacaggaaucggugcuccaggcagcagacagcaaagguguggaggcaggaaaggagccacugucucugaggccugggagagcacugcgggugcuggagauagaugguggcaggggccagcucaggggagggcaggaaucuggucuuguggcuuuggaagcccauggguugcgagcaggagagggugggguggugugagucugagggaggucucagaugggaggggagggcggaguggggcagggaccagugagggccagaguggagacugggcaggagggcauagcacacacauggacaugcuucccaaugagcccuggcccagucaacucccagcuccaggaaccccccacagcccuuugcuggggugcacaccguccagagcacugacuuccccaacgagccagguggaaaugucccagggaggaccccggggccugaggagccuacugaauccucaacaaagaagggaagagaggccuaggccacagcaggcccagaauuauuguguuaugcucuggaucuuggggaauguguaauccccacaccguaucuauggcaacucuccauuaaccagaauuugguucuacaaauuccuguucccauucauucuagaaaacucagagcuguuggucuuuuuaaaaaaacucgcugaaaaaaaaaaaaagauacuaaagaauguaaagaagaaaaugaagucagcuccagccccucugcugagaacacacugauguuaguacuuucgugcauuuccacccaguuuguuuaagaaaauugggauuguguugaaugccugcuuuugcauccugccuuuuccauugugcuucagaucaugagcauuuggcaggucagaaaaaaaaugucuuuggaagcugggcuguggggacugggguuuggaaggcuugcugugugcugugauccuucaggggucaucgcccucccuaagccucagccuuugccucucugcagggagagacugaaggacauuucucaggcucccgccaagagucucaguguuuuccuugcaaugguggccuuguuauuccagccuugcuacucacaggugggccuggugauguuuguggcagggugggcacagggcuggcacugccaccaaguacguaguugagccgguaagcucagaaacgugggcucacuccagccuugagcacuuucccaucucgugauccugggcaaaugacuuugccucucugaaccccuaucucuuaagcuccagaaccgggugguugugaugguucauuggcuuaauguaaguggaacucuuagcauauaauaagugcucaguaaagaggaacuguugcuacccugaggauugcugguaucugugaugucacagguguaauaugaggauuaaaucaugaccuucuugcagcauucagcagaaugccugggacguaggggacacugucaggggguggcaccuggucccauggucuagccaggacuaucuuuguggcccuuaacuugugcagcugcccagggcuggcgcucagaaauggccugugcuuggugcaugcugcucugcuguugcuaucuugaguuuuuauuacuuugugagcaagaggcccuacauuuucauuuugcacugagccccacaaauucugaggccacucuuaacaagaggauuaaucccuagggcagacuggcagggcaccccacacauccacggugcucaauagcuauuuggagggugaaggcaggacugaaugggccuugguucagaggagaacaguaccccagcgaggccagguggcuugcccaguuuacacgccagacauagggccaggcagugcucugaccaucacgugaggggcugucagggcgacggugugucugucaagggcaggaagugggcuguguggagugccagccaggaugggcaggguagccugcgcccugcugaccugcagccagacacacuggggagacacaagacgacucagguuggaaucgauugaaaccaagccaagagcuugggccuuggagugcaugggagggggaggagguucagacccaagguggcggcugcggcugguguuagcacuucuucccggcagggugggcagggccccauuaggggaggcaggccuggaugccccccagcacccuuucaugagggggagagaggagaggagcaaggcccaggccaccugguauucagaaggcugaagugacagugucaggcaguuuggggggcagaugaagccguggcaaaggguggccaggaggccagagcagcacucacagaugaggugggauuggggccaccugcauguguggggaaggagcccccaggacucggugugugggccucuggcugacaaaggccacucugcagaaaggaaauuagaaagaagaaaugauuucuuggcucaugucuucacgaacaagggagaaaguugcuggcguggucuccucacagaagagccaggguaucugaggggagcccuuucucugccagcugggucacccucagggcuggaggugcuggaugccagaguagaaguggauggauggggguguccccccaaaaggagagggagacaaggugaggcugugccuuuuaagccuucugcgcaggccuccuugggacagcccgggucggaucucagacugcagcauguggggcugggagccagcucccccgaggcacgggggcucaagaggucugagcagcaugcugaggucagggcuggaggagcagaaaguaguagggagccacugauggcgucauaaugaaggagcgacaugacaagcuugugaggggccacacagggcagaggcuagggacgaggagaucccgcuggcagcugggcauggaauuucugguggguagugaaacagccagaccuaggaccuguggcagugaggauggggagggggccagaugggcacacuucaggcaggggaaccccaggacuugggggccuccucagagaggccuuacagaaggacuggggcagcaagcaaggccuguggggcgaggaggccuaaggacaccauggaugcacuggagccaagccauuaaggacccugcaccccggccagaggccucacucaggauggcugcaguggagacugaagagaugggucggguggagggaaaugggcuuugcccucaggaggugguugugggaggagaugcggucacccgggaagagaggccagaggaugggaccgaggagcagcgacacgggaggacggcagggcgggugagcgggggggcccugcccagggugacagggcuuugcugggcccuccaggacccuaggcagggucuccccuggaaccaggcgguacaaggccugugaugggaggggcgggaggaugagggauugcuggcaggagggccugggaccagaagucuccacugcagccauccugagugaggccucuggccggggugcaggauccuugucuaccugcgggguagggagacagccugucucccaaagggcggugggguggcugagccucaaggacaaaggcaggcgggggcaggggaaggagccuguggcugggagcuuaauggccccgaaaaaaaaacauaaaaccagagaauuauggggagacauaaacagagcugucaggcauuagcugcagggagacggcucagccuggguaagagaugcuggcggcugagcugggauccuugcgugugcauaaaaaagacagaaguuauaaaaggagggagauuaagaagauacugccucuuccaugauugggcuccccggccaauuccuuucucacgccccggcugaggccccagucgcacacugacccuaggggccuggccugcgaggccuggccaggucaggggccagggccugccagcggccagggagguccauggggguggguggggguggguagcgacuuggcccaagcuaguggaggggccggggagccaggcccaaggacgcaggcggcgccagccccagcaauuuaugggugcucacacacccugccgucuucauuuuccccguugcugcugcugucauuagccaagcacuaaugggcuuaaauuucaccuuaaaccauccccacuguccucagcagaugacaaacgcccuacucucgccggcugcaaagcugcugggcggccuccaagcaggcaugugcccucccucugcccguguccucuggcccucaauaaggaggcuccuaaggacccagggccugggauacucacaggccgggagaauuccugggggugucugggagcccaaggaagggcagggcucaggaaagggggcuucagggggaucuuuggagacccugggaugauaauggauggggagacaggagcccaggguccaggggcaccccacuguuuggccuuggcagggccaugccccugacccugcccaggugucaugaagaagggcccuaggagcuacccgccauguuuuuaaaagccuuagggaaaucauauuuugcuuaggcuaacaaaaauagcaguggcuuugcuugggguuagaauuccauccauccauccauccauccaucaaauucguucacucauucauucagcaaauguggcccaugagccccuggccugagcagguccaugaaaggcccgacuagcuguucauuugaggcccaugagagggaacaagugggugaucucuaaaugcaguucguuugggagacaaaauccuuuagcaguggcucugaggaugggaggggaagugaccaaggggcucuagaggcuguggggacagagugcaucaaccuggggugcauccaguccaugaggcggguguuugcccgaaaaggagacaggaauagagauggagcuauggcagagaugcagggauugcugggggcucccugcucaugugugcacauagccauggccaccgccucccgccuuuguuucccagcaaggggcaggugcccgaggagcugcugggguugauccaccaucaaagccggccugucgggggcugguaugcagagucaucccuuucccaugggaaucucgcucccuuccaagcccccagcacccgccuuucaucccugugcugagagccaguacucccacugacacccaaacagugaugccaaggaggcacugccagagggaggccaccaccauacaggccuggaaugucacacucucuguccccaccaccccccaccugcagugagccuaggggaaagaacaggcuggcacaggcauuaacuggagauggaggguggugcauggcucugggccaccaugcuguguguccccuuguccucucugggccucagacaugcaaucugucaccuaaggguauugacccugccaggcucuggcacaccaggaaauguaagccagacucaaggguuggcaauauguacgggagguugggugaggcaucuucuccaguccaggaggaagggauuccuaacuggugcuuaggaccauggacuuuggagaaaucuauuccuccccaccaguaucuagaauuggcuguggaguccugccaaugcucuguuccugacauuucuagaauuucucccugcauuuccagccccugccaccacuuuggucuggccccauuauugcucucugggggacagucccagcuuccuguucacuggccuccuggccuccccucucacccccaucaccaauccauccugccucacugcagccacugcagacuccccaacacacaugugugaugcucacuguugcucacucucuggggcuccccguggcccucaccacaacaucugugcucuccacuguggcccagagggccacacaccacguggacccugcccaucucucauuucuugccucucacuuccacucgagagccagccugcauucucacuacuaucucucacucucuccugccuuccaggcuuuuccucuuucccuugcuaacuccggcacauccccuaggucucaggugaagugucacuccccugggaagccccucugcccuccuguucccacucagguaugacguagggcccuuucccaugcgcuggcacuuacuugccuucuccacgaggcucugagcccacagcugucucugggugcucagucucuagcagguguauggcauacaguaagcacuuaguaacugcuucugagauggacagauggguaugugcaaggguggaugggcagguggguaugugugcauggaugcauggauagaaagaagguaggcuggugaguggauggaugggugggugauugugagguauacaggugagugaguggauggguggauggauagaugggugugugugcauggaugcauggauagacugauggguggguggguggguggauggauggauggauggauggguggguggguaggugaauaauagauggguggacuguuguguggguggauggagaggccagguggucuaugaggugaguccagaggcauuagaaaauggaguucuaagccuuuggcuuuccaugggccccaauuucucugucuguaaaauggucagcucagcuccugugcccagcguggaggcucaggaugagcuggagagaagguggaggcuucagcaggcagcacaucaggcgcuccacagacagugcaugggacagaacaagguugcuuggcgucccugcagcccaagggcucccuucuucagggggacaccgaugcccuccuccaucccugcuugcucccaggauccuugcccagguagcagacugggaaccagacccauagaguucaaaucuaaacguugcugcucaccaggaaauucccuuugccuccuaggccuuaauggcacaucuauaaaaugggggugcucguguauucauguucuuugcaguuucucuggggaucaaaacaaugugacgaagggaggcagagagaaaaaaugcaaugugacagggaagauggcaccucuccugaugcccagcacacagaggguacccaggaaauauggggcuuagaaucucaacaccugaaagagcagcuucugcugcagccccugccacaggcgccacacuggccacagugcucccuccuagcccuucuuccccuggccaaagcuaccucuggaaacugaguucgaaguuuccaaaccuuaucccagaccccauagccaugaguuauaauaggcacauaauuaauaaucacguaauuauaaugucuauauuauuuauaauuuguauauuuauauauaauuuauuuaacugcaucuauaaucuauaauuuaaaauuacaucagguaaguaauuacuuaccuacuauagugcuucugccacuuacaagcugugugacuuuggauaagugcccuaaccucucugugccucugcugccuccucuaugaguuaaaauguguagacugcuucucagaacagggcccaacacaugucugguaggugugggaauuagccccgaggaugcugaugacaaagcauuucuguaucuguuuugcucauggguucuuugcucaacccugcaaggugggcauuuaaucacuaucccuauuuuaugggugaggaagcggaagcccagcaaguuggggugacucaccugaggucacacagcgagucagcagugggcgucagguacucgguguucuuuccaaagacuccugaggcccuggucuggaaaaagccagcucuggaccaggccggaacacaggggccuuucugaaccuuccuuucaggggccuggggccgcaggggccuccggcccgucagccaagucuuuuccucccaacaugccagccagggaacacagacagccggaccccgcucuggccacugccccgccaggccccugugccaggacagcguguccgcccacccgggcagugaccagcuguuccugaggcugugggcuggagccagguuucugucacuucaaggagcuccugucuucccggccgcaccuccacagccagcaaggaccagucagggauuuuccugaacuuucccucuguuauaaaagaguauauaaacauuuaccuuuuaaaaguaacagcuaacuuaguugcgcccuccucugcccagcauuggucuggcagcugcauguacguugucuccuggcaucugcgcaccaucgucugaggugcauaaucuugugccuguuugcagaugaggaaacugaggcacagggaacuugaguugccugcccaagcccccacagcaaggcagugucuggguggggauuuggaccuagacagggagccucccuaccaaucaggccuucagggcagagucuuggggcccagaaaagcccagcccagcuucugguuuuaaauuuuauaacguguuccuuuguucagaugauugaaggaaagcauauugcagguagaaauagaaugaaaacauuguaacacaugaaaccaggagugccuuugugugcagcugacccuugaacaauguggggguuagggacgcugacccccacacagcugaaaauucauguguaauuuuuuuuuuuuuuuuuuuugagacagggucuugcucuauugccugaguuggagugcgguggcacaaucucugcucacugcagccuggaccucccaggcucaggugauccucccagcucagccucccaaguagcugagacuacaggcaugcaucaccaugcccagcuaauuuuuguauuuuuaguagaaauggggucucaucaugucacccaggcuagucacaaacuccugggcucaugcagucugcccgccuccaccucccaaagugcuggaauuauaggugugagccaccaugccuggccucauguguaacuuucgacuccccagucaauuaacacacauuuugcauguuauauguauuauuuacuguagucuuacaauacaguaaacuaaagaaaagaaaauguuauuaaaauccuaaggaggagacaaucgaaucuauuuacuagucaugaaguaaaagcggaucaucgugaaggucuucauccucgccgucuuuguauugaguagacuggggccaggagaaagggagggucuugcugucucgggugguggagggggaggcaggagaggcaggcacacucgguguaaccuuuugaaaaaacuaucuugggaucuuggcucaguuauuccgaugcugaguaugcuaaucacaucuaauuuucauugauucugagaaaaacauccacauauaaguagacuguguuguucaagggucagucauaccuggcccuggcagcagcagguccccacacagcuuagcgcuugagccaguccuggcugcugcgucccccaaagcuguguacccacugaggaggacgcagccuguacaggaauucagguuugguucuccuuccccucuugggggcuguuuccucauccguaaaaugggaggcugaucccuaucuugcgcauugcaggacgcaggggagcugacuccucuuggcagcugggucuugucccauccuacugagggggaaacugaggucaacccaccagccuagagucaaacagcuggaaaguggcagugccagauuugagccugaaaccagguuauuuuuucagucaccuugccuagccauucauagaaguuuuuaaaucuuuuaggaguuaucacaugcucaugguagaaaaauucaaaugcaauuuccuuuuuauacaaauguuuuguacacacuuuuuuuuuugagacaaagucucacucuguugcccaggcuggaguccaguggcgcgaucucagcuuacugcagccuccaccuccugaguuccagcgauucuugugccucagccuccugaguagcugggauuacagguguguaucaccaugcccaguuaauuuuuguauuuuuauacagauggaguuccaccauguuggccauccuggccucaagugaucaucccaccuuggccucccaaagugcugggauuauaggcaugagccaccgugccuggcucacuuuuuuuuuuuuuuuuuuuuuuuuuuugagagagggucuugcucugucgcccagacugugcaguggugcagucacagcucacugcagccugacuucaugggcucaagcaauccuccuaccucagcuucccaaguagcugggaccgcaggcaaacaccaccucaccugccuaguucauuuuuuuucuuguagagguaggaucuccccauguuacccaggcuggucucaaacuccuaugcucaagcaauccuccugccuuagccucccaaagugcuggcauuacagugugagccacugcacccggcccuguacacacuuucuacacugcacuuuuuuucaccaacuugaagacugcuccaauuaauccauguggugcuuccauucucugaguacucagccaauagaaccucccagauguaucucccucaucccccuuggauggacagcuaggggaucccguguuuugcugcugcaaaggacauugcaguugguagccuugugcagaugacuucgggcccagguuagagggcacauguaauuugcauuuggguccauauugccagaaagcucuccaaagagguaguaccauuuuacccucccauccccaacuagauugggcaccucuuuccccaugcccucaccagcuaggcagaugcucugugccaagaaaaccaaacagcugcuucccuuacaaauacucaagggccugggcaugugugggggccugaguccagccugcacccguuaccaacugcaagaucucaggcaauaggcuucaccccguggggcucaguuuccucaucuguaaaacaguggugauuggauuauggugagaaguuuguagaugcaaaugccuaggacagugccuggaacaucgaggccccaggucagaaguggcuguucuuacgagucugcaugagucuuguaccccaugacugcagucauggggaugggggcccagccccuaggauggaugcucaggccucagaccuguguuuugggaagggaugaagggaagggaagagcaauguggggaauuaccaaggggaaagggugggauuagcuuaucccagcuucccacugugccaguggggaaacugaggcccagaggggcccaggccuugaagugauugcaaguucagcagcaugaaacugcucuuuauccgugcacugcugucaggaacaaaugcugaauggagaguccggaggguugcccaggccacugcaggacccaagcucugagacugagggcuuggggacacagagccagagccuuguccugaaauccuggagggugcuccuuggacaggacaaaacuuguauucucucucugagcccagccucagcagaacccagagucuuccagggcugagaucuugccguaccagcugcggucacagaccugccacacuggcuugaccugggaguuccuuacagcugcagaaccccugucccaccugacccgcugcaucaaaaucugcgucucaccaggauguacacuuuaauguuugaggagcacugagacucagccaggaugauacucuaccugccugcagguacaggccgcugcucuaugggcagaccucaacccucagccccagaauguccuccccagcucugucgcagacauacguggcucccugggaggcauagaaaguacaagacuuggaccuggcuccccaugaacugguggcccuggaaguugcuaccuuuuauugagccccugccagcuaccaagcacauuaucccauuucgucccacaacagcacugaaaguuugcuguuuaauuuagaguaucuugcagcuuaggcacacaaagcacagagagguuaaguaaacugcccaaggucacccagcauauacauaugcaggagcugggauaugaauccagagcugaccccggcaccagagucuagccauuuacaaucagagugggcaugggggcagaugguggcuccucucaccccugaaaccggagccccagccccuaugagcccucacaguucauuggucuggcuguggugaaucugaccucucaaaagccucccuuuccggagcagaggccugcgauucuccaugcuggagagcccgccaagagggauucuccuacaacuuuccagaacacagcaguucuggggccaggccaagcuagcuauguacagcuggaagaggcucucucccccagaugcugagugacuagaagccaagagggagggaguucuggaauggucugcagcagcuggaggugaggccugagggggcuggggcggggccugggaagaggggccagugcacagaguauucugaaccgcagaaaguauucuguucacucugggagaaaaacaagaguguuguucaaaacagcuggacgccaggcccaguugcccucgccugguuuuuacucuuaaacaccuucgcauuucauggcuguuccaaagagagagaaaucagccaguuguccauucagacacaagacaaggcaucagccgacaaccaaaggcaaauauuuuccguggugaggaaagccucccggguggccccaggccugccucuggagcaguggcuggcugguggcuggcucuccccgaaggucgcugcuucuggucagcagacugcgugucugggggacuggccaggauccgcacccacccagggagcgcugggggcagcggggcggccauccuaggcccguaguaaauggaagcucccuuccuggcaugagagcagccaggccuccagggaggccaggacagcgugggccccacaguucccugucuugaaaccccagcccuugauaucaaaaugggaccuguuagucuguugucggggagggggauuuaacugcccaaagcucuuaggcccugagugaauuuuuuucagcacaacaguagcuacacacaguugaagaguguggcacauggcuacauaggguuuguauuuggucuacagaugaaggaacaagacccauguggacuuaggccucauuaucauaauucugcagccccaggagccaaauccccacauggaaacccuuaguagguagccuggccaaguggguagcgggaaaucagugaugguaggcccugggacuucucucuaguccccuccccacccuuuuuuuuuuuuuuuuuuuuuaauagacggagucucgcccuugcccaggcuggagugcaguggcgcgaucuuggcucacugcaggcuccgccccccgggguucacgccauucuccugccucagccuccugcauagcugggacugcaggcacccgccaccucgcccggcuaauuuuuuguauuuuuaguagagacgggguuucaccguguuagccaggauggucucgaucuccugaccucaugauccgccugccucggccucccaaagugcucggauuacaggagugagccacuccacccaggcuuuuuuuuaagacaagaguuuuacucuuguccccaggcuggagugcaauggcgcaaucuuggcucacugcaaccuccgccucccagguucaagcaauucucaugccucagccucccgaguagcuggaauuacaggcgcaugcuaccaugucaaguuaauuuuuauauuuuuaguagagacgggguuucaacauguuugccaggcuggucucaaacuccugacuucaagugauccacccaccuuggccucccaaagugcuaggauuacaggcgugaggcaucgcacccggccacccacccuuuuuuucucccaagaaaaccaguuuucugaaauuuucagggggaaccaggaccuccucgcccaugucuuucaccccugggugccuguauccuguauucaccaaagccccacgggcaucuccccgauugaggucccaccccucagggccuaggacagggggaccagggagggcccccagaggcuggaguuuggaauacccccuucucuucucuggagcucaguuugcaugucugugaaaugacaggugaugucaccucccagaagggcaguuugagagaaguaaaaucuauugaggcaccuuggacacaggagggggucagacggcaucagccuuugagggugcugcaguuacacggcuccagcagucugagccuuaucaagaccuuuccagauaugagggaaguccaugcccagugucuagcuggcugggggagaagccccuugagaacccccacucuguaaugcuaggcucugcauuugcuuaggaggcugugucccugucucuccccuucugggccagccuugcuuucugggcaggcccaggagugucccgggcccagcacucagagucagcgcugucuuuaaucuguauuccacaggcauccucacccccuccccucccaggagcuaggaaccugccaggcuucuuaccucucugcuggaaucuccaccccccaccagaggcugcccucuuggggaaggggcccagcccuugaggccugucuccuccagacuagcuaaaccacagagagaacuccaucucagguucccaaauaggcgguauucuuccccgccaccaagcuaggcagcuccuggcggcuggaaugcccugcuccuuucucagcccaccacuuccuccaaccuuccguccucugugcugcagcagggagucuuaccccaccuccuucaggagggaggugcucacggguuccuaugccugugggucuccaggauugggcacggagcagucugcaaaaugucaagugagggagagauccagucaaagccccaggggggccucugagcucagucagcuccucugcugcuccccaccucuugggggaaggacaggcugggguuugcauggguggccuuuuggagagcagaguaaugggagccuacuugaacuuccugcggccucauucccugacugggggcggaggguagucugagcugcuggccuggggugcuuggccgcaggggaaggggcugggagggaggggucugggugagucuaagggagggugagccugaaaaggggacggcagcacuaaacugccuucggggaguccccacugugcgccccuggcacuuucccaguccccuggcgcggucgcaggcacggguggggucugccucaaaguuguugguacggccagcccgcugcuguuuaaaugguguguuuguuuagagcggcuuagggagggaacuggaaauggggggcgggggcagcgccccacuuggcgccaccgcugccggagggucugcguguuagaagccccagcuucguaaaugaccgaagaagggugggcguugaggagggaaggccgaaaaccaacggagggcucggggccccgggccggccgcccccuuuuugcggggggagagcaggagccgccucucgcagccacucugcgcgcggggugggagggagagagggaggcgaagggacgacagcgccgggcuccccgcccccaucccacccgguuccaauauuucgcagaaaggcacgcggcuccuaaucggucuuuuccaggcugagauuuagccgugcgaugcccgcgcaggggcgggggccgcgggccaggggaggcgcucagaguccggagccgccgagcgaggugaggagcccgcguccucggcugguggagcgggcgggcgggcgcgcaaacccgagaggcagauauagaaaggggggcagguuaaaaauaacccucuccggcugggaagcucgcgcgcgcucucucgccucguucggugccagaggacuccaggggagguggcguuggggagggcagagcgggauucccccuccuccgccgggcggggugcccgccugcgcgccgcgguugcacgugugcggggccgcgcgcccgggcccccucugcacccggucggugggugcccccuccccaggaccgggcgcaucuggcaguggccccccgcccgcagccuugcgcggcuggagggaagcgcuccauuauucauuauuuacgagcguuaauagguuugagccacgggggcgggggguugggggggcgacgaggacccaguggggaccgaagcauuagaagaagggauagggagggagggggaagggcgggggcggggcugugccgcggccuggaggaagaggucucggccuggggcccggcgagccgggcgcaccucuccgucagguuucuccacaccgccggccgucgaggcugcucagggcgccaagagggcagcacgggccuuagauuuugcucucggccucuguccuucgcguccucgcccuuaccgaggcguggggagggagcugcggaggccguacgccccgcccugcgcgccccuugccgccgccgcguccccgcggcagccccggccucauuuaucaucaucuuuggucaaguggagugugcaaggaacagcugcuucacucggcugacuucgagggcggcuacgggagaaucagggagaugaaugaugggggcugguggcagccccccgcgguccccgcgcaggcgagagggaggcggggacguccagggccgccuccgccucauggcgagugcagcgcccccuuccucucuccuggcgccugcagcgaccggggaccgggggaccggggcaccgaggaccgggcccgccccgggaggggacugggcgcggggacgggggggcgcccuucgccggcggagaacuggcgggcgcgcugccggcagagcccgagguugccgugaccuugcuggggucagcgggcugggcugcggaggcggcggcgcggcgucuuuggugcgcuuuccggauuggcgcagaggccgggaaacaaggcgggggcgggcgggggaacacaaauagaaggugaaauuuuaccugccccugagggaguccugcggauuuucuccggcagcagcaggcgcucugccuuugucuuacacggcugaaacaucuguugcagaggggcggagaggccgcaacaacccccacacacccugcgcugcuccccgucccccucugccccagccgggcugcaggacuccaggcgccgcguuaacccugcucgcgcuggggcgcgcgcccgcacucgcugccgcaguccagcgccucgcguggggcuccucgcccccgccccggaucugguccuggccggggcgcccggugaccccccuccaccucgauggggugcugagguguaggcggggggcgggggcggaaaggguuaauggccuagucgcagacccuaauugucagagccggccccgcuucguuucaauuacccuaaguagagacugaaugcgcaauuaacgaagucagcuugccaacuggaaagccggccccgcuuucacguugagcagaauacuccaccagcugacuuggacgaagcaauuuccuccucucucucuccccuuuuuucucuccuucucucuuccaaucccccucccucuuuuucucucuccuuaauaauaaaauuauaccaagcaguuugcgguguggcaggcggccagaaaagcguuucuuuaaacgccgccgucucacaauuaggcagcaagaggauuugacacgccguggcggccugacaggcggcuuccuccccuggggacuggggggagggagggggugccaauuccccgcucccccagguggaacggggacugggaggggcuggccugcugugccuccccggcugucagaauggcugcagcgagggggugucaaaggcagggaagcgaggggcgguuccgccuaggcuggggaaggcggaaggcagcggcacauuccacgacuccucugggaagcuggcguauccaggagggagaccuuguuccccuuucuguuugacagacaggcacucuggggcauagagcuguagacggaucucagcccugcugggcguccugcacaagccacuggcccacucugggcuucuuccauuaaucccucggcaaaaugagggggagauuugaccuagaaugugcucugcaaaaagugucuucccguggcucguugcccuuaacagcuggucuuguaggccaggagaggggggguguaggcagcaccacguagaagcaagccggagaccccuaugccguuuggguggcagacccaugggccucaaggcacacaggaggguggcucggcggggagccaugaugcaggcagcuaauagauggggugacuuugcaggauugccagggauuggugccaugaggacagaggauacugaacacuagcugcagcagccgggccacuugagcucggggaaggcccagagaauuuggcagaggugggagguaacugcagggguccccauuugcucuuugcagccccccagucccacccaggcugcugcuuacauggggugccuucauccuuccccacauaguuaagcccuucuuccagccuucccugaucaccuccucuccccacccccaugggccccugggugucacuacaucucaacaccaccagggcaguuguaugugugucugccugccucuggagagcaagggccaugugcuguuuccugugugucuccggcacccagcucggcccacauccagacuguaagcugagcagaaaugugcuccacaggugaaccagugcaggcacuaggggcucuggaggagacagcacacacuuugucucuccuuccugauuggcuguugcaugcauccuggccuccaggccccucauccucaaaccugucucuggguaucaucccuuuggucuguguuggggguuaaaugcacucaacacagaacccagcaccccaauccaucucaucuguuuauuuauccaaguaauacugaagggacaucgacucuggggccaguuucuggguuuggagcuuagggucaaacagaggaagucucugcccuccucaggcuacguucuagugagggaggcacaugugaaacagcucauuguaccaucaauuauguaauuaccgcugccaugagagccaccaaggagccuggcgggggacccaggagaguugggguggcgccucgcccggugucugguguggaaugccacagagguucucaccgccucuggaagccuccagccuuuccagucccccuccucucugcaccuccuuuccaaggccgcugagugcaccuccugcacgggucugcccugccuccccccugagcccagggcacucgccuuucugcucuccugcguugcucugcuuaucugugcuggucccagagcuucugcugggcccgugagcacuguuccuccugcucugggugccaucgagcccaugcagauccccuuugcaucgguucugucagcauuugaccccaggagcuugugaucaaauucaggccacagacagugucucuugaauucucaaguaugaaagaaaaaacuuuguacuugguugauaauauuuucuuaaaugagagcugucccuuuuuguaaaauccugauuucugucuuuuucaagggaaaagcucagaagcuuuggcacccuggccucccacucccaaguggccgcaguccgcuggugcugagaggggcugcugcugccccuccccccccacuuuauuugggagcaggaucgccaguuugucuccauacccaccugcccacuucccugccaggccucgggaagauguucuuugucaaaugaagcaaagcaguggccaccccugaucucccgcugccuggcccacccacaugugcucugugucgccacuccacugcucuuucuggauauuuucacagaguuacugugacauuuugugcauuauugauucaguaaauauuuauuguucuggacaauggggaguagcugugaacaaaacaggcagaaauccuugcucucauggaacuuuuguucuaaagaggagaccaauaauaaagcaagucaaguuugauuacaacaaggucagucgugggggugcaaggggugcuguuucaaacaguggucagggaaggcuuauugagaaggugacagaggugacagaggagccaagacuuggagccaggguagaagcuguguaguuaucugggagugguauuuccagagguaaaaggcuugcccaaggucacacagucagccagcagucagacaaaccugcagacacuugacaccucuguguuuccacuuccccagggaaguaagucauggacccucugggcaugugggguagggaggacaaggcuggggccagacaguccugugccuucccuuagcagccaggccaggagugguggcucacgccuguaaucccagcacuuugggaggcugaggugggcggaucaccugaggucgggagcucgagaccagccugaccaauauggagaaacccugucucuacuaaaaauacaaaauuagcugggcguuguggcacaugccuguaaucccagcuacccgggaggcggagguuguggugagcccagaucgcgccauuacacucuagccuaggcaacaggagggaaacucugucucaaaaaaacaaacaaacaaacaaaaaaacuagcagucacaccuagccuaucucauccuuaucaugcagccuccuacaagggcaggcacuccuggggcuugggguggggagaauggagcuggcugggagcaccucugugggucccaucugaccccugugccagggucugggccagccccuuggucuugcuaggcccaggacugauugugucugauggcaucagccuggccucgugggggaaggacaggggcugugucccccagcaggacccagacaacugccugggccaccagacccuugcccuguuaacugucugcgacccagcaaucagcaccccccacccuuuuucccuuuucuucauuuugacagagacacagagagguggugacgcuuuuuguucaguggugaauaaagugaucuaaaaaaaaaauuauuguccacaagagacugaucaguacagaacugauaauaggugagcuccucccggcagccuucccuggggggccuaggaaugccugcagcugcuguggaaucccauguugcucccccacaccucacaguggaggugggacugcuggccaucugccccucgucccuggacugugggcccugcggcccaggucucccggccucuugauagcuguaucccaggaaucggcaccaaggaucgguggggugggaguggagagcagggcacagcuuuagaguuaggggaccugggcaccuaggcagggggccuggcugugcccaugaacagcagguggggccaggccagcgggugggcgugguuaggcccugcagggaucccauucagcuggcuuagcaggucucagcuguccccacagcugggucccuggaggagaugguguugggggcugugaggggaggcuccucaaacaucuggagaguccagauaccucugcacucugaagggcccagagcccccagccacaccagggcucccccaaccucaacugagccuggcuagggcugcccuucugcuucucaccccaucacuggcauccugauauuugggacccccagacccuauagagaggguauguuggucaccccgugggauucuuccuugagcaugggggggccaugaaugaggagggaugcauauccaagcguugcccacagggaguggucuggaggggcugccugguccucugggguuccugauguccuaggaggguccuccaucugcccgaagcaggccucucagcccguggacccuaaccugucccagaagccuaugggcacccaaccucuugucuugugggcuccuuggaaacucgcccccuuccucccauucaagccaggccccuaggauauggaauugagcccauacgauagcagugaaucuggcgaacgauuucucauuuucaccaagucuccuguauugauuauucaucacccacaacagauggggaggccugaggaguuccaccuucuccaccccugccuggacuccuccucugcccuguccucagcuucuggagcccugguacacugcuccuucauucucagguucccaggccuugaguggguuggguuuuuaaauuuuuuucuugcagcuacaaaucaugaaaacaggucauaaaaccaccuuggguaaguaggugggauggaaccaguggccucagagcugcugcuggggaucaggaagcccccaguccguuucuuucucccucucucccugccuccccucagccucccucucucccuuucucuuaggaaaaaauuccagccaccaccucccagcugggcucccucaggagccacagcagcucuggccuacacugugcccauuucgcugacuggggccucaagccuggggucugaggaggcuuuaggccuagugaccucucccugaggcugcccaggggacaguaguugccuuggugacaguggguggcuggugaccaucacugcccauuaguggacccacccgaggugggucuggcugcuuaaagaugaggacagaauaaaaaagugaggacccuggccugaggcucaggcugucacaggcugcagcucagccccuugccccacagcagcuuuggcuugcauccugcuccaagagacuguuccuccaaagugggagccccucacgggggcucaggacagggguguccacccgugguccagucacugccgcugcugcugagggcguccugcauaggagcuucccugcgggugggcucugcucugggguccuaagcagggcacuuguccugaaccucacuuuuuucuguaaagggggaggagagauuaaucaaaccguuguucaagaaagccgcacagaguagguguucugcagccgccuugcucccgccucagcaguccuauagauuucuggagggaaagggcugaggucuuugccuaaaagaagggcugugccccaggugugugccacacugccgaaggccugugagagccgcuggccuugcaccguaggguagcugggguuucguugugcccccacuauguucauggcuuggagugaggacacccauugcugugucaaggggaauccugaugcccugggugcuaugugauuccagcucaugcucccugcugugccuggccugccuccucuguccagcgcugagaagacuaaguuccaggaucugauucuaagggugaaguguucauguaucuggugcuuagaggaugcacuagacuccgcuccuccugccuucuaguuucagcaagaacuuuggagauaaggccuggaccaagugucugagaggagaggcagguuggggagaaacggauggaugggaaugaguggggaccguccgggcagugugguugagcuggaccaugaggagugagcccaguggguggggggugcccucccuuguccccucucaccaccccuucucccuccagcccaagccacaggccaaacccacaaucugccugcuaggccacuucuucccugcccccagguucaaaggucaccaucguucugccggggccagggaggggggugcucuuucugcccccuccucuccugaggccugcccagcccaacccaacccagcccagcccugcugccugccucgccuucuguguccuguccuagugcucuugaaaaguaaucauaaucauaauaauuaauaacaacagagcccauagcaggccugaggcagcccuuaaagaggcagugcccccuuuucucccagcagagcuggcagugggaccuggcuggcacugagaggcggccugugccuuuguucccaucccucccuuugccuuggguuccagggugguguuggggcgagcauuuuugccugcauucuccaucagcacugggcuucucguguuuuaauugaacugucuuuucuuagcaauagaugcuuucaccgcauccagcugcucguguguauugggaaaccugccuguaauacagcucggcuaaauuaaaagacacagcagcuggaccaauuaaacagggagggaggaaugcagacggacaggcagggaggggguacugguaauagcacccccucacugucucugucucucuuuaaauaauguuucugguaaugcauuuuggagaaugugaaaaaaaauaaaaaauaaagccguagaaauguuaaugauauccacaggacacucagcaggaaaugagagugaucugggacuaauaaaagccgaaauguaauuugugcagauauacgaggcgcagccuucagagugguccuggguuugcacauucugggcucauaaacaugcgccuggggagggcagggagcgggcgcugugcccucggccugggcacaggcccgccugggcugcccuguggcagucuggccagggcaggagcgugaggcugcccaccuggcagggagcugccagaccagaaccaagugccguccccagcuccucuggguuggcgcgucgcagcaggaaccuccuguaauguuuuauccaagcugccagggguaggauugaagugggucagaagggugggcacgcugcuuguuagggaugccugcgacaaauccagggagaggagcuggagcagagggaaagcggcuuugauaagccggugggcaggggcucgccucgugggaaaguggccggcccccacacugggcugacucuccugcauuugugggccagggcaagcugacuccagagagcaggagagguggucccaggacugggcugacgggcuucugggggccaucuggcugcccugggcuugcccugcucucaggcagauggaggcccucugucgccuucccugcauccauccccagacacuaaaugaggaaggcacuuguggugggguccgggccaaggaagaaggguaaauggagcagcacccccagcucucccccacuccccaccuuucugccucuucccugugccccuccccgacucugcgugccucucccucucugugccccucucccccucucuuugucccuuccugaccccuucaacaaccuggaaucuuuguagccugaggcaagccaccccuuccuuuuggagcauuugggaaccagcacuggaaaguccccuauccccuccugggggccugggccacacaggccgagcugagccccuuucuuccugccuccgggccagcaugguucuggguaaaucccaaacccucugggacucggccaauggccagccccuccaugcacuuccuccaaaaccuggggcauuccucuuucuuccaucccucuuugaggggucuucugguuggccaggccagcgagucagcuggaggaaccuuuacccuggaugcugggcugucagaugcucugcucugagaggcucccgcaacccacccuggguccuuuccugacccaggauucugcucugcaggcaggggcagguuagaccccugccugagccccauccccuaaaaucauaaccagaugggcucuugaguguugccugccccagcccucaccugcugagguggggaggaacuggccaggaggggacagggcugugucgccccauguggguggggcugggcugugcccuuccguggccguggcccugggacugcaucucuacucccauuaguaugcacucccucacucugggccacguaaucuguuuaugcacguaugauaucaaaaacaggaggcaggugcugccgucuugcguuccugggagucagaggaggggacauuuuaugucuacaguggcuuggcagccccuaaucgaugucugcuagaaggaacagacagauuccagauggcguggcagugauagaggaggugugugugugcaugcgugugugugugugugcgcgcgugugugugugagcauacauaugcuugugugcacgcaugugcguggggacaggggcagacccuccucaguccccagcauggcugggucaugcuugaacacggucgcgaagggacuaaauuacaggauccagcaggccccaggggaugagggagcgggaauugcucugcuaaaugcuuuugagcugucaggaagggcugggagugaugggugggggacauuggggaggagcuggcaaugggcggggggggggcggguagcuccccagugaccuggcgcugggcagccgguuuugccucccgcaucaguggccguccuuggcaagacucagcugcaggcgaugugggagcgggaauuacagagcacaccucccugacacagaaguugucaauaugcgcacagcugguggggaggcucaggcgaaggggggacuauuaagagcugcgcgggggagcaggcaggguggggaggugggugggagggugcuuucugaggcaaaaggaaguggcccgucugaaucgcucauccucugcccccucccugcccauccuccccucccuccuucccucccucccucccuuccuuuuucuuuucacagauaaccagcccgagucaugcagucuuuucgagaaaggugugguuuccauggcaaacaacagaacuaccagcagaccucgcaggaaacaucacgccuagagaauuacaggcagccgagucaggccgggcuaagcugcgaccggcagcggcugcucgccaaggacuauuauaacccgcagccuuacccgagcuaugaggguggcgcuggcacgcccucuggcacugcagccgcgguggccgccgacaaguaccaccgaggcagcaaggcccugcccacacagcaaggccugcaggggaggccggcuuucccuggcuacggcguccaggacagcagccccuacccaggccgcuaugcuggugaggagagccuucaggcuuggggggccccacagccaccacccccacagccgcagccacuaccugcagggguggccaaguaugaugagaacuugaugaaaaagacagcagugccccccagcaggcaguaugcagagcagggcgcccaggugcccuuucggacucacucccugcacguccagcagccaccgccgccccagcagccccuggcauaccccaagcuccaaaggcagaagcugcagaacgacauugccuccccucugcccuucccccaggguacccacuuuccucagcauucccaguccuuccccaccuccuccaccuacuccuccucuguccaggguggugggcagggggcccacuccuauaagaguugcacagcaccgacugcccagccccaugacaggccgcugacugccagcuccagccuggccccggggcagcggguccagaaucuucaugccuaccagucgggccgccucagcuaugaccagcagcagcagcagcagcagcagcagcagcagcagcagcaagcccuucagagccggcaccaugcccaggaaacccuccauuaccaaaaccucgccaaguaucagcacuacgggcagcaaggccagggcuacugccagccggacgcagccguccggaccccagagcaguacuaccagaccuucagccccagcuccagccacucacccgcccgcuccgugggccgcucaccuuccuacaguuccacaccgucgccgcugaugccaaaccuggagaacuuucccuacagccagcagccgcucagcaccggggccuuccccgcagggaucacugaccacagccacuucaugccccugcucaaucccuccccaacggaugccaccagcucuguggacacccaggcuggcaacugcaagccccuucagaaggacaagcucccugagaaccugcugucggaucucagccugcagagccucacggcgcugaccucacagguggagaacaucuccaacaccguccagcagcugcugcucuccaaggcugcugugccgcagaagaaaggugucaagaaccucguguccaggaccccagagcagcauaaaagccagcacugcagccccgaagggagcggcuacucagccgagcccgcaggcacaccgcugucagagccgccgagcagcacgccacaguccacgcaugcggagccgcaggaggccgacuaccugagcggcuccgaggacccacuggagcgcagcuuccucuacugcaaccaggcccguggcagcccugccagggucaacagcaacucgaaggccaagcccgaguccguguccaccuguucugugaccucuccugacgacauguccaccaaaucugacgacuccuuccagagccuacacggcagucugccgcucgacagcuucuccaaguucguggcgggugagcgggacuguccgcggcugcugcucagcgcccuggcacaggaggaccuggccuccgagauccuggggcugcaggaagccaucggugagaaggccgacaaagcuugggcugaagcacccagccuggucaaggacagcagcaagccacccuucucgcuggagaaccacagcgccugccuggacucuguggccaagagugcguggccccggccuggggagccggaggcccugcccgacuccuugcagcuggacaagggcggcaaugccaaggacuucagcccagggcuguuugaagacccuuccguggccuucgcuacgccugaccccaaaaagacaacugguccucucuccuuugguaccaagcccacccuugggguuccugcuccagaccccacuacagcagcuuuugacuguuucccggacacaaccgcugccagcucagcggacagcgccaaccccuuugccuggccagaggaaaaccugggggaugcuugucccagguggggauugcacccuggcgagcuuaccaagggccuggagcagggugggaaggccucagauggcaucagcaaaggggacacccaugaggcuucggccugccugggcuuccaggaggaggaccccccuggggagaagguggccucguugcccggggacuucaagcaggaggagguggguggggugaaggaggaggcaggugggcugcugcagugccccgagguggccaaggcugaccgguggcuggaggacagccggcacugcuguuccaccgccgacuucggggaccucccacugcugccacccaccagcaggaaggaggaccuggaagcugaggaggaguacuccucccuaugugagcuccugggcagccccgagcagaggccuggcaugcaggacccgcugucacccaaggccccacucaucugcaccaaggaggagguggaggaggugcuggacuccaaggccggcuggggcucuccgugccaccucucaggggaguccgucauccugcugggcccuacagugggcaccgagucaaagguccagagcugguuugaguccucucugucacacaugaagccaggugaagaggggccugauggggagcgagcuccaggggauuccaccaccucggacgccucucuggcccagaagcccaacaagccugcugugcccgaggcgcccaucgcaaagaaagagccugugccacggggcaaaagcuuacggagccgucgggugcaccgggggcugcccgaggccgaggacuccccaugcagggcaccagugcugcccaaagaccucuugcucccugaauccugcacagggcccccccagggacagauggaaggggcuggagccccaggccggggggccucggaagggcuccccaggauguguacucguucucucacggcccugagugagccccgcacgcccggacccccaggccugaccaccaccccugcacccccagacaaacuggggggcaagcagcgagccgccuucaagucgggcaagcggguggggaagcccucacccaaggcugccuccagccccagcaacccggccgcccugccuguggccuccgacagcagcccgaugggcuccaagaccaaggagacagacucacccagcacgccuggcaaggaccagcgcuccaugauccuucggucacgcaccaaaacccaggagaucuuccacuccaagcggcggaggcccucugagggccggcuccccaacugccgugccaccaagaagcuccucgacaacagccacuugcccgccacauucaaggucuccagcagcccccagaaggagggcagggugagccagcgggcaaggguccccaaaccuggugcaggcagcaagcucucugaccggccccuccaugcgcucaaaaggaagucggccuucauggcgccgguccccaccaagaagcggaaccuggucuugcggagccgcagcagcagcagcagcaacgccaguggcaaugggggagaugggaaggaggagaggccugaggguucccccacccucuucaagaggaugucuucucccaagaaagccaagcccaccaagggcaauggcgagccugccacaaagcucccacccccggagacccccgaugccugccucaagcucgccucucgggcagccuuccagggggccaugaagaccaaggugcugccaccccggaagggccggggccugaagcuggaagccaucgugcagaagaucaccucgcccagccucaagaaguucgcauguaaagcgccaggggccucuccugguaauccucugagcccaucccuuuccgacaaagaccgugggcucaagggugcugggggcagcccaguggggguggaagaaggccugguaaaugugggcaccgggcagaagcucccaacuucuggggcugauccguuaugcagaaauccaaccaacagauccuuaaaaggcaaacucaugaacaguaagaaacugucuucuacugacuguuucaaaaccgaggccuucacauccccggaggcccugcagccuggggggacugcccuggcgccuaagaagaggagccggaaaggccgggcaggggcccauggacucuccaaaggcccgcuggagaagcggcccuaucuuggcccggcucugcuccugacuccccgagacagggccaguggcacacaaggggccagugaggacaacucugguggaggaggcaagaagccaaagauggaggagcugggccuggccucccagcccccggagggcaggcccugccagccccagacaagggcacagaaacagccaggccacaccaacuacagcagcuauuccaagcggaagcgccucacucggggccgggccaagaacaccaccucuucacccuguaaggggcgugccaagcgacgacgacagcagcaggugcugccccuggaucccgcagagccugaaauccgccucaaguacauuuccucuugcaagcggcugaggucagacagccggacccccgccuucucacccuucgugcggguggagaagcgagacgcguucaccaccauaugcacuguugucaacuccccuggagaugcgcccaagccccacaggaagccuuccuccucugccuccucuuccucauccucguccucguucuccuuggaugcagccggggccucccuggccacacucccuggaggcuccauccugcagccgcggcccuccuugccccucuccuccacgaugcacuuggggccugugguuuccaaggcccugaguaccucuugccuuguuugcugccucugccaaaacccggccaacuucaaggaccuuggggaccucugugggcccuacuacccugaacacugccuccccaaaaagaagccaaaacucaaggagaaggugcggccagaaggcaccugugaggaggccucgcugccgcuugagagaacacucaaaggucccgagugugcagcugccgccacugccgggaagccccccaggccugacggcccagcugacccggccaagcagggcccacugcgcaccagugcccggggccugucccggaggcugcagagcugcuacugcugugauggccgggaggaugggggcgaggaggcagccccagccgacaagggucgcaaacaugagugcagcaaggaggcuccggcagagcccggcggggaggcccaggagcacugggugcaugaggccugugccguguggaccggcggcgucuaccugguggccgggaagcucuuugggcugcaggaggccaugaagguggccguggacaugguaagaggccagcccagccaggguggggagugugggguuccaaaggacaggcaggcaggcagucggggagccccuuguuucuagugcuacagugugggccaaaugugucugcagucucgggacaaucugcagaguccugagccucucuggggugugugggggaaguggaggcacccaucuggcuaaggcaggucacacucaccuacccugucccaggagacuucccgccggggcccguaugcccagccaccgccacucucccacucaccuggcaucuucaggcuccagccccacccagaauccacugggccccuccccaugcugucaccggagaugccaaggcccagagaacacgaggacucccaagauugaacaucagggcugccccgggcggugcaagagcaaguugcccacccucuguuccugucuccauugccucugggaugaagcuaagggcucaggaagacccucucuggcgacacaggcuuggugcauggacccagucacaggguuccucccucugcaggacaguccauggggucacacagucacaacaggcagggcggggcagauccagacccucucaccauuggcucugagaccagcuuuggaagccauagucacugagcaccaacaugagagagggaacucuggggcugugccgccaugcaccuuuggggcugugaccugcccucucugugccuccguccccucgccccuaacguggguaugagggugcccauggaggaggggucgggaggguuaaaaggugggcaccucugagcccaccgagcacagcagcccugugauagucagugcagaggggccugguggcucuggugacagcagggugacguucuucguggugucaccacuuccccaguaccauagaguaccucugugcccuucugagggaggggucagugggggcgguggggugcaccucucccccggggccaugcuucugcccccacauucaaccccgacuccacugccucauccagacuuccguggagugacgcucccggcucucagcgcugugugguggcucucaguggggacgccugcagccuucucuggccccugcccugagucccauccccuccacuccuuccuucaacccacuaugugcggcugaggucacaggggagccagaggggcuuggcaggggucuccagaggcccuggacaaacacugccugcaucugagugauucagugacccagcacaguggccccagccgguggcuucgccccucccccugcccagccuccucccccgucgcugcacugcccaccugcuccucgcaguacaccccugcagccccucugagcagccccugcuccugacaguugccguggcauugccuggccaaaccaaggucccggugggggcccacuguguuugccacccacgccuccuagugugugucuugggcaccugcuucccacugcccauggggauggcuggagaccuucuccacgcccagacgcccugcccaccucacuccacccuccaccucagaggaaggcuggccccgacaggacuccugcagguuccuggugccgcgggccuugcuuacccagcagaugguggccuugggccucuucccucuccccuucccaguuagugauuuuuugccucucuccugcuuucugucucucucugucucucucucucucucucucucucucucucucucucucucucucucucauuacuggcuccuucccagcgccuugaaacagguucaagucucucccgucaucaaaaaauaauaacccucagaucaccagccccagcuggcugccaccuccccugcuucacagccccauuccugaaagccuuguccccacggcauccucggucccgcagccucaccaggggcuccccgacacucacgucccaccaggcugagaucaggucgucuccacauccccugcagccagcacuggccggccgaagggaggaggggucagccccgagcaccgaccaccccauccugucccuggcccaugggugucuuaaccgcccaugcacacacaagguccugcuggacugaggagacaguguguguuggagaggcgcuagcuucccuacaccacgcgggggcuggaacuugccagcccagcccaugccugucugcugugccaugcuccagaaauggccugacagccugcgcaacuagggcugccccgggaaggucggaaccaggaacacccugccagacagaugggacauccugggagaaugggcagagucuggggcuucccagggucacuuuuggcucaccaccccuuccugccucaguggcuugggggcgccaugcuccuuggagugagacccugguucaaaucccagcucugccgagggcugguuccauagcuccaggcgagucacgcaugcucugagaacuccacaaugucaaaccccguuagcaggauugugggguucuguggaucaugugggaccugccuggcauguggaaggggcuuggggugcagcugugucccuggccccagcacugccacaccccucgguaccuugaccucacuuuugcgcucuggagggcagaaccucugagccagcucucagggauaccuuuuuuccucgauggccuuuucugggaacugcccucgccugcuaucucugagcccugccugcccuucccccaaagccaucauagaccccuaccuccuauccagauggagccuggccauggaaugcuuggggugagagggacccauagcgggcuccgggcauuguuagggggcuagguggugucugcagaggccccaccuguggcaggguuuacaugccgccaccccugcccuccucuuggguagcuggggucagaagggccugaggccucacucucucugcaucuuaguuucuucacaucuaaaaugcuauucauaugccugccugagggugguuggggccuccgugcaguaaguggagagaagccuucagccagaggacccccauaugcuuaaacauccagacaccaagggccacucacagacagcagccggcuuguguuucgucaucccuuuugggucaggaacuggggacgcuggacuccagaucuccaggaggccaucccagacuaggcgggaaggaggccucagcccugagcugaaaaccugaaauucuagaauaaaccccaggccccacucccagcaugggcagcggggaggggaguguucugacauuucucagcugcugugguugggauggugcgcccacccugagcaugugggguccugugggccccuacuccagccuggaggcagcugcaggggucagagaccagccuggagcccucgggcagguuacucagccucagcucucauugguaacccagguaaaauaacaguaaucccaucauaagguugcugugggcaugaggcuuccagccaugccuggcacauaggaagcuauugucguuuguuucacuggcuucgcacuugggcagaggccgccgcccucucugcugccuucucuaccucaccccccgcccccagcacgguggcacuguggcucuggcgccuggugacuucucccuccccggccucagguuugcuucacucuuccaagggccuucuuggugugacuguccuguccuggccacguccacuccaagcagcugguccagguguggggcagcccccaagcucagcagaggacaguuuugagacuuagaggaggacggcaucagauuuacaugaagucagccaucucaagggauuaccacgucaccgccuccucucacaggucugagagcugguccccuggagggugcaggucucauccuagguagaacagucccagccuagcuucaaagugcuccugcugccagaaaggguagaaaaccaugcugaaugccuucacuguugccuggaaugggagccucaguuucaccaucuguaaagugagauuaaugaaagggacccacagagggcuguuagagccaguaggcggccaggcgcgguggcucacgccuguaaucccagcacuuugggaggcugaggugggcggaucacgaggucaggagaucgagaccauccuggcuaacacggagaaaccccgucucuacuaaaaauacaaaaaauuagccuggcgugguggcgggcaccuguagucccagcuacuggggaggcugaggcaggagaauggcgugaacccgggaggcggagcuugcagugagccaagauugugccacugcucucuagccugggcaacagagcaagacuccaucucaaaagcaaaagaaaaaagagccaguaggccaggcgcuaugucuuacaccuguaaucccagcacuuugggaggccuaggcaggcagaucaccugaggucgggaguucgagaccagccuggccgacacagugaaacuccgucucuacuaaaaauacaaaaauuagcugggcauggcagcacaugccuguaaucccagcuacucgggaggcuaaggcaggagaaucacuugaacacaggaggcagcgguugccgugagcggagaucacaccauugcacuccagccccggggggacagagugaaauucugucucaaaaaaaaaaaaaaaaaaaaaaagcaagccagugggcaaggacacacaccacgcccagcacaccagaagcaugcagcagaugcuggcugguagccacagccaugguaguaacuggcaucacuggcccaagggggucucccuacccaauguaccagcccagagggugcuaaaugacccauguuugugggcauguguaccccagugcugaaccuccuucugguagauuuucaagcaccauuuuggagaagggaggcagggaccacagggggccagccagccuguacagguuuuuuguguuuuuuuuguuuguuuguuuguuuguuuuuugaggcagggucucacucuugcccaggcuggaguacaggcaguggcgucaucucggcucacugcagccucaaccucccaggcugcagcaauccucccaccucaccuuccugaguagcugggacuacaggcacacaccaccaacccucacuauuuuuuguagagacaguuucaccauguugcccaggcugguaucaaacuccuggacucaggcgauccucccaccuuggccucccagagugcugggauuacaggcaugagccacugcaccuggccuaccagccuguaaagcuugagggcugggcuccaacuggagacucaccugccuuuccuuucucuucaucagauguguuccagcugccaagaagccggggccaccauugggugcugccacaaaggaugccuccacaccuaccacuacccgugugccagcgaugcagguacgagcccgcccaggaacaggagggcauuggagcccauccaagcaguccagggggacccucccugggcacagcuccccaaacccaggccccaucucacucuucaguuucccuccucucuugccccagcaauucuuuuauccuucugucugccuagaccucugcugggcaaugccagggacauggaaaugaggcauuccccaggcaccugcuugaggagugcccagagcagugagggaagauagaagcauaaauuacaauguggaaugcugucugcggagccaucauugccaaggggcagggaggaucucaggccucagagagaaagggguauuggagguugggccuuugaaggauaaauaggaguucacucagcagagacaaggggaaaggcacuacuacaacagcaaaaaccaacugaguugggggugaugagguucaaaacagacugagacccauggagcaauuguggaaguuuugaagcaggguaaugggguauggagguaggcccaggcuccccgcauccucuccccgguccuuccucucacucauguauucauuuguuccgcaagcauuuguugagccccuaccaucacugggcacacagaaugaccgugcaugggcuggagccacccaagagcccuuaccuuuaucgaccagguggggaaacugaggcucagagacauuccuuauuucauccagagaaagcaauugcuuaugguacaauauuagucauuggggacaacaauauuuugggagauauggggccaacuuuggccuggauucaaacccuaguggugggggguggggugguuuucguucuuguuugagacagaguuuugcucugucacccaagcuagagugcaggggugcagucguggcucacugcagccuuaaccuccugggcucaaucauccucccaccucagccuccugagcagcugagaccacagaugugcgcagccaugcuggcuccuaguaguguuuuuauuuuuauuuauuuauuuauuuauuuauuuauuuauuuauuuuugagacggagucucacucugucaccaggcuggagugcaguggugcgaucuuggcucacugcaaccuccgccucccgaguucaagcgauucuccugccucagccucucaaguagcugggacuacaggcgugcaccaccacgcucagcuaauuuuuguauuuuuuguagagaugggguuucacugcuuuggacaggauggucuccaucucuugaccucgugauccgcccgccucagcugccuaaagugcugggauuacaggcgugagccacugugcccggccccuaguagcguuuuuaauguguggucuugagcaaguugguugauaccucugcacacaguuucccuaccuguaugauggagaugauaauagccccuucucugcagagcugcugggaggagagugaaauaaugaacacuacccacacggugcugccucaguccuauuuuggguccagccucugugaccucuccccacacggugcugccucaguccuauuuuggguccagccucugugaccucuccccgucacccucaaucccucccaacucuggccuggaaagaggcgaagucauaacccaccucccaguggacagaguccaggcccccccaggcucccgucgcucuccuagcagccccagcuacugccucccguccucaccugaugcccugcuggcuuugccuggacaggggaccacagccuguaccccaccugccugguggguccccagccagugucagcccagccaagcugccccagggaggacacagaggacucugagugcugacaguugcuuggcaggggcugagcugccgggacccagcggggaaggggcuugcuggagcagggacguggaggauucucacuggcuucacgcucccacucugagcagugugagccagaguuuaacauggacccugccacuugcccaggcauguggccgcacuccccauaauagcugccacgagucacauuccuccuuccacagugauuaacuuagcgcccgcuccacucccagcccugcuacagaaccauguuguuuccagccaucuucacagauuggcugccucacccacagcacacagcauggcguggacagucccaggacuuaaugccuuggcuuucuugcuccauguccuauguucuuucuccuaccccagcacugcccagccccccaaggggcucacccuugagugggacggacagcaaaacugugguucuuggccacaguuagggagaccagacgggaaggagagaguaugcacuguggaagagguucauccugucugaacaagggagaaaucuaggaagacuuccaggaggaggugacauuuaagccaggccucaaaagaucgggggagcuuuguagcaacuguuuaguggugggacuuguauacuaggcuuugagcaagagaacuuuuauuucagauaaaauccuagaaggauuccucauauaacagggaucccuguagcaccgugaagauugaggcaggaaagggacugggaaugcugcaaauggagacauacaccucagagacugaguuggcacagaauccaugggacuugaugaugagggagagggaggugacaagccugaugcccagcuuccccaugaaggggagaaguaggguguggacgugcaaauggaguauuagcugcugcugcagagcuacuggcccuuccaggcccagcuucaugucuccagcaccagcccuucauuaguucucaaaagggcgugaguuggcugcaggcucugcugggagcaggaugaucuaggguggccccagcugugccagcuugucuuugcuccaucaaucucucauccuccagcaggcuggccugggugcguccucauggcagccccagggcuuugagagaguggaggucacagggccacucacagccuagguccuggacuuuaccacguucuguuagccaaagcaggucccaaguccagcacagagaagugcaggccaccuggggugagcugcagagccacaccacaaaggaccugggugcggggaggggacugggcugcucugccaggccaucuacacacacggcaguucccuuuggccacacggcaguagaggcagcuguggacauacaaaguguagauagcugggcucaggaucgagucucgcccaccaucagcaggcgagggcucaucagagcccuggaagggacaaaauagcaggguuguguucaccauggaacagcuggcugaggaggaggguggaccccugggaaacugaggaacagcugccagagaaggcgagggagaacaagugagcucgagagugaaggcggggaggacgggcgcuuggggugcagggagggcccccagcgugacucugccagccaggcgguggggggggcgggggggugggagugagagggcacugagggagugggcuggucaggcugaucugaugucuggccagggaggagccccaggccucugugucaggcacugggacugcagggcaccagggcugcccacuggcugccagccucugcccugcacugcgcuguccuggccuacucauccugcccccuuccaauucuuguuaaggaacccacuuuggagacaagcagugacugaagagcaggcagaggcugcuacaccacaguguccugucucaaccuuuccccacucaggcccuggggccaaccugucagugagugcccagguuccccaggugcaggcaccaggucaggagccagaucacugaggacuggccuugcccagugacucccgccccgugccccaugugggguggugcuggggcagugcugagggagccaguuuggaaguggcgaccuccuacccucaacuucccuuggugggagugcccgcagcuacccaggcgugccaggggcaggccugggauuuuagccuagugucuuuggaauaucuaguucagccccagaaccacaucuggcuugccugagccaagggaaggggaacagccguggcacaucucuagcugcuggcccugaauggcaguuuccagguccguggcacuccagcuucuggagacaagggcagaucgccucagagaggccugcuaccacccagcccugcccucagggcugcagagcugucccugcccugccuucuggccaccacccugucaugaugccauugcacagagccaccuccagugugaacaggaagauuguguuggagagagcaccagccuccagcuacuuuugggucugggguuuguucagaacaguggcuggugaggcuuugggggaggggagccgagaaggggacuagagacuggggggucccugggggaaaagccagcuucucccuagguggcaguaggcaggggaguggagacucccugagauagcaacaccuccugggccuaggugggcauaagcacuggccaugcuugguuguccucucugccccugccuccugcgcccacugcaugccacacaugugcagggugguuuauuuuuaaauuuuauuuuauuuuauauuuuauuuuauuauuuuauuuuauuuuauuuuauuuuauuauuuuauuuuauuuuauuuuauuuuauuuuauuuuauuuuauuucaucucagacagggccuggcuguguugcccaggcaggggugcagugguacaaucacagcucacugcaaccuccgccucccaggcucaagugauccucccgccccagccucucgaguagcugggacuacaggcaugcgccaccaugcuggcuaauuuuuguauuuuugauagagaugagguuuugccauguugcccaggcuggucuugaacuccugggcucaagcgauucauucaccucauccucccaaagugcugggauuacagacaugagccacugcugcugccaagaugguuucuauacacucccauccucaaucuccaugauaggcauacaguagguggcauaaugcccauuuuacagauguggagacugaggcucagagaaguagcagaugcucaaauccaggcuugcaacaccacuaccaguccguccacagggguucaugacaugcucacuggaaguuagugagcucuuccaggggcugggcauacauccagggaagaagacagagcuggugcccucugggagcuugccugccaguggggaagaaacaaggagcaagacaagaucacacaggccagucucuuaggaggcagugacaaguguggcuggcagaguaaggcgggagggagggagggacugagggacugccucaagugaggaggggcggcacguggaacucagggggaaaagcucuccgcggaggaggugaggugagucaagacugccaggccaggggccgcacccgcgccguggaguggaguggaguguggaggguuuugugcagaaucugauuaacucuuugaaaagagccccugcagucuggagccucgcgggcagugcggcuccccuccuggcugcagacaaaaccccacagcuguggggcccccacccuguccuaaccaccgaaacuucucuuuggucacagguugcauauucaucgaagagaacuuuucuuugaaaugucccaaacauaagguaggggaccacaguguuuuguagggcgaggggugucaagcgggagaggagccccaccucgcaccuccuucacaguccccugggcccccuuggcugcgcagccccgcagggcccagcccuaggggagggagcucuccccgcccacccccaggagcccccgccgccguccagcucaggucccuguccacuugcgcgccgccgccgccgaaaacccgcaggcgucggggcaugggcagccaggggcuggagggcgucccugggacggccucccugcagcuccccaagauaggugacagaguggggcaggcgggggcgcgggacgguggcacggagcugaaggcgaaggugaaggugaagcuggacgggguggggccagaagggguggugccgacggccucgggcggagaccccagccgcgcucuggggucgccugggucuggggcuuaggcggggggcccacacugggggcggggccuauggacugugaaguccgaggucgucgguaacuggcgggcgggcgucuuuugcagaggcugccguaguaauccaccccaacggccggaggagccgccggagcccgccugcccgcccgccgccgaaggagaggagccgccugcgcagcccccgggccuuugagcugcucccagcgcugguccagagccgauccuugauccgggucccggaucguggauccggccgccuagggcucagacuugcggccccggguugggaggaaaacccguuccggagccgccugcucccggaaccggacggcacagggcguucuugcccaccccaggggccaggcuugcggagggggagcccgcggagcggccagacuccccggggcgcucagccuccggcgagggugggagacggcuuuguccuggggacacuuucccucuggaaucucaagacgacguggcacacauuccacgugggugcugccgccaccccagucggucguggcgugcagcugggagcccugggcuugggggugggggucgaaacaguacuggaagaggcggagggcggcuccuagcuccguggacuaggcgggggagaaaggaagccuuucugagagcgggcuaggccggcacuggagaggccggagccuuuggaacaaaccgugcggaacgcguccaggggccuucccgcccagccuuugccagaucucucgugcgguucgggcaaagccgggguagaccugggcuaugcucaguuagggguugcgggauccccgagugugggcgggacugggacacccuuuggccucuguuuguccccuuuccaguccuccaccccaccccuggagcccagccugggagcgcaaaacccaagaagcggccagaacgcaccuccggcuccggcggacgcgcgaccguugugcaccaccagggaccgccgcgccuacucugcacgggagcagggacagcgcuagauuucguguacaaaaccuguguaccccucuauauauauguuacauagaauguauauauguugggaacaugcucgcuucucccgugugucgccgccgugcgucgugcgcccgcaacagagccccaaccgggccuuugccggguaaggggcuaccgcgacgccacuuguccacgcagccaccaccggcccgggccagucccugccaguccguccgccuguccguccguguccucagcucuguccacgcuucgauaggccugacgcagcccccagcccagggccgcccuagcaacuuccuguacauaugacuguaaaaugguaaacguguguauuauaucuggccucguuauauaguguauauauauguauacauauacauauauauaauauauaugaagacuguaaauguuaagacgacuaguguucuuauuaguauauugcuucacacugaagauuguguguaucgagcuguuucuaaaagauguuuauuuuccuuaagaguaaaaaacagucauugcauucagaaaaaaaaaaaaaaaaaagucaauaaagauacaacgauuguuuuggaa

SEQ ID NO: 6315 - RNA, 80291 nt, Homo sapiens
ucauauauccagcaugaaguucccucucucccucccauuaugaauucugggcugugguccugcuugcuccuugugugucagauugaaguucugaugcugucagccaugucugaccaaucagcaaacaacaccacaggaugaaauuuaaacaaugcagaugcucagauacagggcuauguugccuggaccacgaagggaaagcagagguaaggucagagucuccccaaaguggucuauccugagccugccugacuugacaccucuugggcugcacugugcugcuuugacuuguauguuacccauuugcuuugcacuacuucugucuucccuggcauucaccagaacuuucauuuuaauucgcucugcccggguuacuuuaccaccuucaucugcucacguccuuuucuuuuggauuggugcugacugucauuacgaauguuccuggauugccucguggccgaggguccuuggcaagugccaccuuguucaggucuuuuguggccagacuuuuaggaauagaggacugcugaggaucagggcaaacggacggaguuaauaggccuuauuaauuuucccucugcaggacaguggaauuuaucauucgguuacaaccacgguuuuguuucuuaccauugugauguauugaauuguaaauugagcuuaaaucaucuuuuuuucucagaaacgguuuacuuagaaaagauauaaauagauacaaccuaaacgaggaugaaucagcucaucuuccaagaguuuuggagggggagaaagggaauugauaacucucccccacccgaauccccccccacuuuuuuuuuuuuuuuuuuuuuuuuacaguuuuugguguuagcucacuagauuacuguuugcaaaagaagaaucucaucaucauccucuucuguuuuaaguguuuacuuggcccuuuuauaauuuaaaguguuuacacgguucugugcucccuaggcccaucuggaaaauauuuaaacuucauaagaucuauaagacuagaauaucacauauaaugggauagggggaaggaagaaaaauuagagccguugcguguguuuagaauaaguuaguuguuuguucagaagcggcugcuggaggaauuggaacaaauagcugugugcggugaacgauuggguccagagcuguacauuucaccacagaaugagccuugguuugugaaacugacauucuguugugacuucuaaauccaaacaaaucucugcaaauuucugcccgaucgaguuaauaagaaaauauauacaugcagaggcgagagccguaugcuacuuguacuucugucaguguugguggaaauaagagacggauuuuaccuacuguauuacauucaaccagcaauuggcagaacccccagcucagcggguuuucuugacuuuuuuuucugcugugagaacaaugggaugcaaaagggcuucagaaaaggagagcagcagauacgggauuggggucacuuuucuucuaauugccuuguaauuggggagugguuuccacuuucccacuaucucacuggugggaggggaggaagacagauguggcuuagcgguaacgagcuuucuccaggccggaugugcugagggaccaggggggucauucccugcucugggccugugaucugcuucacaccugugcucauuuucccccaugaucgaugaccuuguauuaacccagagugaccuuuugccuucgccuguucucugggacgagcucuuggcuaguggacccuccuuucucucugauuuacaggugguuacuggagccacauacacuuguuuuucauggugcacugugcacuuagcagcccggcaagaccugcaauuucaucccucucaaggggccaagcaggggauuggaaggugggagggaggagggugccgcgagagugguugcuguuugcaugugcuuuucuauuuuguggcucauaugguaucaauuaccauuugauggcaacgccaggccugaggcccuucgcauguuuguccugugagaaagaucuggaagaaccgacauaugguuuugauugcagcaauugcagguugauagaaugaacgcaggggugagguggguggguuuuccuuccggcccuuuccacucuggguugcuaaugugcuucgcuuguggaacuggucuuuucaucauccagccccucccccacuuaccccucccccacccccaacucccugccacuuugcauucccugccccugccuuccaaaugaccgccaggaacauguggcccacauuaaggaccuucaauuaaaacaaacaaaaaauuguccacucuucuguucagucccagagcaggucaguccaucaagaugguuggaaguguaccacaguuaagaaacaaaugguuggcauagggggcagauucccuccagaagcuugggacauguuuuaaaauggcuguuaguucagauuguuaaacaucgaaaugaugcugaaaaauagcagcaauagagauuaaugugggguguguguguguguguguguguguguauaucuguauguguguguauuucauuuaagacaccucuuggaaucugugcaucugcugcauagggacaggaagaugaugauaauggauaggaguucuuugggguuccaucuuucuguacaucccaggccauaagaugauggaaaagcaagugaggcaugugugucucuaugagcauuucccuucagaaggaagauguuggagacucaucucccaugcacagugacuucucucuuacuaaauuugugaugguaggggguacuccucauuacuguggcucagcagggauugcaucugugaauaugccaagggagggucuacuauuggggaauggugagaggcaaagaggagaaaagaacauuauaggcacuuugaauguuacccagcaacauuuuuuuuguuguuucaaaguaacaucuuucuauaaugcuuucaaauuuaccugucugguaaucuguucuaagaugggcagcccaugagguuuugacuuuuuucacuuuggcuauugcauuucaaaauauuacucacaauuaggaauuuauaccauuugaaacaauaaugugguaucucaugaguaaaugcugccauuaacaucuuccuucuuuuaaacugaaaacaagcaaaccagacccaaaaaaaaaaaaaaaaaagcagaaacaugcucccccaagaaagcuuguuuuuuucuuugagauggagucucgcucuguugcccagguuggagugcaauggugcgaucucgacucacugcaaccuccaccucccagguucaagcgauucuccugucucagccucccaaguagcuaggauuacagguguccaccaccacaccuggcuaauuuuuuguauuuuuaguagagaugagguuucaccauguuggccaggcugguuucaaacuccugaccucaagugauccgcccaccucggccucccaaagugcugggauuauaggcgugagccaccacaccuggccaagaaaguuuuuuaaaugugagaugaauuuuuaguuuugaaggccagcuauugaaaccuaaucacacugcuugacauacuucuucauauuuaucuuuauauuagagcugaucuuuaucaaaagguaguagaaacuaaaaaacuuaaguuauugaccuaaauuguagggaaaugucugucugaucgacucuagagagaaaauuggccguaucuuuauaaugguuacugaauguauaucuucaugaggcuacaguuuuuuuuucuuugcuccaacuuucuccuuaugauguagagauugguguauuaaauaaucacuuuuucaacagucuugaugacaauuuuauuuugcuauuucauaaucuucauacaaugggauaaguguuuucagagauacguuugaauucagagcaacuggcaauuaagugauuugcucuagucacauguuuuaguaguagcuauuugguuauuugccugauauuuaaugcacacauauguacccuuaaaucaucauucagugugauagcuuaagacaacauuucuguuugcugcucaugccacuauuagcuacguuugaagagugauauacugagaaguuuaauuugcugggguuuuuuucuaaaaacauugcuuuccugaaauauauaguauugggggcucauagcaaaaaaaccguaguauauggguugugagccugucuucgaacauggugggucacuuaacagcagcugugcuggagagauauuugauuugagaagacuguuuugaaucuucucagcccuaacaccauucugguuuugaaaugggaaaauggaaaagaguuuuagggaauagagauaucucagccuugaaaggaagcauagguagaaaucuuucaguucucacucagaugaaccagcauuccuaaucuggcuacccucacagaggacaaagagucugcugggaaauguggguuuauauuuguagagacacacuucagaggcaugagauaguguuagauaccgacuggaugcuucgugcccaacaucaauuugguuugcagauugaaauuuaggaaagcuugcagaggagccaaucuuuuuuauauacagcaccuuuaaaaaaaagacuguccacuacuauuaaaaucugauucagucuucuaaaauauuacuacauucaagacaacuuuuaaaaugaucaaauuuagauagacaucaaugauguuaaaagauaaaagcccuccuacauguaauauauagugucuuaaaccuuauuuuuuaaaaaagggauaccacuuuugccaaaaguuucaauguagggauacucaaacuguccuuggaaguccuaaaaauugcuaguuuuuuuuuuguuugcuucuuuuuuuguuguuuuuguuuuuuguuuguaguuauucacaaauggagaaauauuuauaaaauuauauuauaauuuguaaugcacgcaaacaaccaucagaccacacuugaaucagagaguuacaguuauaaauugaggaaagaggaugccagcacaaugccuaauggagugaaaaauugugcuuauuuucacaggacucucuuggagaggagcuaacuacuuuccucucucuuaauacccagacccucucccucagcccugacagcacguuacagaaugcauucacuuagugugugaagagcuagcucaccaccucccuuuaagaucuauucuuguuauucauacauugcaaauuuguacuuuuguauccacaaggaagacauuacuaacuucaagaaaggcagugucaaugaggagcaggaaaauacaguaugauacaagccugccaaugaaagaauuauacucagacucuaugcgcucuguuaaacaaaauuugaaccuuugaggaaaaaauauuggggauucugaugaguguuuuuacucuuucuuuccuuuuuuuuuuuuuuucuauuuggaaaucauggcuuccugauccuaagggauaaaaaaaaaaaaaaaaaaaaaaaccucaaagaaaagacucaacaggcuuucuggacaucaaauaguuccuacaaaacaacauucugaugacuugcauguaaagaaaucagaaacauaugaauuaagcuucucucgaaauacauauggguugaaaaauagagagaagugcugagaaaauguguuuuggguuuugcugagcccaugacguuugaaaaauaguaugagacauugaacaaacacaaagcauggcuuggcucacccauuccuaauauuagccuucuaguucaacggcaaaucaguuuaccaugugccuaaaugugagccaccuuggugcacucccccacacuuaauuauaugcaguuuaaauuuuuucaauuaggagcucaaaaauaacauugcauuucaaggaaaugcaaaucuuagcauuuucuuaccugguuuguucaccucagaccauuuuagaaaacaccacagauuauuucaccuuaggagcagucacacugauguggcccucuuugauguggcuggcauauaacagaagaaacguaucauuuuuaagaaacuggcuccaaagacaauauugcuauuaaauugaagccaaaaaccacugcagguaaaacaugaugaagaugaaggacgcccucucuuagccauauaguagaagcccgaucauagacucucacccuuacaccaugacuugaguuccugcucauuuuuaucccugagcucugcagacuucuaagcaguggaaguuuucauucucuuucccacauugcacucaagagagcuaacaugagagauucuaaauccugggauuccucugcaucuggcuuuaaguacaggagcagaacacagggaauuuaaggaacaaaaauagccagagcuucaggcuucuuccacugaugguaagucauugacaugcacuuggaugaaauccuguaucuguucuuuggacuagcacuaucgccugagauuaucaguuucagagaguuacagagaggcaguagauuucaucuuuccuauuucaggaggaguuauuuugguuguuuaaaaaaaaaaaaaacacuuuaauguacuuuuccuaacuccuucacucagaugguggcaagaaguuugacagaauaaaguaauucagcuaauauuuaucaaaugccuacuaugagugagcuguuagaauauaacccugaacaagacaagcaugagauaggcaaacagacuauuaaaaccuagacugauaaugcauugauugggguguacaggcuccuuaagguagauauacaaaggacaacuaguccacauuuggccuuagaggaagugaagugcaaggaugaaugggaauuaagcuggcaaaaugcaaggguuauaacuggaagcaggggugagcauggcauauccggugacccagaaguaguucagaaugccagaagcuuaugguacaaaaggauaacauaaaagaugagacugaaaagguaaacaguggccugaucaaaaagcgacuugugagcccuauuaaggaguugagauuuuaucaugaaugugacgaggagccuuucaaauggguaugccugagaaguaauugaauuuaaaagucaagacggauaggaggaccuggaaaacuuagagucagagaagccaagggaggcagaucugaccagaaggaggaaauugucaacagugucagauguugcugaaagauagaagugacauuuggcugcagcauccaggaggucuugagcaguuucauugaaguagugaguguggaaggaagguaaagaaguggagaacaggcauugcaagauaauuuuccaucaucgucaucaucaucguccucaucaccggaaaaugagcaucaauuaucuuaucuaccagacauagagagugaccagguaaggaaugacacaccugcagccugggagauuucagaaaacagaucauaaauauaaaacagaagacagcaacacaugguacaacacaugcaaagggcaaaaugagcaguguaggccaacgggaugaagaacagaaagaauuagggggcaggugaaaugggagaguuuuucaagcagucagugcgcuugagguuugcauucuggauugugccuccuuauaagucaguccaaccuguuuuugauucuccauccaguggaaauaggaaacaccaucaaagaugaugcauagucuuaacuugccugugacuucugauuauguuuccgaauuuugggaggaagauuaaagucauaaacugacucuugguuuguuauaauuucuugcaacuguuauuuuaaaaauccggacacaggccaaggcaggaggauucucugaggccaggaguuugagaccagccugggcaacauagugagacccugucccuacaauaauaaaaguaaaauaaaaagaaaaucuggaugcagaaacugagguguagauaaauauagcaagucagagauauucguaaauucuacaucgaugaguuucuugagaaauucugcacacccagugcuggacaacuguggaauugcagcgugauaccuuucacaucugggucaucuccauaugauaucuucuuccugguacaaggccagaaguucaccccacgcacaacaccuauggaagccacuuacgauucaaaggacaguuuuucugaaaaagggugcaugauguauacuucccuucaacacuaaaauucugcugcuuaaacuuuguaagugaaggaaaggacugguucucuucuacuuuggcugucuuccuuguuuccuauuuauugggugcuugcuuugggcaacccauuguauuggaugugcucuaaaccacaaucuuugcuccuaaggaguccguaguauuuaucgggggauacgaccuggauaauucauauaagauaugaauuucuuucuuuuucuuuuuuuucuuuuuuuuugagacagauucucacucugucgcccaggcuggagugcaguggcgcgaucacggcucacugcaaccuccgucuccuggguucaagcaauucucaugccucagccccccaaguagcugggauuacaggcacccaccaccauacucagcuaauuuuuguauuuuuaguagagauggaguuucaccguguuggccaggcuggucuugaauuccugaccucaagugauccgcccaccucggccucccaaaguccugggauuacaggcgugaaccacaaugccuggccaagauaugaauucuaaaaaaaaaaaaaaaaaaaaaaaaaaaaaaaaguccuuggaaaguuuagaagaugaaauacauuuaaugaaaauugagcucauucuuccccaauauuuguuccauauuccucuccauauuauacuauuaguacacaauccuguuuggacuuacuggaaaaaagagcugaauagcuuauccacaugucaagaaacuuucuguuuaagaacacugagguucaucaacaucaaaaaauauuuucagcaucauucaggcacuggacaugcucuacaaauuaaauaccuuagggccccuacuauuucaguguuuucucagugucuuguugcaguggcaaaugcuaugaacuacauuuuucaaaugaauauugaagauugagaaagagguuaagaaccucuaucuauuaacgauagaaccaaaucuagaaagaugucuccugcucuguagagcacauuagggaucauuauuuauagccauuuggcucucuuaagacauuuuggcaaugagggaaaaaucauagguugauuuucuugguggaaugaagaacauugaguuugcuaacaaagagagcaugagugacuuugguaagagagcaguuuuuauuucaguggaaaggcagccuccucuccuaauaauagcuacauuauuuaccuaaauguuccauguagcaacugauaacaaggcuuacugcuuaagaaauuuggccaucaucuuguccucucuacuagaauuccaucugccuacagaugggcccuugcuaauauuuuuuuucugaaggacaacauguaacuuaagggcccacuacuguguguuauuuuguuuuuuuaauugaggugaaagucacauaauguaaaauuaaccauuuugaaguaaaccauucaguaauauuuaguacauucacaauguugagcagucaccacaucugucuaguucuaaaacauuuuccccagcccagaaggaaacucuguauccauuaagcaguuccuuccuaucccccuacuucuaggcuuuauaaaccuuuaauuuuaauguuauauacacacacaggcauacacauacauauaugcuauacacacauauguauguauauauguauaauguguguaaauaauguguaaauauagacguauaaagauguauaauguggguaaauaaauggauguguguauguguauauacauauauguacauguauacauauauacguauauauguauacauauauguaucuacgcacauguauauacguguauacacacacacacacacauucaugucuauuuauagauuaggaaguuccaaacagaggaccuaauauuuccuaauuauguaaacaaagaacuaucuacuuuaaugaauguuucuccaccaggaaaaagaaaaauaggaaacauuccuugcuucuuuuaaccugucuguauauuucucuuaaauucucacuagaugcuaauuuaucaaggaagacaaaaaagacagaaauaauccugagccuuuuguuguguaaaacugcugcucuucuuguaaagacauuuucucauuaauuucaucaacacugagaauuuuaaacugcuucucaauuuuaagcaauuguauggguuuuacauuucuauuuuugaaaauccaaaauuauugaacaaaguaauuuaguuagcaaaguuuacauuucuuggaaagaaauaugaaagggucauucuuacuauaauuuuuauuguuaaagaaauugcuguuguucacauguauuuaugcccuccucauuccggaagaauauuugagguagccaguagcacauuuuuuugaauuaagaaaaaauuagaucaaaugaaaaaauaccuaaaauuuaaauauuuagagaaagccaacucaauuauauuuuaaauaugccugaagucgugaacuaacuaauguugaucauuuagucuucugguccuaucucaggaauauuauugcccuucuuaauucaucuuucaccuccuuuaagaaguauuucugaauaacccuauaggauaacuuccuuuacauuucuuuagcucauaugguuuauacaaaaggcuacucacuuuaucacauuuucuaguugcuuauuguacuucauaaaucucccaacuaguuccuagugaaaauucugcccuucuaauuuuuuguauguaauuuaccaaagcaccuagcuuugugcuagcuaaaagcucugcucugaguuaaauuagugaaauauugcugguugauuucaccuaaaaguuugccccgggcaggagggaagagggugggcauuugaauggguaacagacagagaagcagcugauuggacauagauguugacaacuugcauacuuauuuuuuucauuucaaucugugccacagagucauacauuugguaauuauuucaugcuuuuguuuucaguugaaaguaguuagggccauauguuuugacagaaaaaagauaauucguacuuuuuuucagcuuuaugaaagggaagaugggguaacaauuuuacaguguaccauggcagugauuccuguucaaaacuuuaccagauuggaaacucacuguucauaacaauucucuugguaagcagaagaugaaggcaucuguuuaaagcacccagaguuaaguuugaugcuucaaagcacagcagaguucauuuauaacucuacuuagcacuauuagauaucuuuaacaaauaugaaaaguuguccaccagauuccuuagacuguaggugauuuggaaggauauucuggucaagugcuaacuucugacugaggauuucaaaugaaaagaccuagguuauaaccccauuccugcccuuacucugucuugugacucauggaaaaggaaggcacuuaacccgcuccaagcuuauguuccugaauguauaagauggguagcaugguugaccacuuagacagauaauccaucucaaaaugaugauuaaagaagauaauggaugagaaaaguccuuuugauuuaaaauacuaugaagaugugaacuuuuaauaaugacuaaugauagaauuuugucaaauuugcuuuacguaauuaaguucaagaucaaagaauauaucuagagaaguaccuauguauuuugugaaauguuucuuugaguauuauuauuaucauuuuaugucuguuagaaucuuggccucacugucuuuucauucuugcuugaaugucgacucuucaaagugugacuuucugcuugugucugaugcaacuuucuuccugaucgcucuugcuuccugagaaggaauagguacuuaggaaugauggcuuuuuggcugucugugcuuauuagguacaaacacagcacuaaagacauuugggacuggagaaauaagaagagcgccuuuaggguuguaugcaaaaggucaaacuauaauguaguuagcauuuuucuuuguacugcuuucccuucuuguaacaaccucucaauacccucauaccuucucugcuuuccagaaaugcuuucuaaaaauugauuauugggaaaagaucugagaccucauugcccugaaguguaauuacugcugacaaacugugacagcauuucccaaagacagggagugauuggagaugugaugaaaaguggguuugugacuguggaaacucuuucagggauguaggcuuuuaccccucuugguaauguaccuugacaaaagucugcagcaaugaaauuaacuuguucacuccaaucgcaucuaaaguuauuugagcuuaaguccuuucuuaaggaugucagcuuuaggcuucaggcaucaaccuguggacuagaauucaaagggaaaaggguagggaauggugcucuuaaaaucuuuaggaccauuauagguaauuccauauccuaaagaaagcucagcccuaaacacauuagagaaguggaaugcacuaaaauauauuuuggcagaaccaaugaauguuuaucuuucucuguguuaugauguuauucuuaguuugacguguaucccaugugugguguguuuauucauucaugcaugcaugcacuuaguaaaguuuugagccuauucugugcccggcauuacaugcacacacacauauguccaagcacaccugcacauuuuuuuuuuuuugguaaugccuuuuuuaccuuauuguuucugcaacuggcuauccuuagcaggccuucuuaauguacaauaggguauagaagaaauaacaaucaacauuggaguaaaccuaaaauuaauuucugucuuuauuguagagucauagaauuuguuuuccucuggaagaugugcugcccucauuuaauugauaaaacagugcuuucagaggucacaaagcuauuuuuuggcagauauaaccaaaccuauuuugauguuccagcaccuccuaaugaagcaguagucgucaucuaaaacaaaaagcagucgguugcuaaaggaggagaaaguguugagaugugagaugaucuguuagacauaauugacaaucaugaauuugauaugauagguguaaacagagauagaaauaauuuaguuacaucuguuuaagauuuaagauaaccagaagcaauaauguuuaauugaaauaauauaucagguucuccuuaacauuaccuugaauuucuucacaugcacaucaaugcauuugguaaauaaaaguuuggaaacaacuuaguuaaguguuuagaacauauuagaguugugaugugcuuagcauccgcagucuuuuaucugugccaacccugagccugguaaugaagccaacucccacaugaauaaguaacauaaggaguguaaccaggaagaagucaggguuucaccuggaccaaauuuuaggcaauuaaguguuucaagagaucuuuagccagguguaacuuaaucaguuuaaggcacucucagcuagggccaagguacucauaauguuggcagugggcauucgucugauacaccacguugaaaguaauaggaaacauagagugucugcucaguuauugccaagagcaagagaaaugcagguguaaaaauauaaagaaguauuuggagccagaggcuaguacacauagacaagacuguauuuacacuuggcuuuaauaguucagauaauaacauggugguuuuuaaucaguuuagugugcugauauuuagucgugggucugguuucaccacuaaacccuaguguaacucucagccgguuacuuagccucucucugucucuaguaauauuaaacaaguguauuaauaccugcugcaucuuagcucaacuucaugucuggaagacagaugaaugguccugcuucuugcaguaacacacaagaaccuccuuugugcugcccugacugagaugaucuuguguucuucucuacgggcaaaacagcccuaggcugcuaaauggccaggcaguauaggggacuuaggacucuacaaagcuggguuuugguaggaguccaugagcaccgcggagagaauucuuaguuaucaggagauacgguuguaguacuuaaaaacucaaacuccaaaacaagacuacgugguuuugaaucucaguuuugccaguuuauuagcugugugacuuuaagcaaguugcuuaaccucucugugccucagaucccuuagccauaaaauugggaugaucaugcaacaauaggauuaguauguaagcaaaaugaguauauguacaguuuggcugcaauagagcugauagguguaaacagauauaaauaaugacuucuuuucugaaaaugacuucuuuucuguuuuucucguuggugaucccugcuuaugucacugggauggcugcgggaauucaguaggauaauauuggaaaauagcuuaaaucucaaauguucuauagcuaugauaacaucacuaugacgucauagcagagugaguccacucacaucucuccuggcaguuuugcugccucagaguuggaauaauaacucacugaaaauacuuccaaaauagugagccacucugcagauuuaauuuguaauauuauucuuucuaauuauuaguggcucugucuuaaguuccuuuguuuuaauugaagcaggguuuuuuuucccccuuguaaauuucuauacaugucaaaggcuaccaacucauuuuuauuuagaguuugaaauuugauuugaaaaauauacugcagccagcuauaugaaaaacauaagaggauauuguugacuuuugaugaagggaagaaagaacaagguagagcugccuagccaugaagaacgccaggguuuuuguaaccccuggugugcuuugcacgcagaaggcacacacuuaaauuggcauggcucacuuuuuuuacugugccuuugcugagcuugcugcaggcugagugcacugguagaggagugcagggcuguguucuggccaucccugccugcucaggccucuccugcuccuuuguggaucgcccaggucucugcugcuuccuggugccgucuccuggauccucuugacauuuuuccguucuguaauuugauugacaguuacagacaaggaaggggacugaaauucuuaccguuuugugacuuccuaaaacgggaaaggaaauuuggugaaugagaaggggaaaacgccucuuggcugaaauuauuuacaggauuuagccccagguuuaauguacucaugaaugaauaaugacucagcugauauuuagaagccgggaaaauuaugcgauuuuugugaugggguguauagauauggauguauacuugaagugguuuguguucuaaauauauuaacaugcucagggaauuucuuuuuggggaaauacauauauucuuuuucauagauuuuuguggugcauucugguagacggaagaugggucauugcucaguuaguaaaaaugaaauaugaauaucauacacauaagugguacauuuuacacuuuuugauaguugugaaauacucuuuuuuuuucagacuaccaauaaagagaauuugaggaguaaaacucuucuuaccaugaauuguuuuggggcacuuagaacuauuuaguuaauucuuuuaaauacuccaacugauuuagauagaauaaaagugucacaauuuuaacagcuuacaccagugaaauguuuccacuuauaagaaauacccucuuauuugucagcauacugaagacauauauguguuauuucuaagcacauuuccuauuuaugugauaauggagaucgcccuuuaaccaucacuuggacgugaaggaggauucuucuuccuccauuaguaaauauuccuugacuugauaauacugaaaauaugugaggugaaugagcuuuaauccugugguuugguuugguuuuugguuguuugcagucuuggacuguucaccugcacugucuugugccuuugaguaugauuaacugccuugacgccuuacagugcauuacacaacucuacuucuuccauuucuugacuaaucucucaugcuguuugacugcccauuggaaucuuuaaguuagcuacuuaggaaagacuuuaggaaggagaaugcuaagagaacuggcagagaagucaggagccugggcucuguccaggcccuggcguaaguccuuucaccucuuccuuugacuccuuuacaaaaugaaguugaacucauucgagcuuuaaaaagaugacgccaagaggcaagacagagggcaguagaugugaaaguaacaugaaagagaaaggaacaucugaaaaaaaaaaaaagguagaaaaagauuuugacaaauaguacuaaaaacaaagaauauagaauagagagacccaauuauacugauaauuacaauuaucaguauuguaaaaacuacagcaaaaaagcuaaaaacauauucagcuuuuauuguccauaaaaagugaucacaccaugucuaacuguaauucguuugucaaaaacacuagaggccaaggacuaaauugcggauuaagaguuucuuccuuuuauuuccugcauauccagaaaccuggggucauagauacucuuccaugguguguuguuuggcacaacuugcaaguauuuuggcagaugguuagaaaaaaagacuuuaagaaauaugcaauaguacucaggacucuaaauauaauaaauaaagcuaagauaccaguauccugccauucauuacaaucaacauuuauugaacagcaguuauaugccagguagcagggauaccuagaacuugccccucccacuagcacuccagaagaguuccugcuuucccagccuaaagcaacagcaagucuuacaugagcuaggcuuacugugauagcuguccugacggcgaguggcaaacauggcccagugccuuccucauggaugaacaugacucuacacugggacuccccgguagaccuuuuugugaugaugagaaaguccuguguuggugauguucaguaugguaacuagugacuguaugugcuguugagaacuugaaauauggcuacugugacugagggacagaacauuuaauuuuauuuaacuuugguugaguuuaauucaaauaacuacauauuacuaauggcuacugauuggacagcagcuuucuagacccauuguuaaaaauaauuauaagcaaugaguaccucuuaugagauagaauuaauaaucccauuuauugagggcccaugacagauuaagaauuauguuugacauauauuaucccuaauccucacaagaaugguucauuugacaaauaagauaacugaaguucugagagauaaauugcuuuguuauguccucgcaaggaauugugagagcuggaauuugaaccuaauuggucagacuccagagcugggugauuucuaguaaucugccaaaucuguguauguacuguccggaugcugugucuucugaguacaucuucuccuugcuuuauggauuaguuagcaaugucuuuaucuuggucacauaggacaguuacaggguccaucuuaucucuucugaauauggacguaucacugcacuggaaccauucauuuuucuuacugaggccuauguccuucaaaaaauauuaagaguugaggguccaacccagcuucuugaguaguaagcuaaucaccuacaaguauauuuccccaguagaugcugagagaagcaucaaaguacauggguaguucuguggacaucaguggcacucaguaaacucuuggcauuugaguguuuaacugucacaguugaggauaucugugaacucucccaaggccugagucacugaaugagcccagccaguacuugggcgucuguggcuccauucugcuuugcuguuuucugcuuuccauggaacauacaguaacucucuugaagggucugaaagccucaauuacaacguuucagugauucugaacugauuuuucuuuggaaaguauauaugcagaugguacuugcagaaucaccaggggguaguaacguggaggagugguaaaggucuacuggacaaucagguggcuaccacccaaccacacauggugaugugauaugaagccacuuuucuuuauuccuucagauuuaagguuuccccuucaggaagcagguuacuuaacaaguacuugauuucaccauaacaugcauuaugacauuaucuuuuuuucuuuuuucuuuuuuuuuuuugagacggaaucuugcccugucgcccaggcuggagugcaauggcacgaucucggcucacugcaaccuccuucucccagguucaagcaauucuccugccucagccuccugaguagcugggauuacaggugcaugccgccacaccuggcuaauuuuuuguaucuuugguggagaugggguuucaccauguuggccaggcuggucucgaacuccugacuucguuauccacccaccucaaccucccaaagugcugggauuacacgcaugagccaccguuccuggccgauauuuuauuuucuuaaaaggucauuaucagaugccacaagaguauuucuauaaacuaugacccaaguauagccuaauguuaauagcuuaaaauagguuuuauuuaccuuuuuugcccuuuaaaagcaaggaauuauuuuuuaauggaaagaacauagacuuugaugaucaguucacauccuugcuuuaccccuugaaaaaugugcaaccuggaaagacagcuuaacauuccugagucacauuuguccaaauaauacaaacaauggcaacaagacuucagcacuaaugucugauguuuuuuguaugauuaaucugugccagguuccauucuaguuucuuuacacacauuauaccaucuaauucucacaacaacuuugcauagcaggcauugucauuuccacuuuacaagcaggaaucugaggaccagaguuaaaaguaacugguccaagauugccuaguuaauaaaugguggaauuugcagucagacccaagcugguuugggccaauacacuugaccuucuuaugauacgucagccuugugaaauagggcagauacuauuaauaauauccaccuugugugaucauuaugaagguuagauauaauguauguggaacucuugccaccaaagugguuccacaagaggcccuaaacaaaugaguaaucauuauuauuuuaaaauguccguaagugaaaccgauaugccaagaccaguaaaaaugagagcuucuuaaggaaaagaguaggaggcauaccuuuguuucauuuuguuuguugguuucugugcuugcuuuuuguucuuuucuguuaggcacagguuuuauuuagaauaaauuaaauuuuuuuuucuuugaugagugcagaaauaauaguuggaaacauugaauggaacagcuaauguaccauaguaauacuucuuggauuaccaaaaaaaaaaaaaauuaaaucuguaaaaugaaaacauuuuuguuuacuuuggucaguucaagguucaguguuaucuagagauuuuuguuaaacucaggauuucuauauguaugauugucugcuaaauucagaauuagaagagaagagauaauggcgcuaacuuugcauguuaaauauacuguguuacuaguuuuccaugaaguuuuuacucaacaaauagguuacuaaaagagcugugaccuaugaguuucaccaagucuuuccauuuccaauucggcaacaaaaguuucacacuucucaauuacucuugugggaggaaucagaaugccaacagucaccuugaucuaagcguauuauuggagaaaaauucaaggauagauauuuguuucucauuagauuuuccucauauuuuaucauuggggucacucuaguacaugguacuagaauuugggauuuuuauuucauuuuagauuggacugauuuucugguguuagucauuaaaaauaauuccaacucuuugaagagaucugggauguuuguuauuauucuauugauuaaauaaagcuauuuuauuuaacaauuguguuguuaaacuuucuauauacuuagaauaauaauacuaaaaacugaauggguaugagcuuuucuuauugaauuuaaugucaguauuaaauaccuuauugaaacccauacuuugaaagcuugauugagaaauuggcaaaagaguugacugaaguaaaaguaaugaagcaguucacuggucauccagguuaugaaaaauuaaaccauuagagauaaacugaacugugaaaauuaugaucaugguguuuucauaaauaccaucuaugucuccgccaccauucuaaaaaaaaguacccuaucaaauggugaaaaauaagagugauguuucugugaccauuucauuauucaguuuucuuauauuugaaaugugggagguugaacuaaaauuuguugguucccuucuuuaaaaaaguauaguuauaugugauauuuauuuauuuauauaaacaaaaauauagagaucuuaccuugaaaauaacuuuugagguaagaaugauaaaguaucuaaauggaagaugaauaacauuguaucugauuuguaaauuaugauauaaagaaaauguauaaaauauguagaaauugucuguauaaaaaacuauaaacagugguccguugccuauuaacaaagaguuucauguuaucuaaaaagucuucaauuggcuaaaacagcagaaaaauagaaauuacauacuauaauauauccuaaaaacauuucaauuccauagauacucuucuccaugcagccaauauuuaugaauuuggaguaagugaccuacucuuagauauuugagcuugauuauaauucauagucaaaguagccuccuuguaaauaaccaaaauuaaccaaagauuuuuccuuaucuuccaaaagcaaugccaaguaauucuauccaaauuggaaaaaaaaaaagaaaaaggauaaaccuuauuaggugucaucaaaugguguugacauaaugauauauauguuuaaggauaauguaauagaauauguaauuaaaauuaaaguauauaugaaaagaauugauuuuaauuguuuuaaaacauaagaugauuuaauaauaugggucggagauucuuuuuaguuuuauaauaaauauauugauuucugaaauuuggguauauuccauaguacacuuagcuuauguuaauacugaggccagauugcugucaggcuaauagcguguagauauauuauagucacacuacaaucauuccgucaguuuucaguuucccuuuuuccugugauguuucuuucaucuuguuagauuauucucaagaccuucucuaaauaccuucaguaguaauucacaaacucuuuguuaguuaauaguucucaagaaaauucugagaugugguugacagaacuuagaucauugguuuguuuuuggauuccuagccaaaguuuuauucuuuguuucuuaaaaauacucaaaaaaguuuuuuuuccuuauuguaagcccucuggaaauagaagcaaaucacuguuuauacauuuaaaaugugaugaaaauuacaaaauaaaguccagugaaauauagggcuuguauccauuagugccuuaagaaaaaucccuguuuucugaagugcgagugggcuuuucugguuuguuuuuguuuuguuaaagcuccaggaccucccaauuuucaagggcacuuuggggcauguguagcauuuauuugauguauggauguagaugcauauuuucccacaucugucucuguggaccuauccuuugugaaauccuaaaccuuguauuaaugcuuaguuuaugauucaugguguucugagagcaauuauauaauuuuucugggguguuuauucgaugugcacuguaaaaaaaaaugagaguuauuuuuugguaacccugcacuugccuuuuuauuggugaauuucuuuuccuuuuacugugaccugugaauaucacuguaggcucacugccaauuuugugagccgcugccugcuucaaaauggaggcaggaagguauccauuuucaucaagaggaugacaguguuucagucuuucugaccaucuggagagaggaacuuugagagcaaaagaaaauggggauuaaaaaaaauuauauuuagcagaaaaggcaagggggaaaaccaauuaaaguuaaacuauaccuuaugaauuugugcuuuucuacuaugcuguccuguuuaaaaaaaacauaaacaagaaaauacacaggcuauuuguauaaagaauugguuucccaagucucaugaguauuaguaaaugaauguaaguaaauuagguuuuuggcacacuuuuuaaguuuauuguacacacaaauauaauaagcaugaaaaaggagggcucccuccucccgcuuccuaugcacacacugauuguugguggucuuauguagauccaggcuuuuaauggccuuuuucaugcaucucugcaaaaagcugacacuaugggaauuuaauauucuaagauauauuuaucacuuucugugguuuggauaguucauuuguguucucucugucuccccccucccuaccuccucucuguaaaagugaaaauuuuaauugaaagguagaguuuuuacucuaccauuugaaagagguuugaugcaugucuuucuguuuuuaccauuuucacaugcuuaugggccaucuguguuuagaagaaaaagaaagaagugcuuagacucacaggauuacccuaugggcauuauacaguguauuuacaacuagacaugguuuacaucaacuggaauauaacacaccugguuauuuucuguucgcacaaauacaccgagcuuuuguuucguuuuguuguguuuguuuuaguguguucggaaagggcacuguuucuaggguuuguucagauuuaaacuggaaaggguagaaauguagcacuuucugccuacuucuuauauaagaauggagcuugggcugcuguggucaaugcaaaaagcaaaacucaguugguucuuucuccucaggucuaugcuccaucagcaagcacugccgacuacaauagggacucgccaggcuauccuuccuccaaaccagcaaccagcacuuucccuagcuccuucuucaugcaagguaagaugcugcugcuucugagggaaaggccacuggauagcauuuuccugggucacuuaaugucacagauggggcagaagaaauggaauaguaggcaaguguagaauuuuugaagucaugcucuucuuaggaauugaauuccuuaaaaauugauguauuaauuaaaacuguacuaagucuuucuuuacaauuaaaccccuuuaagcaguaauggguuaagauuagauugaucugcuucacuuagagccgaugcuuaugauggucuuccacucaugaccaaccauuucagcaucuucaccauccccaagacgauguagcuguuuguuuagaagugguucagcuccauguauguuuugaacauccuggauuuagccaacugggaacaaguuggccuaauguauaaccuuauguaaaauuuucacccacuuacuaauuuguagguaagaacaaggguccaagaugaaguaaccuaccacagacuggaauauuacauggugaaagcucugucccaacauaguaacugguuuaggauaaaaggcccaacuuuugggggagaagacaaauauaggaaauuauggaauuguccaguauguuuaaauacauggaugugugcccccacccugagcuuguagucuugcuacugauagcguauaccuuucugcugcucaaaaaagaccaagauguggccgagugcgguggcucacgccuguaaucccaacacuugggaggccaaggcaggcaaaucacaaggucaggauaucaagaccauccuggccaauauggugaaacccugucuguacuaaaaauacaaaaaauuagccaggcgugguggugggcaccuguagucccagcuacucgggaggcugaggcagaagaauggcaugaaccugggaggcagagcuuacagugagcugagauugcaccacugcacuccagccugggcaacagagcgagacuccaucucaaaauaaauaaauaaauaaauaaacaaacaaauaaauaaaugaauuuuuuaaaaagaccaagauguuugaaaugauagcagcuacuucaagaaugaaccacuuggaggaugccccuaagggcuccauccugauauguguguggcacuuauuuucuaauguaauuaucuuguuaccaaguuaaugcccugaauuuagauguggaauuuaccaagaaccccugugugcaaaauguuaacucuuuuugcccaggugugaaaaccuuauuuguauaagccuugucuacgggccaugggguuuccuucuuuaugcaucucuaggaagggccaugucacaggaaggggagcacauuuggggcaaagaguaccagggaagcagccugauauaguggacacacucaaaaucauucucauuaaaagauacuaaucuuccuucccuucaguguguuagcucuuuuaguuuguuaguucacgugugaaauuccauggaaaucuauaaaauuggauggaauggcucuguuaggaauagagagaauuuguuccacgcauaauagagcccgugugucagaaguccuuuaacuuugugacccguccuagguguaacucaaagggacacagcaggcuaugucaccugggugcguuuugugccgugacaaaaagcuaaucaccuucaguuauaaacaguagcuaccucagcaucaguccccuguuuugugagcagugggagauauuguccuacaggagcuuacagagauuggcaacucaaggauccaucacucaaaacagauuucgauugaaaacauugacggaaggauauauuuuuucuaucugcccaggaaaguggcuuucuggaagggugcacauugcaggagaggccagguagauuauaucaguaggcuccuuucccuagcagaccacacaaaauauggggaacaaauuuguuuaucugcauaugcauacccgaaaagcaaaaaaaaaaaaaaaaaauugaguugacauuuuugaugagcacaauuaauuugcacacaucuaauucuauucuuucuuucaaaagaacauuaugccaagaucaugggaugugauaaauauuaauuuacugugaaaagcauaauuuauguaaaauauguauuuuuauaagucugcaucaagcagaguacucuguguuaacaguccuaaacgcauugccacccaggguaucacauugucaggagacucuuguuuagugauauauguuuucaauuuauuugucauaugugccaucuauuuaaaauguuagugaucuugaacuucauauuugaauuuaaggugacauuuaaaccucuguaaucuaaggacuaaagcucaaguacaugaaugauaacuuuaaaaaaaaucauguguuuucacaugauggccacagaaacaguugcaucaugguccugucccacaucagcuuccuuucaguagagggguacuuggugcccugagaauucaagacuugaaggaauaugcaauuaaggugaaagauguucagaaacugucuggggcauauuguaaacucacuacuguggccucuuauuuguaacuucaauuuccaucuucuaguuaaaacucugaaguugucaaaaucacagacaugauuuugcuugcaugguucuuaaagagaggaaucugcaaacuauuccucccaauaugaaaugaguccaguuacaaaauucuaacuuccggauuuaagaacucaaugaaaaagagcuucacgaaauacagugucagauuuaacuuuucuauugccuaacuuuuuaauaggccuuuacuauauaaaauguuauggugaaaauaaucuuauuuucaaggaagcaauaucugcuauacauuuaacagccagcugauggccuaguguauaccuaguacucaauacuuuuuguuaaacuauugaaacaaagaaaaaaugaaugaauuuagcaguaauguagaucaucuuuucccuuaggcuugggaaaccaaaccuaaacauuagcaaucauuaauaauaaccuguaggccaauaggcccagagaaugaaaaaauccguagggauguuuuuaauaagaauguuaacaaaagguuaaccuuauguugaaagauacuuuauauaauuuuaaaccucuauaauucauaaaucguuuuauaaaauccagagacucucaaaaauaucuguaauauaauagcuaccuagggcauguuuguacccuuuggauugcuacugaagguuuaagauagcuauauaccuauacaccaaaaaauaaaaauaaaauauccuaagaacuauauauuugagauucaucuucucugcaugccguaauauaauuauaauuccaacuuuaauucuauuuauuguauauguuaaaaaugaaauuaaacauuuucaaucugagauuuuuuaaaauuaauacuucuuuacaugcuuuuaaaacuugucaacuuuguaauuucucaaguacuuuucaccccaaaguuuaggaacaauuuaacuuuuuaguugguuuucauagaaaaaacaguuagaagacuucuaagaaauguuuccuuuagcaguaauuaccuugcgacuugacauaauucaugguagaaauauacucuguuguucuuuuacaguucaauuuuuaccaagaacacuuuaacuuuuuuaaguguuuauauuuguuugacaauauagagccacuugggaagaaaugaugacugucuucugauguaaucagcuaaccaacacaaagaugaauaacacaacaggcagucauuuucaaguauaugaaaaaacccuauucuauaaggcaaggcugaaugccucagaaagucaugguugucuuuguccuuuacagauggccaucacagcagugacccuuggagcuccuccagugggaugaaucagccuggcuaugcaggaauguugggcaacucuucucauauuccacaguccagcagcuacuguagccugcauccacaugaacguuugguaaggcagacauacacgguaacgggaaugucacagcuaguugauuaaaccucguccucugucuuuccaugcauauacacaaggacucugcaaauaagugcaaaaauggcacacacccauuauucuuaaguuguauuguuucugugaucaaagacauaacagguucaaaucaccuuuguaaauucuuccagauucucucuggcauuguucuuuuguuuauuguguuuugcucugugccuucuuuaucacaaugucagcuuccuuggguacauaaauagauaccuauuuaaguuguagaaucuuaacauggugguuccugguuuuuuuuuuuuuuuuuuuuuuucuaucuguaguuucaaaagauguacugcagagggcagagugacagucgguagauuauaugcaucacccaggagcauuucauuucccauugacuggccuaugucagcuuuggccuguugugauguauccaaaagaaggaguuuguauuuucuguagacuuccaucaguaagagaaaccaugagguuucuacauagaucagauucccauuuuucaguauuuuaacuuuaauucccaucccagccugccacucauacuguguuuugcgucacuccaggugaaaacuggugggcucuagaauguuaggucuuucauuacuaaacauuuccacucuguccaucaccuacauucaucuaucauaguaugucucuuuauccuggaggaaacaacucagcugacuuucuucuagccuuaaauaucaccacagcccagaauccacuguugaacuuaagucugucauuaaagagaggaaagagccuagaucuugagugagauuugggaugcagauaagaugaaacuugaaucccuugugcaagaacauagcuuaaacaauauguggaccucacauccuacaaaugcgaaagcauaugggaaauccagugaucccaggugauacuuacaucacuacuauucaucuugcauuugccccuuuuucuucuucucauaucuacacuuagguuucuuucucuguucugauaaaggaaaucauucuggauucauguggucuuugcucucuuuugcucaaccaguacagauaagaaacaggaucugaucuccuacuccaauaaucaaaaaaauuccagaaguuaagauuucugauauccuugaaaauccguauuuaguugguccuagugguagagaugcuaaguagucaauuagccuauacauuccugagaggcagacaguggaaaugguauuggccuuuuuguaucaccucccaagauugaauguguaaaucacaaacuaucucacauuucagcacauuuccaguaaauagcagaugacuuauuuucaaauuuucucuuuucccaccuccuauuuggagauauuagagugaaagcuuagagaaauaucaacuauaucaacuauuauuaugcuagaauccguuuuggcuaaaauuuucauuucugcaccaucauuuuccacuucugugggaacucauggucaaaacuguauguguccuaugagcaaggaaaguuuugauuacaaauaaaaguuuuaggcacuauaccgcauguuggaauuucaguucuuuuaagaguugcccauuugacauuaauuuuucuucccuucuguguuucuuucuuucuucuccuaucaugcucaagaguuuugaguuaggcgauuugauuuuauccuaguccaguucacugcaugggaaguagcuuuaaaaugugcuuccaugcacaaaaaguauaauuucaaaauggaaaccaacuauauuccuuuuagaaaaaauuuuacagaaccaaaacaauauuaugaacuagagagaaaauaucauuuugaaguaguaacccaguaggcuauaucagaagccauauuugcaaugccauuuaccuaucacgaaacacaggauuuucauuuuucaucugaacaguuaacagauuucagagaguagaguuuuuguuuuaaaggagacaugaauaagcuaucuugcaauguauacuaaugaauuuucccacuguuagugaaacuauugaauuauuauaucuaguugucauuguacuuucaguauuuaaccaugugaaaaucuuuuacugaagugacuuagaagaaucugacacugacaauacuuugaauauauaguagcaguugguguccuuucaguugaaaauaaugguaguuccuuauaauuuuauucuuagcaucuggcuagccccauacugaacaaagggauaguuuaagaaaaagcuaagcgcuguuccuggauuauuugggguauaauuuggccaaguugauauuaucuguaaagauaaaauauuuuaaaaacaucauugccuucaucacuuuaugccauguuauaacagaauguguaauuauaaagcuuaagauccacauauuucaguagcgacugucaaguuacugauguuuagucuuuaaauccccuuuacaguuuuagccuguccaacagaaucccacagcuaaucauuacuguguuacacauacccacacaaaaucacucagaugaauggaguuugcgguuaaaguuuggaauggguuguuguagaugauuuuauguuuggaaugacuuggcagaguucuuuuuaagaacaggauagaguccucacugucuggcaugauuuaggcauggucuuugcacuacagggcgaaacaguccuaggagucuggaauuuuccuuuaaaggaaguucuguuuucuuuuauuuuuuuguaacauaaacccuuacuucaguaauucucaacugauggcaguuuuucccuucagggaacguuuggugaugucuggggacauuuucauuguuacaacuaggggcuagaugcuacuggaauccagugcguagaggcuaggggugcugguaaacaugacgucauguaugggagagccuccacagcaaagaauugucuggcacaaaagaucaguagugcuaagguugugaaauccugcccaaacccaaagcaugauuuuauucuuauuuaugugcaccaguuauuauauuuuucuaauguuugaauuaucaaccaguauaucaguaauggaaacauuuccaacaauuacucuguuaauagacacgaaauacaggacucuugggcaucauaaguuaaaaugaacgaauagugggcauguaaagccucgcacuuugucacacuccucauguccuuuguagcaagcaggaaagacaguaauagcuggaguaagagacuaagaggaccucuuauaguuuaucccuaaauccucuaaaagagacauuauucucugugguguauuuauuacaucucugaaugacaguaguuuucaagauaguuuuuaauguaaaauaaucuaguuauaaaucucguuaguuuauuucaacaacuaauuuucuaugagucucuaaaaauaacugauuuacauggauuccauugguucacuccuuuauaaucuauggggauuaauuuuucuuuuuauucugugaacucagcguuaacccuuugucaaaucccaaauuacugcccauuuuacauaaaguuaaaagggcccaaagauucucaccgaugugauuaucuguuuuguuucaucuucugauuauuauaguuaguuaaauauuuauaauucuucuccucuuuuuuugauuuuugcacauuucaggcagauuuguaguucgucuguucuucagaaauuccacauggaauaggacuguguagaagugagguuaaaguuagucaucucuuuuuuuguucuuuuuuccacauucuguuucuuuuccuccauuuuguuauagugcuuaccucuauagcagaaauaccucuaucccugcuaagcuuucagaauagcuguacuauggaaugggcccacuauauuuuucauuggagaaaauuccauggacuaccuuggguguucauuagguggcaaguagaaaugaguuuaacagguggccuaaggaauuuuggggucaaggaaagaaagagguccauggaauuuaaaaauuugaaaggcauucucaggaacuuggaaagauuuaaaggcaucaucucaacuuuuuuacggaagucuuuuaaguugggcuauuuuggucauacagagguaauauuuucaaaaacauucaugcgucuuugaaaauccuaccucuaauacguagauucauuuccuuagacuaguuggcucucaaauaaguuauacuucaauccacuguuuauuaaauucugacugauaaccaauuguucauugagcguauaguauaauuauguguucaguaguuagccacaaguugugggaugcagaacuauaagcucuauuccuuuaaagaguuuacaauacaggugaaaauacauuagaaaaagcaagaaaugaaaggccaaauauaauuaaguguuaaagacaauagugcagaauguaagugcauuagggaccuagagagaagagaugguggaagaguuggagguagucagggacucuucaagaaagagguagaauucaagacggaucucacagaguaaacagggcaacacucaagagacuaugguuucauuccucgugagcaaaugcuuggguuuuaaauacccgugacuaucagcaucauauucaaucucuuauuuugaaauaaacaauuuuuaacagcauuuccaauaaugauauaauaaagacucauaauccauuaauauauugcauaugaagaaaaaguguauuuuagcuuuaauauauugccuuuacauaacacauucagaugccuaugagaauaacuuuugaagcugcuuuuuaucuugaaaauagcucagcacuuuuuuguaaauuacuauguccauuuuagugagcuguucauucccaagcagauggguggauugcaacuaauuugccaccuuacaggcacuguggcauacccaagaaacacagcuuauuuggaaaacuaauauaauaauuaaacucaaagcagagucuuaaaccaagugauucuguaaagauguuguucuuucauugccagcuaugugaggauugcuuguagguggggcauggaaagaaaguacucaaaccaaaauaagucaugugguccuaauuuaauucaguauagucaauaguuacauauugaugaguaagagagauauuuaaccauuagugcuuuuuaaauuuuuuauuuacuaaauuuuauuguugcugggguucaaaaaaauuuaauuugggaggaagaagauuugagacugguuagucuuugccauuuaguuucaagaagaucaggaugaaauguaauauaagcccuguggaucauaauguuguuuuauucauuauauaguggaaucuuuuucacuugaucaauaggccacacaaaaaaauuaauaguagaguggucuuuuauguugccgaaacccuggagaugauuuuaagcaguaaucuguagauuucgagauugugaucauuucucaaugucccucauugccauuauaucccuccacaguugaugcaaacccaagcuauguuucuguauaacuuauuauuugaaaaaugaaagcugucagaucuaaacaagauauauucuuggcuauuuugaaauucuaaaagcugucuccauuguaaaauagagaguugugagaaaaguauuugaaaauaacucacuaaauaccuuaugauuaaauauggccaccuuuuucugcuucuugcuauagagcuauccaucacacuccucagcagacaucaauuccagucuuccuccgauguccacuuuccaucguagugguacaaaccauuacagcaccucuuccuguacgccuccugccaacgggacagacaguauaaugggugagucacagaaaugccaauucugauaccaacaauuggugucagaguuuaaucaucaaggaccucuuuuucccuuucauaacugaauagcaauuaggcacuaaauauuagucacaugacagaaugaacacacaaauguaccaaacagaaguaaaaucacuggcuugagcauaaccauauuuuucgucacaagacacugaaauuuagcuacguucuacguugcaagucauuagauugaacaaggguucaaacagaccaaaacuaucuuguuccucacauucaaaaagagugaacaaagucauaagaugagccaucagugacuagugagcuacaaagcagaauagcucuuaaugguaguuauugaccacuucccaaaauuccagucauugugcuaggcucuuauccaugaugugccacugucuuccgaggacugguuaaugugaaauucucaggugacugcuaauaacuacaugagguuaaucuccuggagaaugugacacuguggagucccucagaggggaagaaguauuuguucacuuaugagagaggagaugcgugggcaucaguuggccagaaauuauuugcugcuuuuuuaaauuaauuaauuaauuaauuuuuaccaaggacauuuacuaaugaguuaagguccaagaagaaugcuguucccaugaacugagccaucauccucucauuucuugugauguucacuguagucuuuuccauaggugguuccccagucaguauucccacuuugaggaaugaacugggcuggauguccagcugccccuggagggaagagguggaguugguggggagauagcuaccugcuucugaaccagcuuugacaccuuguuguucagaugagcagcacagcuuagugccccagggucuuauuaaaaccucagacuucucagguagucacuuucugcgguuauagcucaaacuaacuccuugcuuggccugaaugucacugucagagcgucgguggggagaauacucaguguaugucuuugagagaagauggcgcaacagaauaaugcugcuguugaguccucuuagcucuuugcacuuguuuucuuuagagaguguguagaauuuggggaaguggcgugaaucacuuauguaggaaaguuuuugauguuggaggagagauguguuuugaaauguuggaaauauaauuucugccucaauaaugcccucccugcguauucaauaauauaucucacacuugagaugagcuaucucgcagccucuccacuccgcuauccugucuaagaagcaaauugaggagagaguuuccauuuuuuuuaacuuuuccuaaccaagcuucuacaaauauguugcaucaguuugaccuuggagagcuacagacagaggucacauggggaaguuuguuagcuaucaaugcaguuuuggcagauuugaaaaacaagaagaaagaaagcagugcagaacugaaagagugagaaaagcauauuucacuucagugugguuugacaaauggaaagccccuuucugcagucaugaggucugguuauaaagaaggaugaccggucauucauccuuuuacaagacagauuuccugucuacuugugguuugaguaauuuucuuuuuuaggaagguaugaagguggagcagaaccuugaguugaggaaaacauacuuaggcucuguuugaaaaaaaacuuuuucugauugauuugcaaaacaguccucuugagagagaggcacuaugacuuggaagggacauaucaggaaauagggugguuaucuccaugagcuguagacagcuuagccacagcucucagugggaaugaguuuugcuugguuuuagcuggucaucuucauuaguuuguggaugaacaggagaaucuacuuguuggucuagccagaguggagcaauaggugacuucuauaugcugagaauagacuuaacuuguuaaaaaccauagggccuuauuuaagggucuugacaauaauaaaggagcuauaauuuaaaaacaaaaguaugagauuuuuagaacccagaaaagggcuuuuuagaaauuuauuucauacauuauuuuacaauaauggaugcacuugucaaaauccacuagcggaaugagaaaaagaugcauaaucuuuaaggaaauagguagacaugguaauucagcauuuuggaggagcaaaccuuuauuauuaugcauagauacagauauuacuuuaagguuacuuuaagggagaacauucuagaauguuuuucuuuaaaauaauauguucaccaauugcguacgugaaaaugcagaggaaaauuuaagcauaauaagccuuaguauugcgugaugucugaguggcccauguuuuuucacacuuaaguucucuuaggcuuugguuugauuuuuugagugugguagaagucagugauggcagcgugucuguauaacaagaagagaagcuuucucuucugauguuagugauacuacccuaacaaacaguauggauuaauaggauacaucugcagacuuuugaaaauauuuggcauauacucacucauucugaaacgcaggaaguaaagaaauauuacguugccuguaucucaaagaacaaacagagcuaauuaaauaauuggcaaauagggaacacauagccugacacauguuugagauuacacacgauucuguagaaaaugacuguaagcaauacuaaugccuuaagaaugggguucgagcacuaacacauggacaucacauuuuucacguuuuccugguaaaaaguugcaagacagugcagucuuuucauacaugguguugaugucuuaggaagcugcuuuuucaguucagaagagggcugcugcccuucgucucagugucauguuauaauaugucuuucugguggucagcaguuguccugaacugacacuagaacaacgcagugcauguggggugagauacaagcucuagaacucucggaagggaaccucucuguaaccacauucccuuucuucuucuguucucugcaucucaaagguggaagaugcccacugagguuugcuguuuguuuggcuugggggagugaccagguguuucuuguuuuguuuucuuuugcccuauaauacccaauaucauuuuuugagaaauccauaagaaggauaaagcuuacuuggauuacauuaaugagagauuuuuuuuuuuucaugacacauucauccauggauuuucaagagaauuguagaacaagguauuuuacucauugcauacaguccacuacuuuucucaagccuugcuggcaaacucuggagaucauauuagaccuuucugaauugaaaaggucaucuaauuagcccuccaauuagaggaauauaauguaugggacacagcauggauucacaguaguucagcugguggcgcacccaguuaaggaaagaagcugucaggggucuuugggaguuaccagcaucagcaccuucuacucaguucuucaaacuuuuucaauguuaugccacuggguauucucagaagcagugcaguucagugccucugcaucugagcauacauacggaggaggaaguguaguaaguuauuagauaccagcuauagagaauaggaaugucugcaggauauuaaccauacacauuugguuagccacauacuuccuuccuauuugcaauaauauccaguagcccuuccugauggaaagaaguaagaggaccuccuaccauagcacagaccacugagacugcucaagggugagaaugcgucgucuccccauugggacauaccaucuguauacauucacagggugugacccuuugugguuugaggcuacacacacucccuugcccucagagagaacuggucauauaacuaacauaaugguuauaauaacuauuauuguuuuauuagucuuuaacuggccugcauucuaauacguggucuuuuccacguuuuuaaaccucaaaccaaacaggguugaaggaacagacuaccaagauugauuuaauacaccauaugcuaaagauuacccuggaauaucuaucugguucaugaauuaaucuggcuuagaacuuuaacuucgaaugacauguuaguauguggcuugucuaguagaaacauuauguccuuuucucuuugaggacuugguuucacaguaauuuuauuauuagaguagucacauaauguucacuuuauauuuuacaagaauauugagccuugaaguagucaggcgaugaacaagcacagagcauaagaguaauaagaauuguauccagcaaugugaaggcaucuuaguuaccaagaccaccagcagagaacaauaaacuaguuugauuuaaaucuccuccauuuccugugcacgaucaggaagcccaacuucccccugaauuccuaggaaucccuccuguuaaaaaauagugcauuguagucuauauacuugcguuuguauuuuaaaaugguuguaguaggagugcuggaaauguuccuucuuuuugucaucuuuauagauaagcacauggcauuguuaugcuguuucuaaugguuuaauaacacgagggucacucggacacaguuuagaaaaaccuacuuugaaagcagucaucuucucucaggcaaacacagugugaauugugcugcuuauucuuuugaugccuucaugauguucccagccuuagaugaugggugugcauuaaaggggcaacacauuuuccaaauucugauuuuuaguaguugaucccaaggcaccacucaucccaguguuuuguugaggguguguucuaaugggaaugaacauuuccccaaagcugaggcugagacagaggguggucuagcauguaacccaagauacaaaaccuuucuuucugcuucaucuucuagccagcaacaccaccuguguucaagccaucugaacaauacuuggguggcaggcagugucgaagccuccuacaaaaauuacaguuccucuuaauaacugcucaucuuccauucauauuuguauguuacagcucuacuuagggacugauuauauuucucuugggcaagauaaauugauuagagccaaaauuagaaaucgauaaagucuuuaccaagcaaaugcauuaguuuucaucuuucuguuacauggacauuuugaucaucucuaauaugaauugacaaaaaucuugggccucaaagaguaaucaaguccuguuacaucaaacccacauuuucagcuuuaauguaucuugcuaaacauggcccacuucucaaugcaaaaaaaaaaaaaaaauucugccacuugagaauuaaaauauauuucuuuuccaguuauacccuuuguuauaucugucacacaaauaaaaagagaaaucuguaagagaaagacucauguagcuuaacauguucaggcaaucuagaaaauguagcuucuccaguguuuccuggaccagaacaaaaggcauuccaagugaaagggcaaacuggccccaguaaacugcuuugaaauuuaagcccuuggguuuggcacuccagcuguugcaagguaaaaucgcuucauguuaaaaaauagucuguucuuaucagugguuuccauggguagccuuuguaguuuucugaaauauuuucaugacgcgaugagguaagaaguugauucuauuuuuaauucuauuuccugagucauaauaucucccugcauaaaacaggcacugauagaauguuuaguuagaaagguguaguucuaaagaaaucagauuggucauaauaucuugccucuucuaacgugugauuuuuggggcguauauauuuaguuuuuaaaugcuccuaaaauauuuguauugguuuucaauacuuuguuuaguuucauaaaaauauauauauuauuuguaaucuucauuuuaaaguuguuuaaaggaagaauuaaucuuuugaaagccacuacuguagcagauauuaucuguagugaagcaauaucuuguucuuuuuuggcuuagguucuuuguuagauaaugugauuuuuccaauguagcucugaacuuuuugugaaaaucuauauucaaaucaagcagauaucacagauuauuuugacugauagaucuaauuuuuagguauauaauaaugaaaagaaauaucgcuucuaggaaaaaaaaaaagauaaguacccccaaauaccaugguaauacauacugaaaaaagguuaguaucaucuauauuucacaucauuauuauuuucucuuuagaaugguuuuuagguuuguuuguuguucuuguuguuugaggcagaguuuugauccuguugcccaggcuagagugcaauggcgcaaucucaaucucggcucacugcaaccuccgccucccagguucaagcgauucuccugccuuagccaggcauaguggugcaugccugcaauccauguuuuuaguuuuuaaaggacuccuuaaugcagaaauucuucucauuuucacacuagauauaauuuguuguauuuuaucuuauauuaaauauuuuuaauacucuugauaucugagcugcucccagugguccaauuguaugaugucagacccucauuucaaagaacuugcuuauacaauaccuaucaugaguacuaaugacucauguauuuuaauaucauaacuuugugauauggaaguuuauuuugucacgagauaauuguguucuucuuaucaugugccagauuucuuucaguauuuuagcaauuaacaaauaaauauggguguggguuuuguaaaccaaauaaaguauauaucaaaacauuaucggcugggcaccgugacucaguccuguaaucccagcacuuugggaggccaaggugggugguucaugaagucaggaguucgagaccagccugaccaacauggugaaacccugucucuacuaaaaauacgaaaauuacuuggcgugguggcgugugccuguaauccuagcuacucaggaggcugaggcaggagaauugcuugaacccggaaggcagagguugcagugagccgagauugugccacugcacuccagccugggcaacagaacaagacuccaucucaaaacaaaaaagaaaacucaucugacaaacucaacauauaaauauaugaaaauaacaagcauaaauuagcuaugcuaagcagaggucaggagaauuaaauuaugaccuggaaaagccauagaauuggaccacugaagauccgaccccacuacugcauuuuacaaguguggaaggugaugacaacacauuuguaagaaagaaggcucucuuaguucaagaauggggcuggaaagucuuugaaauuauauaccuguuuaaugaaguuuugcuuggauucauugggugauuuaaccuuuccuuuucuuauuucacaaaauagugaaaaacaaucuucccucagaacuuuaauagguuuuauuuagauacuaugucuauuugcuaauguugaggcuuuaguaaauacaacauaccccaagugcuaggcauucuguuaauacugaagaccacaagaauccuggaaaucccauuuuaucacuuaguucuaaaggcaagauaccuuccaaugauacauguuaaagaaagcuggcuuugaauuguauacuguaauauaugucuuuuauuauucacaauacucuuuguucuucucuuuuguagauaaaaauaccaguguuuaaggcaguagagauaagcuucaugaauauguagacuuacuuuaucucuggaauucgaggccauauugacuuuuaguagcauaccaguucacuuuuuuuagugugaacacagacuuuuaaauauguggagaauauauguuauuuaaaacauuaaaaauauuuucucuccuuguuagccagaccuguuguggaaauuuuuguuuguuuguuugguguacuguaggacugugagacgaauaccccguuuugcuauguaucaaauuucuauuuauuugaaaacagauggaaguuauuugugaagauaauuccauuuacuauaaaauaauauaaagaaaagccagacucugaggacuccagagaccugaaaguagucuauacuugucagcaaugaccgucacauagcuugcuacauucaccagcucaucaacagcaaggggaaagucauagcaaggaaaccacuuuaucuuuaaaccaaggugucagguuuauauuuuaucuguaaaaaaguaacaugaauauauuugacaucuaccucagcaaacaaauuaaugcuaauuaaagauuaauguguuguaauuagcauuaaaaaugcaauuaaauugugaguaaauggaccaggaauagaaaauuguuagacgucucacugccugguuuucauauucugccuuuuguuuuugcagcaaauagaggaagcggggcagccggcagcucccagacuggagaugcucuggggaaagcacuugcuucggugaggaaauauugacuuuggacuccauauguaccauuguaaagggugaacuuuaaucagaaguggacauuuggaauuuuagaaaaugaauggcaaauagcuuugauuuuuggaaaaugcuagcuuucuugcauaacagucacuggaaaauuugagaaggcucugaagcuuccaguauauagucucuuucucucauccucaaaaugguacuaagcugcacucaauuauggaugugggaauauucuccuggucuuuggguuuauagguuuuuuauacugaugucuuauuuuucucuaaaguaauaugggugcacauugaccagcuaagacugucuuagcaaggaauaguucuaaaacacuuugaaagaggcauuugaaaaaaaaaaaaaaaaaaaaagacaauaacugagguccaugaagaacugucacauaauuggcaccugggggacucagcuucucugcuuugcccaccuacugccagaaagcuaaaauugaacauuucuugcauguucccugaugacaaaauggcauaccuucauugucucagagaguauaucugguauuuuagucaaaagcuaaacauggucauuuagaaauguaaguggagggccagguaguguggcucacacugguaaucucagcacuuugggaggccgaggugggaggaucacuugaggucaggaguucaagacuagccuggccaacacggugaagcccugucacuacuaaaaacaugaaaauuaacuaggcauggguggcacaugccuguaaucccagcuacuccggagacugaggcaggagaaucgcuugaaccugggagguagagguugcagugagcugagaucaugccacugcacuccaacuugggugacagagcaagacuccaucaaauaaauaaauaaauguaaguggagauuucuuucucuaagauuuugucucuucaguuggcuuuuaccauugagagcauuaaaaaaguucacacuguauuagcauugugcccuaaguaaaaguuuuuguuucaucugggccuucugaugcuaugcaaucaaacgccuagaucuggcaaaagaguggcaaaauaucuuaggaaugauccuguucaaccucucauuguguagaugaggaaaggaaaguucaaaguaucugcuuggcuugcccauagccacacagccaguaggaacgaagaguugguuugaagucugcugaccccagccuggcucuuuucccaccaucccauaccacaucaguaauucuuguuuugaaaaauuaaaauaauuguuaaguucuucauuugacaauuuugguacuguaguugauuauuacauguaugcuguaacuuguaaguucuaaaugaauugcguugacaacuucguaguuuagaaaagugugaauuauuuuaaugaaugaggguguuuuuuuuuucuccuuauuguuuuaagaucuauucuccagaucacacuaacaacagcuuuucaucaaacccuucaacuccuguuggcucuccuccaucucucucagguaguguauuucaaaucccauuucaucauauaacaguuuauaagaaugauuccccccuuguacuuccugauuuuguagguggaaacucacuuccccccaaaucccaaagcuuuaacauuccuauaacagacaaauacaaagggugggagagacaaauuaccagauaacaguauagucguuuacauccaaaccuuuucuuaaaaauuagauuaucuuuuuaaaauauacaggcauauggaaaauguauuucuuacacuuuucuuagcucugcagaagacacccaacggcagaauaauguauuccaauaaaacgucucagaugaaaaaaacucaguuaauauagucaugaauaugaauauagacuagauagucaucaaauauagacuauuuaaauggaucauuuccugcaggaauuucaggcuuuccaaauucccucuuuaaaguacaugccauugggauguuuagagaaaacuauaauuuuguaaauaaauugugaaauaauugugugggguagaagggauguuugacuucaaaguauaauacauucguaugaccuguggcuucaaauugaauaacuauaauuuguagaauuaugucaguaaauaauuucacuuuucagggguccguuuaagagacucauugucuuuccaauauaaaugcuuccagaaagccuuccuugguucaugucucugcucuuugguaaggagacagguggcuuauuaaaaaaacaaaacaacagcaacaaaaccuaaaucacaucuguaccugauggaaaccuuaccuuacuguaauuuauaguggaguuacuugcguuuguuauuuccugcaugcagcucucauggcccaguguaaacucagcuccuuggucgaggacaggagguuucacauugccacaaaacuuucagaaaugauggccauggcuuagcugggauuuaaugucaaccucuuccaagccuccgugguaugagaagaucacagaauagagagggcagugggauucugaagucucuauguccagagagaccgcguugaaacugggaagcgauugaggugauuuuaagaggauaaucaaacguucccccugguggaaauagaaacuagaguucaguauuguuguacuccucggguucuguaccagauucuuacacucugaaaaaugauuucaauugucaguaacccccuuucgagacaacaagagauacaacaagggauagaggaaucugagcagguggaacuccaguuuccacauuucaaacaaaguagcuuucauuuuauucauuuucuaauuuagaaaaagaaauguucuaugguaucauaauguuugagaacgacuaauguagucugauacccugauuuuacagaugagaauacugagucccaaaaagggaguugaguuguugaguuuauuaccagugguaauagcagagcuuggacaaaaaucuggugcucacaguucugccauccauuucuagauuaauggugggaaagaaaaauuaggaugcacagucauucuagaaaacaucacaaauucccucgaccugaguagcaugaucucagugaaaggcacagaaacaaggcuagagaugccacuuuuugggucuugguaaugcaucauggaagaccacauguuaggaagaaagaacuuuuaugaagaugcaaauauggggacagauugcuauuuucacaccgacggcucuguccaaauucugucaagaaaaguaauugaacaaaauauucuauuuuuauuuagcauaaaaauauacaugcacacccagaaaagacaggaagaguggauuuuaaaagugcuaacagugucggggcaugagauuucagugagaucauagcuauuauuuuuuccuuuuuugaauuauguauuuuccaaguuuucuacacugaauguguauuauuuuacauuuaaaguguuuuuuauuuuguagguuagacauguaauauguauucuaacagcaaucuuuuuuuaccuucaaguuuaaugaaucauaaaaaaauuauuuucuucagaagaaacuuuuagucauugcuguauauugacuuuaaauuucuggcuuaguggaucacugauaacuaaucuuauucccuuaaaaaguuuuucaagauuuaucuuuuucuaaagauuguuuuaaaaacaaguggcaaagcuguuuuccacuggugcgagaauuuugguuuaacauaaacuagccuugcaugaaggucuaacaaaaucccauuuuuguacccuuaaaaguaccuugauuccauggugauaguuuuucuuccacaggaacccuucuuaccaaaauucagaaucaauuaaauguucucuuuuaggagacagccagccugggggaauugugagucuauguaaagucuacauauuuuacauuuaaaauguuuuccuugucccaaaauucuuauaugggaaguuuacauguauuuacguuguuguuuaaaugaaaaucaucauugccauugccauuuccaaaaggacuguuuaaaauauuggcaagcgucuuuuuacaugugucuagaucugauuguaauucccacuuuaauaucagcaggcacagcuguuuggucuagaaauggaggacaggccucaucgucuccuaauuaugaaggacccuuacacucuuugguaugucucauuugcuaaucucugucccacccauuuucaggucauguucuuucuuguucagucuccuuuacucuccaagauuuugauuuucccuguuaguaacuuuaagucagcauuaagcacacagguuugcgggagccagagucauuagccuaugcuugcuccuauuuggagaugggaacccagauacuacuguaauggcagccccagggcucuaaauaucuaguagcagauaaaauccuggaagggcaauggccuucuccccaucucuaggaaagaucccugucaaugauuaaaucacuuuccugcuaucagagugcuggaacuccagccagguccuauaccuggaacauuugauucccucuaccucugcuuuacuuuccagaauaacagguuuacaggagcuuuccuucucguagaaacccagugguauccuucgugguagagaaaugccuacucuuccaggagugaauugcugaaaauuuccauggauguaguuaauuauuauaaauacucacaugaugauucagugucugacacuucagucuuucucuccucaugauggugggggccagaaauaugcaggaaacaaugcugguugugcagcauuuaggcuguacaugaauuuagcgggaaggaauagcaguaagggagaggagccuuuuaguuccucgggguugagguuuucuuuucucccuccuaucuugagaugacacauggaagaagacauagauuuaucuaucugcuuuaguguugucuuauauucuucccuuucagcuuaaucuuaaggaaaaucugaaaagaaaagcaaagguggauuucccuccuuugcuguguucuuccuugcuauaguguaugaaucauucagcuaugcauuuuaaccaguaaaggaaaccagacagugaaacauauaugcacuacccagcccaauuaaucugcggaccacauccacauaauuaguuguuuuaguguuuaccuucaucaguuauucucuggggccuauucaucaaaaccaggcuucguccaacuauagaacuguaaagacgggguguauaguuaugggccacagcuuccauucuguuugaauucugaacacugaagaagagauuuacaagcagaaacugcugucucuaccaggaagcugugagccagaaacugugauaggcacauguaugauuucuuuuccugcauacauuuacacucagaaguaaguauguauuaucauucccauauuuauaaauuagaaagcaugcacuccaagagguuuaguaacuuuuccaaggccaaauacguagcaaagcuagcagucuaggggagguaguuuaacucccaaacccaccaaaucagaauguucuguaccauagacuacuauauuagacacacauucuuccugucaguauaaaauagaaauguuuuuucucaugcaauagagcugguacacuuguuugcacagccgauucaaaaucaaagucaauuguagcaugaucuagugcaaagagucacuagauuuaaaauaaaaagaccuagauuccaacucugacuuuaccauuuccuagcagugugacacuacguaacuaauucacuuugugucuuugagccucauuuucaugucuguacggaaggaaucauaaugucuucccugccugcccauacacacgugaaacaaggaucaaugagaugguauauuuuaaaguguacacuggagagugguauuugauaucauuauugaucaguuuuuaaaaugaauacauaccuuuaaaaugaauacauacauuuucuucacuaaaaacuauacgcauugucuaguugugaaaaacuagaauccuaauggcaaggaugaacaaagguugguugguuuuuaaugguuuaaaguugcgaauucuaugcuauaguuggggcuuugaacucaguuagaugcccccagugaacaguugauucaaguguuugugauucuucagucuuaaaaucuuauacuacuuuaguugacagaauuuauauaauuuuuuucuguaaccauuuugaggcccuuacacgcauaccaccacacacccacugguuuugaugacaggaagccagaaacaccgguaaaaacucaacaagaaauuaucauccauuugcuuuucccugucucugauuugguacuuagcacugggucauauaccacagggaagaccaaagaaauauaccuucaggaaaagaauuuaauuaagaaacuauaaauaggucaucuuuccagugguaauuguuuaaaacucuuuaacuuaauaccugccagaaaguuccuuaaauucagugaauguuuuucucuucuaaaauaaauuuaaauugccuuucaaaaggcaguaccguauauagcacauguauguuauaauguccuggaauaauuauugaauuuaguuuguucaugaaaaauaacacuauaauuuuaacauuaacacguucuaccaguuuucuggaaacaacacuauuuguauuauuguuuuaaggaaauacauuuuauuggaaacauguauuuagaaacacaguguguuuuuugucgacuaaaauuuuacuuguauaauuuaggcaccccuuuugaacuaaaucaaauuuuacaucauuuguuaaccaacagcaaagccgaauugaagaucguuuagaaagacuggaugaugcuauucauguucuccggaaccaugcagugggcccauccacagcuaugccugguggucauggggacaugcauggaaucauuggaccuucucauaauggagccauggguggucugggcucaggguauggaaccggccuucuuucagccaacagacauucacucaugguaagugaugaaauuuauagacucuauaguuaucauauagaguuagaauuucagauauagauacuauuguugcuguuuuuuaaaaaaucagcuuuauugagauauaauucacuuaacauacgaugagcccauuucagguguacaauucaaguguuuuaguguauuuacaagguugugcaaccaucaccauagucuagguuuugaauauuuuugcccccugcaaaaagaaaagaauccccguugcccauuaagcagucauuccccaucccuccacuuccagcccuuggcaaccacuugucuacuuccuaugucuauagauuuaccuauucuggauauuuugaauauauggaaucauacaacaugugguggucuuuuuugacuggcaucuuuuacuuagcaugacuguugcaguuuuucuacaguuugccacguauuagagcuuuauucauuuuuauugucaaauaguauuucacuguauggacauaccacauuacacaguuggguuguuccaacuccuuggcuaugaugaauaaugcuucuauaaauauucauguuuaaguuuuugugcagacacauguuucccuugaggaugaauugcugggucauuguugguguuugaaauuauucauuuuggugacccuggccaaaguguacaauuugaguucauauuauaauaugacauugcuaguaauucaaauauuaguguuuuuuuuuuaauuaaagaagccaaaauagugucugucaauucugagucugggagauagaaauauaugguauguuuauuuguauaaauacauugcaugugacuguguaauuuaauagaguagcuuuacuacuaccuauuuagaauaagucuuuauuugaauuauauuuaagcagauuuguccauauuacaauugugauuuuuuuccucauuacuuuugaaaggauuuuggagauaauucuuuuugaggaugauuaugaagauucagagacucuucuuaauagaauauuaagugaugacaauuaaugaggugaccagagugguggagaauguaacuugaccagugauucucuguaguucugauccucacaagcucuaccucgucucuaagcaccuuaguguccuauuuugccccuuacaggcucgcuaaaaguugcuuggaugaagguauauuuuccauuaucacuguagcauuucucguuuaagcauggucccaaaaggaaaugcaaaauacauacaaauuauuaugagguucuuuuaaguucuugcucaguaguauucuccuguccaucuuucaguuucucuuaauaaaagucuaagauuaagaguaccauucugaacgguguaguauugaaaucugcaaccaauuugaaaccaaaaauacugguuuauaaauagaagcaacgaacucacaucuaaaauguggaaagauauuuuugaaugccaaagagaaaucuuuuuuucuuucccuugaccucugcccuaaaaauucaucauugaauaaaaauuguuuauauguucauggcaguugcuuagaguuuacaaaagaaaagucuagauuuuaauuuagcuuggccucagguaauguguuaaauacacuugggaugcauauaauaugagauuuucguuuguacagcucuuuuuuuucuaacuacaauguuuaaacauacugcuuuuaauuaagaaaucuggcuuuauuaaaagccagaucugugacuuauaaccauuucuguauaucugcucucaaucaacagaaaaauaguuuaauuucuguagcuguguucauuuugcauauguuaaacggauguaacaugcacccagggcauugcuucagagacuauuuuuuccauaaauauguaaaguuuuucuuaaauaccauauguagguuaagugguucuuuuaaauauuaaacuauacauaaauacuuuuggggacuauuugaccuuugaauugacuccuuuuugagucagauucagaggugggaugggaggaaaagacuagaauuauuuuuggagaugggaaguuggacugaccucaguagaaccgaaagugagacgacugaauagaacgguagaaaaaaggaaauaauuagccaauauuacauagaaaccccuuuaauuugaucuugauauacacacacacacacacacacacaaaagcaauaaagccgccaguuuugcugauaaggauaaguuccuguuuucuccucugaagacauuuaauauucaaucaaggacagccacagagccaagcagaucauagcguaacuccaaagauauggcaugucaucacccugcugcccuuugaaccaaaugggguuuugcagucucucuccuuucuuccugaaaaccauucaacguguccccagaaucugagcuccucagccugaaacacuaaugugugugaaaaggauugguuuggccuaucuuucccgugcaaacugguaugaauuuuaaaacaaaaacauaagaacaaaggaaauaguuuuugaauuuaaucagucugaaguuagccuuugaccauuugauacauuccacaauaaaaaggaaguuuaaggggaaggcaaaaaaaaaaaaaaaaaaaccucaucccccuuccccacaacaacaaaaaaauucaaggaggauacugguaauguuuuccacauuugaauuuuaauacaugaaacaggcuauaaaacuuuggccagcugcaguaaauaaaguagccgugggagguaugcaccggaaacuucagcagagagcacuggugagagucucauucccaacuacacaccuucguuuguuguucugggcggaagcgaguugcaguaacuugauacucaucccagucccgguuuuguauugagcacaucgccuuucuaacucuccucaguaauuccuucugauuaaagaguagacagcucugaauccucucgaccuccguacgcuucucauuuccuuucucccugccuuccaaaaaucaaaacaaaauggcuugauaacuuggaaggugauauaagcauuucuuucugcagcagcuugaaguugugguggggaaaacugugguucugccucggcuguuauguuaucucauuuaauugcuaacauauuguccuuagcuuuugauucauaaaauguuuuccuuggaguucugaaguaggucuucagugauuuacuaaguauuaguauaaugaaagggauuuuuuuuuuucacagcggcauggcucauaacacaagagcgaauguuuguauacuugcaagcucucuggaugauauuauugagcuaugcuuauuuccugcucaaaaaccuucccugccuuuccauuuucuacaagauaaagaccaauuccuuagcucagcauuugaagccuauuaccauuuaccgaaagccuuauguugagcucuuccaaucugcaacaagucuuccagcaagacaaggcugggcauauuaccagaauucacccuguauguucuccuucggaacuuuuguaucucuuugucuuguccagcccuaucugcuuaucucuguacaccuaauacccacccauucucaaagcacugacucaaaucauucuucuuccaggaagccuucccuugcuaccccacucaugcuagccauuuuuuucucuauucuuacagcccuaugaaucauaccauuucuagauauuuaucuuaaccagcuccgcauagcugugcaucuuuuauagauaugacucugccuuaccaacuguuguaaauuccucgagucucacauauuauauuuugucucucuccccccgaccccuguaaauagaucauccauagaaacgggagaaaagaaacgaggaaacuuaacauucugugagugugaguuggcagccccucugcuaggcgcucugcauguguugucuuaggcagucuucacaacagcccagugaggaugauaauaguggucauuucaggugucgguaaagugagccuuagaaguuugagcaguuagucucaaguccugcagcgggauuuaaacucaagcacaucaacuccaaauucaaugcucuuuuuuacuaccaggcauacucuccagagauuaucuaugagaacaccuuuucagaacuuauuuuaaaugcuaggagcuugugauuuucaaaacuugauaaguguugguuggcaaaagaaguuuccagguauuccauggcuggguucccagagcagcucucuucccaaauguauagacagagaacuuucccuccaaagugguggcaugcuuggauuaaaacccacauuaucuaugcacuuauucuuaaaccaacauguuugcgcugagugccuaagaggugugaacucucccuaccaggguccuugagguagcaaauuuuaaguuaucaaguuauuuuucuuacuauaaccacccacuuuucuuccaaaauuaaagcagaaaucucugaaugugggagaauaaggaaauagccaggucuucacuacccuaguuagaaacucuuaccaaguaugauucccucucugccucagagaccuccaugauuaauccugauauuaaaugauuagauuucuuauaaauuauggaaagggcaauuuuccagauagaauucucucuguuacucauucaguauucacauccacagaugaggccugaaaagaagcguuucaaaugaccuaaccgcuuuuuuaacugacuaagaacaaaacccacaucaaacuugucuuuaugugacucuauguguucccguuuauuuguugguagagucagcaacuacgugaucauugagcuaaaaauccccucuacuauucauauaucgcauuaguguagcucucagauccuucuuguuuaaagucuauuuauucauuucaauaacauuuauccgugguuaccaaguguagguucugugcucucaaggaauucacaggcuaguaggaaaagauguguacuuaagcagauugcucccugccagucugcuaugcccucuaaaagaccaggggccugacccuuauccaguagugaaagaucacaugguuguuuaguagaggaguggucaucuccaguugacuuagggaugggggagucaugugcaacucaccccacacaccuguccuccacagcaucccuucagaguccugcaggugggggauguggaacccauuucagaaaucaccaauaaaaguggaucuuugcccaguuuuccucuuuucaguaacaauuuuuguuuuacuuuggauuaaaugcagucuaucaaaagagcauuccuuaggaaaagugguaucuuuuuauuuaacugacauuauauacaugagaacuuuuaccucuuagggcuucauaggacaaacaacuucaguuaguuuuccuuguauaguuaagagcucagaccacugaauuuuagauucuaaaaguacccuggaaaucagcccauugcccuucuuugaagacuaaggccuaggaaggggaagugaccaaaccauggguacucacuaguagaauuagaaaccagacaaaagaggcuggacacgguggcucaccccuguaaucccagcaauuuaggaggccgaggcggguggaucacucgaggucaggaguucgaggccagccuggccaacauggugaaacccugucucuaccaaaaauacaaaaauuagccgggcaugguggugcacaccuguaaucccagcuacucaggaggcugaggcaggagaauugcuugaacucuggaggcacagguugcagugagccaagauugugccacugcacuccagccugggugacagagagacccugccacacacacaaaaaaggaaaccagacaaaacagcaagcagaccagcacuccuugugcuauauccuacacugcucagccgacuuccucuuuacccuaauaccauaaccauuucaaaacugugagugguagaaauuagaaaccauucuguuacucugacuuaacuaaugaaauccaagaaaacucuguaguuggcccuaggcugccugcaaugaguugcuauuuagcucuaccaguaauauuuggcaaaaagagaggguagugggcauugaugugauguggcaguuauugguacauagucaugggagcagcaggagucagaagauucuguuucuaugugggccucuucaacaaagauaugaucaacagaggcaucagcaucuucaguugauaaaguugauaaaauagaaaacuauuuucuaaauagccuguuacagaauuucagcgaagcuauugguggucagcaucaucuuuuaauagcuacuaucuuguuuuucuuuaaauuaggauauuugccuucucuaguguucugucaucucuccuaaucuccacaacuaucagguauuucggagagcagauuaguaaccucaacugaaaguuuugaucuuuaucaauuuaucaguugcuccucuugggcuuucacagguuuugauuccauaaaguucugugucuauuugagugcauacuucauuucuaagcaguuauucccauggacucucagggaauuuaagagauuaucucuacugaaaucucccuacagauuuccugccaagcagucaacaagucuugaucagccuccuuccuucaagggugacuagcuccaaaugcccacaaaguccauuuucaucaaauauuugaaaguucuuccuagguccagcccaaauuugcuuuuuucuacaguccuuauguuucugcccaauagaauugcccacaaaucaaguccaacaagcacuugagaaacucaguuauuugaagacagucugcugaguguuuuuucccucuagacgaaacaucacuaucuucaaauauuuaaccugaaaaaaaguuuggacucccugucaugaacuccauugcuucccagugcauucucccuaguuuagcaaggaugccuuuuucuccacaagaaccuuuuaguguguggaaccgcaaacugaacacagugcuuaagaaaggaucaaguggacuaggguggaucuaucuccucccccauucaguaccuuguaucuucauuaaggccaccuaacaauauccuguuuugcuauguuugaugcuuucauuguccugcugacauauauucaauuuguaaucaacugaaauccauaagccaccuaucuccccagucucauuguguacuuuuuguugugucuguacaaaacuucaugaaaccccauugaauguuauguuguagccucagucugauuccuguuuaaugguuucccugaagcccucauucagucacauacucugccaucucuguugcuggcaaaugugaugggugugacuaaugcccacaucaaagccaccaauacaauauuuucaggggaggggauugaccagaaggccaugaggcucaguguuacagacauucuuucuacacgagugcugucuucuauccuuugaguuuaaucucagcugguucugucucccuccuuauacaccguauggcccaccuuugcucauuuuguccguagcguugucacagaagccgggcaugcagcacucacugugaagcaggaaaugaggcuuguccagaaugccuugcucugguggaaccaaacugaguuugagaggccauuccuguguuucagagcacuuucaaaacuauuuucuaaauacccuguuacagaauuucacccaagcuauugguggucaacaucaucuuucaauagcuacuaucuuguuuuucuuuaaauuaggauauuugccuucucuaguguucugucaucucuccuaaucuccacaacuaucaaguauuucggagagcagauuagcaaccucaaccgaaaguuuugaacuuuaucaauaucauacuuuauuuuuuuaaaacugaaaaaaaaaaggacagaaagguaaaagaacuugaagaaauucuuuuagccauggaugagugauaacagcugagaauccuugagcuuaccauuugauauuucuauauuaauuuaaagaaaagucaaaagauuuugaaaacagcaauagaaguaagauccuuuaagcucuauucagcagccccuaagaaaagugaugaggacacugugcaugcccauaugugaacaugguuggccaccuuagguauuuccccuucucuccacaugaauacauauuuuacucaaauucagacucuaugauguugaaacagucuggcauuggauguuuaccucaaaacccugcucucucugcaccuaggacaaacaaauccuaguucucugguguuuagcaucuuggagccaugaauuuuaaauaaaucaaagacaaaaaccuugucuuucccaguuuuaaaauauaaaagauacacacacacacacacacacacacacacacguguauuuaaaauagacccuauaaccucaucauauucuuacauccuuacaugguuuucuucuuaaauuguggaggaaaaggcaggcagacacauuuaauagcacagugaucaucauuuuuuaaaugaacuguuacagggacauaaucuuaaacuauccauaauuuggaauaggcacaacugugcauuuaaaaaaaugcaauauuacccuuauuuucucaggaaagcagauuuucuggagggaaaaguauauauuguauauauuagaaaauauacauauguucauucacucuuucugcaucugcugugcuucagaugcuuuuggggaugcauaaacguguaaaagaaaguaucugaucuuacaggccuuuuauccugguagagugauaauacaaauaugggucuaacuauaaugcaagguagaauuaugaaaugaccuaaggagcaauucagaccgcuaggaaaagcuucccggagaagaugccauugagcucauauucgaguccacauagaauuucaacaauuagagacaggauagaaaaggcguuucagagccauauaauaaacaugauuuaaaaccaaaaacagaaaauaaaggcucaugcaccuaaauggaaguaagaaaacugccugaugauaccaguccuugcagcuugccagccagggcugcauugggugaaaagccccuccacagcacggcagcuccagcaguuggcucgaauauuucacaugagaguccacaggaagagcgagcuuucauguauauuuuuuacauccaaauuaaguuaacucauggaauuuuccacccuuaggaauuaaaguagcaacucaugaaguaauucaguuaugucauucauaccaaaacagaaaauacuggagcaacuuggcacuguuuaaaagccaagauuaggccuuggccauuuuauauuuuuucacauuccauggccguuguguuauuuuaacuuuuauuauggcuguaaauuuuucaaaucaaaaguaucuuaauugcuuagaaaacagaaguugaaaauggguucauaguaagaagaggguuuaggcaaagcagcuuuaggagugagaacugaaaaaaagcuguagcauuacauuuucuguaaugcgaggguucuaccuauuugguugacauucacaguugugcauaauuauagcuuccucuauauccauaaaucaucuuagaacuauaaaguugaguuuaaccaaaagaucuguccaauauuagugaaaugacaucuuuagggaagcauuguccugauacaauagccacauucauuuuaaagcaguuaauuggacacauugucaaaaaccacgguauugaguuuccacauuuuaauuucacauuugccuucucccuggcuucugcacacggacgggucucuuuuggagcugaaagugugugaaaguuauuggagaaugguagucucuggguaauguuucuguaagcugcccaaaauuuucccccuguagucuagaugggaaacagcugguauuuguuuaaaaagcuguuuugcaaaaugucuaaaccuugagauauagaacugaggucaccauuaaagcaggugcuuaagagcaagugagaaagacuucagaggccgacuggcucuggaaucuucugcagggcacuuccuauuagaagaaaaaguguugaaguuugcuccuuuauuuaggacacggcuauaaguauuaauaaguaagugcacuagcaauacuacuagaaauugaguauuuuugaacauagccagcccucaagugaauaauuagcucaguaugaaaggaacuaaaauggucauuuuucucacagggcuucaagauacaagagcccaaggcgcucuagucuccuuuggguguuugaauuuccucuuuaaacacaccaacaguaaaagaacuacuauuucaaauaagcaguaccauaacugacuauaucuuccaagguuuuggaugcaaucuaagggaaagggggaaaagagacccgacuuggcaagacccguaccgaagcagucuggaaaaaaagcaaagcaaaaaacauguggaaccacuaaaggccagugcacgucagguauccaccagucugaagaugaaaggaaguaagccuccuccccugggagcuggagguuauuagcagcuguuuauccagucgggaauagagauuaacauuguacuuuuuuuuuaagaacuagaagaaaauuuguuugggaaguuggcuuuucauaucaagucacugugcuuugccaaaaaaaacuuccuuucucagaacucauguacuagcauugagcaauguuaugauucucugagaaacucugaauuaccaaaaagucuuucuccauuaaauagaacagaaaaggacagagaaaugggugaacguuugccauugacacauugcaguuguacucuuuaccaugugaaauuugccguuuggucuauuaccuguucuccaaccugacucuaaaugggacacucugcccucuaccccucacacguacccucacaacuuaaucauugccacucuaaggugcacacaauggguucugcagauaccuacugcuugcaaaaagaccuuucaugagauauuggggaaacugccuaguacucugggugcuuuauucucaaaaaacaaacaaacaaacaaacaaaaaacgaguuggauauagguauuuuuccccugauuuaaugcuacucuuaaugucauuuucuuuuauuaaauccuuucuucugcuuuugaucuuauuuauagcagagccacuggucauauggaaacuauuacuguauagcugcgagaugaaagacuucauggcaauuaaauaagagugaaucauuugggccaauaauacacacauacagugagguaccauuuguguccaaaaugcccuguguuguucacuuuguagcaaagccauugagcuuuacaaagggcuuuacaaaaaucugcuuuuugucagaaauauguagucugacaauaugaaaacacauguuaacacacaguccuuagcugcuugcuucuucacacauacacaguaucuaaaucaugccacuuauugauauaaaaugaaauuuucacuuaaauuugggauauuauuuaguuguguuaagcgucagcucuuuaaaaauauauuuggauaaucuauaucaaaauucgacccaucacucaaaaccugccuaaaaugucauguucuucuuaaaguagucccugguuuccuaaacggguaugacuucaucauuuuuuaaaacccuacaugaccuuguacuccuuuaugacauucaucguauuuugccuuguauaguaauauuaucccaucauuaaaauaucagugccugggcuaggcgcggugguucaggccuguaaucccagcacuuugggaagccaaggcgggaggaucacaaguucaggaguucgagaccagccuagccaacauggugaaaccccgucucuacuaaaaauacaaaaauuagcugggcguaaaggugcacgccuguaaucccagcuacuggggaggcugaggcaggagaaucgcuugaacccgggaggcggagguugcagugagccaagaucaugccacugcacuccuuucugggcaacaaagcaacacuccaucuuaaaaaaaaaaaaaaaaaucagugccugcaaagucauagacguguuuauuuuuccuugcaaaugcccauguagugccuugcauauaguacacuuucauaaggcgcuugucaaauuaagugaaauguuuauuugauagaaacaugcuaaauguauauuuggcaauaucaaacaauuaaauuucagacauagucucacagauccauagcauuugugucaucauuugcuaagcaucuaacugcacauuguacuauuacacucccgugcagugaccugugcaguuccuguccuugggaugggaugcccacaaauggagacaaguauaggcuuuacgaauggcagcaaaacaaacuuauugaaguuuaugcccugcaccauucaacaaugaccuugaauguguuuuaaggguggugucuguaaugcauagugagcucgugaggugacaagaaaguggagauuucuggagauccacucagcccugaagggucagagagugaggggaucugugaggcuaauaaaagagaagcaguuggugaguuaggaggaaaaaacuagcccagcagacagagcagggagggcuuugcucaagccuuagugaugugggcguuaacccagcagaugagaggccaugcguagguaauugaacauugauagugaggaauuuaaaaauaggagggaacugcauugguccugggagucuaggugaaggaugcaucagcacaagguggaccucuuagacuggauccauacagcaagcaagagccaggcugaagccuuaauauugcaucaacugauggagagagaauauugcauuuaaaagaugaguauuuggaaagugauggggaagaaaugguucauucguuuaggugagcuucuuuauacuucuacucucuuuucaaauauauuacaguaagcauguguuacuugaauaacaagaaaagcauuuaagaaauaaaggccaauggguaaugguaaaucccuagggauccuuagggaugggccaccuggacuggcuaaaaacuguguggaggucagcagcaugacugugcacucucacagguaugcuugcacuucaggcauucagaauuccaaguguaaaucaaguguccaguugucuuuuccuuuaaacaaaagcuguuuacacauaauugcuagacuucaccauauucucugugcuagauauguuugguucacuaggauggauuaacuuuaguuccauaccaucuacuuacuagccugcuauguggagcaaggaagagauagaggaaugggcucuguuaaucugccaguguccccgcuaggugagcucucuccaguuaugguuuccacuguauaggaaaaugaugucgagaauugagggugugggacacagaagagagaaaugaaacaguuuuaauagauggaacguaugaguuaguacaagaaagaugaacugaggucggcucacauccguuugcauuucuugaacuauaucauagaaucauucauuuaaccauuuuggugaacauccaggggaguuucagcccagcugaucauaugauagacaagcacugccaaggucaggaucauuuagaucauguuuaaauccucuugaaaauuacuuuauuaucuggagaaucaauauuaaauaaaucuccaagaauugcacaauaaggaauuaccuuacauuucauacagaacauaagagaagcugugauguuucuggaaaacaauguagguguucucaagacaguuaugaaaucuucucccgacauacauguuaagaaucaaguaaaaauccaaacaaaagaauugaauccagaucugauguuaaugaaaagucucuuaaagguuuaaucacauguacuaaagaaaaaucaucugauaauuuuuuaaacugagaaauauggaaauuauguuugugguuggagugucccagauguuagcucuuucucccacaacaggugguuauuagagguaggucuuguuuucugcagagccucugugccucuaguguuguuccucacaguaucuaucuacugcugccauuccaugaacuuccuaauucccaucugugagccauuaaaaaaguuugcaugaccgcuucccaccucuuuaaaagaugcacuuuuguacuaaaugguguuuugcacauuugagaaaauaaguuugcuuuccucuaauaugacagaggucuggcaagauaauugaaacugaaaucuaguacucuacaacugucauguauaauugauauuucauggggagauuacaguucagacaccaaaacuguuuucuguaucaauggguuucuaauuacagugaaaacccaucagcuuuucuuuuguguuaauggaaaaacaacagagaaaaguaacaguaaguugcaguuaccaggacuucugucuuugucccauuuuguuguuguucuucuuucuaaaaaccaaaaaaaucuauguccaaaauuggaaaccagaugccauuaauagcaaacuuuaauuuugauguaccaaaauguuuauaauaguauauccaguuuugugucauuaucacuuggucuagaaacugaugacaaguuuccuaaaguucccauuguauacucuuuuagaaggauuaugguagaauagaagugacugaggucugaaagccuguuuugaagcaguuaucucuggagauaacauuaacuaggauugaauaacugccaaaugaaauuuaauacauuuucccauccaugaaauaggccucuuaaauacaacagaauaauuacuuucacaauacucccuggaaacaaagagagcaaaaauauugaaugucuuuuuuguuugugguguuuguuguuagcuagaggauaaggacaaggauauuuaccacaaugcugaaugcaucuccauauaaaaacagccuugccaacagccaccuaauuugaaucugcaugucuuuuaaaucuguuuauguuggagggaucguggcaaauauuaaauuuuauaauuuaguuagacaucuuggccuuggccugaguuaaugaacuaugauuuucccccugcaauaaagaaaaaggaaaugauuuuccucuaucuauauauguacguauauauauguauguuauaugcuuguaccuagguguguguauacauguauggacacacacacacacuguuuuaaaacaaaagcucugggaaauaaacgcaucuugcccccuaacucuccuccccucuccuauauaauuguucaguguuguaaguuuucugaguucaaaaucuguuuuagaucuccaacuaagcaucgaaaguuggaucuuaagucacuucaccauucuuggccuuagcuuucuuuguaaaaugaagaguuugaccuaacugauauauaaccaagguccuccaagcccucgacgucuaaguucugugauuuaaaaguguuucuaucaguuugucaagcccuuucuuggaaacuaagguuauuuaaaauuauauggugcuuacgugauucaaaauaauuauugcauaucuaaugacauuuaauuauuuccauugacaaauucacacaggagaauucaaauagcuguguuggaauuugaauauaauuugaccuaagauacaauguaacucagacauuuacaccuacauguaccagucaauauguggacgggacaggccaagccgccuguguuuggacuacaugaucuuauccccccuuccucguuuguagcucucuggaccgggaaaaugccugucauuaagguggcccauucauaguaugaccuaugucugcuucaaaaugagcugggccauccagugaucuuggcauucugagcuuagaaauacaaagacaaagaggaaauuagcaggagguacagaaccagaaagaaugcaccaagagguaucaugaagaaagaguccaaucugucaucaugagagggcagaagccagagagaagcagagguccccccagagagaggagagaggcugaauagcccagcagaggcgaggaguggcauucgguucccaagagcucucugaguccaaaaccuaagcuacagaaaacuauuuaugauaaaucuuuuauuugaacaaacucaaauagguuucucuuccuuacuauuaaaacuaccccacuaaauugaucagcauacaaaaauccccccaagaaucauuaugaguuccacaaaaaccaggaccacaucugaguuauuucucauucuauccccagugucucccaaagugacaggcaugagcuagauuagaaaauguuuguuaaauuaguaaaugcauucucugaucaaucaaugaauaaucauugaauaauuuuuaaauuucacuucuaucuucuauuuuuagcauagauaucacuaaaacugcauuauacgugacuaugggaagauucacauuuacaaugaguauuaauaaaauuuucauaagcuggcuuuuaacuuuagacuauuguuaucucuaugaaaagguuaucaaaauagagcuuuaacgaaguauggauuuucuaaaaauagggacgaaaugucaugcuuagaauugacuugugggaaucuccuuucuccuagucacauuaugacguauuuaaguucagaaugccaagaucauuggaugccccagcucauuuugaagcagacaugggucauucuaugaaugggccgccuuaaugccagugggcaaaucccugacccuuguauauacagagaacagugugaguuucuccaucuauuucuguguuauucuagcgauggauuugugccgacaguccacuguguuucuucccuugucucuuaugugaccagaaauaauguuucugaaagagaagaaaacaggguuagaauaugccaucuguggccaaggaaacaagcaaagccaagccaauuauucaaauuggaauacucuuccacagccacaggcaauggaguugauccuauccuggagaaucaagcucauuauuacauggcucuggaccuaucagagggcauucacaugaccuggaauagacacaaggggagucuuaaaacaucacgacaaauuagccggcgugguggugggcgccuguaauuccaguuacuugggaggcugaaacaggagaauugcuugaaccugggaggcagagguugcagugaacggagauugcaccccugcacuccagccugggugacagagcaagacucugucuccaaaaaaaaaaaaaaaaaaagucagaacaacuuugucucuaacauucuuuauggaaaaugauugauauuauuuaagaugaucuauagaaaauagauggaguuagguaacauaugggccuaaaauccaaacaaaaauguaguuggaacaacuauauccucagauauauuuauaauauuuaagaguuuacagucauuguauaggggaaagauuuaaaauuaaauggauuuuaacaaaauagagacaaagaucaccguaacugaagauagcuugaguuuugaggggguucuugaacuacacaggcuauuauuucuauauaacaugcaaguauuuucagucaaaacacaugauucugucugcaguuauuauguaccuauuacauaccaguugucauguacgauugcauggguucucuuuuucucuuuugagaacuuaccucaaugugaucuagagggaaaaaauuucaggagcaguaacugaauauauuuuaaguaaaaagcaaaacauuacucuuaaguuaugucacagaugcuugcaaagaaaucuugagaguguuaaugauucugaaauaggaguacacuucuccucuaugcucaaaucugugguuaccuucagugauuuugacuuagagucauccuuuguagaaauucaagaaauuagauccauugggaauacaaauaaauaugaaucagcacgaagaauuauuuagguuuauauugauugacagacauaaagagccaccauuugaucaaggccuguaaaaauucaugcuuacaaguugacaucuuagauugaaaggauaaucauugauugaauccguuuucuaaugcaugaauauaaaaauagcaaaucaaaaccucaauggaaaauagcuaucaugcuucugaauaaaaauuaaaauauauaagagagugaguuacaaaugguugcuggagcaggugggcguggucugccuauaagagagcagacuucagucacagaggaaaggagugguguggcaggcaacaggguugaauauguuuaaaaaaaaaaaaagguuuguacuuaacgccacagagcucuagaagcugaaacuagaaucagugagugaaaucuacaaagaggccaauuugugguaaaaauggaaugggcuucuuugggagauaucagucucaguacauuugaagcaccccacagaggccaaauaaccaccauucagaaaguucuguguugcgacacaggcaccggggagcagugcuggacuuccuacaucucucugcugaaacauucauuuauacuuccugaggcucauaagccucaaguguugucuuauucuugcuguauuuugaauccaaacaauuaauaugauuuaugugaucaucuccacccaaaauuuaaaaaaaaguuggagugcauacacacacacacacacacacacacaugcacacaugaauauaaaaauggcauacuucaggaucaauuacuuaaauauauuuucaguaaaaagcaaaauauuauaggugauacuuaauacauggcugccuuuaaauagcaugugcuuauuagguccugugaauuuguuguugguucagauacuuauuguugaugcauucuuuggaaauacccuuuuaaaauauauugguaacacaagagugaugauucuccuuucugguuucauauuuuugacuggaaaaaaaaauaaaccugauucauagcaguauaaauguaugguuaauuuuuuguguuuuagacccaccguccuguguaaaugcucacuuaaccauaggcuaagaaaauacuuggaaauagaaaagaaaaugugaacuacugauuguccucuuaguugacaaaugcuucauguuuucgcuugaaggcaugugcuaugaaguaggcaguugcugucucagugccacaaguucaaugucucuggaccccagagucgauaguaguaguuaauaaaaagcucagcaguauuuuuuuaaugaaguaaucaugcuguacucuauaauuuuauucuuggaagcauaaagaguauuuacaauauggugucuuucuagggucagaauagugaggaaaaaaauggaaaaauguccaaacauccuuccuugcauggcaaugauggcauuacugguguguuuaauaaaaccuuuauugguacauuuuccggugugguggcauuggcagaaaccaucccccuuuggauuuggaacucagcagcugaugaaauacaguaaacauuaauuuggaaugggcugccaguuuuggaaagccaggugacauuuuauuauauuuguaccaagcagaggcugugucccauacugcuguagcuuccgcugucagaggcuuagcuggcauuauggaaaaaaaaaaauggcaggccugagaaucuuauccccugaaaugaaagucgaaugccaaauugaaauuccuguaggauuuccgauagcaaugggggaauugagaagcucacaauuaagcauaugggcauuaagauaauugucagaucuguuggcggacaugauagaagacagauggguacgaaucagugcgcuccacugcagcacccugggaggcaauuugacguuuuaccugccugagcuacucugccauauuugucacugaauguacagcacggcaucuuacugaguguuaaguguuuucgccgggaacuauaggugcaugugcgguccuucagcgcccucuagugaaacgcguuugggaguaugguuuuugaaaagccagccuucaucagguccucuuggccucuggaaauagcugucgcaccuccgguuccugcucaccucucugguuccucucgcccuuucagguggggacccaucgugaagauggcguggcccugagaggcagccauucucuucugccaaaccagguuccgguuccacagcuuccuguccagucugcgacuuccccugaccugaacccaccccaggacccuuacagagguagguuggccucaccagggcacuucugaccucacuuucacaauaggaccaguguugauacccagccucuugguguucaucccucaagaagcacuggcagaaacccaggaaucaaauugggcacaaaaaugguaaggaaauggcaaaguauuuagaacuucgcccgcuaauuguguuucuccagggacuguuuuccucaaacauccucugaaauccugguccuauaucagcagggaaugaggccacagacugaugagaggaaauuuuauuuuagcuauuuccacauuuuucucauucagguccucuaaugugguuaguuguggccugaaaaugauauuuccaaaugaauaggaaggaaggaaauuguuuuuguuguuuaagauggaaggaaauauaggugcauuuaaaaaauggagcuugguugcaugauuuucgcucuugagucaucuagcccucuaaugauugccucauaccggugauuacgagcggcuuuucaugaccccaggaaguugggcuauugcuggccagcugacuaggagucgcuuagauaacaucuucucagucccuucacauuuaauauaaaaaugauaacauugccacaggaauacaugugggcauuuuuucagcuguucaacauuguacagaucugagugucaauuauauguauggguaugucugcccauuuuuuaugaauaauaaucauuuuauggacuuuuuuuuuuuuuuuuuuugacagagccucacucugucgcccaggcuggaguacaguggugcgaucucagcucacugcaaccuccaccucccagguucaagcgauucuccugccucagccucccaggggguagcuaggauuacagacaugcaucaccaugccuggcuauuuuucguauuuuuaguagagacaggguuucaccacauuagccaggcuggucuugaauuccugaccucaagugaugcacccgccucagccucccgaagugcugggauuacaggugugaaccaccacaacuggccaggaccuuucuuaucaggaggcuuuggauuuugcccucuuuguccuaaaccugugcuucucaaacugcacauaagcacaaccugagcaucuuguuaaaaugcagauuccacuucuguaggucugggauuguccauuucuaaugggcucacagaugaugaggccgcauggaccaaaguuugaguggcaagguucuagaauacacagauuacaaauaaagaggaauacuugacagauaugcuucuaccuuuaaaaaaauuacuacauuagggucguguuuuaaaaugcagugugacuuggaaaguugagcaaugauaaagcuagaaauuucuaaaaugaguagcaaacugccuuccauauguaccauuuuaaaaugcugauuacuucuugagaauaagagaagccuaauuucagaauaucauuaggguaccuauugaagucuugacugcacauauuuagcauacucccugggaauuauauuuuaaggacauuuuucuauuaaaucauugcauauggaagaaacucaauauaauagcugauauuuacuuggguucuuaaucagaacauuggcugugugauuuucaugauuaugauuuucauugcaauuaaguugauguuuuguagacagugaaauuaccaucuacuccaaaagauugcaaaauagaauuuaaccuuagagccaaugcagggaaaacuuguuucugcaggugcauuuuuugaaacuucaacagauagcagggggaaaaaaaagugacagaaggaucacaguucagcaguaugaauugucugcuggcagccuugcaaucuggugugcaggcagugagauugugguguacaugucaccugauuucucuuuuucggcaggcaugccaccaggacuacaggggcagagugucuccucuggcagcucugagaucaaauccgaugacgagggugaugagaaccugcaagacacgaaaucuucggaggacaagaaauuagaugacgacaagaaggauaucaaaucaauuacuaggucaagaucuagguaacaguauauaauacugucgcuucauuuaauuccuuuauuggacuuugaugaagugaacagaacgggaagaaacuauucaguuuuuuccuggcagguaaauuuacagcugaaaagaaaauuaaaggccuacucuagaaguacuaaaaguaucguuucagauaccuguacucuauuggagccuaaacuguuuuggcauuuaugaaucuggacccaaugcuaaugacacacagugaaaaaauuugucucugauucaaguacaguuuauuuguaaaacuauacuuauucuacaaauuuggucagaaauguugugucuauaauauuucuaaaaagagauuguagccauguuaaaaacucaacugauguaugugccaacuauaacucuuuucuuaccucuaaaguaagaaaauaauuuccuagauuuauccuaaacaugcugauguauauaagaguaauaccuuaauuguuuaugguuuuucuuccuggacacucuuuucuacagaaaacacaacugcaggaaaauagcuucugucugguuuucuuaaauaucugcuaucuuuaaauucaaaucuauaucuccuugaacuuuaaucugguaaucagaugguuuuugaauaccaacacccguguacuuugccucaauucccugagguuguuuuuauucacaaauucaaccaauuguccuaagacuacagcuuuccuucuaaaggcugugguucucaagguucuaucuggaaucuuuugugaauuaagaacaugcugccucuuuauguugcuguuguaauuauugagauaaauuccgugucuugccacaaguuuaaaaaugccgaauacuucuagauaaccccuuuccuuccuuguugucuuuuucugauucuuggccacuuuggcaagaaaucccaaggaggggauuucauaccuuuagcagcuucuguguuagaccagucaguucuugguaauuuaacuuauuguggccaaacuuaugcauguuaauggauucuuugaaguuuuggaacaacauuuucauucgcuguugagaaccuucuuauuuaaaaaggucacucuuaugacauuuacuuauguaugccuccaaaacuguauuauaaggcagugcuuuuucaaaucuaggcaguuuuauuugcauaacuaguuuauuuguaagugaauaaccaauucuaauuggucguuagccugaaaaucuuuggaagaaaaguuccuauuuuccagucuccuuuguguaagguguagcauuuguuggauguauaaaaauaucacccaaaugcucagcuuccggacaggccuggcagagacuguuuucauuugcuuuuuacagccuauuugcauaguagaauauaggagugaauuaaucauuacugauuuccuuggcacuggcagcaguugggggugagggcagaggagggauccgcagaaggcagagaaagagggccuuuuccaguggacucaguugacuuccauguuuaccauacacaccuguggcagacagugccaucuggaaaggcgcuuacgcuauggagagagaggagccuggucuuacagcauccuucuguggugucauccuccuugccccuaacuuuucuccuucacccaaguguucuugacuuacgugcauuaucuuuauguguaacguauacuugcaaccgaagaauaccacucccacuuuugauugauuggagcuucucaaguguaauugguccuuauugccacuuggaaguuacccagagauucuccaaaauggaacaucagagucauauauuuuaaaccagcauucauuaaauauacauuuaauugaguagauaauuucccacaucuuccaacuccgaaauguugugauuaaucaucuuuauucugugaacauuuccaaugugugaaauuacccuuuagguuaauuguuagucacuuccauggaguuucuugugauggggagucuacugauguucagugaaguuuguuucauuuucugugucucucauaagccccccaaaaguccucacucauguuuauucacaauagucauucagagcuuuauagcacgugcugcucugccuucuugagacaagacgucgugcacacuucucuuuuuuacaugacagcccuuggaauauuugaacccugcugcugugacgacuuccucauaugauaugcuuuccagguggcucaucauccucuuugccuuccauucaaaaguuucuaauuugucacuguaacacucagaaauggacagaaccgaucuuaucuuuucagacuauucugggcccggccaugcauuuguuaugaaucauggaauauuuugguuuucacaauuagaaauuaccuuuuggcuuuuuuuuuuuuuuuuuuuuguaagagacagagucuggcuguguugcccaggcuggagugcaguggccugaucacaucucacuguagccuccaccuccuagauucaagugagccucccaccucagccuccugaguagcugagaccgcaggugugcaucacugugcccagcuaauuuuuuuuuauuuuuuguagagacgaggucucacuauaucguccaggcugggguuauaggcaugagccacugcacccagcuuucuggcuucauuuuugacucacaaugaggucauggucauucauaagcugcagguguuugguuuguugaaucguuuugcaugacugauaucaguucagguuucccaaacuuguucuguggaucauaaacaucuauaagauuaaagaccauggaagucauguuuuuguaacuuuuuguuuaauacauagagaaaaugagacucacauaguggguugaccaggccuucaaagcaagguaauggggacaccugaauaaaagccucacugucuucacucccauugcucuggugucuuacauauaggccuuucuucuuacuccuguuaagcugccuuguauuuuuuugaccuaucaaaaucauuuuucaauuacuuguuuccccuagauuucagaugucacgguaugaaagguuuuauauauauuuaaaaaauaaaguauaaacauaaagucuuuuugaagcgugguuaugcaacauaugcuaggcguaaguuggugaaugccugcuuugcagaguguaaccccauugaauaaaaaaagcuuuguuuucccuuucugccccccuguaucaguaugggcacacccugcacucuaacuuuaaucuacgucacccucaccuguuugguuuggguuuaaugucugcgagaaaaccaaauaucuuguguauugugaacugucaaagccaucuaaaccaaucccaaggucaaguggauauaaaaauucugccaaaaacauggcauaagauggaaaaguucccugaaaacucuggaagaaaacaaaguaauguagacaccuucuuuuuccccacaccauuagaaaauguugcaucccuuuugucccacagcaauaaugacgaugaggaccugacaccagagcagaaggcagagcgugagaaggagcggaggauggccaacaaugcccgagagcgucugcggguccgugacaucaacgaggcuuucaaagagcucggccgcauggugcagcuccaccucaagagugacaagccccagaccaagcuccugauccuccaccaggcgguggccgucauccucagucuggagcagcaaguccgaggucagugcaggccagccuccuugcagagcucgugaggagcuuguggcaggcacaagcugagaugggcacgccagucuugagcaguggcagacaguagacuuucaagcaucauuccaaagaauuguuuccauugcagacugugucuaaauccauaaggcagcaucccuuucuccuguaauuaaguugugggauucucuuauaacuaagauuauauugcaacuuucccuauauccuuucaguaauuugagcuuaguuuauuugcuuuaccaaccuuugcuuacuguaaaguggcuguacacacucacaugcaguucaccuuuuacuagugacugaccaaauggauugccacaguacuuaguaacuguuccuuuuguucuguaauauaaacacugagaaaaaggucagacacgcaagaagagugcauugcugcccucugccagaagccucagcauuaaacaaagguucugugcuuuaauccuccacagaaaggaaucugaauccgaaagcugcgugucugaaaagaagggaggaagagaagguguccucagagccucccccucucuccuuggccggcccacacccuggaaugggagacgcaucgaaucacaugggacagauguaaaagggcaaguuuguuuucagccauuucugagaucgaucauucaaaacucucaucaguguaucagccauaaaagugaauuucacccaaauugacagauauuuucuuucauggaaaaagaauuuuuuuuaaaaaaagcauacuuuuucuguuacaaauauauuaaugaauuuuuucucucuuuuuuccuuucucagguccaaguugccacauugcuucauuaaaacaagagaccacuuccuuaacagcuguauuaucuuaaacccacauaaacacuucuccuuaacccccauuuuuguaauauaagacaagucugaguaguuaugaaucgcagacgcaagagguuucagcauucccaauuaucaaaaaacagaaaaacaaaaaaaagaaagaaaaaagugcaacuugagggacgacuuucuuuaacauaucauucagaaugugcaaagcaguauguacaggcugagacacagcccagagacugaacggcaaucuuuccacacuguggaacaaugcauuugugccuaaacuucuuuuggaaaaaaaaaauauaauuaauuuguaagucugaaaaaaaaauauuuaauuuaaaaaaaauuguaaacuugcaauaaugaaaaaguguacuucugaagaaaacuacaugaacguuuuuguugguauucaagucagcuaguguuuauaauuacuggauauugaauuaggggaagcucggcugcccuaguaacaaaaccagcaaacguccugaugacaacgaagugaugacauuagccauuccuuaggguaggaggaacagauggaucuuauagaccuaugacaaauauauauauaaauauauauauaaauauauauuaaaaauuuagugacuaugguaagcuuuuguucauuuguuucagacuuuuuucuccuguaaaaaaauaguacugauuaacuuuuuuaaaagaaagauuuuacuguaaauauggauuuuuuuuuuuuuggucuuauuucugucccuuucccugguuuguuaucguaaccuguagugccaacucugcuuccagagggguagugcaggaugaaaugcugacccugauguugcuucucauucauaaauaaguagaaaguuguuucuccagucuuuugggaacacaggacuuaaaagucacaucauguguagauauuacaagcagcauuaccaagacauggcaaaaagaguuugucugaauuguaauguugcguuugugaaccuauucugggauuuucagagguacaagguuagaaugcuacaauguuaccacugugccuuccaauguuuauaucaucggaaacauaacauaaucaaaguggcugugauuuaacaaaaugauuaaaguguuaccuaccuguguagccgaaguagugugcagugaggcguuucugaauacauggucagauuuuuggaaaaaaacaaaaacaaaaaaaacaaguaaaguucaaaaaccgucaaaugagaaaauugcaaguagugugacagagcugauugauuuuguugcuuucuugauuuuuuuuuucaaaauggguuuacuaaaauguagaugacuuaacugccuccuccuucgucugaaaaaugccaauauucaaucaucaugcagcauuauaacaagccuuauaaguccuaaagcauuaaguugcacuuuuuugaggagggguagugcaguauuucucuggccaguaugaaugaaguuuauacuuaccauauuugauagaaacauagaucaagcuauggcacagcgacucaucagauagcuagcuuugacgucugggcacaauugaaccaacuuccaucgugaaucuuuauaaugauugacuuugguguauagugcaguaaacaaauagugcuccuaguuaaguauuugucagcauccuuuugucucuaacuuguuucuauuuuuacagccacacaauucuuggcauguauuaagaaaaaaaaaaaucccuguucaaguaguuuuuccaccuaucagcacugaguaaaugccauaaauccauugaaauggucuaaauguuccaucuguucuccuguuuugccaguuauauaguaaugaaauacauuuguaaauuuuaugcaacaaauggcaaacguaucauuauuuugaaauuguguauguaaaaguuauauuuuuacauguagacucuuguuauuauguguuuuaauacauuguaucaguuuuuguuuuuuuuuaaaaacugugguuuaaaaagaagucucauuuaaaugaaauagcuacaagaaucagaauuuuauguucauuucugaaaauguaagaacaaauaagauaguuaccacguggucaucuuuuacaaacccauaaacauuuugauuagcuguguguguguugaaaaacuguaaauauguucaguagcgauaaaacuaaaauaacuuugauuuguugauaaguuccuaaaauguggagguggauuaaaaccuuaggagaauagcagaaaucaaacuucaugaaaaguuauuuuggggcuuuccugugaaauguaugaacaaagaggcucagagaaggacauggaagacaauaauguauacucucuccuccucccugaauaaugaaaaccauguguauuuguucccuccguauguuaaagauuuccuuuuagugguacauucugcacucauuuuguauagucuaccaaggcggguaucccuaggaacaauauuauauaggaagcagguauacucugaucacauucaggauaaguguacagaagaaaauacgguguuuacucuuuagggaacuggaaacacucccugcauugauguacauuuuaagaauggcacuuuugauacauguuaucauaaaggugcuuaauagagcugaauuaaaguuuuucaaaucuguaaacaaagcaaaaaaguaaauuguagucauuugauuauuuuuuaaauuggugcuuuauauuuuguucucacucagaguaaaagcugcaauuuauuguucaccagcuuugauguauucauuacucaguaaugcaauaccucuauuguugaauucccuuuggaaauaagugaaaauucuaacggccacugaaagcugcucgcuagguuuugcuugguggagaaacauaaucugcaccuauccauauuaauuggguuguauccccauuaaaaaagaaaaaaagggaauguggccuuuuuaguguguuuuuuauuguuguuguuuuguaauuaucaaacccagguaagauauugguauccugcacuggauuuucaaaugaaguucagcagaagacaguuaagauuaaaguacuauacaaaaauuucaaaaggguccauacuacgcuaucuguaugacgacacuuaggcuggggaucucuuucagaaacucggacuuuaaaagcaacuuggagcaguugauccaccuccacauucaaguaauuuaugaauaugcagaauagggaucuguucaucuagaaauuuuuaccauuugucuucuguguagcugcaaggaacacuaauguuuauacaacugucaguccacccaguggugcaacugguucugauucagucuuccgauuccuuuuuauuuuucacuuuuuccuauuucugaauuuuuuuuuuuauuugugaucuugauuuugaugagggguuggggaguggggagggagucgaaccaagacuuggaguuaagaggauuuucaucuuuugcauccaacaggcagaauaugaucuguguccaaaagugaacuugagucaggaaugaaucaauuucagcauaaacaagcacaaaaauuuagucugcuggcugacuggaagcaaaaaagucaagauggaauaugaugaauuccaacacaauggggcaccaaggccuuuaggccucucuuuuuauuuugcuuugguuuuguuuguuuuucuuuagagacaugcucuuucucaugggacuugaaguggacucaucuuugugcagugcugguuuugccauacucauuucaaguauuauagacauauguaauggugaaaauauaugaacuguggccuuuuucauucuuguuacuugugaugcaauuaagugaagauaagaaaaaaaaaaaaaaagcagagauuuaccauguaucagugccuggcuuuuuguuauaaagcuuuguuugucuagugcucuuuugcuauaaaauagacuguaguacacccuaguaggaaaaaaaaaaaacuaaauuuaaaaauaaaaaauauauuuggcuuauuuuucgcaggagcaauccuuuuauaccaugaauauuacaaaaaaauugucagauucugaauauuucuucuuuguagauuuuuggaaucauuaugaguaaaaguuuguuacuuuauuuuacuauuuaaaagauguuauuuuaccauguguuaccaagaugaaacuguauggguagcuuuuuuguuuguuuuuuguuuuguuuuuguuuuuguuuuuguuuuuaguuguaggucgcagcggggaaauuuuuugcgacuguacacauagcugcagcauuaaaaacuuaaaaaaauuguuaaaaaaaaaaaaagggaaaacauuucaaaaaaaaaaaaaaagauaaacaguuacaccuuguuuucaauguguggcugagugccucgauuuuuucauguuuuugguguauuucugauuuguagaaguguccaaacagguugugugcuggaguuccuucaagacaaaaacaaacccagcuuggucaaggccauuaccuguuucccaucuguaguuauucgaugaagucauguacaugaccguucuguagcaauaaaugugccauuuuuauaaacuguuucugacacuuguuucauuucauuuugcauuguccauauagcuaugauucucuucuguaaguaaaacgcaucuauauuucauuuuccaaguguuggagguauugacagcuuaacaaacaaaacauacaaaaaaaaucacaaaaacaaauugaaaagcaaagcacaugauugaucaaggaagagaugcccuuaaugaaaauggaacgggaugcaugcaaaacaaaaagaaaacugucuagaggauuaacuaauugaaggaauauaauuaauguguguguaacacugaagcuaugcauuugaagagcucugaacugcaccaguguuuucgguugugcugcagguugcuaagucaagucagccuuaaccuuuugcaccaguuggucggcuguuuggcagaacauucucagaucuuuucagucaaaaaucuaagaugauuuauuuuguaucacuuuguuaaaagcugaauauuguuaacuacaguuaauauuaacacuguauuuauacuuucucaaacuacauccgccccaccacuucugguugccucuguugacuauuaauccagauguaaacaaccagauguuuuuuucuaacuuguacaaacugacgugugucaacuaucauggaaggaaaaaaauguacagauuaaaauuauucaguguuauguacuguaaguuaauauuuuuguagaauggacaucaaucuacuuugcaaaauuuggaggcuauuucaacauugcacuguagaaauguaaaguaauguaugcaauguaaaggaaagcccgcgguagcugagcgcuucauaacagaauguucuaaucaaguacgugguauuuggggaugucuccaauauugcucuuguauucuuucuaauuggguuuagugacuaguugaaggaaaauguuauaacgccauuugguucacaugugaagugcccuccauagccaaauguugggauuuuuuuuuuuuucguuuuugguuggacuguuugcagauauuuaaauuuuaugaaauuuccaaagauuuugguugauaacccccuuuuaccuucuaaaugauuugagauguucuuauguucuuacuguguguuuuaaauauauauaaaagagccacaagcauuu

SEQ ID NO: 6316 - RNA, 99529 nt, Homo sapiens
accacgcuuggcccggccauaugggaaaaugcaacugaaggaauuguugugaaaaaagggacagcgaguuugaaauaaaaguuguuagagugguacugaggagaaaaaagaauccgagaccauguacugcgcauacacaaucccgggcaugggcggcaacucuuugauguacuacuauaaugggaaagcgguaagcgaaugcgggcugcgagggggauuuuugacaaguuuuauugucgcagggaugagcauccuagguggugaucauuguuugcaaaguugugcaggacugccgcaccuuccugggugccaugaaauauuuaucauuugccaauccuaagaucuucuucuugccuacuucuucuccuucgucuuuuuuuccccccacuccucccccagaguagaaaaauagaugcuuucagagcuuuagagaguggauccuagagcgaaaguuugcagucagguaaaguugagaggugguaugauuuuuuuuuuuuaaagaguuuuggaaaauucuuauuccuuccaaaugacuguuagaaaggaaaagcagauaugagaagcagaauugagaaagcccaaguuaggcugagaggaaauuugggguaaguuucucccuggauugagguuuugugauaucuaaagucuuacuaaguuggaagcuugagugcaguggauagaguggagagaaccugaaagguuaaaauagagcaaacacauaaaacugagagaucaaauuaaggaguagauuauauaagcuuagauauauauuuaaagccaaaauggggaaggaaaaacaaacggguucauucaugcauauaacaguauugucauaaguuauuugugcuguguggcuucuucccucaauuucccccccuuccaacagaaacgcuuuauuuaagaaaaaaaugugucugguauuuugugcauaaccccagcagaagguuuauacuugccaucuggagguuuauuuuuuuuuuccuucgucugggcccacugaaggaaaaggauuucaauauuuucaaaucgguauguggggcucucgggaagaguuguugggugauagaggagcaaaaauuuauuguuuuaaaauagaaaagaagaaugagagaaaagugaaaagcagccauuuauaaacuguucucuuuguguacuuugaacuuccauuuggauugaucuuaaucagggauaguugggccaaaggggacagaucagagcuuucaggaaggcccaguucagcuguagcaauuggcgcaaacgaauuaaacauguguaugugcugcuauaugccugugaguguauauacauacagaugcaugcauaacgguuauuucuagaugagcauauucuguaauacauacauauacacaacuguuugaaggugcaguuucagaagauuaauaauuucauuuaagaagccaguuuuaugaaugggcaacuugaaauaauaucguuuacuuuuauuuugaaaaguacgaguaaaucaucaaaaguucauagcgcuauccuauuuuuaucuuuuuuaaaaaagagcacgguguaauuaaaauaguuaagugugguaagggaaauauaauuuuaaaacaaaugguuuucguugugauuugaucaaaguguuuaaaucuguaaacauaaauauugggauuauguaacaucuuuuuuuuuuuuuaacaaguacaugauuugcaauugguaguuacucauauauagauaagacuuuugccuauuaucuuuuagauguucucauacauaacuuauucagcaccuuucauuuuaaagcacuuuuaaugaaaauuuugugaaugaugccaucguagucaguaagcaaaagugucucugaagcagauucagggauuagauagcccuuauccguaaugaaagacuuacauuauaaaagaauauaaguuuccaugguuuuuaucuuucaggauuaccaaugaugugacuuuuacauguuaauuguuaauuuugcaucuuaaauaucugaacugacaaaauuuuaauuuaaguuuuguaccuuuuaacucccuuuuggccaaaaggaauuuucaaaaauauguauuccauucccacagcuugccaguugccuccaccguaagaaaaugcugaauaugacaucauaucacuaauaugcccucucaguugccaaauauuuugguuguuagauuuuuuuuuuuuuugagaggaugguacucauaaaaucaagaucgcucugucacaggaaauguauuuauaggaacuguuuuaaggcguuuauuaaaaacaaaucuggugauguguaucucuauugauucaaacacuagaaagaggcaaauuguacacacauuauaguuagaaaaaaaauagccauuuggaacaccagcagaaagcuuuugaaacugcggauggcuaccaguuguccaucuuagcuuuaugaaacagacagcaaaguccaguugugugugucccaaggaaggggccaauucuauaccauuuuuuaaaaugcccucaugcauacacugaggaagcagauuuuuguuuauucuacaguguguauucugcuggcucuaauucugcauugaguggcuuuugauuuggugccagacauguuguggagauuguauauaccaugcguuaauuguucaaaaugccuaucgaagagacuuuacauuucuugaguuuuacuuaucguuuggagguugaauaucuaugcuuuuuuguguguaugugcaugucuaaccaauguguguuugaaccugaauuguugaaguuaaguguggucagcuauuuguugcacaaguuuuccucugaagagaacacagcacugaauuccuucuuuuuucccagugacaagucaauuacuuguuuaaauucaguuugaacucccugaacugagagaggccagaggaagcagguuuucccugugaauaaacaaaagaagaaaaauggaaaaucauuccaaaacacagugauuuuagcuugugggaagaauauaauuaagcauuacaagaauuaugguuucuucuuuuaugaacuggcaacuauaggguuuguaaaaucaguuguccucuaacuuucuagcagaaauauaaucaaugauauuuuaggacaaacgaaaaaaacgugaauuuuuuuacuaccuuaaguuaugaaguguuuccauguccauaucccacaaaaaaauuuuuccuuguuucugugaacaacuguaccuguccagaaguguggacucugaaaaaaauacuuaacaaaaaaucguaacacaagagcuaucaaagaauaaauuuuggauauaaaccagaauguauuuuuaaaaaucaguuucuccucaggugagaguuucaugaacuugauaaaauaauuuuugugauuuuuuuuuccucuaugcauuagagguuuaaauacuaacggauccaaaucuaagcuuaaaaaaaauuaaagcaccacuucugaacuacgaaacagauuuuuuuuugcagagaaaaucaguagcuuauuuuguguuggaaauacaagcuuguaucaaagugugccaaugugucuguccuuauuaaggcuauaagaaguauuaggcauuaccugcucuccaauaaguguaguucuagcucuaaauuuugaucuuuauggcuucuugcauguucauugaagaagaauuuuaauaagugauuauuuggucaaauuucacauaucuaauauuauagcauauccacgaagauaaaauuauggcaaauaaaacugaaaacaaaaguggcgaaauguccucguaaugguaauugaagaucacaucaucagcucucgccagcaugugcauguguuaaaccguagagagaaaccuguaauuauuguaauugcucuuuuugcuuuauacuaacaagcuucaaaccauguuucaaaguaguuguuuugaaauaguuauuugucaaaucaucaaaucucggaaaguaaaugguaaugagcuuuuuauguuuauauucugacuguuggucauauuaugcagcuuuucaaguccauaaaguucagagaugaaacuggauguuaauuauuucugauaucaaggccaaagaauaaaauaauguuacgaguccugcuuaaggugaaaaauuaggaauauuugaauaucagaaucucucaauugggaaacucucuauucuuagaagaaaguuuuccuguaaauaagugacaauaucagucagcaaccuaaauuuuuuaaagcugaaaauugggguaugaagaguguagcuuuuucucauuuaucacaggaagugcuaagauaaaaagaucaauauuuaaaugacgccacuaauaacauuuuucaguacauuuuacauauggcucuuuuuuuuccccccaaaccucacaguugguuggaacagccacacauaggacauagguagccacuggguuuuaaaguuuccaguagagugucaacuaugcaaauuacauuuggcauuuuaaaaauauauuucuuauacuuacuauuuucagaaccaugauuauaaaugaaagcagccaguauaaaugcuuuuauuuuuuuuaauugcuguuuacuugcuauuacacagcaaaaauuugcuuaggccacaaaguaaucaaauuuuuaaauuccccacugguucaauaaaauaaaacauaucaaagagaaagcauguaggaaaaacugcuuuuuugugagcuuauuuuuuaaauauaguuggcacuuuaauuuacccauuuaaaaauaacaaugaaauuuuuuuuuaugcuucauuacuuuaaaacaaaauuauguugauuuuguucuuuauguuuaagcugauaaaaauucaccagacacuuaaucuugacauuguggcuacaucuugccuuccugccucugauuaaauuuucaaaaucccugcaugagauucacagauaccaguuugaacguuucugugaggcuaauuucucagggaaaaaauauggaucaguuacaucuuugguuaauuuuaucuaguuccuaauuucugcuaggucuaagcauuuuaaauauaguguugguaaagcauccuucugucgcugggugauggcauuauugcaggcagaauuaggagaaaggacauuggcauaggagaaagaggguuggggagaaaaguggucaggaaaaaagaucuaauaguugaugcagucuuuuaaauaccuuuccaacugaucuacaggaaauugugcugaagaaucauuuguuuccuguuccacuauaaaugugguuugcauuacauccccuguucggcuuuuuuuguuguuguuuuguuucuacuaaauuguaguaccacgauggaggcuugagaauaagugaugucuuccuuuauaacuuaucuuuuaauggcuugaucauaguuggauuuuagacacugucauauuucauuauaugaauuuuguauguguguguuuccaagccuacuugaaacuucuauuacugcucugccacuaagaaaaacaaugcugcagucuaaguucuuuagaaucacuauuguaggucaaauacauggucuacaugcugccaucagggaucuauuaaaugaaucucuuguuuacucauucagaaaauuuagagauuuuagaugugguucuggcaauuguaaaaguuguuagaauucagauuuacuuuugccuuaagaagaaaauacaguggagacauauauuugcucugcacagcugaccuaaaugcaugccuuguaccugugagaauuucaguaugcggacacauaaaagauuacugggccuuuuuucccccuccaauauuaucagaguuacaaaauaaauaaucuuucacagucaacauaguuuaaaaguaauuuuaguuuuaagcuuuuucaaguuuuuauauguuuaauugcacuuuauuagcccuuaauacuucaaacauaacucuaagaugacacaggcuaaaguuguauaugauaaacauuauugauuacuuaaaaaaaagggauaucuguauauucauaaaacauuuauaaucuauuuaggaaaucaucauaguccuaaaaaaaaagcaguuguuuguauaccaggaaaaagagaucaguagugacaaaaguggaaaagauacuuguauaaaauugucuccuuuagugugaagugaucuacugaaaguuauacuuggaauuuucagaaaauguccauaguuguaggcuuuauaacauuucaaauucuguaauaaacuauuuggcacauuaucauaucauuuuagguauauagauaccauggcauuuuauuaagcaaaacaauuuuuuucuucugaagaauacuuaaggugaaauuuacugguuuugagcuugaaagugguuugagaauuauacaugaacuccacuuaaacuuuggagacuuuccuuuuugcagugcuaaagauccaugacuugguuccaaacuacaaccuuuuauuugcagauguauuuauggcacaguaccacauucugauuagaauuuaagaguucacauuucugauauuucugucucuaaaugcuguguugcuucuguuuaccuaguuuucuuccuauucuuccuaauuucuuaaagaaaucugcacauauucauugagguauuuaauccaaaaagauuuaaaagagacacuacgccucuaacauucuguuuaggagaguauacuacuuuaaacuccguucuccccaccuaaaaaaggggggcuaaagaguggguuugaacaccugagaagucagaggugggaacaguguagaugauggucuaauuucaggcucaaccaaaaaaaaugcaggcuuuggcuggcauccuccagggaccuagcucugugcuuuccuagagaccaaauuacacucaucuugagagagggcauguugagguaauuggugggagagaguggggagaguugaauuccagcugcuuccauuguagcuguccugaaaaugaauaggggauguuaacaauggaggcuaacauuugacuuggcuuuuucaccuccacaaaccuaagggugagaauuauagaguacugaaugacugcaccaauaaugauccuguuuaagugggaauugcuauguugggaaaaacucacaccauuuuaaaaauaguugaugcauuuaccaaccacaguccuauuacuguagcccaauaaaguuuauccacaguauggaaacacuccuuuuuuuuauugucagccaucuaguguguguauuggaucuucaccucuuugguuaccauuuuaaaaugcuccuacugaaagacauuuggaaggcaccagaaucccaucuccaagaagggaagcaagauacaagugcccuguacucccuuucuccuagaauguguggucuuuuuuuuuuuuuaaggagaauaaauacuguaugacucaauagcuuuucuaacgaauaaaacaaauuaaauugauguuacaugcguauuuaaacccuauccaguuaaguacugaugugauuaaaauaaucaaauguauuacuuaaaaaauuaaaaaggauaaauucugcaccccauuauuuuauugacuuuuaaauauaaauugcagaaauguuuacauuccuaauggcauuauuaagcuaaacugacaaaucagaggaaaaaguugauuggccagcacauuauuauuucugcaccuguuauuacagaaguggaggcucagcauuaaaggagcuggauggaugcuguuuucuuaggcuuccuuugugugauguggggguugggauaaauguguaacaaguguaguuucacuuuguagugccuuuuuguguguugaugugauuaaaagacuacaguguuuuucaugucgcuuugaaauuaauaugcaaauaauaugggauauuagggcuucccucuaccugcugcacuaagcuucccuaagccaaaugggguggggauuggugucaacuuuuuucauacaaguuguuuaguugcaaauaucgccaacguuuuaucucuacucugugaauuuguaagggggggagggaaaugucaaacucauugaaguaggauugaagaucugggaugaaaauacuuuaaauuuuuauuuucuacuuauauaucagccaggauguuaggagaccuugaaaacauuuugaaaaaguuguguaacauuaccaaggcuuugguauaagauuauacuuuucuucugguugaguucuuccuuguauuaaucaugcaauaucauuucucagacacuugagcccggcucuccccuggagcauagguggcaauaauuguuuguuauuauaauucuagaauuucuuggguguucauuguccguaauucauuucacacagagaaaucuaaacuuucuucagccaguagaauaaauaaugccuucccuguccuuuccuuuucuuuuuuaaauuuugaguucuuuaggaaugucauuauagucuuugaaacguaaugacauuaaauuuggauugaaggggaagggagaggaacuuuuauuucaugccauccaguggcuaguuugaguuugcaaagaaauagauacaaugccauuauuuucugcaagauacuaguuaacacuauucucauaucaguuuagacuuuguccuguguaauaauuuaaauuccuagauuuuaauaacacuuaauauguagcauggaucccacuuaaucuccccccggcuucacaacaaaauguuuacauaaaugaacucucaauuuugauaucaacuauuuaacucacucuuuccugaguuaauacuuccauaauuaaacauguuccacaguugccauaggaguguaucuuaaaaaugauguucuucucuguucuuuugagccaucuguuugcuaggucaguaaagaaaugggagccugauuuuauuuuaaagccaauaaguuauuacucuacuauuguauuagacauucagcuucagagggaguaaaagauaaaauuccaucacauuuccacuuucuuacauuugcagcagaaacuuguaugcucaaauugguuauuuucaacucaugacagcugugauauuuaaaaugaucacagcuguugugacuuaaaauugauuuuucuauuaacaccugagaaaaagaccugugccguauuaaaaacuuaaauaagguaacuguaaaauuagauguguugaugugaaucugguaauccuacuucccagagguugcaaagugcagcacaccucuugcaugcuuccagggaaugagcuaaaacugcuagaaauagaugcaugauuguuaaaagcguuuacauuuuaaaggauuccuguaauagcagauccucuuggcccaacuuuacagugucacuuuugcugauaaaaucauuuaggauucaguuuccuuaauuaaccccaagaaagaugacuuacaugaaucauuaugauauccuaaccucuagacuagagaagcugcuuuaccuuucagauaugacauugaaaaaugcaaaaccauacggaauuguuucuuaugaaggaaguuuugguuuuauggugcuuuuccuccauuaucuuuagaugacgaaaaaggaaaaacagaugagaaaggacaaauagaucauggcuaaguagcuuuaggcuagcacuuguuuuuggaaucuuuaauacauuuuuaaucuucauguugaagauccauuuaaccuguuuuaaaguuagauggugauuccuggguucaguuggucuguuuaaauguuuaccuuuucaggauaauccguauuagaaucuugcaucucucaauagauuaccuauuuaacaaaguaaccaauuuaagaaaaccuaaacacauuuauacauuaagauauuuuccuguuucgaguuagaugauguaguauauaaaauauauggcuggccugauguggaauuauguauagacaacagugucuucacagaugcauugccaauagggagcuauguagauuaaacucuuuggccaguccuaggcuuuuuaccuguguaacucaaucagaauugaaagcaugacagguuuuaugaugaugaauguauggcuggauuggagaaaguaugguuggguggguagauagauggauagauuucauaacuagacaguaauagauaaugccaauuauuuauuacucaaacuuguuuauuccucagaaauuuuucugcagaguauuauuuugauuauugcauguaguucagaacauuuaguugaaaaugauaaaauauuugcugucacauaaucaagacugcuauagaguugguucuaaaaguuccagagugaacauacauuaccugugucaaaguuagaggcuaagacuauggagggccauaagaucacaaagucagacuaucacauacuaagugaucaugggugucaauggcuauuuccuuguuuaguugaaagaagauacuccucgagauggacauuguuuauaugaagauuuaagaaaaucaaaguggauauuuguugcugacagacuaagauuacaaacauauaucuuuagaacaggguguuccccaggggacauacggcaauaucuggaaacgcuuuugauugucacaacugugggggucaggcaggagcuugcuacuggcaucuagggcuggaggccagggaugcuacuaaacaucuuaacagcgugcaagacagacccucagaagugcugagguugggaaguccugcuugcaaagugauauaucuggaccuuaagaauuaaauaaugucauaauaaguuccauaauuaaaucuuggcauugugaggcauuuauagaggauaacauuuuuuuguuuuuuuucuuucccuuucuauuucccuuuuccuuuucuuuucuuuccuuuuuucuuuuguuuccaaaacauuguuuuuuguuuguuuguuuuggcauagcacacuauagcauugcccagguauuucuacguuuuaccaugaaaacgugagauuuuauaguguauuaaauauuguacauuauuugugaaccaacuggaauggcuucaaagcagcuguuagaauauguugagucaguaacacaacaugucugcauacccuaaacauauauuugucuuaccuuuuaaaauguuuagaacccucuaucaguguaacuauugguuugucuugaaucauccuaaaugaggaaguguauuaccauuuuuucccuacaggacauaaaguggaaagaagaaauuagcauaaagaaacuaauuaauaauuauguuuuaaguuuuuuggcauuacggacauuguuuacaucaucauuaacaucauaacaucauaucgucuguuaucaagaaaagauuaaaauuuaaagccaacauugaagauguucuuuccagcuuucccaauaaugcaacuccuuuaccuccucacaacuggggaccucucucccugccacugcugcgcuucuccucaauguggauaauucuuggccaugauacggaagugauuuugaaaccucaguugccuucuguagcacccuguggaggaagguggcaggaucugguggcugagucuuacaucugccaacuucuagaccucacuccuuaggugccacauuuuggagcuaguugccaagccucacaguaacuugagccacucuucaauuuccuccccaugauauacaaaguucuccaagguuuaaugagaguagauauggaggcugggcacgggaauggcagcucugauuugcaguauaucuuugguguacagauaugcuuucauuuauugcuuagcccauuagcuaauggaauuucaauuccuucccacaggcauucucagacccugcacuucacucuuccuguuucccuguccagcuugguacaacacauucuaguaaaaucacacugauguguuuagguuuacuuuguacaucacaucuguaaccaucuauaaguuugcccuaaacuggcauuuauuuugaacugucuuccaccuuuuauuguacagcguugucuguacucaaagugagcaacugaaaagaaaauuuuaacauucuuuuugugugccagacaaguaauaaagauuacuauuuuuaugguaauuuuuuuauuugaauauuucuguuucuggaagaugguaauuuuuuuaaaucaugaauuuccuguaagugaaacuauuugagggaguauugaccuuuuuuugaucaaucauugauuaucuguguugcacucucaguauuucucuuauaguccauaugucccucugaauaauuguagaacaauaacuugcuuacacaguguuuuuagaauaugcuucaggaagcuugccugugugguauuuaacucagacauuuauggaguauaaaaccaaucuuacugugacuuuuaauuauuaggaaaguggcuuacaguuaaaauaaagcuuacagaaaauauuguagcaauaauuaauauccaguaaaauacaguuguaagcuucgguucuuucagacauuuucucaacccaguucuaauuugaucguuacugcaccucaguaagauaggugaugcaggagucaucaucccauuucacaggcaaagccuggccuguucagugagguagccacuggccccauguggcuauuaacauucaaaugaaggccaggcacaguggcuuaugccuguaaucccagcacuuugggaagcugaagcgggaggauugccuaagcccaggaguucaagaucaacaugaucaacauugggacacccugucucuagaaaaaguuaaaaaaaaaaaaaaaauuagccaggcaugguagcgcucaucuauagucccagcuacuuaggagauugaggcaggaggaucauugagcccaggaagcugaggcugcagcaagcugugaucaugccacugugcuccagccugggcagcagagcaagacccugucucuaaaauuaaaaauaaugauaauaauaauaauaauaaauaaaugaugucagucaaugagaauuaaauaaaacuuuaaaaagaucacuuccuugguugcacuagccaaguuucaauuacugaguuuucauauaugaucaguggcuacuguauuagcacagauacagaauauuuguaucauuguagaaaguuccauggggaggugcuggccugggaaauggaagcauugagggauuaaaacuugcugaagaucaugugggucaugacagaauagagucauugcugcuauauauuccaauaggauauuuuuacauuuuucuuagcuuuauugucaaauaucugauguaagaauugacauuuuaaugcuaccuuguagcacuuuacugaaugcuuaucucaacugaauuuaaauuuagagcuugaguuacacaaacuuuucaaaggauacagcccuuugccugucugcacacaauggggaccuugaauuuccagccagugauacccuccagaagggaccaugucuuaaugcaucuuuguagaccuuuuggcauauuguagacaaccaagaaauguuuaugcagccuaaugaaugugucacauccaccauacgggcauauguccauacauacaguuagacaagaccuuuggguagaaugcucccgagagagcuggugucugccaaauuuuacagagcucaugccucugcucuugcuguuuuaguaaaaaguaguauuuuaucaaaaguuaaauuggguucaauauucaccauuuggguaauggguacauuagaagcccaguccccagcagcaugcaauauuccauguaacaacaagcacguauaccccuuggaucuaaaauuuuuuaaaaauauguauuuacucacauaauccaaauauuuuucauaguaaaugaaaacgucuguccaucuuguccuuagcagucauuuagucccuaaccugacuuuguguuguuauaaaguugugucacuuaaguaguacuuaaguaaguacauaccuacauccauacuaucuuuccauuuccugcaucacugaguuggacaaaugugcccaguuagcguugguagugcugaagaccauguucauucauacaugcacucaaaaucauauuaauuacuuuucagugauaaccauagguggcaacagaugaaugggcuagcccuaggcuauuauuaagcacugggaaugagauuguuggugccuuguaccugugcuacuuuaacaggugagacaauuccagagcuuuccccaucauccucucguugcuacagucuagacauugggagcacuggaagccuauggugacacagacuggcagaugccuugggcuucuaaugguguauauguaagccaucauuuuguuuguaauaauuaugguguugagaagcauuugugugcugugcacucuuucagcuugugccacguuuaguuccuguuaugcaaauaccacuuuaaacuuagaaauuccaauuugcauuaauauuuugguuucauagagcuaacuauugcauuucacaaacaagugcauuuuaaugaguaccggcagaaugauuuaaaaauguuauuuauuaaauacuauuguagaaaaugcagucuuugguugccagaaacuauuaagacgaaauauaauguguguugaggccacagaguacaccucuucaagaguauuugacccuuauggcuuucagugauacaacagccaaugcucuucaugcaggcuuggagggcagagguaauuaauauaaaauagaagccagcguaccauugacguuuggguuuacuuuuaaaauguaaacauauuuuuacuauuugacauuugucauaagaccauaggucauuuaccucugaguuaaggugaaggacuuuaccagucauaaacacccaaguuuuaaagcaguguuuucuuauaucuuacaucuugauguuaaauccugaaauggaguuuguugcugcuuuauaauuuuuuucccucuuccuaaaagccuuuuuuuaaaucagaauuguggauaaaaaaauuuugauguacaaugugugggaaaauaaaaauuuugcaacuggauuuucagaaaugaacuauuuuaacacauggacuuugaaugcugcugucaugguugucauagcuugugguuccuaauuauaaugagcuuuuuuggugguguuauugcaguuguuuuauucccccugcccccacccagucuucaacucacuuuucccagaaggagaguuccaagccuuugaaaauucucaugauuuugcaaauccacucuauuuuugucuagaauacaggaaaguuaaaacuguggcugguaugaugccauguuuugaauccaauuuuaaagcaacccuuugcaacccagggaguaaagcugacaucuuuguaucuguaaugaagauaauuauaccugcaaggugacaucacuagcaaaguaacaaauacccuugaaaacggaguuccuggucuucucugaauucuguagaccacauuuggcauuuaacaccagacaccucuuucaugccugucguuugagaaguugcuuucagaugaauuuacuaaagcugacugacacaggguuaaauuaauucuuuucuuuauuacucaaagugauacagaccuuucuuggacuaauguagcuuaauuaguggucaauuaaaacugaacauugcugaauugaaguucuuugaucaaacucccuggcaugggcuugcuuucuuuaacuagccaccaucuugaauucauuuggaaucaguaguauaaacaaguuaaaaacugguucuuuuauaagaaagucagcaggcuuguauagcugugguuucuuuuuuuacuucuguaggcggcaauucaaaggcaugcuaaaugaaaacaguacuacacccugaaaaaauuacauuuuuaaaaguaacacuaagcagucagaaaacagucaacacccuuaccuguuuauucuagauacauuuaucuucuauguagaacaaauaauuaauaauucacuucccaauuucagugguugauuuuguuguuacauggaaggugaaaacuccccacccucccuugcaaagucuauaguuauaacaaaaagugaagcaaacaaaauccaaccugguuguugggaguagagucggaaggggcacgguaaaugaaggugugcccaguugcuccuaaauucauucuuugucacucuugggaaaauaguucaccucuguaucuuuggagugggagugacacacuacuucauuuacuuauugauuucaucauuuauuuugaagggcauuauccuaucaguauggaaacugauaauagcauauauuucauaugaaucacuugauuaaaaauacacauugcuuuuguuagaauuugggugaaguuacaaaaaaagagaauuaggggagcugaaaacuggggcagaggaaaucguaagcauugguaauaagaucacccaccuccauuuauccaguuacaugucuuaauauuuaaaguguauauaccauucuugucuaaacauaaauugauaccauuccguaauccuaguuuuugaaagcuuaacaaccaaaaacauacauccuagcuggcauucaguuagugcugugcauucuggaguauuaauugaaacugguacuuuuguacuggaaauaaaaguaauagauuagguuuaaauagauaauuugcuuaguucauagugauuucuucugguuuuuggaaauuuucacagagaaagaguuaaaggaaauuuggaagugaccauguacaguguucccccuguaagugacagaauuuuugugguuuucauuacuuagaucgaaaaauuguaguuauaaucaauaauuaaaauuaaaaauuuuaccaguugacagaaagagaaauuguuuauagucaaugugccuuucagccuucucucuugccuucucccuaaaaggcugauuaggauguaauaauuggggaugauagcgggaggaagacgacaauuccauuuaauuaaagauaauuuauuuuacuucaaauuggugaugucccacaugaauaagaguagcuuuagcagauagauuuauuaauggguacugacaucucaguugacagaaaaagcaaacauuuucuuuccucauuguuuuuauugugucccgucaccugaaacugcugucaccaugcuuccuuugcugcuugacagagcuguagacuuuuccaccaaauaugcaauuauugguuuaucauugaaacaaaguugauccucuucugaguuaaaaacuaggccaggagcuugaaaggcgguucaggcuuucagagcuaaugcuacaaaugcucucuucuuaaaucacauuuucucaacugauccuucccauaucuaguucaugaguagauugaaccuuuugaauaaggaccaaagauuuccuuuggucuugggugaggugcuugcaugaauauuccuuuaauaccuugaaugucuuggauaaugaaaugugccccaaaaaacuaccauuugcauuacuuagguucauuccugacaaggaauucugcccucgugugauauguucguuguugucucaugcaaucguaaauggaucuuggaaguugggacaguuuuuuuuaauuaggaaguagauucaagaaaugcaugauauuguuuuucauauaaucuccucagucuauagugguuguaaaggugugcuguuuagcauaccuuuagcaaaacuguauuuauaauucuauguaucuuaaggcacuuuuuaaaugcuucugacaaacugcauucuguuuuuccaaugucuauuugaucucuguuacauuaggcuuauuugucuuacucucacaucgaauuccuauauuuuuguuuauguuuucugguguucagucauuucuguaugcuugccuaguauguuucuuucauaccgucuucuucacugaaugaaaugcagaccaccuuggccacuuccuuccuucugggcuucuuuuccuauucacaacuuccgccauucacacugacccucuagcuuuacuuauaucuauugcuccugcugcuuuguugcucuaauuuucauauauauuuccuuuaugcuaauauccuuuccuuaacucuuuggauuucacugguuugucuuuccagcuuuauuuagaaaauuaggccauauaacuaauguuuacaccguagaaaggaaaaugagauucuuucuuucuuuuuuggaagugaagaggugagaagguugugguagagguuuucuuuuauuuuaaaccagauggauuuauuuuguccugcuuugcuauuucacuauuucaaauugauuuuaaaucagugaugguguuuucaaggauuaauuuuuauuaaaucuugauuuucaugucguguuaaccuuuuccuuccccucagccaaagggucuucuuccuuuuuucuguccauuucacuuguuuguuuuaauaaccugaucucuccagccauuauuuuauccucaaauccugccacuuuuauccaucuuuuuuuauugcacuguuguccuuacuucaccuuauaucuuuucuucuucuguaauuauuacagaauccaugauaccuucuccaaaauucuaacaaagaauucuggaaaaggagaaauugggaaagagaaaaauugcaaguaauguucuuugcugagcccuaggaagucugcuuggauuuuuauauucgacugauauuccucccuagaguugcagucaugauucuauguaguagggacacgaaggcaaaaguuuaaauagacuaacacugacccuuaauuggaggugauaauccuacauauaaacuuucaggagggaaagcgauccugcauuuuacaucagguaaacucaguugcacccauugccaguagcugggucagguguguagggguguguguguguguguguguguguguguguguguguguguguacguacugggagccagguuggaaguaggaagagaaggagguucuucuuuccucucccacuugcaagcuauuuucuuucuuuucugucuguuuucauuauuucuauggcaaguuuacuugccacgucuuaaacaccuucaaccuuuuugucucuuccuuuacuuuuuugcuuuacugcuaucaaagaguuaaggaaguccauuaaauuggaggccauuccucaccauaagagaaaucuggaugggaugcuuuugacaacugggcucucuuuaguagcuucucucuacuugggaaaaugucagauauuuugagaaauaaaugcauugccccaaacugaaaacaccacuuuuauucuguaaaagaggcauucagggaaggagaccuccucuauucccaggaggucacaggaacugggaguggcaagaaggaagcugcuaaacgggcuccagaugcagcuuuauccaggggacgccucaugccuggucauuuggguggcugggcuugucccaccuccccuucuucaugcccuccucccggucucauccuaggcccucccaccccuaggccagccacaggccucacagcggacaucugcgggucugaguuucauauauccagcaugaaguucccucucucccucccauuaugaauucugggcugugguccugcuugcuccuugugugucagauugaaguucugaugcugucagccaugucugaccaaucagcaaacaacaccacaggaugaaauuuaaacaaugcagaugcucagauacagggcuauguugccuggaccacgaagggaaagcagagguaaggucagagucuccccaaaguggucuauccugagccugccugacuugacaccucuugggcugcacugugcugcuuugacuuguauguuacccauuugcuuugcacuacuucugucuucccuggcauucaccagaacuuucauuuuaauucgcucugcccggguuacuuuaccaccuucaucugcucacguccuuuucuuuuggauuggugcugacugucauuacgaauguuccuggauugccucguggccgaggguccuuggcaagugccaccuuguucaggucuuuuguggccagacuuuuaggaauagaggacugcugaggaucagggcaaacggacggaguuaauaggccuuauuaauuuucccucugcaggacaguggaauuuaucauucgguuacaaccacgguuuuguuucuuaccauugugauguauugaauuguaaauugagcuuaaaucaucuuuuuuucucagaaacgguuuacuuagaaaagauauaaauagauacaaccuaaacgaggaugaaucagcucaucuuccaagaguuuuggagggggagaaagggaauugauaacucucccccacccgaauccccccccacuuuuuuuuuuuuuuuuuuuuuuuuacaguuuuugguguuagcucacuagauuacuguuugcaaaagaagaaucucaucaucauccucuucuguuuuaaguguuuacuuggcccuuuuauaauuuaaaguguuuacacgguucugugcucccuaggcccaucuggaaaauauuuaaacuucauaagaucuauaagacuagaauaucacauauaaugggauagggggaaggaagaaaaauuagagccguugcguguguuuagaauaaguuaguuguuuguucagaagcggcugcuggaggaauuggaacaaauagcugugugcggugaacgauuggguccagagcuguacauuucaccacagaaugagccuugguuugugaaacugacauucuguugugacuucuaaauccaaacaaaucucugcaaauuucugcccgaucgaguuaauaagaaaauauauacaugcagaggcgagagccguaugcuacuuguacuucugucaguguugguggaaauaagagacggauuuuaccuacuguauuacauucaaccagcaauuggcagaacccccagcucagcggguuuucuugacuuuuuuuucugcugugagaacaaugggaugcaaaagggcuucagaaaaggagagcagcagauacgggauuggggucacuuuucuucuaauugccuuguaauuggggagugguuuccacuuucccacuaucucacuggugggaggggaggaagacagauguggcuuagcgguaacgagcuuucuccaggccggaugugcugagggaccaggggggucauucccugcucugggccugugaucugcuucacaccugugcucauuuucccccaugaucgaugaccuuguauuaacccagagugaccuuuugccuucgccuguucucugggacgagcucuuggcuaguggacccuccuuucucucugauuuacaggugguuacuggagccacauacacuuguuuuucauggugcacugugcacuuagcagcccggcaagaccugcaauuucaucccucucaaggggccaagcaggggauuggaaggugggagggaggagggugccgcgagagugguugcuguuugcaugugcuuuucuauuuuguggcucauaugguaucaauuaccauuugauggcaacgccaggccugaggcccuucgcauguuuguccugugagaaagaucuggaagaaccgacauaugguuuugauugcagcaauugcagguugauagaaugaacgcaggggugagguggguggguuuuccuuccggcccuuuccacucuggguugcuaaugugcuucgcuuguggaacuggucuuuucaucauccagccccucccccacuuaccccucccccacccccaacucccugccacuuugcauucccugccccugccuuccaaaugaccgccaggaacauguggcccacauuaaggaccuucaauuaaaacaaacaaaaaauuguccacucuucuguucagucccagagcaggucaguccaucaagaugguuggaaguguaccacaguuaagaaacaaaugguuggcauagggggcagauucccuccagaagcuugggacauguuuuaaaauggcuguuaguucagauuguuaaacaucgaaaugaugcugaaaaauagcagcaauagagauuaaugugggguguguguguguguguguguguguguauaucuguauguguguguauuucauuuaagacaccucuuggaaucugugcaucugcugcauagggacaggaagaugaugauaauggauaggaguucuuugggguuccaucuuucuguacaucccaggccauaagaugauggaaaagcaagugaggcaugugugucucuaugagcauuucccuucagaaggaagauguuggagacucaucucccaugcacagugacuucucucuuacuaaauuugugaugguaggggguacuccucauuacuguggcucagcagggauugcaucugugaauaugccaagggagggucuacuauuggggaauggugagaggcaaagaggagaaaagaacauuauaggcacuuugaauguuacccagcaacauuuuuuuuguuguuucaaaguaacaucuuucuauaaugcuuucaaauuuaccugucugguaaucuguucuaagaugggcagcccaugagguuuugacuuuuuucacuuuggcuauugcauuucaaaauauuacucacaauuaggaauuuauaccauuugaaacaauaaugugguaucucaugaguaaaugcugccauuaacaucuuccuucuuuuaaacugaaaacaagcaaaccagacccaaaaaaaaaaaaaaaaaagcagaaacaugcucccccaagaaagcuuguuuuuuucuuugagauggagucucgcucuguugcccagguuggagugcaauggugcgaucucgacucacugcaaccuccaccucccagguucaagcgauucuccugucucagccucccaaguagcuaggauuacagguguccaccaccacaccuggcuaauuuuuuguauuuuuaguagagaugagguuucaccauguuggccaggcugguuucaaacuccugaccucaagugauccgcccaccucggccucccaaagugcugggauuauaggcgugagccaccacaccuggccaagaaaguuuuuuaaaugugagaugaauuuuuaguuuugaaggccagcuauugaaaccuaaucacacugcuugacauacuucuucauauuuaucuuuauauuagagcugaucuuuaucaaaagguaguagaaacuaaaaaacuuaaguuauugaccuaaauuguagggaaaugucugucugaucgacucuagagagaaaauuggccguaucuuuauaaugguuacugaauguauaucuucaugaggcuacaguuuuuuuuucuuugcuccaacuuucuccuuaugauguagagauugguguauuaaauaaucacuuuuucaacagucuugaugacaauuuuauuuugcuauuucauaaucuucauacaaugggauaaguguuuucagagauacguuugaauucagagcaacuggcaauuaagugauuugcucuagucacauguuuuaguaguagcuauuugguuauuugccugauauuuaaugcacacauauguacccuuaaaucaucauucagugugauagcuuaagacaacauuucuguuugcugcucaugccacuauuagcuacguuugaagagugauauacugagaaguuuaauuugcugggguuuuuuucuaaaaacauugcuuuccugaaauauauaguauugggggcucauagcaaaaaaaccguaguauauggguugugagccugucuucgaacauggugggucacuuaacagcagcugugcuggagagauauuugauuugagaagacuguuuugaaucuucucagcccuaacaccauucugguuuugaaaugggaaaauggaaaagaguuuuagggaauagagauaucucagccuugaaaggaagcauagguagaaaucuuucaguucucacucagaugaaccagcauuccuaaucuggcuacccucacagaggacaaagagucugcugggaaauguggguuuauauuuguagagacacacuucagaggcaugagauaguguuagauaccgacuggaugcuucgugcccaacaucaauuugguuugcagauugaaauuuaggaaagcuugcagaggagccaaucuuuuuuauauacagcaccuuuaaaaaaaagacuguccacuacuauuaaaaucugauucagucuucuaaaauauuacuacauucaagacaacuuuuaaaaugaucaaauuuagauagacaucaaugauguuaaaagauaaaagcccuccuacauguaauauauagugucuuaaaccuuauuuuuuaaaaaagggauaccacuuuugccaaaaguuucaauguagggauacucaaacuguccuuggaaguccuaaaaauugcuaguuuuuuuuuuguuugcuucuuuuuuuguuguuuuuguuuuuuguuuguaguuauucacaaauggagaaauauuuauaaaauuauauuauaauuuguaaugcacgcaaacaaccaucagaccacacuugaaucagagaguuacaguuauaaauugaggaaagaggaugccagcacaaugccuaauggagugaaaaauugugcuuauuuucacaggacucucuuggagaggagcuaacuacuuuccucucucuuaauacccagacccucucccucagcccugacagcacguuacagaaugcauucacuuagugugugaagagcuagcucaccaccucccuuuaagaucuauucuuguuauucauacauugcaaauuuguacuuuuguauccacaaggaagacauuacuaacuucaagaaaggcagugucaaugaggagcaggaaaauacaguaugauacaagccugccaaugaaagaauuauacucagacucuaugcgcucuguuaaacaaaauuugaaccuuugaggaaaaaauauuggggauucugaugaguguuuuuacucuuucuuuccuuuuuuuuuuuuuuucuauuuggaaaucauggcuuccugauccuaagggauaaaaaaaaaaaaaaaaaaaaaaaccucaaagaaaagacucaacaggcuuucuggacaucaaauaguuccuacaaaacaacauucugaugacuugcauguaaagaaaucagaaacauaugaauuaagcuucucucgaaauacauauggguugaaaaauagagagaagugcugagaaaauguguuuuggguuuugcugagcccaugacguuugaaaaauaguaugagacauugaacaaacacaaagcauggcuuggcucacccauuccuaauauuagccuucuaguucaacggcaaaucaguuuaccaugugccuaaaugugagccaccuuggugcacucccccacacuuaauuauaugcaguuuaaauuuuuucaauuaggagcucaaaaauaacauugcauuucaaggaaaugcaaaucuuagcauuuucuuaccugguuuguucaccucagaccauuuuagaaaacaccacagauuauuucaccuuaggagcagucacacugauguggcccucuuugauguggcuggcauauaacagaagaaacguaucauuuuuaagaaacuggcuccaaagacaauauugcuauuaaauugaagccaaaaaccacugcagguaaaacaugaugaagaugaaggacgcccucucuuagccauauaguagaagcccgaucauagacucucacccuuacaccaugacuugaguuccugcucauuuuuaucccugagcucugcagacuucuaagcaguggaaguuuucauucucuuucccacauugcacucaagagagcuaacaugagagauucuaaauccugggauuccucugcaucuggcuuuaaguacaggagcagaacacagggaauuuaaggaacaaaaauagccagagcuucaggcuucuuccacugaugguaagucauugacaugcacuuggaugaaauccuguaucuguucuuuggacuagcacuaucgccugagauuaucaguuucagagaguuacagagaggcaguagauuucaucuuuccuauuucaggaggaguuauuuugguuguuuaaaaaaaaaaaaaacacuuuaauguacuuuuccuaacuccuucacucagaugguggcaagaaguuugacagaauaaaguaauucagcuaauauuuaucaaaugccuacuaugagugagcuguuagaauauaacccugaacaagacaagcaugagauaggcaaacagacuauuaaaaccuagacugauaaugcauugauugggguguacaggcuccuuaagguagauauacaaaggacaacuaguccacauuuggccuuagaggaagugaagugcaaggaugaaugggaauuaagcuggcaaaaugcaaggguuauaacuggaagcaggggugagcauggcauauccggugacccagaaguaguucagaaugccagaagcuuaugguacaaaaggauaacauaaaagaugagacugaaaagguaaacaguggccugaucaaaaagcgacuugugagcccuauuaaggaguugagauuuuaucaugaaugugacgaggagccuuucaaauggguaugccugagaaguaauugaauuuaaaagucaagacggauaggaggaccuggaaaacuuagagucagagaagccaagggaggcagaucugaccagaaggaggaaauugucaacagugucagauguugcugaaagauagaagugacauuuggcugcagcauccaggaggucuugagcaguuucauugaaguagugaguguggaaggaagguaaagaaguggagaacaggcauugcaagauaauuuuccaucaucgucaucaucaucguccucaucaccggaaaaugagcaucaauuaucuuaucuaccagacauagagagugaccagguaaggaaugacacaccugcagccugggagauuucagaaaacagaucauaaauauaaaacagaagacagcaacacaugguacaacacaugcaaagggcaaaaugagcaguguaggccaacgggaugaagaacagaaagaauuagggggcaggugaaaugggagaguuuuucaagcagucagugcgcuugagguuugcauucuggauugugccuccuuauaagucaguccaaccuguuuuugauucuccauccaguggaaauaggaaacaccaucaaagaugaugcauagucuuaacuugccugugacuucugauuauguuuccgaauuuugggaggaagauuaaagucauaaacugacucuugguuuguuauaauuucuugcaacuguuauuuuaaaaauccggacacaggccaaggcaggaggauucucugaggccaggaguuugagaccagccugggcaacauagugagacccugucccuacaauaauaaaaguaaaauaaaaagaaaaucuggaugcagaaacugagguguagauaaauauagcaagucagagauauucguaaauucuacaucgaugaguuucuugagaaauucugcacacccagugcuggacaacuguggaauugcagcgugauaccuuucacaucugggucaucuccauaugauaucuucuuccugguacaaggccagaaguucaccccacgcacaacaccuauggaagccacuuacgauucaaaggacaguuuuucugaaaaagggugcaugauguauacuucccuucaacacuaaaauucugcugcuuaaacuuuguaagugaaggaaaggacugguucucuucuacuuuggcugucuuccuuguuuccuauuuauugggugcuugcuuugggcaacccauuguauuggaugugcucuaaaccacaaucuuugcuccuaaggaguccguaguauuuaucgggggauacgaccuggauaauucauauaagauaugaauuucuuucuuuuucuuuuuuuucuuuuuuuuugagacagauucucacucugucgcccaggcuggagugcaguggcgcgaucacggcucacugcaaccuccgucuccuggguucaagcaauucucaugccucagccccccaaguagcugggauuacaggcacccaccaccauacucagcuaauuuuuguauuuuuaguagagauggaguuucaccguguuggccaggcuggucuugaauuccugaccucaagugauccgcccaccucggccucccaaaguccugggauuacaggcgugaaccacaaugccuggccaagauaugaauucuaaaaaaaaaaaaaaaaaaaaaaaaaaaaaaaaguccuuggaaaguuuagaagaugaaauacauuuaaugaaaauugagcucauucuuccccaauauuuguuccauauuccucuccauauuauacuauuaguacacaauccuguuuggacuuacuggaaaaaagagcugaauagcuuauccacaugucaagaaacuuucuguuuaagaacacugagguucaucaacaucaaaaaauauuuucagcaucauucaggcacuggacaugcucuacaaauuaaauaccuuagggccccuacuauuucaguguuuucucagugucuuguugcaguggcaaaugcuaugaacuacauuuuucaaaugaauauugaagauugagaaagagguuaagaaccucuaucuauuaacgauagaaccaaaucuagaaagaugucuccugcucuguagagcacauuagggaucauuauuuauagccauuuggcucucuuaagacauuuuggcaaugagggaaaaaucauagguugauuuucuugguggaaugaagaacauugaguuugcuaacaaagagagcaugagugacuuugguaagagagcaguuuuuauuucaguggaaaggcagccuccucuccuaauaauagcuacauuauuuaccuaaauguuccauguagcaacugauaacaaggcuuacugcuuaagaaauuuggccaucaucuuguccucucuacuagaauuccaucugccuacagaugggcccuugcuaauauuuuuuuucugaaggacaacauguaacuuaagggcccacuacuguguguuauuuuguuuuuuuaauugaggugaaagucacauaauguaaaauuaaccauuuugaaguaaaccauucaguaauauuuaguacauucacaauguugagcagucaccacaucugucuaguucuaaaacauuuuccccagcccagaaggaaacucuguauccauuaagcaguuccuuccuaucccccuacuucuaggcuuuauaaaccuuuaauuuuaauguuauauacacacacaggcauacacauacauauaugcuauacacacauauguauguauauauguauaauguguguaaauaauguguaaauauagacguauaaagauguauaauguggguaaauaaauggauguguguauguguauauacauauauguacauguauacauauauacguauauauguauacauauauguaucuacgcacauguauauacguguauacacacacacacacacauucaugucuauuuauagauuaggaaguuccaaacagaggaccuaauauuuccuaauuauguaaacaaagaacuaucuacuuuaaugaauguuucuccaccaggaaaaagaaaaauaggaaacauuccuugcuucuuuuaaccugucuguauauuucucuuaaauucucacuagaugcuaauuuaucaaggaagacaaaaaagacagaaauaauccugagccuuuuguuguguaaaacugcugcucuucuuguaaagacauuuucucauuaauuucaucaacacugagaauuuuaaacugcuucucaauuuuaagcaauuguauggguuuuacauuucuauuuuugaaaauccaaaauuauugaacaaaguaauuuaguuagcaaaguuuacauuucuuggaaagaaauaugaaagggucauucuuacuauaauuuuuauuguuaaagaaauugcuguuguucacauguauuuaugcccuccucauuccggaagaauauuugagguagccaguagcacauuuuuuugaauuaagaaaaaauuagaucaaaugaaaaaauaccuaaaauuuaaauauuuagagaaagccaacucaauuauauuuuaaauaugccugaagucgugaacuaacuaauguugaucauuuagucuucugguccuaucucaggaauauuauugcccuucuuaauucaucuuucaccuccuuuaagaaguauuucugaauaacccuauaggauaacuuccuuuacauuucuuuagcucauaugguuuauacaaaaggcuacucacuuuaucacauuuucuaguugcuuauuguacuucauaaaucucccaacuaguuccuagugaaaauucugcccuucuaauuuuuuguauguaauuuaccaaagcaccuagcuuugugcuagcuaaaagcucugcucugaguuaaauuagugaaauauugcugguugauuucaccuaaaaguuugccccgggcaggagggaagagggugggcauuugaauggguaacagacagagaagcagcugauuggacauagauguugacaacuugcauacuuauuuuuuucauuucaaucugugccacagagucauacauuugguaauuauuucaugcuuuuguuuucaguugaaaguaguuagggccauauguuuugacagaaaaaagauaauucguacuuuuuuucagcuuuaugaaagggaagaugggguaacaauuuuacaguguaccauggcagugauuccuguucaaaacuuuaccagauuggaaacucacuguucauaacaauucucuugguaagcagaagaugaaggcaucuguuuaaagcacccagaguuaaguuugaugcuucaaagcacagcagaguucauuuauaacucuacuuagcacuauuagauaucuuuaacaaauaugaaaaguuguccaccagauuccuuagacuguaggugauuuggaaggauauucuggucaagugcuaacuucugacugaggauuucaaaugaaaagaccuagguuauaaccccauuccugcccuuacucugucuugugacucauggaaaaggaaggcacuuaacccgcuccaagcuuauguuccugaauguauaagauggguagcaugguugaccacuuagacagauaauccaucucaaaaugaugauuaaagaagauaauggaugagaaaaguccuuuugauuuaaaauacuaugaagaugugaacuuuuaauaaugacuaaugauagaauuuugucaaauuugcuuuacguaauuaaguucaagaucaaagaauauaucuagagaaguaccuauguauuuugugaaauguuucuuugaguauuauuauuaucauuuuaugucuguuagaaucuuggccucacugucuuuucauucuugcuugaaugucgacucuucaaagugugacuuucugcuugugucugaugcaacuuucuuccugaucgcucuugcuuccugagaaggaauagguacuuaggaaugauggcuuuuuggcugucugugcuuauuagguacaaacacagcacuaaagacauuugggacuggagaaauaagaagagcgccuuuaggguuguaugcaaaaggucaaacuauaauguaguuagcauuuuucuuuguacugcuuucccuucuuguaacaaccucucaauacccucauaccuucucugcuuuccagaaaugcuuucuaaaaauugauuauugggaaaagaucugagaccucauugcccugaaguguaauuacugcugacaaacugugacagcauuucccaaagacagggagugauuggagaugugaugaaaaguggguuugugacuguggaaacucuuucagggauguaggcuuuuaccccucuugguaauguaccuugacaaaagucugcagcaaugaaauuaacuuguucacuccaaucgcaucuaaaguuauuugagcuuaaguccuuucuuaaggaugucagcuuuaggcuucaggcaucaaccuguggacuagaauucaaagggaaaaggguagggaauggugcucuuaaaaucuuuaggaccauuauagguaauuccauauccuaaagaaagcucagcccuaaacacauuagagaaguggaaugcacuaaaauauauuuuggcagaaccaaugaauguuuaucuuucucuguguuaugauguuauucuuaguuugacguguaucccaugugugguguguuuauucauucaugcaugcaugcacuuaguaaaguuuugagccuauucugugcccggcauuacaugcacacacacauauguccaagcacaccugcacauuuuuuuuuuuuugguaaugccuuuuuuaccuuauuguuucugcaacuggcuauccuuagcaggccuucuuaauguacaauaggguauagaagaaauaacaaucaacauuggaguaaaccuaaaauuaauuucugucuuuauuguagagucauagaauuuguuuuccucuggaagaugugcugcccucauuuaauugauaaaacagugcuuucagaggucacaaagcuauuuuuuggcagauauaaccaaaccuauuuugauguuccagcaccuccuaaugaagcaguagucgucaucuaaaacaaaaagcagucgguugcuaaaggaggagaaaguguugagaugugagaugaucuguuagacauaauugacaaucaugaauuugauaugauagguguaaacagagauagaaauaauuuaguuacaucuguuuaagauuuaagauaaccagaagcaauaauguuuaauugaaauaauauaucagguucuccuuaacauuaccuugaauuucuucacaugcacaucaaugcauuugguaaauaaaaguuuggaaacaacuuaguuaaguguuuagaacauauuagaguugugaugugcuuagcauccgcagucuuuuaucugugccaacccugagccugguaaugaagccaacucccacaugaauaaguaacauaaggaguguaaccaggaagaagucaggguuucaccuggaccaaauuuuaggcaauuaaguguuucaagagaucuuuagccagguguaacuuaaucaguuuaaggcacucucagcuagggccaagguacucauaauguuggcagugggcauucgucugauacaccacguugaaaguaauaggaaacauagagugucugcucaguuauugccaagagcaagagaaaugcagguguaaaaauauaaagaaguauuuggagccagaggcuaguacacauagacaagacuguauuuacacuuggcuuuaauaguucagauaauaacauggugguuuuuaaucaguuuagugugcugauauuuagucgugggucugguuucaccacuaaacccuaguguaacucucagccgguuacuuagccucucucugucucuaguaauauuaaacaaguguauuaauaccugcugcaucuuagcucaacuucaugucuggaagacagaugaaugguccugcuucuugcaguaacacacaagaaccuccuuugugcugcccugacugagaugaucuuguguucuucucuacgggcaaaacagcccuaggcugcuaaauggccaggcaguauaggggacuuaggacucuacaaagcuggguuuugguaggaguccaugagcaccgcggagagaauucuuaguuaucaggagauacgguuguaguacuuaaaaacucaaacuccaaaacaagacuacgugguuuugaaucucaguuuugccaguuuauuagcugugugacuuuaagcaaguugcuuaaccucucugugccucagaucccuuagccauaaaauugggaugaucaugcaacaauaggauuaguauguaagcaaaaugaguauauguacaguuuggcugcaauagagcugauagguguaaacagauauaaauaaugacuucuuuucugaaaaugacuucuuuucuguuuuucucguuggugaucccugcuuaugucacugggauggcugcgggaauucaguaggauaauauuggaaaauagcuuaaaucucaaauguucuauagcuaugauaacaucacuaugacgucauagcagagugaguccacucacaucucuccuggcaguuuugcugccucagaguuggaauaauaacucacugaaaauacuuccaaaauagugagccacucugcagauuuaauuuguaauauuauucuuucuaauuauuaguggcucugucuuaaguuccuuuguuuuaauugaagcaggguuuuuuuucccccuuguaaauuucuauacaugucaaaggcuaccaacucauuuuuauuuagaguuugaaauuugauuugaaaaauauacugcagccagcuauaugaaaaacauaagaggauauuguugacuuuugaugaagggaagaaagaacaagguagagcugccuagccaugaagaacgccaggguuuuuguaaccccuggugugcuuugcacgcagaaggcacacacuuaaauuggcauggcucacuuuuuuuacugugccuuugcugagcuugcugcaggcugagugcacugguagaggagugcagggcuguguucuggccaucccugccugcucaggccucuccugcuccuuuguggaucgcccaggucucugcugcuuccuggugccgucuccuggauccucuugacauuuuuccguucuguaauuugauugacaguuacagacaaggaaggggacugaaauucuuaccguuuugugacuuccuaaaacgggaaaggaaauuuggugaaugagaaggggaaaacgccucuuggcugaaauuauuuacaggauuuagccccagguuuaauguacucaugaaugaauaaugacucagcugauauuuagaagccgggaaaauuaugcgauuuuugugaugggguguauagauauggauguauacuugaagugguuuguguucuaaauauauuaacaugcucagggaauuucuuuuuggggaaauacauauauucuuuuucauagauuuuuguggugcauucugguagacggaagaugggucauugcucaguuaguaaaaaugaaauaugaauaucauacacauaagugguacauuuuacacuuuuugauaguugugaaauacucuuuuuuuuucagacuaccaauaaagagaauuugaggaguaaaacucuucuuaccaugaauuguuuuggggcacuuagaacuauuuaguuaauucuuuuaaauacuccaacugauuuagauagaauaaaagugucacaauuuuaacagcuuacaccagugaaauguuuccacuuauaagaaauacccucuuauuugucagcauacugaagacauauauguguuauuucuaagcacauuuccuauuuaugugauaauggagaucgcccuuuaaccaucacuuggacgugaaggaggauucuucuuccuccauuaguaaauauuccuugacuugauaauacugaaaauaugugaggugaaugagcuuuaauccugugguuugguuugguuuuugguuguuugcagucuuggacuguucaccugcacugucuugugccuuugaguaugauuaacugccuugacgccuuacagugcauuacacaacucuacuucuuccauuucuugacuaaucucucaugcuguuugacugcccauuggaaucuuuaaguuagcuacuuaggaaagacuuuaggaaggagaaugcuaagagaacuggcagagaagucaggagccugggcucuguccaggcccuggcguaaguccuuucaccucuuccuuugacuccuuuacaaaaugaaguugaacucauucgagcuuuaaaaagaugacgccaagaggcaagacagagggcaguagaugugaaaguaacaugaaagagaaaggaacaucugaaaaaaaaaaaaagguagaaaaagauuuugacaaauaguacuaaaaacaaagaauauagaauagagagacccaauuauacugauaauuacaauuaucaguauuguaaaaacuacagcaaaaaagcuaaaaacauauucagcuuuuauuguccauaaaaagugaucacaccaugucuaacuguaauucguuugucaaaaacacuagaggccaaggacuaaauugcggauuaagaguuucuuccuuuuauuuccugcauauccagaaaccuggggucauagauacucuuccaugguguguuguuuggcacaacuugcaaguauuuuggcagaugguuagaaaaaaagacuuuaagaaauaugcaauaguacucaggacucuaaauauaauaaauaaagcuaagauaccaguauccugccauucauuacaaucaacauuuauugaacagcaguuauaugccagguagcagggauaccuagaacuugccccucccacuagcacuccagaagaguuccugcuuucccagccuaaagcaacagcaagucuuacaugagcuaggcuuacugugauagcuguccugacggcgaguggcaaacauggcccagugccuuccucauggaugaacaugacucuacacugggacuccccgguagaccuuuuugugaugaugagaaaguccuguguuggugauguucaguaugguaacuagugacuguaugugcuguugagaacuugaaauauggcuacugugacugagggacagaacauuuaauuuuauuuaacuuugguugaguuuaauucaaauaacuacauauuacuaauggcuacugauuggacagcagcuuucuagacccauuguuaaaaauaauuauaagcaaugaguaccucuuaugagauagaauuaauaaucccauuuauugagggcccaugacagauuaagaauuauguuugacauauauuaucccuaauccucacaagaaugguucauuugacaaauaagauaacugaaguucugagagauaaauugcuuuguuauguccucgcaaggaauugugagagcuggaauuugaaccuaauuggucagacuccagagcugggugauuucuaguaaucugccaaaucuguguauguacuguccggaugcugugucuucugaguacaucuucuccuugcuuuauggauuaguuagcaaugucuuuaucuuggucacauaggacaguuacaggguccaucuuaucucuucugaauauggacguaucacugcacuggaaccauucauuuuucuuacugaggccuauguccuucaaaaaauauuaagaguugaggguccaacccagcuucuugaguaguaagcuaaucaccuacaaguauauuuccccaguagaugcugagagaagcaucaaaguacauggguaguucuguggacaucaguggcacucaguaaacucuuggcauuugaguguuuaacugucacaguugaggauaucugugaacucucccaaggccugagucacugaaugagcccagccaguacuugggcgucuguggcuccauucugcuuugcuguuuucugcuuuccauggaacauacaguaacucucuugaagggucugaaagccucaauuacaacguuucagugauucugaacugauuuuucuuuggaaaguauauaugcagaugguacuugcagaaucaccaggggguaguaacguggaggagugguaaaggucuacuggacaaucagguggcuaccacccaaccacacauggugaugugauaugaagccacuuuucuuuauuccuucagauuuaagguuuccccuucaggaagcagguuacuuaacaaguacuugauuucaccauaacaugcauuaugacauuaucuuuuuuucuuuuuucuuuuuuuuuuuugagacggaaucuugcccugucgcccaggcuggagugcaauggcacgaucucggcucacugcaaccuccuucucccagguucaagcaauucuccugccucagccuccugaguagcugggauuacaggugcaugccgccacaccuggcuaauuuuuuguaucuuugguggagaugggguuucaccauguuggccaggcuggucucgaacuccugacuucguuauccacccaccucaaccucccaaagugcugggauuacacgcaugagccaccguuccuggccgauauuuuauuuucuuaaaaggucauuaucagaugccacaagaguauuucuauaaacuaugacccaaguauagccuaauguuaauagcuuaaaauagguuuuauuuaccuuuuuugcccuuuaaaagcaaggaauuauuuuuuaauggaaagaacauagacuuugaugaucaguucacauccuugcuuuaccccuugaaaaaugugcaaccuggaaagacagcuuaacauuccugagucacauuuguccaaauaauacaaacaauggcaacaagacuucagcacuaaugucugauguuuuuuguaugauuaaucugugccagguuccauucuaguuucuuuacacacauuauaccaucuaauucucacaacaacuuugcauagcaggcauugucauuuccacuuuacaagcaggaaucugaggaccagaguuaaaaguaacugguccaagauugccuaguuaauaaaugguggaauuugcagucagacccaagcugguuugggccaauacacuugaccuucuuaugauacgucagccuugugaaauagggcagauacuauuaauaauauccaccuugugugaucauuaugaagguuagauauaauguauguggaacucuugccaccaaagugguuccacaagaggcccuaaacaaaugaguaaucauuauuauuuuaaaauguccguaagugaaaccgauaugccaagaccaguaaaaaugagagcuucuuaaggaaaagaguaggaggcauaccuuuguuucauuuuguuuguugguuucugugcuugcuuuuuguucuuuucuguuaggcacagguuuuauuuagaauaaauuaaauuuuuuuuucuuugaugagugcagaaauaauaguuggaaacauugaauggaacagcuaauguaccauaguaauacuucuuggauuaccaaaaaaaaaaaaaauuaaaucuguaaaaugaaaacauuuuuguuuacuuuggucaguucaagguucaguguuaucuagagauuuuuguuaaacucaggauuucuauauguaugauugucugcuaaauucagaauuagaagagaagagauaauggcgcuaacuuugcauguuaaauauacuguguuacuaguuuuccaugaaguuuuuacucaacaaauagguuacuaaaagagcugugaccuaugaguuucaccaagucuuuccauuuccaauucggcaacaaaaguuucacacuucucaauuacucuugugggaggaaucagaaugccaacagucaccuugaucuaagcguauuauuggagaaaaauucaaggauagauauuuguuucucauuagauuuuccucauauuuuaucauuggggucacucuaguacaugguacuagaauuugggauuuuuauuucauuuuagauuggacugauuuucugguguuagucauuaaaaauaauuccaacucuuugaagagaucugggauguuuguuauuauucuauugauuaaauaaagcuauuuuauuuaacaauuguguuguuaaacuuucuauauacuuagaauaauaauacuaaaaacugaauggguaugagcuuuucuuauugaauuuaaugucaguauuaaauaccuuauugaaacccauacuuugaaagcuugauugagaaauuggcaaaagaguugacugaaguaaaaguaaugaagcaguucacuggucauccagguuaugaaaaauuaaaccauuagagauaaacugaacugugaaaauuaugaucaugguguuuucauaaauaccaucuaugucuccgccaccauucuaaaaaaaaguacccuaucaaauggugaaaaauaagagugauguuucugugaccauuucauuauucaguuuucuuauauuugaaaugugggagguugaacuaaaauuuguugguucccuucuuuaaaaaaguauaguuauaugugauauuuauuuauuuauauaaacaaaaauauagagaucuuaccuugaaaauaacuuuugagguaagaaugauaaaguaucuaaauggaagaugaauaacauuguaucugauuuguaaauuaugauauaaagaaaauguauaaaauauguagaaauugucuguauaaaaaacuauaaacagugguccguugccuauuaacaaagaguuucauguuaucuaaaaagucuucaauuggcuaaaacagcagaaaaauagaaauuacauacuauaauauauccuaaaaacauuucaauuccauagauacucuucuccaugcagccaauauuuaugaauuuggaguaagugaccuacucuuagauauuugagcuugauuauaauucauagucaaaguagccuccuuguaaauaaccaaaauuaaccaaagauuuuuccuuaucuuccaaaagcaaugccaaguaauucuauccaaauuggaaaaaaaaaaagaaaaaggauaaaccuuauuaggugucaucaaaugguguugacauaaugauauauauguuuaaggauaauguaauagaauauguaauuaaaauuaaaguauauaugaaaagaauugauuuuaauuguuuuaaaacauaagaugauuuaauaauaugggucggagauucuuuuuaguuuuauaauaaauauauugauuucugaaauuuggguauauuccauaguacacuuagcuuauguuaauacugaggccagauugcugucaggcuaauagcguguagauauauuauagucacacuacaaucauuccgucaguuuucaguuucccuuuuuccugugauguuucuuucaucuuguuagauuauucucaagaccuucucuaaauaccuucaguaguaauucacaaacucuuuguuaguuaauaguucucaagaaaauucugagaugugguugacagaacuuagaucauugguuuguuuuuggauuccuagccaaaguuuuauucuuuguuucuuaaaaauacucaaaaaaguuuuuuuuccuuauuguaagcccucuggaaauagaagcaaaucacuguuuauacauuuaaaaugugaugaaaauuacaaaauaaaguccagugaaauauagggcuuguauccauuagugccuuaagaaaaaucccuguuuucugaagugcgagugggcuuuucugguuuguuuuuguuuuguuaaagcuccaggaccucccaauuuucaagggcacuuuggggcauguguagcauuuauuugauguauggauguagaugcauauuuucccacaucugucucuguggaccuauccuuugugaaauccuaaaccuuguauuaaugcuuaguuuaugauucaugguguucugagagcaauuauauaauuuuucugggguguuuauucgaugugcacuguaaaaaaaaaugagaguuauuuuuugguaacccugcacuugccuuuuuauuggugaauuucuuuuccuuuuacugugaccugugaauaucacuguaggcucacugccaauuuugugagccgcugccugcuucaaaauggaggcaggaagguauccauuuucaucaagaggaugacaguguuucagucuuucugaccaucuggagagaggaacuuugagagcaaaagaaaauggggauuaaaaaaaauuauauuuagcagaaaaggcaagggggaaaaccaauuaaaguuaaacuauaccuuaugaauuugugcuuuucuacuaugcuguccuguuuaaaaaaaacauaaacaagaaaauacacaggcuauuuguauaaagaauugguuucccaagucucaugaguauuaguaaaugaauguaaguaaauuagguuuuuggcacacuuuuuaaguuuauuguacacacaaauauaauaagcaugaaaaaggagggcucccuccucccgcuuccuaugcacacacugauuguugguggucuuauguagauccaggcuuuuaauggccuuuuucaugcaucucugcaaaaagcugacacuaugggaauuuaauauucuaagauauauuuaucacuuucugugguuuggauaguucauuuguguucucucugucuccccccucccuaccuccucucuguaaaagugaaaauuuuaauugaaagguagaguuuuuacucuaccauuugaaagagguuugaugcaugucuuucuguuuuuaccauuuucacaugcuuaugggccaucuguguuuagaagaaaaagaaagaagugcuuagacucacaggauuacccuaugggcauuauacaguguauuuacaacuagacaugguuuacaucaacuggaauauaacacaccugguuauuuucuguucgcacaaauacaccgagcuuuuguuucguuuuguuguguuuguuuuaguguguucggaaagggcacuguuucuaggguuuguucagauuuaaacuggaaaggguagaaauguagcacuuucugccuacuucuuauauaagaauggagcuugggcugcuguggucaaugcaaaaagcaaaacucaguugguucuuucuccucaggucuaugcuccaucagcaagcacugccgacuacaauagggacucgccaggcuauccuuccuccaaaccagcaaccagcacuuucccuagcuccuucuucaugcaagguaagaugcugcugcuucugagggaaaggccacuggauagcauuuuccugggucacuuaaugucacagauggggcagaagaaauggaauaguaggcaaguguagaauuuuugaagucaugcucuucuuaggaauugaauuccuuaaaaauugauguauuaauuaaaacuguacuaagucuuucuuuacaauuaaaccccuuuaagcaguaauggguuaagauuagauugaucugcuucacuuagagccgaugcuuaugauggucuuccacucaugaccaaccauuucagcaucuucaccauccccaagacgauguagcuguuuguuuagaagugguucagcuccauguauguuuugaacauccuggauuuagccaacugggaacaaguuggccuaauguauaaccuuauguaaaauuuucacccacuuacuaauuuguagguaagaacaaggguccaagaugaaguaaccuaccacagacuggaauauuacauggugaaagcucugucccaacauaguaacugguuuaggauaaaaggcccaacuuuugggggagaagacaaauauaggaaauuauggaauuguccaguauguuuaaauacauggaugugugcccccacccugagcuuguagucuugcuacugauagcguauaccuuucugcugcucaaaaaagaccaagauguggccgagugcgguggcucacgccuguaaucccaacacuugggaggccaaggcaggcaaaucacaaggucaggauaucaagaccauccuggccaauauggugaaacccugucuguacuaaaaauacaaaaaauuagccaggcgugguggugggcaccuguagucccagcuacucgggaggcugaggcagaagaauggcaugaaccugggaggcagagcuuacagugagcugagauugcaccacugcacuccagccugggcaacagagcgagacuccaucucaaaauaaauaaauaaauaaauaaacaaacaaauaaauaaaugaauuuuuuaaaaagaccaagauguuugaaaugauagcagcuacuucaagaaugaaccacuuggaggaugccccuaagggcuccauccugauauguguguggcacuuauuuucuaauguaauuaucuuguuaccaaguuaaugcccugaauuuagauguggaauuuaccaagaaccccugugugcaaaauguuaacucuuuuugcccaggugugaaaaccuuauuuguauaagccuugucuacgggccaugggguuuccuucuuuaugcaucucuaggaagggccaugucacaggaaggggagcacauuuggggcaaagaguaccagggaagcagccugauauaguggacacacucaaaaucauucucauuaaaagauacuaaucuuccuucccuucaguguguuagcucuuuuaguuuguuaguucacgugugaaauuccauggaaaucuauaaaauuggauggaauggcucuguuaggaauagagagaauuuguuccacgcauaauagagcccgugugucagaaguccuuuaacuuugugacccguccuagguguaacucaaagggacacagcaggcuaugucaccugggugcguuuugugccgugacaaaaagcuaaucaccuucaguuauaaacaguagcuaccucagcaucaguccccuguuuugugagcagugggagauauuguccuacaggagcuuacagagauuggcaacucaaggauccaucacucaaaacagauuucgauugaaaacauugacggaaggauauauuuuuucuaucugcccaggaaaguggcuuucuggaagggugcacauugcaggagaggccagguagauuauaucaguaggcuccuuucccuagcagaccacacaaaauauggggaacaaauuuguuuaucugcauaugcauacccgaaaagcaaaaaaaaaaaaaaaaaauugaguugacauuuuugaugagcacaauuaauuugcacacaucuaauucuauucuuucuuucaaaagaacauuaugccaagaucaugggaugugauaaauauuaauuuacugugaaaagcauaauuuauguaaaauauguauuuuuauaagucugcaucaagcagaguacucuguguuaacaguccuaaacgcauugccacccaggguaucacauugucaggagacucuuguuuagugauauauguuuucaauuuauuugucauaugugccaucuauuuaaaauguuagugaucuugaacuucauauuugaauuuaaggugacauuuaaaccucuguaaucuaaggacuaaagcucaaguacaugaaugauaacuuuaaaaaaaaucauguguuuucacaugauggccacagaaacaguugcaucaugguccugucccacaucagcuuccuuucaguagagggguacuuggugcccugagaauucaagacuugaaggaauaugcaauuaaggugaaagauguucagaaacugucuggggcauauuguaaacucacuacuguggccucuuauuuguaacuucaauuuccaucuucuaguuaaaacucugaaguugucaaaaucacagacaugauuuugcuugcaugguucuuaaagagaggaaucugcaaacuauuccucccaauaugaaaugaguccaguuacaaaauucuaacuuccggauuuaagaacucaaugaaaaagagcuucacgaaauacagugucagauuuaacuuuucuauugccuaacuuuuuaauaggccuuuacuauauaaaauguuauggugaaaauaaucuuauuuucaaggaagcaauaucugcuauacauuuaacagccagcugauggccuaguguauaccuaguacucaauacuuuuuguuaaacuauugaaacaaagaaaaaaugaaugaauuuagcaguaauguagaucaucuuuucccuuaggcuugggaaaccaaaccuaaacauuagcaaucauuaauaauaaccuguaggccaauaggcccagagaaugaaaaaauccguagggauguuuuuaauaagaauguuaacaaaagguuaaccuuauguugaaagauacuuuauauaauuuuaaaccucuauaauucauaaaucguuuuauaaaauccagagacucucaaaaauaucuguaauauaauagcuaccuagggcauguuuguacccuuuggauugcuacugaagguuuaagauagcuauauaccuauacaccaaaaaauaaaaauaaaauauccuaagaacuauauauuugagauucaucuucucugcaugccguaauauaauuauaauuccaacuuuaauucuauuuauuguauauguuaaaaaugaaauuaaacauuuucaaucugagauuuuuuaaaauuaauacuucuuuacaugcuuuuaaaacuugucaacuuuguaauuucucaaguacuuuucaccccaaaguuuaggaacaauuuaacuuuuuaguugguuuucauagaaaaaacaguuagaagacuucuaagaaauguuuccuuuagcaguaauuaccuugcgacuugacauaauucaugguagaaauauacucuguuguucuuuuacaguucaauuuuuaccaagaacacuuuaacuuuuuuaaguguuuauauuuguuugacaauauagagccacuugggaagaaaugaugacugucuucugauguaaucagcuaaccaacacaaagaugaauaacacaacaggcagucauuuucaaguauaugaaaaaacccuauucuauaaggcaaggcugaaugccucagaaagucaugguugucuuuguccuuuacagauggccaucacagcagugacccuuggagcuccuccagugggaugaaucagccuggcuaugcaggaauguugggcaacucuucucauauuccacaguccagcagcuacuguagccugcauccacaugaacguuugguaaggcagacauacacgguaacgggaaugucacagcuaguugauuaaaccucguccucugucuuuccaugcauauacacaaggacucugcaaauaagugcaaaaauggcacacacccauuauucuuaaguuguauuguuucugugaucaaagacauaacagguucaaaucaccuuuguaaauucuuccagauucucucuggcauuguucuuuuguuuauuguguuuugcucugugccuucuuuaucacaaugucagcuuccuuggguacauaaauagauaccuauuuaaguuguagaaucuuaacauggugguuccugguuuuuuuuuuuuuuuuuuuuuuucuaucuguaguuucaaaagauguacugcagagggcagagugacagucgguagauuauaugcaucacccaggagcauuucauuucccauugacuggccuaugucagcuuuggccuguugugauguauccaaaagaaggaguuuguauuuucuguagacuuccaucaguaagagaaaccaugagguuucuacauagaucagauucccauuuuucaguauuuuaacuuuaauucccaucccagccugccacucauacuguguuuugcgucacuccaggugaaaacuggugggcucuagaauguuaggucuuucauuacuaaacauuuccacucuguccaucaccuacauucaucuaucauaguaugucucuuuauccuggaggaaacaacucagcugacuuucuucuagccuuaaauaucaccacagcccagaauccacuguugaacuuaagucugucauuaaagagaggaaagagccuagaucuugagugagauuugggaugcagauaagaugaaacuugaaucccuugugcaagaacauagcuuaaacaauauguggaccucacauccuacaaaugcgaaagcauaugggaaauccagugaucccaggugauacuuacaucacuacuauucaucuugcauuugccccuuuuucuucuucucauaucuacacuuagguuucuuucucuguucugauaaaggaaaucauucuggauucauguggucuuugcucucuuuugcucaaccaguacagauaagaaacaggaucugaucuccuacuccaauaaucaaaaaaauuccagaaguuaagauuucugauauccuugaaaauccguauuuaguugguccuagugguagagaugcuaaguagucaauuagccuauacauuccugagaggcagacaguggaaaugguauuggccuuuuuguaucaccucccaagauugaauguguaaaucacaaacuaucucacauuucagcacauuuccaguaaauagcagaugacuuauuuucaaauuuucucuuuucccaccuccuauuuggagauauuagagugaaagcuuagagaaauaucaacuauaucaacuauuauuaugcuagaauccguuuuggcuaaaauuuucauuucugcaccaucauuuuccacuucugugggaacucauggucaaaacuguauguguccuaugagcaaggaaaguuuugauuacaaauaaaaguuuuaggcacuauaccgcauguuggaauuucaguucuuuuaagaguugcccauuugacauuaauuuuucuucccuucuguguuucuuucuuucuucuccuaucaugcucaagaguuuugaguuaggcgauuugauuuuauccuaguccaguucacugcaugggaaguagcuuuaaaaugugcuuccaugcacaaaaaguauaauuucaaaauggaaaccaacuauauuccuuuuagaaaaaauuuuacagaaccaaaacaauauuaugaacuagagagaaaauaucauuuugaaguaguaacccaguaggcuauaucagaagccauauuugcaaugccauuuaccuaucacgaaacacaggauuuucauuuuucaucugaacaguuaacagauuucagagaguagaguuuuuguuuuaaaggagacaugaauaagcuaucuugcaauguauacuaaugaauuuucccacuguuagugaaacuauugaauuauuauaucuaguugucauuguacuuucaguauuuaaccaugugaaaaucuuuuacugaagugacuuagaagaaucugacacugacaauacuuugaauauauaguagcaguugguguccuuucaguugaaaauaaugguaguuccuuauaauuuuauucuuagcaucuggcuagccccauacugaacaaagggauaguuuaagaaaaagcuaagcgcuguuccuggauuauuugggguauaauuuggccaaguugauauuaucuguaaagauaaaauauuuuaaaaacaucauugccuucaucacuuuaugccauguuauaacagaauguguaauuauaaagcuuaagauccacauauuucaguagcgacugucaaguuacugauguuuagucuuuaaauccccuuuacaguuuuagccuguccaacagaaucccacagcuaaucauuacuguguuacacauacccacacaaaaucacucagaugaauggaguuugcgguuaaaguuuggaauggguuguuguagaugauuuuauguuuggaaugacuuggcagaguucuuuuuaagaacaggauagaguccucacugucuggcaugauuuaggcauggucuuugcacuacagggcgaaacaguccuaggagucuggaauuuuccuuuaaaggaaguucuguuuucuuuuauuuuuuuguaacauaaacccuuacuucaguaauucucaacugauggcaguuuuucccuucagggaacguuuggugaugucuggggacauuuucauuguuacaacuaggggcuagaugcuacuggaauccagugcguagaggcuaggggugcugguaaacaugacgucauguaugggagagccuccacagcaaagaauugucuggcacaaaagaucaguagugcuaagguugugaaauccugcccaaacccaaagcaugauuuuauucuuauuuaugugcaccaguuauuauauuuuucuaauguuugaauuaucaaccaguauaucaguaauggaaacauuuccaacaauuacucuguuaauagacacgaaauacaggacucuugggcaucauaaguuaaaaugaacgaauagugggcauguaaagccucgcacuuugucacacuccucauguccuuuguagcaagcaggaaagacaguaauagcuggaguaagagacuaagaggaccucuuauaguuuaucccuaaauccucuaaaagagacauuauucucugugguguauuuauuacaucucugaaugacaguaguuuucaagauaguuuuuaauguaaaauaaucuaguuauaaaucucguuaguuuauuucaacaacuaauuuucuaugagucucuaaaaauaacugauuuacauggauuccauugguucacuccuuuauaaucuauggggauuaauuuuucuuuuuauucugugaacucagcguuaacccuuugucaaaucccaaauuacugcccauuuuacauaaaguuaaaagggcccaaagauucucaccgaugugauuaucuguuuuguuucaucuucugauuauuauaguuaguuaaauauuuauaauucuucuccucuuuuuuugauuuuugcacauuucaggcagauuuguaguucgucuguucuucagaaauuccacauggaauaggacuguguagaagugagguuaaaguuagucaucucuuuuuuuguucuuuuuuccacauucuguuucuuuuccuccauuuuguuauagugcuuaccucuauagcagaaauaccucuaucccugcuaagcuuucagaauagcuguacuauggaaugggcccacuauauuuuucauuggagaaaauuccauggacuaccuuggguguucauuagguggcaaguagaaaugaguuuaacagguggccuaaggaauuuuggggucaaggaaagaaagagguccauggaauuuaaaaauuugaaaggcauucucaggaacuuggaaagauuuaaaggcaucaucucaacuuuuuuacggaagucuuuuaaguugggcuauuuuggucauacagagguaauauuuucaaaaacauucaugcgucuuugaaaauccuaccucuaauacguagauucauuuccuuagacuaguuggcucucaaauaaguuauacuucaauccacuguuuauuaaauucugacugauaaccaauuguucauugagcguauaguauaauuauguguucaguaguuagccacaaguugugggaugcagaacuauaagcucuauuccuuuaaagaguuuacaauacaggugaaaauacauuagaaaaagcaagaaaugaaaggccaaauauaauuaaguguuaaagacaauagugcagaauguaagugcauuagggaccuagagagaagagaugguggaagaguuggagguagucagggacucuucaagaaagagguagaauucaagacggaucucacagaguaaacagggcaacacucaagagacuaugguuucauuccucgugagcaaaugcuuggguuuuaaauacccgugacuaucagcaucauauucaaucucuuauuuugaaauaaacaauuuuuaacagcauuuccaauaaugauauaauaaagacucauaauccauuaauauauugcauaugaagaaaaaguguauuuuagcuuuaauauauugccuuuacauaacacauucagaugccuaugagaauaacuuuugaagcugcuuuuuaucuugaaaauagcucagcacuuuuuuguaaauuacuauguccauuuuagugagcuguucauucccaagcagauggguggauugcaacuaauuugccaccuuacaggcacuguggcauacccaagaaacacagcuuauuuggaaaacuaauauaauaauuaaacucaaagcagagucuuaaaccaagugauucuguaaagauguuguucuuucauugccagcuaugugaggauugcuuguagguggggcauggaaagaaaguacucaaaccaaaauaagucaugugguccuaauuuaauucaguauagucaauaguuacauauugaugaguaagagagauauuuaaccauuagugcuuuuuaaauuuuuuauuuacuaaauuuuauuguugcugggguucaaaaaaauuuaauuugggaggaagaagauuugagacugguuagucuuugccauuuaguuucaagaagaucaggaugaaauguaauauaagcccuguggaucauaauguuguuuuauucauuauauaguggaaucuuuuucacuugaucaauaggccacacaaaaaaauuaauaguagaguggucuuuuauguugccgaaacccuggagaugauuuuaagcaguaaucuguagauuucgagauugugaucauuucucaaugucccucauugccauuauaucccuccacaguugaugcaaacccaagcuauguuucuguauaacuuauuauuugaaaaaugaaagcugucagaucuaaacaagauauauucuuggcuauuuugaaauucuaaaagcugucuccauuguaaaauagagaguugugagaaaaguauuugaaaauaacucacuaaauaccuuaugauuaaauauggccaccuuuuucugcuucuugcuauagagcuauccaucacacuccucagcagacaucaauuccagucuuccuccgauguccacuuuccaucguagugguacaaaccauuacagcaccucuuccuguacgccuccugccaacgggacagacaguauaaugggugagucacagaaaugccaauucugauaccaacaauuggugucagaguuuaaucaucaaggaccucuuuuucccuuucauaacugaauagcaauuaggcacuaaauauuagucacaugacagaaugaacacacaaauguaccaaacagaaguaaaaucacuggcuugagcauaaccauauuuuucgucacaagacacugaaauuuagcuacguucuacguugcaagucauuagauugaacaaggguucaaacagaccaaaacuaucuuguuccucacauucaaaaagagugaacaaagucauaagaugagccaucagugacuagugagcuacaaagcagaauagcucuuaaugguaguuauugaccacuucccaaaauuccagucauugugcuaggcucuuauccaugaugugccacugucuuccgaggacugguuaaugugaaauucucaggugacugcuaauaacuacaugagguuaaucuccuggagaaugugacacuguggagucccucagaggggaagaaguauuuguucacuuaugagagaggagaugcgugggcaucaguuggccagaaauuauuugcugcuuuuuuaaauuaauuaauuaauuaauuuuuaccaaggacauuuacuaaugaguuaagguccaagaagaaugcuguucccaugaacugagccaucauccucucauuucuugugauguucacuguagucuuuuccauaggugguuccccagucaguauucccacuuugaggaaugaacugggcuggauguccagcugccccuggagggaagagguggaguugguggggagauagcuaccugcuucugaaccagcuuugacaccuuguuguucagaugagcagcacagcuuagugccccagggucuuauuaaaaccucagacuucucagguagucacuuucugcgguuauagcucaaacuaacuccuugcuuggccugaaugucacugucagagcgucgguggggagaauacucaguguaugucuuugagagaagauggcgcaacagaauaaugcugcuguugaguccucuuagcucuuugcacuuguuuucuuuagagaguguguagaauuuggggaaguggcgugaaucacuuauguaggaaaguuuuugauguuggaggagagauguguuuugaaauguuggaaauauaauuucugccucaauaaugcccucccugcguauucaauaauauaucucacacuugagaugagcuaucucgcagccucuccacuccgcuauccugucuaagaagcaaauugaggagagaguuuccauuuuuuuuaacuuuuccuaaccaagcuucuacaaauauguugcaucaguuugaccuuggagagcuacagacagaggucacauggggaaguuuguuagcuaucaaugcaguuuuggcagauuugaaaaacaagaagaaagaaagcagugcagaacugaaagagugagaaaagcauauuucacuucagugugguuugacaaauggaaagccccuuucugcagucaugaggucugguuauaaagaaggaugaccggucauucauccuuuuacaagacagauuuccugucuacuugugguuugaguaauuuucuuuuuuaggaagguaugaagguggagcagaaccuugaguugaggaaaacauacuuaggcucuguuugaaaaaaaacuuuuucugauugauuugcaaaacaguccucuugagagagaggcacuaugacuuggaagggacauaucaggaaauagggugguuaucuccaugagcuguagacagcuuagccacagcucucagugggaaugaguuuugcuugguuuuagcuggucaucuucauuaguuuguggaugaacaggagaaucuacuuguuggucuagccagaguggagcaauaggugacuucuauaugcugagaauagacuuaacuuguuaaaaaccauagggccuuauuuaagggucuugacaauaauaaaggagcuauaauuuaaaaacaaaaguaugagauuuuuagaacccagaaaagggcuuuuuagaaauuuauuucauacauuauuuuacaauaauggaugcacuugucaaaauccacuagcggaaugagaaaaagaugcauaaucuuuaaggaaauagguagacaugguaauucagcauuuuggaggagcaaaccuuuauuauuaugcauagauacagauauuacuuuaagguuacuuuaagggagaacauucuagaauguuuuucuuuaaaauaauauguucaccaauugcguacgugaaaaugcagaggaaaauuuaagcauaauaagccuuaguauugcgugaugucugaguggcccauguuuuuucacacuuaaguucucuuaggcuuugguuugauuuuuugagugugguagaagucagugauggcagcgugucuguauaacaagaagagaagcuuucucuucugauguuagugauacuacccuaacaaacaguauggauuaauaggauacaucugcagacuuuugaaaauauuuggcauauacucacucauucugaaacgcaggaaguaaagaaauauuacguugccuguaucucaaagaacaaacagagcuaauuaaauaauuggcaaauagggaacacauagccugacacauguuugagauuacacacgauucuguagaaaaugacuguaagcaauacuaaugccuuaagaaugggguucgagcacuaacacauggacaucacauuuuucacguuuuccugguaaaaaguugcaagacagugcagucuuuucauacaugguguugaugucuuaggaagcugcuuuuucaguucagaagagggcugcugcccuucgucucagugucauguuauaauaugucuuucugguggucagcaguuguccugaacugacacuagaacaacgcagugcauguggggugagauacaagcucuagaacucucggaagggaaccucucuguaaccacauucccuuucuucuucuguucucugcaucucaaagguggaagaugcccacugagguuugcuguuuguuuggcuugggggagugaccagguguuucuuguuuuguuuucuuuugcccuauaauacccaauaucauuuuuugagaaauccauaagaaggauaaagcuuacuuggauuacauuaaugagagauuuuuuuuuuuucaugacacauucauccauggauuuucaagagaauuguagaacaagguauuuuacucauugcauacaguccacuacuuuucucaagccuugcuggcaaacucuggagaucauauuagaccuuucugaauugaaaaggucaucuaauuagcccuccaauuagaggaauauaauguaugggacacagcauggauucacaguaguucagcugguggcgcacccaguuaaggaaagaagcugucaggggucuuugggaguuaccagcaucagcaccuucuacucaguucuucaaacuuuuucaauguuaugccacuggguauucucagaagcagugcaguucagugccucugcaucugagcauacauacggaggaggaaguguaguaaguuauuagauaccagcuauagagaauaggaaugucugcaggauauuaaccauacacauuugguuagccacauacuuccuuccuauuugcaauaauauccaguagcccuuccugauggaaagaaguaagaggaccuccuaccauagcacagaccacugagacugcucaagggugagaaugcgucgucuccccauugggacauaccaucuguauacauucacagggugugacccuuugugguuugaggcuacacacacucccuugcccucagagagaacuggucauauaacuaacauaaugguuauaauaacuauuauuguuuuauuagucuuuaacuggccugcauucuaauacguggucuuuuccacguuuuuaaaccucaaaccaaacaggguugaaggaacagacuaccaagauugauuuaauacaccauaugcuaaagauuacccuggaauaucuaucugguucaugaauuaaucuggcuuagaacuuuaacuucgaaugacauguuaguauguggcuugucuaguagaaacauuauguccuuuucucuuugaggacuugguuucacaguaauuuuauuauuagaguagucacauaauguucacuuuauauuuuacaagaauauugagccuugaaguagucaggcgaugaacaagcacagagcauaagaguaauaagaauuguauccagcaaugugaaggcaucuuaguuaccaagaccaccagcagagaacaauaaacuaguuugauuuaaaucuccuccauuuccugugcacgaucaggaagcccaacuucccccugaauuccuaggaaucccuccuguuaaaaaauagugcauuguagucuauauacuugcguuuguauuuuaaaaugguuguaguaggagugcuggaaauguuccuucuuuuugucaucuuuauagauaagcacauggcauuguuaugcuguuucuaaugguuuaauaacacgagggucacucggacacaguuuagaaaaaccuacuuugaaagcagucaucuucucucaggcaaacacagugugaauugugcugcuuauucuuuugaugccuucaugauguucccagccuuagaugaugggugugcauuaaaggggcaacacauuuuccaaauucugauuuuuaguaguugaucccaaggcaccacucaucccaguguuuuguugaggguguguucuaaugggaaugaacauuuccccaaagcugaggcugagacagaggguggucuagcauguaacccaagauacaaaaccuuucuuucugcuucaucuucuagccagcaacaccaccuguguucaagccaucugaacaauacuuggguggcaggcagugucgaagccuccuacaaaaauuacaguuccucuuaauaacugcucaucuuccauucauauuuguauguuacagcucuacuuagggacugauuauauuucucuugggcaagauaaauugauuagagccaaaauuagaaaucgauaaagucuuuaccaagcaaaugcauuaguuuucaucuuucuguuacauggacauuuugaucaucucuaauaugaauugacaaaaaucuugggccucaaagaguaaucaaguccuguuacaucaaacccacauuuucagcuuuaauguaucuugcuaaacauggcccacuucucaaugcaaaaaaaaaaaaaaaauucugccacuugagaauuaaaauauauuucuuuuccaguuauacccuuuguuauaucugucacacaaauaaaaagagaaaucuguaagagaaagacucauguagcuuaacauguucaggcaaucuagaaaauguagcuucuccaguguuuccuggaccagaacaaaaggcauuccaagugaaagggcaaacuggccccaguaaacugcuuugaaauuuaagcccuuggguuuggcacuccagcuguugcaagguaaaaucgcuucauguuaaaaaauagucuguucuuaucagugguuuccauggguagccuuuguaguuuucugaaauauuuucaugacgcgaugagguaagaaguugauucuauuuuuaauucuauuuccugagucauaauaucucccugcauaaaacaggcacugauagaauguuuaguuagaaagguguaguucuaaagaaaucagauuggucauaauaucuugccucuucuaacgugugauuuuuggggcguauauauuuaguuuuuaaaugcuccuaaaauauuuguauugguuuucaauacuuuguuuaguuucauaaaaauauauauauuauuuguaaucuucauuuuaaaguuguuuaaaggaagaauuaaucuuuugaaagccacuacuguagcagauauuaucuguagugaagcaauaucuuguucuuuuuuggcuuagguucuuuguuagauaaugugauuuuuccaauguagcucugaacuuuuugugaaaaucuauauucaaaucaagcagauaucacagauuauuuugacugauagaucuaauuuuuagguauauaauaaugaaaagaaauaucgcuucuaggaaaaaaaaaaagauaaguacccccaaauaccaugguaauacauacugaaaaaagguuaguaucaucuauauuucacaucauuauuauuuucucuuuagaaugguuuuuagguuuguuuguuguucuuguuguuugaggcagaguuuugauccuguugcccaggcuagagugcaauggcgcaaucucaaucucggcucacugcaaccuccgccucccagguucaagcgauucuccugccuuagccaggcauaguggugcaugccugcaauccauguuuuuaguuuuuaaaggacuccuuaaugcagaaauucuucucauuuucacacuagauauaauuuguuguauuuuaucuuauauuaaauauuuuuaauacucuugauaucugagcugcucccagugguccaauuguaugaugucagacccucauuucaaagaacuugcuuauacaauaccuaucaugaguacuaaugacucauguauuuuaauaucauaacuuugugauauggaaguuuauuuugucacgagauaauuguguucuucuuaucaugugccagauuucuuucaguauuuuagcaauuaacaaauaaauauggguguggguuuuguaaaccaaauaaaguauauaucaaaacauuaucggcugggcaccgugacucaguccuguaaucccagcacuuugggaggccaaggugggugguucaugaagucaggaguucgagaccagccugaccaacauggugaaacccugucucuacuaaaaauacgaaaauuacuuggcgugguggcgugugccuguaauccuagcuacucaggaggcugaggcaggagaauugcuugaacccggaaggcagagguugcagugagccgagauugugccacugcacuccagccugggcaacagaacaagacuccaucucaaaacaaaaaagaaaacucaucugacaaacucaacauauaaauauaugaaaauaacaagcauaaauuagcuaugcuaagcagaggucaggagaauuaaauuaugaccuggaaaagccauagaauuggaccacugaagauccgaccccacuacugcauuuuacaaguguggaaggugaugacaacacauuuguaagaaagaaggcucucuuaguucaagaauggggcuggaaagucuuugaaauuauauaccuguuuaaugaaguuuugcuuggauucauugggugauuuaaccuuuccuuuucuuauuucacaaaauagugaaaaacaaucuucccucagaacuuuaauagguuuuauuuagauacuaugucuauuugcuaauguugaggcuuuaguaaauacaacauaccccaagugcuaggcauucuguuaauacugaagaccacaagaauccuggaaaucccauuuuaucacuuaguucuaaaggcaagauaccuuccaaugauacauguuaaagaaagcuggcuuugaauuguauacuguaauauaugucuuuuauuauucacaauacucuuuguucuucucuuuuguagauaaaaauaccaguguuuaaggcaguagagauaagcuucaugaauauguagacuuacuuuaucucuggaauucgaggccauauugacuuuuaguagcauaccaguucacuuuuuuuagugugaacacagacuuuuaaauauguggagaauauauguuauuuaaaacauuaaaaauauuuucucuccuuguuagccagaccuguuguggaaauuuuuguuuguuuguuugguguacuguaggacugugagacgaauaccccguuuugcuauguaucaaauuucuauuuauuugaaaacagauggaaguuauuugugaagauaauuccauuuacuauaaaauaauauaaagaaaagccagacucugaggacuccagagaccugaaaguagucuauacuugucagcaaugaccgucacauagcuugcuacauucaccagcucaucaacagcaaggggaaagucauagcaaggaaaccacuuuaucuuuaaaccaaggugucagguuuauauuuuaucuguaaaaaaguaacaugaauauauuugacaucuaccucagcaaacaaauuaaugcuaauuaaagauuaauguguuguaauuagcauuaaaaaugcaauuaaauugugaguaaauggaccaggaauagaaaauuguuagacgucucacugccugguuuucauauucugccuuuuguuuuugcagcaaauagaggaagcggggcagccggcagcucccagacuggagaugcucuggggaaagcacuugcuucggugaggaaauauugacuuuggacuccauauguaccauuguaaagggugaacuuuaaucagaaguggacauuuggaauuuuagaaaaugaauggcaaauagcuuugauuuuuggaaaaugcuagcuuucuugcauaacagucacuggaaaauuugagaaggcucugaagcuuccaguauauagucucuuucucucauccucaaaaugguacuaagcugcacucaauuauggaugugggaauauucuccuggucuuuggguuuauagguuuuuuauacugaugucuuauuuuucucuaaaguaauaugggugcacauugaccagcuaagacugucuuagcaaggaauaguucuaaaacacuuugaaagaggcauuugaaaaaaaaaaaaaaaaaaaaagacaauaacugagguccaugaagaacugucacauaauuggcaccugggggacucagcuucucugcuuugcccaccuacugccagaaagcuaaaauugaacauuucuugcauguucccugaugacaaaauggcauaccuucauugucucagagaguauaucugguauuuuagucaaaagcuaaacauggucauuuagaaauguaaguggagggccagguaguguggcucacacugguaaucucagcacuuugggaggccgaggugggaggaucacuugaggucaggaguucaagacuagccuggccaacacggugaagcccugucacuacuaaaaacaugaaaauuaacuaggcauggguggcacaugccuguaaucccagcuacuccggagacugaggcaggagaaucgcuugaaccugggagguagagguugcagugagcugagaucaugccacugcacuccaacuugggugacagagcaagacuccaucaaauaaauaaauaaauguaaguggagauuucuuucucuaagauuuugucucuucaguuggcuuuuaccauugagagcauuaaaaaaguucacacuguauuagcauugugcccuaaguaaaaguuuuuguuucaucugggccuucugaugcuaugcaaucaaacgccuagaucuggcaaaagaguggcaaaauaucuuaggaaugauccuguucaaccucucauuguguagaugaggaaaggaaaguucaaaguaucugcuuggcuugcccauagccacacagccaguaggaacgaagaguugguuugaagucugcugaccccagccuggcucuuuucccaccaucccauaccacaucaguaauucuuguuuugaaaaauuaaaauaauuguuaaguucuucauuugacaauuuugguacuguaguugauuauuacauguaugcuguaacuuguaaguucuaaaugaauugcguugacaacuucguaguuuagaaaagugugaauuauuuuaaugaaugaggguguuuuuuuuuucuccuuauuguuuuaagaucuauucuccagaucacacuaacaacagcuuuucaucaaacccuucaacuccuguuggcucuccuccaucucucucagguaguguauuucaaaucccauuucaucauauaacaguuuauaagaaugauuccccccuuguacuuccugauuuuguagguggaaacucacuuccccccaaaucccaaagcuuuaacauuccuauaacagacaaauacaaagggugggagagacaaauuaccagauaacaguauagucguuuacauccaaaccuuuucuuaaaaauuagauuaucuuuuuaaaauauacaggcauauggaaaauguauuucuuacacuuuucuuagcucugcagaagacacccaacggcagaauaauguauuccaauaaaacgucucagaugaaaaaaacucaguuaauauagucaugaauaugaauauagacuagauagucaucaaauauagacuauuuaaauggaucauuuccugcaggaauuucaggcuuuccaaauucccucuuuaaaguacaugccauugggauguuuagagaaaacuauaauuuuguaaauaaauugugaaauaauugugugggguagaagggauguuugacuucaaaguauaauacauucguaugaccuguggcuucaaauugaauaacuauaauuuguagaauuaugucaguaaauaauuucacuuuucagggguccguuuaagagacucauugucuuuccaauauaaaugcuuccagaaagccuuccuugguucaugucucugcucuuugguaaggagacagguggcuuauuaaaaaaacaaaacaacagcaacaaaaccuaaaucacaucuguaccugauggaaaccuuaccuuacuguaauuuauaguggaguuacuugcguuuguuauuuccugcaugcagcucucauggcccaguguaaacucagcuccuuggucgaggacaggagguuucacauugccacaaaacuuucagaaaugauggccauggcuuagcugggauuuaaugucaaccucuuccaagccuccgugguaugagaagaucacagaauagagagggcagugggauucugaagucucuauguccagagagaccgcguugaaacugggaagcgauugaggugauuuuaagaggauaaucaaacguucccccugguggaaauagaaacuagaguucaguauuguuguacuccucggguucuguaccagauucuuacacucugaaaaaugauuucaauugucaguaacccccuuucgagacaacaagagauacaacaagggauagaggaaucugagcagguggaacuccaguuuccacauuucaaacaaaguagcuuucauuuuauucauuuucuaauuuagaaaaagaaauguucuaugguaucauaauguuugagaacgacuaauguagucugauacccugauuuuacagaugagaauacugagucccaaaaagggaguugaguuguugaguuuauuaccagugguaauagcagagcuuggacaaaaaucuggugcucacaguucugccauccauuucuagauuaauggugggaaagaaaaauuaggaugcacagucauucuagaaaacaucacaaauucccucgaccugaguagcaugaucucagugaaaggcacagaaacaaggcuagagaugccacuuuuugggucuugguaaugcaucauggaagaccacauguuaggaagaaagaacuuuuaugaagaugcaaauauggggacagauugcuauuuucacaccgacggcucuguccaaauucugucaagaaaaguaauugaacaaaauauucuauuuuuauuuagcauaaaaauauacaugcacacccagaaaagacaggaagaguggauuuuaaaagugcuaacagugucggggcaugagauuucagugagaucauagcuauuauuuuuuccuuuuuugaauuauguauuuuccaaguuuucuacacugaauguguauuauuuuacauuuaaaguguuuuuuauuuuguagguuagacauguaauauguauucuaacagcaaucuuuuuuuaccuucaaguuuaaugaaucauaaaaaaauuauuuucuucagaagaaacuuuuagucauugcuguauauugacuuuaaauuucuggcuuaguggaucacugauaacuaaucuuauucccuuaaaaaguuuuucaagauuuaucuuuuucuaaagauuguuuuaaaaacaaguggcaaagcuguuuuccacuggugcgagaauuuugguuuaacauaaacuagccuugcaugaaggucuaacaaaaucccauuuuuguacccuuaaaaguaccuugauuccauggugauaguuuuucuuccacaggaacccuucuuaccaaaauucagaaucaauuaaauguucucuuuuaggagacagccagccugggggaauugugagucuauguaaagucuacauauuuuacauuuaaaauguuuuccuugucccaaaauucuuauaugggaaguuuacauguauuuacguuguuguuuaaaugaaaaucaucauugccauugccauuuccaaaaggacuguuuaaaauauuggcaagcgucuuuuuacaugugucuagaucugauuguaauucccacuuuaauaucagcaggcacagcuguuuggucuagaaauggaggacaggccucaucgucuccuaauuaugaaggacccuuacacucuuugguaugucucauuugcuaaucucugucccacccauuuucaggucauguucuuucuuguucagucuccuuuacucuccaagauuuugauuuucccuguuaguaacuuuaagucagcauuaagcacacagguuugcgggagccagagucauuagccuaugcuugcuccuauuuggagaugggaacccagauacuacuguaauggcagccccagggcucuaaauaucuaguagcagauaaaauccuggaagggcaauggccuucuccccaucucuaggaaagaucccugucaaugauuaaaucacuuuccugcuaucagagugcuggaacuccagccagguccuauaccuggaacauuugauucccucuaccucugcuuuacuuuccagaauaacagguuuacaggagcuuuccuucucguagaaacccagugguauccuucgugguagagaaaugccuacucuuccaggagugaauugcugaaaauuuccauggauguaguuaauuauuauaaauacucacaugaugauucagugucugacacuucagucuuucucuccucaugauggugggggccagaaauaugcaggaaacaaugcugguugugcagcauuuaggcuguacaugaauuuagcgggaaggaauagcaguaagggagaggagccuuuuaguuccucgggguugagguuuucuuuucucccuccuaucuugagaugacacauggaagaagacauagauuuaucuaucugcuuuaguguugucuuauauucuucccuuucagcuuaaucuuaaggaaaaucugaaaagaaaagcaaagguggauuucccuccuuugcuguguucuuccuugcuauaguguaugaaucauucagcuaugcauuuuaaccaguaaaggaaaccagacagugaaacauauaugcacuacccagcccaauuaaucugcggaccacauccacauaauuaguuguuuuaguguuuaccuucaucaguuauucucuggggccuauucaucaaaaccaggcuucguccaacuauagaacuguaaagacgggguguauaguuaugggccacagcuuccauucuguuugaauucugaacacugaagaagagauuuacaagcagaaacugcugucucuaccaggaagcugugagccagaaacugugauaggcacauguaugauuucuuuuccugcauacauuuacacucagaaguaaguauguauuaucauucccauauuuauaaauuagaaagcaugcacuccaagagguuuaguaacuuuuccaaggccaaauacguagcaaagcuagcagucuaggggagguaguuuaacucccaaacccaccaaaucagaauguucuguaccauagacuacuauauuagacacacauucuuccugucaguauaaaauagaaauguuuuuucucaugcaauagagcugguacacuuguuugcacagccgauucaaaaucaaagucaauuguagcaugaucuagugcaaagagucacuagauuuaaaauaaaaagaccuagauuccaacucugacuuuaccauuuccuagcagugugacacuacguaacuaauucacuuugugucuuugagccucauuuucaugucuguacggaaggaaucauaaugucuucccugccugcccauacacacgugaaacaaggaucaaugagaugguauauuuuaaaguguacacuggagagugguauuugauaucauuauugaucaguuuuuaaaaugaauacauaccuuuaaaaugaauacauacauuuucuucacuaaaaacuauacgcauugucuaguugugaaaaacuagaauccuaauggcaaggaugaacaaagguugguugguuuuuaaugguuuaaaguugcgaauucuaugcuauaguuggggcuuugaacucaguuagaugcccccagugaacaguugauucaaguguuugugauucuucagucuuaaaaucuuauacuacuuuaguugacagaauuuauauaauuuuuuucuguaaccauuuugaggcccuuacacgcauaccaccacacacccacugguuuugaugacaggaagccagaaacaccgguaaaaacucaacaagaaauuaucauccauuugcuuuucccugucucugauuugguacuuagcacugggucauauaccacagggaagaccaaagaaauauaccuucaggaaaagaauuuaauuaagaaacuauaaauaggucaucuuuccagugguaauuguuuaaaacucuuuaacuuaauaccugccagaaaguuccuuaaauucagugaauguuuuucucuucuaaaauaaauuuaaauugccuuucaaaaggcaguaccguauauagcacauguauguuauaauguccuggaauaauuauugaauuuaguuuguucaugaaaaauaacacuauaauuuuaacauuaacacguucuaccaguuuucuggaaacaacacuauuuguauuauuguuuuaaggaaauacauuuuauuggaaacauguauuuagaaacacaguguguuuuuugucgacuaaaauuuuacuuguauaauuuaggcaccccuuuugaacuaaaucaaauuuuacaucauuuguuaaccaacagcaaagccgaauugaagaucguuuagaaagacuggaugaugcuauucauguucuccggaaccaugcagugggcccauccacagcuaugccugguggucauggggacaugcauggaaucauuggaccuucucauaauggagccauggguggucugggcucaggguauggaaccggccuucuuucagccaacagacauucacucaugguaagugaugaaauuuauagacucuauaguuaucauauagaguuagaauuucagauauagauacuauuguugcuguuuuuuaaaaaaucagcuuuauugagauauaauucacuuaacauacgaugagcccauuucagguguacaauucaaguguuuuaguguauuuacaagguugugcaaccaucaccauagucuagguuuugaauauuuuugcccccugcaaaaagaaaagaauccccguugcccauuaagcagucauuccccaucccuccacuuccagcccuuggcaaccacuugucuacuuccuaugucuauagauuuaccuauucuggauauuuugaauauauggaaucauacaacaugugguggucuuuuuugacuggcaucuuuuacuuagcaugacuguugcaguuuuucuacaguuugccacguauuagagcuuuauucauuuuuauugucaaauaguauuucacuguauggacauaccacauuacacaguuggguuguuccaacuccuuggcuaugaugaauaaugcuucuauaaauauucauguuuaaguuuuugugcagacacauguuucccuugaggaugaauugcugggucauuguugguguuugaaauuauucauuuuggugacccuggccaaaguguacaauuugaguucauauuauaauaugacauugcuaguaauucaaauauuaguguuuuuuuuuuaauuaaagaagccaaaauagugucugucaauucugagucugggagauagaaauauaugguauguuuauuuguauaaauacauugcaugugacuguguaauuuaauagaguagcuuuacuacuaccuauuuagaauaagucuuuauuugaauuauauuuaagcagauuuguccauauuacaauugugauuuuuuuccucauuacuuuugaaaggauuuuggagauaauucuuuuugaggaugauuaugaagauucagagacucuucuuaauagaauauuaagugaugacaauuaaugaggugaccagagugguggagaauguaacuugaccagugauucucuguaguucugauccucacaagcucuaccucgucucuaagcaccuuaguguccuauuuugccccuuacaggcucgcuaaaaguugcuuggaugaagguauauuuuccauuaucacuguagcauuucucguuuaagcauggucccaaaaggaaaugcaaaauacauacaaauuauuaugagguucuuuuaaguucuugcucaguaguauucuccuguccaucuuucaguuucucuuaauaaaagucuaagauuaagaguaccauucugaacgguguaguauugaaaucugcaaccaauuugaaaccaaaaauacugguuuauaaauagaagcaacgaacucacaucuaaaauguggaaagauauuuuugaaugccaaagagaaaucuuuuuuucuuucccuugaccucugcccuaaaaauucaucauugaauaaaaauuguuuauauguucauggcaguugcuuagaguuuacaaaagaaaagucuagauuuuaauuuagcuuggccucagguaauguguuaaauacacuugggaugcauauaauaugagauuuucguuuguacagcucuuuuuuuucuaacuacaauguuuaaacauacugcuuuuaauuaagaaaucuggcuuuauuaaaagccagaucugugacuuauaaccauuucuguauaucugcucucaaucaacagaaaaauaguuuaauuucuguagcuguguucauuuugcauauguuaaacggauguaacaugcacccagggcauugcuucagagacuauuuuuuccauaaauauguaaaguuuuucuuaaauaccauauguagguuaagugguucuuuuaaauauuaaacuauacauaaauacuuuuggggacuauuugaccuuugaauugacuccuuuuugagucagauucagaggugggaugggaggaaaagacuagaauuauuuuuggagaugggaaguuggacugaccucaguagaaccgaaagugagacgacugaauagaacgguagaaaaaaggaaauaauuagccaauauuacauagaaaccccuuuaauuugaucuugauauacacacacacacacacacacacaaaagcaauaaagccgccaguuuugcugauaaggauaaguuccuguuuucuccucugaagacauuuaauauucaaucaaggacagccacagagccaagcagaucauagcguaacuccaaagauauggcaugucaucacccugcugcccuuugaaccaaaugggguuuugcagucucucuccuuucuuccugaaaaccauucaacguguccccagaaucugagcuccucagccugaaacacuaaugugugugaaaaggauugguuuggccuaucuuucccgugcaaacugguaugaauuuuaaaacaaaaacauaagaacaaaggaaauaguuuuugaauuuaaucagucugaaguuagccuuugaccauuugauacauuccacaauaaaaaggaaguuuaaggggaaggcaaaaaaaaaaaaaaaaaaaccucaucccccuuccccacaacaacaaaaaaauucaaggaggauacugguaauguuuuccacauuugaauuuuaauacaugaaacaggcuauaaaacuuuggccagcugcaguaaauaaaguagccgugggagguaugcaccggaaacuucagcagagagcacuggugagagucucauucccaacuacacaccuucguuuguuguucugggcggaagcgaguugcaguaacuugauacucaucccagucccgguuuuguauugagcacaucgccuuucuaacucuccucaguaauuccuucugauuaaagaguagacagcucugaauccucucgaccuccguacgcuucucauuuccuuucucccugccuuccaaaaaucaaaacaaaauggcuugauaacuuggaaggugauauaagcauuucuuucugcagcagcuugaaguugugguggggaaaacugugguucugccucggcuguuauguuaucucauuuaauugcuaacauauuguccuuagcuuuugauucauaaaauguuuuccuuggaguucugaaguaggucuucagugauuuacuaaguauuaguauaaugaaagggauuuuuuuuuuucacagcggcauggcucauaacacaagagcgaauguuuguauacuugcaagcucucuggaugauauuauugagcuaugcuuauuuccugcucaaaaaccuucccugccuuuccauuuucuacaagauaaagaccaauuccuuagcucagcauuugaagccuauuaccauuuaccgaaagccuuauguugagcucuuccaaucugcaacaagucuuccagcaagacaaggcugggcauauuaccagaauucacccuguauguucuccuucggaacuuuuguaucucuuugucuuguccagcccuaucugcuuaucucuguacaccuaauacccacccauucucaaagcacugacucaaaucauucuucuuccaggaagccuucccuugcuaccccacucaugcuagccauuuuuuucucuauucuuacagcccuaugaaucauaccauuucuagauauuuaucuuaaccagcuccgcauagcugugcaucuuuuauagauaugacucugccuuaccaacuguuguaaauuccucgagucucacauauuauauuuugucucucuccccccgaccccuguaaauagaucauccauagaaacgggagaaaagaaacgaggaaacuuaacauucugugagugugaguuggcagccccucugcuaggcgcucugcauguguugucuuaggcagucuucacaacagcccagugaggaugauaauaguggucauuucaggugucgguaaagugagccuuagaaguuugagcaguuagucucaaguccugcagcgggauuuaaacucaagcacaucaacuccaaauucaaugcucuuuuuuacuaccaggcauacucuccagagauuaucuaugagaacaccuuuucagaacuuauuuuaaaugcuaggagcuugugauuuucaaaacuugauaaguguugguuggcaaaagaaguuuccagguauuccauggcuggguucccagagcagcucucuucccaaauguauagacagagaacuuucccuccaaagugguggcaugcuuggauuaaaacccacauuaucuaugcacuuauucuuaaaccaacauguuugcgcugagugccuaagaggugugaacucucccuaccaggguccuugagguagcaaauuuuaaguuaucaaguuauuuuucuuacuauaaccacccacuuuucuuccaaaauuaaagcagaaaucucugaaugugggagaauaaggaaauagccaggucuucacuacccuaguuagaaacucuuaccaaguaugauucccucucugccucagagaccuccaugauuaauccugauauuaaaugauuagauuucuuauaaauuauggaaagggcaauuuuccagauagaauucucucuguuacucauucaguauucacauccacagaugaggccugaaaagaagcguuucaaaugaccuaaccgcuuuuuuaacugacuaagaacaaaacccacaucaaacuugucuuuaugugacucuauguguucccguuuauuuguugguagagucagcaacuacgugaucauugagcuaaaaauccccucuacuauucauauaucgcauuaguguagcucucagauccuucuuguuuaaagucuauuuauucauuucaauaacauuuauccgugguuaccaaguguagguucugugcucucaaggaauucacaggcuaguaggaaaagauguguacuuaagcagauugcucccugccagucugcuaugcccucuaaaagaccaggggccugacccuuauccaguagugaaagaucacaugguuguuuaguagaggaguggucaucuccaguugacuuagggaugggggagucaugugcaacucaccccacacaccuguccuccacagcaucccuucagaguccugcaggugggggauguggaacccauuucagaaaucaccaauaaaaguggaucuuugcccaguuuuccucuuuucaguaacaauuuuuguuuuacuuuggauuaaaugcagucuaucaaaagagcauuccuuaggaaaagugguaucuuuuuauuuaacugacauuauauacaugagaacuuuuaccucuuagggcuucauaggacaaacaacuucaguuaguuuuccuuguauaguuaagagcucagaccacugaauuuuagauucuaaaaguacccuggaaaucagcccauugcccuucuuugaagacuaaggccuaggaaggggaagugaccaaaccauggguacucacuaguagaauuagaaaccagacaaaagaggcuggacacgguggcucaccccuguaaucccagcaauuuaggaggccgaggcggguggaucacucgaggucaggaguucgaggccagccuggccaacauggugaaacccugucucuaccaaaaauacaaaaauuagccgggcaugguggugcacaccuguaaucccagcuacucaggaggcugaggcaggagaauugcuugaacucuggaggcacagguugcagugagccaagauugugccacugcacuccagccugggugacagagagacccugccacacacacaaaaaaggaaaccagacaaaacagcaagcagaccagcacuccuugugcuauauccuacacugcucagccgacuuccucuuuacccuaauaccauaaccauuucaaaacugugagugguagaaauuagaaaccauucuguuacucugacuuaacuaaugaaauccaagaaaacucuguaguuggcccuaggcugccugcaaugaguugcuauuuagcucuaccaguaauauuuggcaaaaagagaggguagugggcauugaugugauguggcaguuauugguacauagucaugggagcagcaggagucagaagauucuguuucuaugugggccucuucaacaaagauaugaucaacagaggcaucagcaucuucaguugauaaaguugauaaaauagaaaacuauuuucuaaauagccuguuacagaauuucagcgaagcuauugguggucagcaucaucuuuuaauagcuacuaucuuguuuuucuuuaaauuaggauauuugccuucucuaguguucugucaucucuccuaaucuccacaacuaucagguauuucggagagcagauuaguaaccucaacugaaaguuuugaucuuuaucaauuuaucaguugcuccucuugggcuuucacagguuuugauuccauaaaguucugugucuauuugagugcauacuucauuucuaagcaguuauucccauggacucucagggaauuuaagagauuaucucuacugaaaucucccuacagauuuccugccaagcagucaacaagucuugaucagccuccuuccuucaagggugacuagcuccaaaugcccacaaaguccauuuucaucaaauauuugaaaguucuuccuagguccagcccaaauuugcuuuuuucuacaguccuuauguuucugcccaauagaauugcccacaaaucaaguccaacaagcacuugagaaacucaguuauuugaagacagucugcugaguguuuuuucccucuagacgaaacaucacuaucuucaaauauuuaaccugaaaaaaaguuuggacucccugucaugaacuccauugcuucccagugcauucucccuaguuuagcaaggaugccuuuuucuccacaagaaccuuuuaguguguggaaccgcaaacugaacacagugcuuaagaaaggaucaaguggacuaggguggaucuaucuccucccccauucaguaccuuguaucuucauuaaggccaccuaacaauauccuguuuugcuauguuugaugcuuucauuguccugcugacauauauucaauuuguaaucaacugaaauccauaagccaccuaucuccccagucucauuguguacuuuuuguugugucuguacaaaacuucaugaaaccccauugaauguuauguuguagccucagucugauuccuguuuaaugguuucccugaagcccucauucagucacauacucugccaucucuguugcuggcaaaugugaugggugugacuaaugcccacaucaaagccaccaauacaauauuuucaggggaggggauugaccagaaggccaugaggcucaguguuacagacauucuuucuacacgagugcugucuucuauccuuugaguuuaaucucagcugguucugucucccuccuuauacaccguauggcccaccuuugcucauuuuguccguagcguugucacagaagccgggcaugcagcacucacugugaagcaggaaaugaggcuuguccagaaugccuugcucugguggaaccaaacugaguuugagaggccauuccuguguuucagagcacuuucaaaacuauuuucuaaauacccuguuacagaauuucacccaagcuauugguggucaacaucaucuuucaauagcuacuaucuuguuuuucuuuaaauuaggauauuugccuucucuaguguucugucaucucuccuaaucuccacaacuaucaaguauuucggagagcagauuagcaaccucaaccgaaaguuuugaacuuuaucaauaucauacuuuauuuuuuuaaaacugaaaaaaaaaaggacagaaagguaaaagaacuugaagaaauucuuuuagccauggaugagugauaacagcugagaauccuugagcuuaccauuugauauuucuauauuaauuuaaagaaaagucaaaagauuuugaaaacagcaauagaaguaagauccuuuaagcucuauucagcagccccuaagaaaagugaugaggacacugugcaugcccauaugugaacaugguuggccaccuuagguauuuccccuucucuccacaugaauacauauuuuacucaaauucagacucuaugauguugaaacagucuggcauuggauguuuaccucaaaacccugcucucucugcaccuaggacaaacaaauccuaguucucugguguuuagcaucuuggagccaugaauuuuaaauaaaucaaagacaaaaaccuugucuuucccaguuuuaaaauauaaaagauacacacacacacacacacacacacacacacguguauuuaaaauagacccuauaaccucaucauauucuuacauccuuacaugguuuucuucuuaaauuguggaggaaaaggcaggcagacacauuuaauagcacagugaucaucauuuuuuaaaugaacuguuacagggacauaaucuuaaacuauccauaauuuggaauaggcacaacugugcauuuaaaaaaaugcaauauuacccuuauuuucucaggaaagcagauuuucuggagggaaaaguauauauuguauauauuagaaaauauacauauguucauucacucuuucugcaucugcugugcuucagaugcuuuuggggaugcauaaacguguaaaagaaaguaucugaucuuacaggccuuuuauccugguagagugauaauacaaauaugggucuaacuauaaugcaagguagaauuaugaaaugaccuaaggagcaauucagaccgcuaggaaaagcuucccggagaagaugccauugagcucauauucgaguccacauagaauuucaacaauuagagacaggauagaaaaggcguuucagagccauauaauaaacaugauuuaaaaccaaaaacagaaaauaaaggcucaugcaccuaaauggaaguaagaaaacugccugaugauaccaguccuugcagcuugccagccagggcugcauugggugaaaagccccuccacagcacggcagcuccagcaguuggcucgaauauuucacaugagaguccacaggaagagcgagcuuucauguauauuuuuuacauccaaauuaaguuaacucauggaauuuuccacccuuaggaauuaaaguagcaacucaugaaguaauucaguuaugucauucauaccaaaacagaaaauacuggagcaacuuggcacuguuuaaaagccaagauuaggccuuggccauuuuauauuuuuucacauuccauggccguuguguuauuuuaacuuuuauuauggcuguaaauuuuucaaaucaaaaguaucuuaauugcuuagaaaacagaaguugaaaauggguucauaguaagaagaggguuuaggcaaagcagcuuuaggagugagaacugaaaaaaagcuguagcauuacauuuucuguaaugcgaggguucuaccuauuugguugacauucacaguugugcauaauuauagcuuccucuauauccauaaaucaucuuagaacuauaaaguugaguuuaaccaaaagaucuguccaauauuagugaaaugacaucuuuagggaagcauuguccugauacaauagccacauucauuuuaaagcaguuaauuggacacauugucaaaaaccacgguauugaguuuccacauuuuaauuucacauuugccuucucccuggcuucugcacacggacgggucucuuuuggagcugaaagugugugaaaguuauuggagaaugguagucucuggguaauguuucuguaagcugcccaaaauuuucccccuguagucuagaugggaaacagcugguauuuguuuaaaaagcuguuuugcaaaaugucuaaaccuugagauauagaacugaggucaccauuaaagcaggugcuuaagagcaagugagaaagacuucagaggccgacuggcucuggaaucuucugcagggcacuuccuauuagaagaaaaaguguugaaguuugcuccuuuauuuaggacacggcuauaaguauuaauaaguaagugcacuagcaauacuacuagaaauugaguauuuuugaacauagccagcccucaagugaauaauuagcucaguaugaaaggaacuaaaauggucauuuuucucacagggcuucaagauacaagagcccaaggcgcucuagucuccuuuggguguuugaauuuccucuuuaaacacaccaacaguaaaagaacuacuauuucaaauaagcaguaccauaacugacuauaucuuccaagguuuuggaugcaaucuaagggaaagggggaaaagagacccgacuuggcaagacccguaccgaagcagucuggaaaaaaagcaaagcaaaaaacauguggaaccacuaaaggccagugcacgucagguauccaccagucugaagaugaaaggaaguaagccuccuccccugggagcuggagguuauuagcagcuguuuauccagucgggaauagagauuaacauuguacuuuuuuuuuaagaacuagaagaaaauuuguuugggaaguuggcuuuucauaucaagucacugugcuuugccaaaaaaaacuuccuuucucagaacucauguacuagcauugagcaauguuaugauucucugagaaacucugaauuaccaaaaagucuuucuccauuaaauagaacagaaaaggacagagaaaugggugaacguuugccauugacacauugcaguuguacucuuuaccaugugaaauuugccguuuggucuauuaccuguucuccaaccugacucuaaaugggacacucugcccucuaccccucacacguacccucacaacuuaaucauugccacucuaaggugcacacaauggguucugcagauaccuacugcuugcaaaaagaccuuucaugagauauuggggaaacugccuaguacucugggugcuuuauucucaaaaaacaaacaaacaaacaaacaaaaaacgaguuggauauagguauuuuuccccugauuuaaugcuacucuuaaugucauuuucuuuuauuaaauccuuucuucugcuuuugaucuuauuuauagcagagccacuggucauauggaaacuauuacuguauagcugcgagaugaaagacuucauggcaauuaaauaagagugaaucauuugggccaauaauacacacauacagugagguaccauuuguguccaaaaugcccuguguuguucacuuuguagcaaagccauugagcuuuacaaagggcuuuacaaaaaucugcuuuuugucagaaauauguagucugacaauaugaaaacacauguuaacacacaguccuuagcugcuugcuucuucacacauacacaguaucuaaaucaugccacuuauugauauaaaaugaaauuuucacuuaaauuugggauauuauuuaguuguguuaagcgucagcucuuuaaaaauauauuuggauaaucuauaucaaaauucgacccaucacucaaaaccugccuaaaaugucauguucuucuuaaaguagucccugguuuccuaaacggguaugacuucaucauuuuuuaaaacccuacaugaccuuguacuccuuuaugacauucaucguauuuugccuuguauaguaauauuaucccaucauuaaaauaucagugccugggcuaggcgcggugguucaggccuguaaucccagcacuuugggaagccaaggcgggaggaucacaaguucaggaguucgagaccagccuagccaacauggugaaaccccgucucuacuaaaaauacaaaaauuagcugggcguaaaggugcacgccuguaaucccagcuacuggggaggcugaggcaggagaaucgcuugaacccgggaggcggagguugcagugagccaagaucaugccacugcacuccuuucugggcaacaaagcaacacuccaucuuaaaaaaaaaaaaaaaaaucagugccugcaaagucauagacguguuuauuuuuccuugcaaaugcccauguagugccuugcauauaguacacuuucauaaggcgcuugucaaauuaagugaaauguuuauuugauagaaacaugcuaaauguauauuuggcaauaucaaacaauuaaauuucagacauagucucacagauccauagcauuugugucaucauuugcuaagcaucuaacugcacauuguacuauuacacucccgugcagugaccugugcaguuccuguccuugggaugggaugcccacaaauggagacaaguauaggcuuuacgaauggcagcaaaacaaacuuauugaaguuuaugcccugcaccauucaacaaugaccuugaauguguuuuaaggguggugucuguaaugcauagugagcucgugaggugacaagaaaguggagauuucuggagauccacucagcccugaagggucagagagugaggggaucugugaggcuaauaaaagagaagcaguuggugaguuaggaggaaaaaacuagcccagcagacagagcagggagggcuuugcucaagccuuagugaugugggcguuaacccagcagaugagaggccaugcguagguaauugaacauugauagugaggaauuuaaaaauaggagggaacugcauugguccugggagucuaggugaaggaugcaucagcacaagguggaccucuuagacuggauccauacagcaagcaagagccaggcugaagccuuaauauugcaucaacugauggagagagaauauugcauuuaaaagaugaguauuuggaaagugauggggaagaaaugguucauucguuuaggugagcuucuuuauacuucuacucucuuuucaaauauauuacaguaagcauguguuacuugaauaacaagaaaagcauuuaagaaauaaaggccaauggguaaugguaaaucccuagggauccuuagggaugggccaccuggacuggcuaaaaacuguguggaggucagcagcaugacugugcacucucacagguaugcuugcacuucaggcauucagaauuccaaguguaaaucaaguguccaguugucuuuuccuuuaaacaaaagcuguuuacacauaauugcuagacuucaccauauucucugugcuagauauguuugguucacuaggauggauuaacuuuaguuccauaccaucuacuuacuagccugcuauguggagcaaggaagagauagaggaaugggcucuguuaaucugccaguguccccgcuaggugagcucucuccaguuaugguuuccacuguauaggaaaaugaugucgagaauugagggugugggacacagaagagagaaaugaaacaguuuuaauagauggaacguaugaguuaguacaagaaagaugaacugaggucggcucacauccguuugcauuucuugaacuauaucauagaaucauucauuuaaccauuuuggugaacauccaggggaguuucagcccagcugaucauaugauagacaagcacugccaaggucaggaucauuuagaucauguuuaaauccucuugaaaauuacuuuauuaucuggagaaucaauauuaaauaaaucuccaagaauugcacaauaaggaauuaccuuacauuucauacagaacauaagagaagcugugauguuucuggaaaacaauguagguguucucaagacaguuaugaaaucuucucccgacauacauguuaagaaucaaguaaaaauccaaacaaaagaauugaauccagaucugauguuaaugaaaagucucuuaaagguuuaaucacauguacuaaagaaaaaucaucugauaauuuuuuaaacugagaaauauggaaauuauguuugugguuggagugucccagauguuagcucuuucucccacaacaggugguuauuagagguaggucuuguuuucugcagagccucugugccucuaguguuguuccucacaguaucuaucuacugcugccauuccaugaacuuccuaauucccaucugugagccauuaaaaaaguuugcaugaccgcuucccaccucuuuaaaagaugcacuuuuguacuaaaugguguuuugcacauuugagaaaauaaguuugcuuuccucuaauaugacagaggucuggcaagauaauugaaacugaaaucuaguacucuacaacugucauguauaauugauauuucauggggagauuacaguucagacaccaaaacuguuuucuguaucaauggguuucuaauuacagugaaaacccaucagcuuuucuuuuguguuaauggaaaaacaacagagaaaaguaacaguaaguugcaguuaccaggacuucugucuuugucccauuuuguuguuguucuucuuucuaaaaaccaaaaaaaucuauguccaaaauuggaaaccagaugccauuaauagcaaacuuuaauuuugauguaccaaaauguuuauaauaguauauccaguuuugugucauuaucacuuggucuagaaacugaugacaaguuuccuaaaguucccauuguauacucuuuuagaaggauuaugguagaauagaagugacugaggucugaaagccuguuuugaagcaguuaucucuggagauaacauuaacuaggauugaauaacugccaaaugaaauuuaauacauuuucccauccaugaaauaggccucuuaaauacaacagaauaauuacuuucacaauacucccuggaaacaaagagagcaaaaauauugaaugucuuuuuuguuugugguguuuguuguuagcuagaggauaaggacaaggauauuuaccacaaugcugaaugcaucuccauauaaaaacagccuugccaacagccaccuaauuugaaucugcaugucuuuuaaaucuguuuauguuggagggaucguggcaaauauuaaauuuuauaauuuaguuagacaucuuggccuuggccugaguuaaugaacuaugauuuucccccugcaauaaagaaaaaggaaaugauuuuccucuaucuauauauguacguauauauauguauguuauaugcuuguaccuagguguguguauacauguauggacacacacacacacuguuuuaaaacaaaagcucugggaaauaaacgcaucuugcccccuaacucuccuccccucuccuauauaauuguucaguguuguaaguuuucugaguucaaaaucuguuuuagaucuccaacuaagcaucgaaaguuggaucuuaagucacuucaccauucuuggccuuagcuuucuuuguaaaaugaagaguuugaccuaacugauauauaaccaagguccuccaagcccucgacgucuaaguucugugauuuaaaaguguuucuaucaguuugucaagcccuuucuuggaaacuaagguuauuuaaaauuauauggugcuuacgugauucaaaauaauuauugcauaucuaaugacauuuaauuauuuccauugacaaauucacacaggagaauucaaauagcuguguuggaauuugaauauaauuugaccuaagauacaauguaacucagacauuuacaccuacauguaccagucaauauguggacgggacaggccaagccgccuguguuuggacuacaugaucuuauccccccuuccucguuuguagcucucuggaccgggaaaaugccugucauuaagguggcccauucauaguaugaccuaugucugcuucaaaaugagcugggccauccagugaucuuggcauucugagcuuagaaauacaaagacaaagaggaaauuagcaggagguacagaaccagaaagaaugcaccaagagguaucaugaagaaagaguccaaucugucaucaugagagggcagaagccagagagaagcagagguccccccagagagaggagagaggcugaauagcccagcagaggcgaggaguggcauucgguucccaagagcucucugaguccaaaaccuaagcuacagaaaacuauuuaugauaaaucuuuuauuugaacaaacucaaauagguuucucuuccuuacuauuaaaacuaccccacuaaauugaucagcauacaaaaauccccccaagaaucauuaugaguuccacaaaaaccaggaccacaucugaguuauuucucauucuauccccagugucucccaaagugacaggcaugagcuagauuagaaaauguuuguuaaauuaguaaaugcauucucugaucaaucaaugaauaaucauugaauaauuuuuaaauuucacuucuaucuucuauuuuuagcauagauaucacuaaaacugcauuauacgugacuaugggaagauucacauuuacaaugaguauuaauaaaauuuucauaagcuggcuuuuaacuuuagacuauuguuaucucuaugaaaagguuaucaaaauagagcuuuaacgaaguauggauuuucuaaaaauagggacgaaaugucaugcuuagaauugacuugugggaaucuccuuucuccuagucacauuaugacguauuuaaguucagaaugccaagaucauuggaugccccagcucauuuugaagcagacaugggucauucuaugaaugggccgccuuaaugccagugggcaaaucccugacccuuguauauacagagaacagugugaguuucuccaucuauuucuguguuauucuagcgauggauuugugccgacaguccacuguguuucuucccuugucucuuaugugaccagaaauaauguuucugaaagagaagaaaacaggguuagaauaugccaucuguggccaaggaaacaagcaaagccaagccaauuauucaaauuggaauacucuuccacagccacaggcaauggaguugauccuauccuggagaaucaagcucauuauuacauggcucuggaccuaucagagggcauucacaugaccuggaauagacacaaggggagucuuaaaacaucacgacaaauuagccggcgugguggugggcgccuguaauuccaguuacuugggaggcugaaacaggagaauugcuugaaccugggaggcagagguugcagugaacggagauugcaccccugcacuccagccugggugacagagcaagacucugucuccaaaaaaaaaaaaaaaaaaagucagaacaacuuugucucuaacauucuuuauggaaaaugauugauauuauuuaagaugaucuauagaaaauagauggaguuagguaacauaugggccuaaaauccaaacaaaaauguaguuggaacaacuauauccucagauauauuuauaauauuuaagaguuuacagucauuguauaggggaaagauuuaaaauuaaauggauuuuaacaaaauagagacaaagaucaccguaacugaagauagcuugaguuuugaggggguucuugaacuacacaggcuauuauuucuauauaacaugcaaguauuuucagucaaaacacaugauucugucugcaguuauuauguaccuauuacauaccaguugucauguacgauugcauggguucucuuuuucucuuuugagaacuuaccucaaugugaucuagagggaaaaaauuucaggagcaguaacugaauauauuuuaaguaaaaagcaaaacauuacucuuaaguuaugucacagaugcuugcaaagaaaucuugagaguguuaaugauucugaaauaggaguacacuucuccucuaugcucaaaucugugguuaccuucagugauuuugacuuagagucauccuuuguagaaauucaagaaauuagauccauugggaauacaaauaaauaugaaucagcacgaagaauuauuuagguuuauauugauugacagacauaaagagccaccauuugaucaaggccuguaaaaauucaugcuuacaaguugacaucuuagauugaaaggauaaucauugauugaauccguuuucuaaugcaugaauauaaaaauagcaaaucaaaaccucaauggaaaauagcuaucaugcuucugaauaaaaauuaaaauauauaagagagugaguuacaaaugguugcuggagcaggugggcguggucugccuauaagagagcagacuucagucacagaggaaaggagugguguggcaggcaacaggguugaauauguuuaaaaaaaaaaaaagguuuguacuuaacgccacagagcucuagaagcugaaacuagaaucagugagugaaaucuacaaagaggccaauuugugguaaaaauggaaugggcuucuuugggagauaucagucucaguacauuugaagcaccccacagaggccaaauaaccaccauucagaaaguucuguguugcgacacaggcaccggggagcagugcuggacuuccuacaucucucugcugaaacauucauuuauacuuccugaggcucauaagccucaaguguugucuuauucuugcuguauuuugaauccaaacaauuaauaugauuuaugugaucaucuccacccaaaauuuaaaaaaaaguuggagugcauacacacacacacacacacacacacaugcacacaugaauauaaaaauggcauacuucaggaucaauuacuuaaauauauuuucaguaaaaagcaaaauauuauaggugauacuuaauacauggcugccuuuaaauagcaugugcuuauuagguccugugaauuuguuguugguucagauacuuauuguugaugcauucuuuggaaauacccuuuuaaaauauauugguaacacaagagugaugauucuccuuucugguuucauauuuuugacuggaaaaaaaaauaaaccugauucauagcaguauaaauguaugguuaauuuuuuguguuuuagacccaccguccuguguaaaugcucacuuaaccauaggcuaagaaaauacuuggaaauagaaaagaaaaugugaacuacugauuguccucuuaguugacaaaugcuucauguuuucgcuugaaggcaugugcuaugaaguaggcaguugcugucucagugccacaaguucaaugucucuggaccccagagucgauaguaguaguuaauaaaaagcucagcaguauuuuuuuaaugaaguaaucaugcuguacucuauaauuuuauucuuggaagcauaaagaguauuuacaauauggugucuuucuagggucagaauagugaggaaaaaaauggaaaaauguccaaacauccuuccuugcauggcaaugauggcauuacugguguguuuaauaaaaccuuuauugguacauuuuccggugugguggcauuggcagaaaccaucccccuuuggauuuggaacucagcagcugaugaaauacaguaaacauuaauuuggaaugggcugccaguuuuggaaagccaggugacauuuuauuauauuuguaccaagcagaggcugugucccauacugcuguagcuuccgcugucagaggcuuagcuggcauuauggaaaaaaaaaaauggcaggccugagaaucuuauccccugaaaugaaagucgaaugccaaauugaaauuccuguaggauuuccgauagcaaugggggaauugagaagcucacaauuaagcauaugggcauuaagauaauugucagaucuguuggcggacaugauagaagacagauggguacgaaucagugcgcuccacugcagcacccugggaggcaauuugacguuuuaccugccugagcuacucugccauauuugucacugaauguacagcacggcaucuuacugaguguuaaguguuuucgccgggaacuauaggugcaugugcgguccuucagcgcccucuagugaaacgcguuugggaguaugguuuuugaaaagccagccuucaucagguccucuuggccucuggaaauagcugucgcaccuccgguuccugcucaccucucugguuccucucgcccuuucagguggggacccaucgugaagauggcguggcccugagaggcagccauucucuucugccaaaccagguuccgguuccacagcuuccuguccagucugcgacuuccccugaccugaacccaccccaggacccuuacagagguagguuggccucaccagggcacuucugaccucacuuucacaauaggaccaguguugauacccagccucuugguguucaucccucaagaagcacuggcagaaacccaggaaucaaauugggcacaaaaaugguaaggaaauggcaaaguauuuagaacuucgcccgcuaauuguguuucuccagggacuguuuuccucaaacauccucugaaauccugguccuauaucagcagggaaugaggccacagacugaugagaggaaauuuuauuuuagcuauuuccacauuuuucucauucagguccucuaaugugguuaguuguggccugaaaaugauauuuccaaaugaauaggaaggaaggaaauuguuuuuguuguuuaagauggaaggaaauauaggugcauuuaaaaaauggagcuugguugcaugauuuucgcucuugagucaucuagcccucuaaugauugccucauaccggugauuacgagcggcuuuucaugaccccaggaaguugggcuauugcuggccagcugacuaggagucgcuuagauaacaucuucucagucccuucacauuuaauauaaaaaugauaacauugccacaggaauacaugugggcauuuuuucagcuguucaacauuguacagaucugagugucaauuauauguauggguaugucugcccauuuuuuaugaauaauaaucauuuuauggacuuuuuuuuuuuuuuuuuuugacagagccucacucugucgcccaggcuggaguacaguggugcgaucucagcucacugcaaccuccaccucccagguucaagcgauucuccugccucagccucccaggggguagcuaggauuacagacaugcaucaccaugccuggcuauuuuucguauuuuuaguagagacaggguuucaccacauuagccaggcuggucuugaauuccugaccucaagugaugcacccgccucagccucccgaagugcugggauuacaggugugaaccaccacaacuggccaggaccuuucuuaucaggaggcuuuggauuuugcccucuuuguccuaaaccugugcuucucaaacugcacauaagcacaaccugagcaucuuguuaaaaugcagauuccacuucuguaggucugggauuguccauuucuaaugggcucacagaugaugaggccgcauggaccaaaguuugaguggcaagguucuagaauacacagauuacaaauaaagaggaauacuugacagauaugcuucuaccuuuaaaaaaauuacuacauuagggucguguuuuaaaaugcagugugacuuggaaaguugagcaaugauaaagcuagaaauuucuaaaaugaguagcaaacugccuuccauauguaccauuuuaaaaugcugauuacuucuugagaauaagagaagccuaauuucagaauaucauuaggguaccuauugaagucuugacugcacauauuuagcauacucccugggaauuauauuuuaaggacauuuuucuauuaaaucauugcauauggaagaaacucaauauaauagcugauauuuacuuggguucuuaaucagaacauuggcugugugauuuucaugauuaugauuuucauugcaauuaaguugauguuuuguagacagugaaauuaccaucuacuccaaaagauugcaaaauagaauuuaaccuuagagccaaugcagggaaaacuuguuucugcaggugcauuuuuugaaacuucaacagauagcagggggaaaaaaaagugacagaaggaucacaguucagcaguaugaauugucugcuggcagccuugcaaucuggugugcaggcagugagauugugguguacaugucaccugauuucucuuuuucggcaggcaugccaccaggacuacaggggcagagugucuccucuggcagcucugagaucaaauccgaugacgagggugaugagaaccugcaagacacgaaaucuucggaggacaagaaauuagaugacgacaagaaggauaucaaaucaauuacuaggucaagaucuagguaacaguauauaauacugucgcuucauuuaauuccuuuauuggacuuugaugaagugaacagaacgggaagaaacuauucaguuuuuuccuggcagguaaauuuacagcugaaaagaaaauuaaaggccuacucuagaaguacuaaaaguaucguuucagauaccuguacucuauuggagccuaaacuguuuuggcauuuaugaaucuggacccaaugcuaaugacacacagugaaaaaauuugucucugauucaaguacaguuuauuuguaaaacuauacuuauucuacaaauuuggucagaaauguugugucuauaauauuucuaaaaagagauuguagccauguuaaaaacucaacugauguaugugccaacuauaacucuuuucuuaccucuaaaguaagaaaauaauuuccuagauuuauccuaaacaugcugauguauauaagaguaauaccuuaauuguuuaugguuuuucuuccuggacacucuuuucuacagaaaacacaacugcaggaaaauagcuucugucugguuuucuuaaauaucugcuaucuuuaaauucaaaucuauaucuccuugaacuuuaaucugguaaucagaugguuuuugaauaccaacacccguguacuuugccucaauucccugagguuguuuuuauucacaaauucaaccaauuguccuaagacuacagcuuuccuucuaaaggcugugguucucaagguucuaucuggaaucuuuugugaauuaagaacaugcugccucuuuauguugcuguuguaauuauugagauaaauuccgugucuugccacaaguuuaaaaaugccgaauacuucuagauaaccccuuuccuuccuuguugucuuuuucugauucuuggccacuuuggcaagaaaucccaaggaggggauuucauaccuuuagcagcuucuguguuagaccagucaguucuugguaauuuaacuuauuguggccaaacuuaugcauguuaauggauucuuugaaguuuuggaacaacauuuucauucgcuguugagaaccuucuuauuuaaaaaggucacucuuaugacauuuacuuauguaugccuccaaaacuguauuauaaggcagugcuuuuucaaaucuaggcaguuuuauuugcauaacuaguuuauuuguaagugaauaaccaauucuaauuggucguuagccugaaaaucuuuggaagaaaaguuccuauuuuccagucuccuuuguguaagguguagcauuuguuggauguauaaaaauaucacccaaaugcucagcuuccggacaggccuggcagagacuguuuucauuugcuuuuuacagccuauuugcauaguagaauauaggagugaauuaaucauuacugauuuccuuggcacuggcagcaguugggggugagggcagaggagggauccgcagaaggcagagaaagagggccuuuuccaguggacucaguugacuuccauguuuaccauacacaccuguggcagacagugccaucuggaaaggcgcuuacgcuauggagagagaggagccuggucuuacagcauccuucuguggugucauccuccuugccccuaacuuuucuccuucacccaaguguucuugacuuacgugcauuaucuuuauguguaacguauacuugcaaccgaagaauaccacucccacuuuugauugauuggagcuucucaaguguaauugguccuuauugccacuuggaaguuacccagagauucuccaaaauggaacaucagagucauauauuuuaaaccagcauucauuaaauauacauuuaauugaguagauaauuucccacaucuuccaacuccgaaauguugugauuaaucaucuuuauucugugaacauuuccaaugugugaaauuacccuuuagguuaauuguuagucacuuccauggaguuucuugugauggggagucuacugauguucagugaaguuuguuucauuuucugugucucucauaagccccccaaaaguccucacucauguuuauucacaauagucauucagagcuuuauagcacgugcugcucugccuucuugagacaagacgucgugcacacuucucuuuuuuacaugacagcccuuggaauauuugaacccugcugcugugacgacuuccucauaugauaugcuuuccagguggcucaucauccucuuugccuuccauucaaaaguuucuaauuugucacuguaacacucagaaauggacagaaccgaucuuaucuuuucagacuauucugggcccggccaugcauuuguuaugaaucauggaauauuuugguuuucacaauuagaaauuaccuuuuggcuuuuuuuuuuuuuuuuuuuuguaagagacagagucuggcuguguugcccaggcuggagugcaguggccugaucacaucucacuguagccuccaccuccuagauucaagugagccucccaccucagccuccugaguagcugagaccgcaggugugcaucacugugcccagcuaauuuuuuuuuauuuuuuguagagacgaggucucacuauaucguccaggcugggguuauaggcaugagccacugcacccagcuuucuggcuucauuuuugacucacaaugaggucauggucauucauaagcugcagguguuugguuuguugaaucguuuugcaugacugauaucaguucagguuucccaaacuuguucuguggaucauaaacaucuauaagauuaaagaccauggaagucauguuuuuguaacuuuuuguuuaauacauagagaaaaugagacucacauaguggguugaccaggccuucaaagcaagguaauggggacaccugaauaaaagccucacugucuucacucccauugcucuggugucuuacauauaggccuuucuucuuacuccuguuaagcugccuuguauuuuuuugaccuaucaaaaucauuuuucaauuacuuguuuccccuagauuucagaugucacgguaugaaagguuuuauauauauuuaaaaaauaaaguauaaacauaaagucuuuuugaagcgugguuaugcaacauaugcuaggcguaaguuggugaaugccugcuuugcagaguguaaccccauugaauaaaaaaagcuuuguuuucccuuucugccccccuguaucaguaugggcacacccugcacucuaacuuuaaucuacgucacccucaccuguuugguuuggguuuaaugucugcgagaaaaccaaauaucuuguguauugugaacugucaaagccaucuaaaccaaucccaaggucaaguggauauaaaaauucugccaaaaacauggcauaagauggaaaaguucccugaaaacucuggaagaaaacaaaguaauguagacaccuucuuuuuccccacaccauuagaaaauguugcaucccuuuugucccacagcaauaaugacgaugaggaccugacaccagagcagaaggcagagcgugagaaggagcggaggauggccaacaaugcccgagagcgucugcggguccgugacaucaacgaggcuuucaaagagcucggccgcauggugcagcuccaccucaagagugacaagccccagaccaagcuccugauccuccaccaggcgguggccgucauccucagucuggagcagcaaguccgaggucagugcaggccagccuccuugcagagcucgugaggagcuuguggcaggcacaagcugagaugggcacgccagucuugagcaguggcagacaguagacuuucaagcaucauuccaaagaauuguuuccauugcagacugugucuaaauccauaaggcagcaucccuuucuccuguaauuaaguugugggauucucuuauaacuaagauuauauugcaacuuucccuauauccuuucaguaauuugagcuuaguuuauuugcuuuaccaaccuuugcuuacuguaaaguggcuguacacacucacaugcaguucaccuuuuacuagugacugaccaaauggauugccacaguacuuaguaacuguuccuuuuguucuguaauauaaacacugagaaaaaggucagacacgcaagaagagugcauugcugcccucugccagaagccucagcauuaaacaaagguucugugcuuuaauccuccacagaaaggaaucugaauccgaaagcugcgugucugaaaagaagggaggaagagaagguguccucagagccucccccucucuccuuggccggcccacacccuggaaugggagacgcaucgaaucacaugggacagauguaaaagggcaaguuuguuuucagccauuucugagaucgaucauucaaaacucucaucaguguaucagccauaaaagugaauuucacccaaauugacagauauuuucuuucauggaaaaagaauuuuuuuuaaaaaaagcauacuuuuucuguuacaaauauauuaaugaauuuuuucucucuuuuuuccuuucucagguccaaguugccacauugcuucauuaaaacaagagaccacuuccuuaacagcuguauuaucuuaaacccacauaaacacuucuccuuaacccccauuuuuguaauauaagacaagucugaguaguuaugaaucgcagacgcaagagguuucagcauucccaauuaucaaaaaacagaaaaacaaaaaaaagaaagaaaaaagugcaacuugagggacgacuuucuuuaacauaucauucagaaugugcaaagcaguauguacaggcugagacacagcccagagacugaacggcaaucuuuccacacuguggaacaaugcauuugugccuaaacuucuuuuggaaaaaaaaaauauaauuaauuuguaagucugaaaaaaaaauauuuaauuuaaaaaaaauuguaaacuugcaauaaugaaaaaguguacuucugaagaaaacuacaugaacguuuuuguugguauucaagucagcuaguguuuauaauuacuggauauugaauuaggggaagcucggcugcccuaguaacaaaaccagcaaacguccugaugacaacgaagugaugacauuagccauuccuuaggguaggaggaacagauggaucuuauagaccuaugacaaauauauauauaaauauauauauaaauauauauuaaaaauuuagugacuaugguaagcuuuuguucauuuguuucagacuuuuuucuccuguaaaaaaauaguacugauuaacuuuuuuaaaagaaagauuuuacuguaaauauggauuuuuuuuuuuuuggucuuauuucugucccuuucccugguuuguuaucguaaccuguagugccaacucugcuuccagagggguagugcaggaugaaaugcugacccugauguugcuucucauucauaaauaaguagaaaguuguuucuccagucuuuugggaacacaggacuuaaaagucacaucauguguagauauuacaagcagcauuaccaagacauggcaaaaagaguuugucugaauuguaauguugcguuugugaaccuauucugggauuuucagagguacaagguuagaaugcuacaauguuaccacugugccuuccaauguuuauaucaucggaaacauaacauaaucaaaguggcugugauuuaacaaaaugauuaaaguguuaccuaccuguguagccgaaguagugugcagugaggcguuucugaauacauggucagauuuuuggaaaaaaacaaaaacaaaaaaaacaaguaaaguucaaaaaccgucaaaugagaaaauugcaaguagugugacagagcugauugauuuuguugcuuucuugauuuuuuuuuucaaaauggguuuacuaaaauguagaugacuuaacugccuccuccuucgucugaaaaaugccaauauucaaucaucaugcagcauuauaacaagccuuauaaguccuaaagcauuaaguugcacuuuuuugaggagggguagugcaguauuucucuggccaguaugaaugaaguuuauacuuaccauauuugauagaaacauagaucaagcuauggcacagcgacucaucagauagcuagcuuugacgucugggcacaauugaaccaacuuccaucgugaaucuuuauaaugauugacuuugguguauagugcaguaaacaaauagugcuccuaguuaaguauuugucagcauccuuuugucucuaacuuguuucuauuuuuacagccacacaauucuuggcauguauuaagaaaaaaaaaaaucccuguucaaguaguuuuuccaccuaucagcacugaguaaaugccauaaauccauugaaauggucuaaauguuccaucuguucuccuguuuugccaguuauauaguaaugaaauacauuuguaaauuuuaugcaacaaauggcaaacguaucauuauuuugaaauuguguauguaaaaguuauauuuuuacauguagacucuuguuauuauguguuuuaauacauuguaucaguuuuuguuuuuuuuuaaaaacugugguuuaaaaagaagucucauuuaaaugaaauagcuacaagaaucagaauuuuauguucauuucugaaaauguaagaacaaauaagauaguuaccacguggucaucuuuuacaaacccauaaacauuuugauuagcuguguguguguugaaaaacuguaaauauguucaguagcgauaaaacuaaaauaacuuugauuuguugauaaguuccuaaaauguggagguggauuaaaaccuuaggagaauagcagaaaucaaacuucaugaaaaguuauuuuggggcuuuccugugaaauguaugaacaaagaggcucagagaaggacauggaagacaauaauguauacucucuccuccucccugaauaaugaaaaccauguguauuuguucccuccguauguuaaagauuuccuuuuagugguacauucugcacucauuuuguauagucuaccaaggcggguaucccuaggaacaauauuauauaggaagcagguauacucugaucacauucaggauaaguguacagaagaaaauacgguguuuacucuuuagggaacuggaaacacucccugcauugauguacauuuuaagaauggcacuuuugauacauguuaucauaaaggugcuuaauagagcugaauuaaaguuuuucaaaucuguaaacaaagcaaaaaaguaaauuguagucauuugauuauuuuuuaaauuggugcuuuauauuuuguucucacucagaguaaaagcugcaauuuauuguucaccagcuuugauguauucauuacucaguaaugcaauaccucuauuguugaauucccuuuggaaauaagugaaaauucuaacggccacugaaagcugcucgcuagguuuugcuugguggagaaacauaaucugcaccuauccauauuaauuggguuguauccccauuaaaaaagaaaaaaagggaauguggccuuuuuaguguguuuuuuauuguuguuguuuuguaauuaucaaacccagguaagauauugguauccugcacuggauuuucaaaugaaguucagcagaagacaguuaagauuaaaguacuauacaaaaauuucaaaaggguccauacuacgcuaucuguaugacgacacuuaggcuggggaucucuuucagaaacucggacuuuaaaagcaacuuggagcaguugauccaccuccacauucaaguaauuuaugaauaugcagaauagggaucuguucaucuagaaauuuuuaccauuugucuucuguguagcugcaaggaacacuaauguuuauacaacugucaguccacccaguggugcaacugguucugauucagucuuccgauuccuuuuuauuuuucacuuuuuccuauuucugaauuuuuuuuuuuauuugugaucuugauuuugaugagggguuggggaguggggagggagucgaaccaagacuuggaguuaagaggauuuucaucuuuugcauccaacaggcagaauaugaucuguguccaaaagugaacuugagucaggaaugaaucaauuucagcauaaacaagcacaaaaauuuagucugcuggcugacuggaagcaaaaaagucaagauggaauaugaugaauuccaacacaauggggcaccaaggccuuuaggccucucuuuuuauuuugcuuugguuuuguuuguuuuucuuuagagacaugcucuuucucaugggacuugaaguggacucaucuuugugcagugcugguuuugccauacucauuucaaguauuauagacauauguaauggugaaaauauaugaacuguggccuuuuucauucuuguuacuugugaugcaauuaagugaagauaagaaaaaaaaaaaaaaagcagagauuuaccauguaucagugccuggcuuuuuguuauaaagcuuuguuugucuagugcucuuuugcuauaaaauagacuguaguacacccuaguaggaaaaaaaaaaaacuaaauuuaaaaauaaaaaauauauuuggcuuauuuuucgcaggagcaauccuuuuauaccaugaauauuacaaaaaaauugucagauucugaauauuucuucuuuguagauuuuuggaaucauuaugaguaaaaguuuguuacuuuauuuuacuauuuaaaagauguuauuuuaccauguguuaccaagaugaaacuguauggguagcuuuuuuguuuguuuuuuguuuuguuuuuguuuuuguuuuuguuuuuaguuguaggucgcagcggggaaauuuuuugcgacuguacacauagcugcagcauuaaaaacuuaaaaaaauuguuaaaaaaaaaaaaagggaaaacauuucaaaaaaaaaaaaaaagauaaacaguuacaccuuguuuucaauguguggcugagugccucgauuuuuucauguuuuugguguauuucugauuuguagaaguguccaaacagguugugugcuggaguuccuucaagacaaaaacaaacccagcuuggucaaggccauuaccuguuucccaucuguaguuauucgaugaagucauguacaugaccguucuguagcaauaaaugugccauuuuuauaaacuguuucugacacuuguuucauuucauuuugcauuguccauauagcuaugauucucuucuguaaguaaaacgcaucuauauuucauuuuccaaguguuggagguauugacagcuuaacaaacaaaacauacaaaaaaaaucacaaaaacaaauugaaaagcaaagcacaugauugaucaaggaagagaugcccuuaaugaaaauggaacgggaugcaugcaaaacaaaaagaaaacugucuagaggauuaacuaauugaaggaauauaauuaauguguguguaacacugaagcuaugcauuugaagagcucugaacugcaccaguguuuucgguugugcugcagguugcuaagucaagucagccuuaaccuuuugcaccaguuggucggcuguuuggcagaacauucucagaucuuuucagucaaaaaucuaagaugauuuauuuuguaucacuuuguuaaaagcugaauauuguuaacuacaguuaauauuaacacuguauuuauacuuucucaaacuacauccgccccaccacuucugguugccucuguugacuauuaauccagauguaaacaaccagauguuuuuuucuaacuuguacaaacugacgugugucaacuaucauggaaggaaaaaaauguacagauuaaaauuauucaguguuauguacuguaaguuaauauuuuuguagaauggacaucaaucuacuuugcaaaauuuggaggcuauuucaacauugcacuguagaaauguaaaguaauguaugcaauguaaaggaaagcccgcgguagcugagcgcuucauaacagaauguucuaaucaaguacgugguauuuggggaugucuccaauauugcucuuguauucuuucuaauuggguuuagugacuaguugaaggaaaauguuauaacgccauuugguucacaugugaagugcccuccauagccaaauguugggauuuuuuuuuuuuucguuuuugguuggacuguuugcagauauuuaaauuuuaugaaauuuccaaagauuuugguugauaacccccuuuuaccuucuaaaugauuugagauguucuuauguucuuacuguguguuuuaaauauauauaaaagagccacaagcauuu

SEQ ID NO: 6317 - RNA, 99529 nt, Homo sapiens; identical to SEQ ID NO: 6316

SEQ ID NO: 6318 - RNA, 200162 nt, Homo sapiens
auaggaaaguacuuuuauuugugacccaaguaugagaauuucuggcaaacuuuuuuuuuaauauuaaaaaaaaccccccaaacccuccaccuuuucccuucuuuccuuuucccuuucaagacuauuuaaauguacauaguaaaacauguuaggacagccaagccccagcauguuguguucuguccucuggcuggcagauucacgccacaacaguuuauucauccacaugcuuuuuggcgacucuucaucacguauuugggcuuagaucuucuggugccucccucggcgugcuacccauaaggucgaaagaaaagcaaguauucgauuucucuauucaggguggguuuuuuuuuuuuuuuuuuuuuuuggaugauagugguuuuuuuuuuuuugugcuuuuucuuuuuaaucuauucccuuugugguuuaguguaagaguuugagaaugugcccauaauucucucacucaacacuucugguuuaguguuguucuucaaauguaauuuuaggagacacucugcaaucaaaauggaaacccagaaaccccagagcagagauaucgacaaauauuuaacacagagagcuguuaauuuaugaaagccucuguguguugcuuucaaaauguggaacuuuagguuggcaaauguacacuugaugccaaccugguaccauguuugacagacaagccugaaguuaaacugaaaguucuaucuggcccucaagguuagaaagaaaaacuuaaacagagucugacuucauuuucuauuugaucuuuagguuaaaaaaugaugauuauuaaaacuggucuuuuugcugaggcagauguuuuaauaaaagguuuguauaaugauuaagaaaaagggaaaauagaaguguacuucuuuauaaauuauaacguuuauaagcauuuucacucucagaugaauaaaaugacuucugggaguuccuaagaugcaguuuccuguuuauuuaaaguuaaauuguaauucccaaaguugcuagcccagcauaaauaaagauuauaauacgccuuguuaagggaagagagaaacuuugauaugcggggccuuauuuuuuagaguauuucaguaaaacagaaagaaucaucaguuauuucacgaaaauuuuaaaauaaaucuuuuuucccuuguaugugauuaagaaugacuggguuucauuccuuguuaaacucuugggguuccaagaaacagaauuuuauuucaaucucuugcuucuuccaacuuuuauuuugucacaguuuguacaugaaccuguguguguguacacaggcauguguguaaauguguguguguccaugucuaaagauuaugguggcucuguccucucuccuguaaaaucuauugugguaaaauagcaggcaaaagaagguuuuacuuuuuuuuuuuccuuuuaguuuauuucuuuuuuugugugggcaaacugcccauccagaugguagaauuucaccuguaagcaaucugaaacgauagguuaauucugacauuuuauagagcuuuuuuuauuuucuuuucacacaguacaacuaagugcagaauaacugcucaagauaauguuucuuuuuuuuuuuuuuuucuuuuaaagcgcuuucugcugugauugguucuuuuuucccccaaaucugaauuuggggcucauuuaaaaaucuguggcuuuaggcacuuugcuguuauugucaaaaccacaucuaaugaaaucuuugaccagcuucuaauauguguaaaugaggaagugauggcagaagugaaaaagcagguuagucgccgagaagcagauccuuguaauuuuauaacgcugaacguuccacuggcuuugauaaauuuacuguuaguuuucuccucccaccaaauucacagauguauaccaacucauaacuucccaaguaaugccuagcaugguauuagcccccggaauccugggacuugcuuuuguugucagugugguuagccucugguggcuuaugugacugaguaaacuggagaaaaacuucagggugauucguugucccgugaucaaggaaucccauuauuuccaaaagcggguuagaagauguuuuuggaguagaguguggaagggaaagggaguauuggagauuguuuuuacacauaaucaugguaaucaugcuguguugacaaguuaguuuugaaugugccaccuucuuguuuuuauuucuagaaaaccuucauuuucaugaauuauuucuugagcugaugauaaagaugacuuuagagacaucuucuccccugguguauuccuuuagggaaacguuuuugaaaguguuucccuuuauuauaccuguaaggcuugggaccuuugucauggcauuguuuguuguuuuuuccguuuccuguuuugcacguguuaauuccugugggcauuuucuuuuuaaagugaugggauuuccacuguccagcagcaagccacauuuacuggaguuauugaacucuguaauaggaaaccugugggugaucaguuuuacccucccuagaagauacugcuucagucaaugagaauuacagccccaugacugagaauuuuaaagaagggguuccacuaagacacccagauguuuuguuucagguguugcaacaaaaucaacauuuguuugugggcagcgaagccaguguuccugccaguauucccguucagucgcuucucauauuucccuugcaaacuuucccauugguuggggucuguggagagauuucaguggcuggcugguggaaauguuugggagaacauuugcguaucaaagcaaccuaaauauuugcaaaaauguuugcuugagaaaaaagaauccacuuaggauuaggaaguaacugcuuaaacauuuuaaaagcauuugugauuucccuaaguauauuacucaugagccacugccuaaccugaauuucaggggucacucuggaaucuguauauuuaaaaacccuauaagauaauaaagguuuugcuuuaugauuaagaucugaauccauacauuaaaaugaaaaaacacuugacaagacaaaauauauuuuaagaauuguuuaucauuuagugaaccugcaaaacaaaagguguaaagaaagggccucaugaaaugguuggauguugaauaccucuaacgucauucuuucccucuacuguagauuuuuuguugguaaaacccaauuguauugcuaugauaugacauuccuucuguuggaguccauaagcuuucuuccagugguaaugauuugaaugucagaucuuuuucuugaguuuaauguaggcauuuucuguccacauuauuaaaguuucagcuacauuuuacugaugguuuggaaacaguauguguaaaacucaguguaggccaauuuuuccaauuuguuaacaagguaggaguugagcauugacaauuacuguacuuaaaagccccucggaucagguguuauuuuaccaucuggacauuuuaauuaguaauaaaaguguggaucuggauacacagaaauaggaucuacaguacacaauggcccaaugcacucuguuggugcugagguguauguggcuacauuuuauaaauauguauguaugugugugugugggcaaguguaauuaugugccagguguguccuuuuucaaacugggcacuaacacaacaccaaagaauuuggcuacuuuucuuagauaaaaaguaaaaauguauaaucuauaaacuugcacauaaguaaaacuguaucuuuuuaaugcuccuacuuccucaaguauggcaugacaaaauauaaugcugacauuuagguaggccugggcaaaagaugugacucuucucuuucauagcugugugcucuaaggcaaauaaauuaaccaccaaguaucccuuuuuucucauauucagaaugaaaguauaaaugauaauuguuaugguaucuaccuaacaggauuaugaggaagcucauuugagcauguauguugaaaagcacuuaaugaaauauaaggagucauaacaguucuuaacaauugauuguuaauacaggaugcagaugaccaauucauaccccacauaccaucuuuuauaauucaguaaaucaucucauauuuaaaaauaagggagaugcaaauauaauguuacauuagauuauuaacaaaugauaaguuuaagaccaccagaaaaaaauguguucauaaguuucaacauaaagcaaaaugacucauucuuauaaaguauauacaggcucauugacgcaauguuauccuuaauuaaggcaaaagcgaugcauuugagggaaauagugacccucuggagaaauagagaaugaaaauaguuuagggaaaugaaucuuaacaucuucucuuuuggaaaaauucaugcauguuucucuuaaucauuaugaauuucauguuugcaaaccagugugaauacuuaaacgauaaucauuauuguuuagaaucuaccuauuacuacacacacagauacacacacacacacacacacacacacacacacacacacacauuugcucaagaaaaucauccucaggaaguaaaggaguugauaaaauuaccauuggagcagaugaguuuggauacuucuacugaaagcuguuucaguuuuuauuauagguacaguucucccccgagaauucuuugggagaaauaaaaacauuuguuuuuaauuuaaaugagugguaacaugcuguagcauaauauuaacuauuucagugauuuuaucaauuuuaucuuccucugccuuaauguaauaaaugcauaucuugauuaaguacaaaucuuuacauuacguugucccuaaugacaaauauuauuuuaggcaacuuaguuuuaaucaucagagugucuuagggagcuuauaaaacuugucucugggacaugguauuagcaggauguacagaguuccuuuuuggugccaugcuaggaggagagacugacagagucaguccaguccauucauucauuugauagauaauaaguaaaccacagaagaaacgagaauaugucaguucugacuguacagguuuuaagauuuuuuagacuuaauauugaaaacuaguuuuacuuaauguucuaucaguuucauuuaaaugcccuaauccaaugaucacuuucauuuaaauauccuaaucuagugagcagauagggcuuacauagcauuugucuugaagacguuuuaaaaaugcagcugcagguccucaucuuugaaacuccauuugguaaaaauggccaugucuaccuuuaccuguagauuuaaguguccacagucgcgggaugagaaaagaaauugugacacuucuugaaaaauggucucaucaaagggauucaguugaaaaugugagggacugcauuuaaacuuugauaaaaaaaauaaguaauucuaaguaaagucuguagccaaacuccuuaauugugaugcauuugcugaguuccccucuuccgucgucgggccugcucugaugccauauggccuaccauggaacauuuaacuugucagauauaauggauuguccuggaagcagauuuuugcuuugagcacucggcuccuuucuugcauuucacucucagcuccaggcugcaggaugaaggauugugguagaagugcaaagaagagacacacaguugauuccccuuaagagagugaccuauaugccacaaaauuuuacccacguaaagaggcauuauccccgucacuggccuuagcaggcugcaugucaaagucauuuaaauuucccuggacuuaacagauuguguaaacauuucagaacugagagcuuaggaauaaugaaacaucgucauuuuaacuuaggcaaaaauggugcagccauauuggccaaaggaggcauauuauuuauugugaccuacauguaacguagaccaccugguuuuuagauucuauaaauuaaguucucucaaguuuaugaaggaugcuaaaaaauauauauauuaugauggaaauguuacuuggcuuuauuguuuuuguuucgugaauagagaggugagguugaaaugaucauuuaggaaucgcuucuuagccuuuuggcuaagaucaagugaaaugaucauuuagguggagggacaguggcagcuaauuauccuaccaggcuuucuagcuugaaacuuaggggcagaccuuccauucauucuaaccuauuugaaauuagagauuggauguguuauggacuauuuaauuuuuaucuguaaaaguaaauaauguagucuuuguucauuuuaauuuggugcuuuuaugaguuaauuuuuuuuucaauuugugcuauuguuucaacaagcuuggaaaacaguaggaacaauuugugacuuuugcaucuguaggaaaacuucuuuaaaagaauaaacagugcccuaccuauauguguguguacauacauagcugugagguacucuucugguauaaccuacuguaaaccccaaagcaaauauugugauauagagacacagaauagacaauuuacaaguaaucaaucaagcacaaaccagugggaaaauaaggaacuuauguaucucaauuuauucuuuaaaugcuacauauuugauugcuuuaggguugcaaaaguuaauuaauagauuuguauaagacacacagaaauauacauacacuaaaagagacuuugcuaaguguaauucaauauacucacaaaaauauguguuaauuauguuagaaauuuaauauuuaauuuaauuccauaaauccuugcauuacaaauaaguccucauacaggucagauagggcaauaaaaacuacuguggccuugaaaacugacagaagcucacuucuguacaaaucuuuuuaaugaacaacuuuccaucgagcagcuaagaaauaucuguuaaagucaguauuuaauacuaaaguguacuuauguauguuucuuacugauccuaaauugagcacguuaguuuuaucaaugccacucaucggcugacuguaccccuccucccccauacagauuuggugagacuuaguacuaaauaaguuuggggagugccuggccauagccggcucuuguuggggcaugugcgcccucugcuggcugcucacauaggaacugacuggugugugagguucuuucuuucuuuuacuuuucaagguuggguuuuuuuuguuuuuuguuuuguuucaauuuauuuuuauacaacugaucagauauuuaccaugauuauaaaguuguagcuuaauacugaguauggccguuaauuuguuuuuauuuggaaauaaaggugagguuuuguuuuggguguguuuuugguaaauagauaguccugauaguucaaauaacaugcaauguguguaauacucuugaguuuuuuaagugguugauuguauaucacgauuaaccauauuuucauugcuuucauauuccccuugccuugauuguauuugagaaguauucuuguuggacuaaguugggaauagaacuuaaaaggggauagauaagucauugaaauuuugaaauaugauuauuugucuguaauggaugugguagguaaucccuaguagaaaaauuccuguuaugguugguugauaguuuucacuugcuuugccaaggaaaaugaguauauuuacaucauaauacuuuauaaaagcauuuuugguuuccuugcaaaccaaauuaagcugugcucacuggcagacauugagaaugguaguuugaguaaaauauuuuuuguuuuguuuugcuuuugcaguugcuguuuauagaguaugagauguuaaaggaacaaaucacugauggucucuuuacucccaggacacaggacuaaacuauacaagggcaguuacagaggaagagugucagccucucuaccauugccuggguggagagcauccuuggguccugguagugaaggccagggcucuguguaaugagugugucuuuuaaaaauagcaacaauuuuuguugacaaggcuccaucaaagucuuuauaauaauuuaguuuguauaagugauuucuguguaucucugaaauuaaaugacuugauggagucaguuugguauuuguuguacagagaaggcaguuuagauuuuuauaguucuuuugucuuacauugcaaauuuuucuaauuuguaagcaaaagccauaaaaacuuccaaaccaaccguggagugaucaaagaacuuagagcuguggaagggcagaaaugucaucuacguuuuuuuuuucuuuucuuuucuuucaguuuuuccccuuugcaauuuuagguuccaguuaccuuaaaauuuguuuuggauaaaugauauaaauuuuuacuuaauagucuuuacuuacuuugauuuaacauugucaaauaacuaagaauugcauucuaacaaauauuaaguccuuauuaccucuguuagaaugucaucuugcaugaaaucucacauacaugucucuccuguuaccaccuugucuucaaugagguuguauugggugcucuuucuuggugcuucucuggguucccauuauaucccuuacugguggauagcauuguguuacuccugguauuuagucaucuaaacucuuaccuccuugagaauaaugugcauuguugacucucuugcauccagcacauguuacacagaaagcacccaacaaauauuaaauucccuauauuguguuuuuuaggccucauucaccacuauucagaugauaauuuuugcaaguuucaggauuaaaaauuguggucuguaaacauaguauauguaaugcauuuuauuuucuugcauacuuuuuauaggaugaggucauucuucuggcuacuccuugucugcuuucuuuuuucucuuuuuccucccucucauccuucccucugccucuccucuuccuuccugugcuccccaccuuccucucuugauugagucaugcuccuagauucagucauugagaggcuucucuuaaacacugcagcaugggaccauucaucuaccaaccuuccccuuccuugaacaauaacuagugcugcaggcugguuggacucuggggaguguggcccugcguaucuggcaguuugguuauuauuaugggcccauucucuugaaguugaucuugaagagcaggcuuggcuggaaaacaucauucuucuauaaauauaaugguuagcaaucuuccuacucuuugucuuccuuggaauguguuuucaauucugggcuguuccucccacuccccuccaguuucucucaguagugcauguuuaggggauauaggucaauuguauucagugcuaaggcuagagaaaugaucauuuaauauauuacagauacguauacaaauggcaguuggauuaucuucugucugggguuaaaaaugucacuuauauauguguguuuauguauguauuauacauaucuauauaccguauauaacauugucauguccccccccauucuuuugauguaguuuugaguaucauauccaauguguauaguuuaagagaugaacauuguuauauucuuguucacuguaaacuuagcuugaaaguuaaggccaucaccuguguaccauggugcuaaaauacauaauuuuucuauauagacaacuaagugccuauguagacuacucuauaacaaacaaaccuuuuccucucuuuuccaucucacuguggcuuauuuagaguuguaucauuuuuaucuuuuacauugacuguugcuaagacucugguggaacauucaguuaagugagcagcauauaauuuaugauuaaaagugauuuguguggugaaaugcggcugcugauuuccuucauauuuuccaauaaauuccaaaauauuuagccaggcaccaaagucuugcccagaugauguugucucuauuacauucagccagaaaugucacccaucuccuccaaugaaagggaaaggaccggauuuucucccucacuguggacuugucaugccuccacagaacguggacagagaagggguagaaggacccuuuuaaaugaacgaaccaggucagguucacuagaguuggauccuggauucuaaaggugacauccacucuugagauagaagagagaugcuuucagagcagcgggccagugggucugaucaaugaggagcaaccuuaacaaaacuccgggauucucauauuuugggauacuguuguuuauuaggggaaucgauuuggcaauguaaaaucgauuucuuaaaaaaaaaaaaaacagccuucauuauuggagaugagcacauuuaaaggccuagcacgcugccagagaaagguuucucuaacccaugaaauguaacugucugaaaugaccuuggggaucaacaaguccuugucuuuuaaaaaacucugcguaaauaggugagugcuaguaguaaucuacuuuuuguuaucuaccauguuaccaggucuauuggaguuuuagcuaauguaaccuauagagcugugccuaucacuuaaauugguugcuugucucccuagcuggucagaauaaccaguggaauuuuauuugcaagaaaaaaaaaucuguugggcaugguggcucaugccuguaauccuagcacuuugggaggcugaggcagguagaucacuugaggucgggaguucaagaccagccugaccaacauggugaaaccccaucucuacuaaaaauacaaaaauuagucggaugugguggcacaugcguguaaucccagcuacucgggaggcugaggcaggagaauugcuugaauccaagagauggagguugcagugagcugagacugcaugccacuguacuccagccugggcaacagagugagacucugucuuaaaaagaaaaaaauaaaaauaaaaagagagaaugccagacucuaccgaauucacguaccauggagaagagaacccaggaaucuguuuuuaggaaaagucuugcugauaauucuccugaucagcaagguuucuuagccaugaauugaauuugaggaaauugcuuuucuccacacucaccaucucaucacaagucuuccuucugccuaagaacauagugaaaauauuuuauuucugcgugcuuuugacaccuuuagcauguauugcaagaugagcuuuuuuucauuuuuauaugaaaaacuauuauguucuuuugaauaaaaaauaagcuuucaaaugcauaugcuguuuuuucuaagaccacacaaguccuuaauugccuugguuauauccaauuaucauagacucaaacugcaguaaaaauauaagauaggguaggcaucacugugaagauguuauucacauaaagccaaugguaaguuacucauuagaaguaaguugagugauuucaggguugcccuuaguccuucaggucucuaggggacccuuguacaaauugcugauucagaaaaucauuacuuuggugguucaagugguacuuuaguggccuuaaagaguuauuugacacaccuccccaaacagcuaaguuauccccaugauuauguugauuaauugcacacucuguggaauuaguguuauuuucaaugaaagauuuuccugcguucggaaaaucaagcauaaaacucaugugcuuuaauuugauaauguguguacuucuccuaagcaggaugccaagugaggggcugauuuugguuguuguugucugggccaugugaaaucaucuaggacaauauuuuuauucugcacugaaaagguaguuuuugauggacuguaggauguucacucaaaaugcuuaucgauucggacauuuucauccaucauggaacuugagaacucuuugacuuuaugaauugaguuuaaauuauuuggggagaggauuacgguagugagaaggcaaugguuguugcuacaguaggcacuaauaaugauacaucuagaaaacuccaaacggagguggcauauugugggaaagccuugguacuggaacuggaggucugugugcuaacuucaccacuucauaucugugcagccuuuuuaacuauaugagcugguuacccuuaauuuuagugacuucgucuauaaaaacauggacuaaaaugcccauuuaaugagcuuuuaggguguguugccuuaaauaauguaaguuaaauuugcaugcgagauagugcauuacaaauauaagugcucuauggagaauugaauauagaaucugaaauucuucacuuaggcagagcccugaagugaagacuuuugguggcaccuuaagauacuaucugggguuucaguacccacacuguguuaaaggcagcacaaugccuagaugagaugaggggaaucagugaugaaaugcagccaaaacuccccaauuuccagugggaucagagcuauaggccauuacugaguauucuauuuuuaggacuaaaagaacaucagcggaagagagaguuaaugccagucuuuuccagaaaaaaaugguuuacugcccauuuuucauuaucccuugauacauacaagcuaugugccuaguuaguuaccuuuucccccauuugucuuuauaggauuuccuagguuguuggaugacuaguuuauuugcuggaauggaguuguaauucuuuuagcacaaauuuauuuuacauuuagauuuuuaaaugacuguggaugaaggcagaguugucccuguaucguaagauucuguaggagagaaccaguacucuucucugaaauguuggaaauugaaagaauaaugucagcuucugcuuuuuuguaaacccagagucucaccuccaaacugggaucaggaguaaaguugacuagcuagucagaacaaugaagcuauaccugcauggccacagauuaccguaagacauauaagccaauagaaaccagcaaauuaaauagucaaaauguuuucauaucaauuuaaauaaaauaaaaauuuaauuuuugaaccuacaucauuuaucugauagaaaacuacaaauauauaguaaccugauauauucuuaguguuaaguuguaaauaauaguaguucugaaaggucaucagcucuuguauuaauagacacaaaaaagauggggacgggcauguaugcucaagucaguuuaggaaacauuguauaaaacuaaauugaaagccaaguacagugucucaugucugugaucccagcuccucuggagagcagugcagaagaauccuugagcauaggaguuagagagcaccuuggguaacauagugagaccccaucucauuaaaaaaaaagaaaacccugaauuaaaugucuuaacugcaguacuucucaagagucuuuaacaugcuagauacaauguaaaucuguuggggggcagggcaauagcuuguaacaguucguagauucuuuuaauuagucucccuuuugguuuuuggagcccguugugggaucacuauucuauagaugacacugagugaugcuggguuguccuguauuauaauuauauuuuuacuuuuacucuucuguacaucuuaauacaaagacauagucuucacauagagguguagaaaugcaguuuucugccauguuuuuguuaauuaguugcuuuguguuaaugugcggagaugguggcaguuuauuguaagaugucacagaauccauguguaucauuugugcagcuauaaaguaccuagagaccuuuuaggaauaaaacaccauguaaauguaaauuaucauugccuauaagacacuuucauuaauuucauaucaaauucaugaguguuuugagcucugggauuugagagucuucagugucgggccucuaguuuauuuauacuuuuuuuuuuuucccccagaguuuaaacaccagcagcauagcauagugcuaagagcacagucugggcaaacaaacugccaggguuugaauccuggcucugucacuuguaccuguguggcugugggcaauuuucuagaucucaguuuccucaucugcaaaaugguguuucuauuaccugccuuaugggguugugcagauugaaugaaucauuuuauguagagcuuugagcagugguuaauacaugauaaggacacagcuauucuuauuuggacagggaaggaaaaggcaggcauggaaacgaugaaggacuguaaauaauaaccucauguauguguucagaacuacuaaaaaguucaguuguuguuuaaugaacuaguccuuucuacauauauauagauucacaggguaaucagagauggaugggacuggggauggggacagaaauuuauucugagucaaacauguuuaugaugaguucccuagucugaugccagggaacaaaaggcucauucuucaguucccagaaugaggauuaacagugaaacagccuugcuugguguuguccugcagcaucagauaauuuuucaucaaggcguuucacgggaugauauauucucccauauagaugaaucuauuucagcggugggugaaacaccuaccauuuauauauaauuuuuaaaguggcauuuuacaaaugaaaggcuacacaaccaaacaugacccuguuauuauccuacuggucaaccacaagagggaucaucucuguuagagcuuaucucuagaaaucauuuuauugauaaguugcucgucugucucuagcucuuucuaggugguuuagaacugucauguguauccaggggcaguaaucuaccaaaggugauccuucuuagaaguaucccuaugaguggaauggauuuaugagaucauuuuuuucccuucauguaauauuuucauugucacccaguucccuuacaauaggauaccauggauguaucggaagaaaaauuggaagucaaauggcugauaauacaagaauauaaaaauauucaauuugaaauucuauagacauuuguuaaccauaucacccucaaauaaaaagcaaauuuuccugcuccuucuugggacagcaagauaaaagauuguugaauagaucagcaaaacauugacuuuuuuuuuuuuuuuuuuauauggaaguugcuugccuuuccugcucauauuaguuuuucugggccaggggaagcaagugaauccuuuauugauugccauuuggugccauuuuuaauaaucaaauuuaaauauaggcuuuagcagcggacggguucgauuuggacagaacacauguugacuuccuggacuguuugcucacuggagaugccgacuuguucuguagacggggcugcauguugaucuccuuugucuccagaaggauugauugacggauguugugucugcucauuuacagcguuuuccuuguuuaauuuaaaaaauugugacauaguauuacauguucccuuguauacaucauuuuugcagaagaaaguuguuuagccaauaugucgacuuaguuuaugaaauccucucuauagcuuucauucagcccuucguguacuccauuaggucauauucauuucaugcacggcaaaucgucaccagcagcaaaauuuaacauuugguccuuuuagguauaaaaaugaaucaaaugccugacaagauuuguuucugguauauauuucagaaucuccccccgccccccgcaccaaccccaucuuuaugggcauacaacaaauguuacuaacggguacuuuuaguuuuaaaaauauggacaacaguacuccaugcaguaaaagacuugagcgauuaaugcuacccuuaugccucuuuugaguaguuuuagccauggggcuuggcacugccaccauugucuuugugccaaaaaauauccgcagcggcugucgcauucuaguaccggaggguugucucgaaaauuccgcagugaacgcgccggguuuguucaucacugcuaucucuuuuaaauauuggaaaaauagaaucuuuagcucuuucaaagccccguugugguuguggggauggggggaggcggguggugaagaauggagaaaggaggaaagaggcuguccgcgccagccaguugguauaagugacaaaaauccaugccugacauagaguaaacacagauauuuaagagcuuuuguguucaugagcacagauaguuacuuaaggauccuacucaaacauguuaucagcgcucuugaaaauuuuauuaucugaaacaaauguuccaagugaauuuuaagcagaaaaucaacaucaagaccauagcuaauuuuuaauggauaauuuacacaaaagauaguuucuuuucuagaaacugagguguccuuuuaaaauggcugcuuuuagucuuuaaaaaaaaugauaggaaucgcgauuuuauguuugagaaggugcgugggcuuuauccacagugccugauuauuuugcucccaaacagggguucuggcucugagggcagauuuauaguugaauuggggaacaaaaagauguaauaaaguuaaaagcuuacacuaucagaaugaaauguguuuguucaugaucucuggaccgaucuauuugaugguaaaaguggaugcuacagaugaaaucuuuacaaggagcauaauccuuaaaaaaaaaaaaaaaaaaaaaaaguccaccucccagccuccugcuggcugugcugccucuuugguaccucgcagacuucgacagagcccuggacgggugcccauugaugucauggaaacacucaaauuacugagaaugauucaugucuaugcuggucucuuauccucccccacacaaacaggaguagauuuuuaacccugacaacuuguaauuugcaguggguuuauuuuuguaucuggauaaauauuuuuuaacaagcaaaauuaagauuaagcagucuguaucugauaugauaguaaagaaugcuggguuccauguagccaagaguacuuuggggacucugcagcgugaauucauauucuucuccuccuccucucccuccugccucuuucuuuuccuaccucuugcucuuugcauuccacucuuccucucuuuguuuuucuccuacuuauucucucucuccuuuuaaaauccugcccuuuuaucuuuaaaauaauggaaggaguagcccaacuuauaucuauaagugaggcaaauccuggcagaaagauuccucccuccuguucuguguguuggagucaaguugggaaauaaugcugaguggugaaauucuacaggggauagcuucaggaauuccuucuagagaaaaaaauagaugcuuuuucuuccuuaaacuguauuuuacaauuuggauuuuuagaaauuaccaaaacaggacacuagauguucaguuucuuaggaagucagagcagauucuacuuuauccaucuuucugucuuucugccugccuccuuaccugcccagcuuccugccugccuaucuaccuguuaaacaagugaauauuacaucaaaguaagugauguaauggugauauugaagcauucuuagaugcaagagcuuaaggaaggacacgcguccuuugauagcucaugaaggucgagccuuuucuguuaguaauauuuauagagagaaguuaaaggguauaaguagcuuaaauuugauguacacagaugaguaaauaugucuuugugaccauucacacugcugauacaaguauaaauuuaucuuuucuucagugcaaaauccucauacaauggaaguuauucuguuagaucuucuaagacugacagucugugcgauggugucuuguuucacugaaauugaaacugauauggggcauugauuuuauacuuugcgcugagcgcuagaccagaaauggggcggagguguuuucccaacuuuaagauucauuaaaaucaguagaaaaguuaauacugggaaacgggguuaauuuuaagacuuagguuuggcuuucuuugaaaaccaccauccauuuuauauauguaaugacuuggauacaggauacccuuuugaccacauagaaaaauuuauggauauaaauguaucaaagauacauucuuuguguggggucaggaaggcauacucuaauaacauugccauugccauugaccuaaaagauaaaaagacuacuguuacuuuuagcauucguguugaguugagaggggaaaacuuggggguuguaaacuucagaaggaaaucuauucagccucucaaaauacaaguuuagaguuuuccuguuggaaaaaggaauacuguaguccuauguaucaaguacaauuacuguaaagcuccagucuugacgaaagaaguauccuuuagacuugcgugggguggggucuuaggcaccugccugccucuuuuagccccuuuuaauguucugguauggacagauuucuacaaugauucuccacaugucacuaucuggacucuacugcuuagaucucuuguaaugugauuucauuauccucccuaaugauuauugggguuaaacuuuaaaaagaaacaaaugaacacccuugauuuuauucuuagauguggccgaauagcaucgaagggucuauagaucucuguagagcagucuacagauaaaaauuggguuguuagaauuggaacaagacauucacauuccaugaucccuuguccugcugggucuauugguggaaucugaacuuggguucagaguaggcaauuuuucaaaagcccuguuucccaaauguaaauuccaucaucaucuugaucaugaugggguucacuccugggaaagggaguuuuuaaaaaagagagagagagagagacucagaauuuugaauaguuucuuugcuaaauucaccaucuggagagccugugauugauuaguuuuggccucacuauuaagugucaauauaaucaaugggaauuacuaggcuagggucauuacauagauaauuugccugcuguguaaauaaaaaugaaauuguuuaaauuuugugcaagagaaagugaaaauaaggaguuacgauuuguuuguuagagaaaguggaggccauuggaaugacaguuuuuggaaguguggagcaguuuggcuaagaauaggaaugaaggauauuuuuuuccaguuuaucauagccagagugaggaaguguuauucccucucuugcuugcauacauugccaguagugccuacuuuacguauguaaacaucggggaagagcaguagaugucuguuaccuggaggagauuuuuuuuuaaggaaaaacacaauuuacacuuuuuugucguuucucuuggcagguaaaacagaaaggggcucauacucaucuuaugggagagaaucaaacuuacaggguugccaccagguaagugagaaucucuguugcggaaggguugagaggauuaaccugguaaaucaguuuguuuucuaaauuagaugaugcauuuuaaacugugacaccaaagaugcaccggcaagucagaugauggcucucucuuuaaguaaugaaauaacacagagcuuagaacuaauaaacaccucaucuuuagaucgcugcuguaucagaacuacauucaugggcuuguuuuuauuuuuuaauccaucagccgguaccaguggcacuguuugcaaaccagcaaugucggugaaagugguucuauuaaaagaguuuauuugcaauuaagaacuuaagaauuucuuacgcaggaaauacuucgcggagucaugugucagacccuggguuucggguggcuauugcccuaaauuauaguuuucauaggggcuguaugauguugugugaaaacaggguuguauugagggauaaaaaugucugugaaaauaugauuuguugucccuuuuuguuucugaauuguuuuuggcuggaagucaaggccagcaggcuaacagcaaagccgucucaagggaagcaugcgugagcuagaaaaauaagaguacuuuaauuaaauaauaaaaugccaguguaauacaaagguauagcauguguguguuugugucucugggcacuuugcauuuguauacuuuaaacucuccagagagagccuauuucuaaaaauacugucaauagcuaaaaguauaagcuuuguuucaagacaacugaguuuuuauagaugcuuucuuuuucaguucaguaucaguauuaaucauguauuuaaaaucuuuuuuaaaaauuuauacuuccuuuuuauaagugcauugguuucuuacuuuggaaaacucuugauggaauuuaauaauccucuuuaauauucagagcucucuacuguuuuuauuauucacgcaaacaaaauguacuuuuuuuuuuucaaaugcuggaaaggggaugcuuacucucuugaacucucucacccucugauguucuugaugggggaaaaaaaucuauuuuaauuuuauuuuaaacagcccauuuaauauaccccugaaaaauguaagcaaaguuuuguuuuuguaauuaaaucgagccuaugaggaaaguuuccuuuacguaccagacauaggaagguacgacuucugguggguugguguguuuguuuuuucccuguauauauuugcauuuuuaaaguuuacucccuuggcccagccaccaauucagucauauucggcaucugaaagauuuguugcauugaggugaacagugcuugguuaagagcuccugccggagugcaguucauggcaguuuguuuggaaagaauucugcaggaaagaaauuuacagccauuccagcgcaacggaaacaucuuuggaaugugagugcaaauguucgggcuagauagccugggcgacaagccucugagugcugugucucugguguaaagcucucaguuccugcagaagaccguguuccugugggucugguuucugagggucaaggcggaggucauuagaguuuuggggagaagaaaguugacaacauccuuccuuucugcagauggucauggcagaggucucuguuuucgcugggccccuuuuucuggucauugagagaauaggcuuccucaccccuguauccuuucuuacuaauaggaauuggcgugauuccucacagacacaaagauuuccucugcugaguaagcgugaggccccuuaacuugugaaagcaucauccagaccgugugagucugucuguguaugugcagaacacagacccuccuuucuccguuuguggggaauacuucccucgggugaaacugaaguuaauuuuuuuuuuuuuccaaacacaaggugagaaguggaaaggggcagaggguggaagagagguggauggauuggcaugugauggcugaauuucugggccuugggagguucguuuugaggcauuaauguccaggaaaauucuuuuguauauagcacuaugacugcauaugcuuuucuuaaaaagccuucguaauguagccguggaguguggagauuccuucauucuuaauuugugcuucaugguugugagucuugcaagagucuacuaucucugugcuuagcguggucgcagcaaucuccauaaacagugugauuacuuagggauaaauaaaagugaaauuuuggaaauuugcugacagagggaaaauagggacugaagaugaaaaauguacagaguaugaauuucugcuuucugugaaauuugagaauagaacagaccauagugugucuuccagugaaucaguuucucuugugccguauuguuauuugaaucccugucuacaacaucagcuaugcaaaccaaagagaaaggcaaaaucucaguaucuugggcuucaagucuaaauagcagaucacagcugaaaugauuccccacugugugacaaggugagugacucguggaggggaggcuuuuguuuucuucuguuuacuacaugauugagauacggaauaggaaaccuucagauggugugcccuaaggagcuccaaaagcugcuuuaucguauuauaacaguguauccuauggacuuaaaggggugagcagugcuauauggaaacaugcuucuuccagucucaauagccuuuuguuugguguagagacagaguggugguaagcaacagguagcaaagcgcuguccuggaggaauacauuauuauugugagacguguguuguuucagaaauauaucaaguuaaaaauagauauauauuuuagauuucuccuaaggauuuaacacuaauacugauggacauaugacgcuuuuuuaaauggauauauuuuagcagaagaaugaaagccggcagguucuuuauuagcaauuaaguuguuuucauuaaaaauaguaaugagauauuauuucauuaaugcauuuccaccugaaguuaucagaaauaaacauggugacuuuuugagacuuuuaaaauuguguugaaaaugaaucaauagauaagcaaaaguagccaaacgaacuuuuuugaguucuuacuaaauaugacaaaacuaauuuaaaucaaauugggguacagaaaucacacccagcuuaacauguucuugccaaaugguaaccucauacuccuuuuaacuggcagagaaaaugaaauuuauaauggaaagucugacagaaacgaaaaugagugggaauaaaguuuuuugcaagcuaguccaaccuuaauacuauaauagccaauaacuaaaacuuaaugggcaucauugcaaaugccagaagggaaaaaaugucauuuguuuugguuucuuuuugcugcuuugaauagaauguugggugauuugcaaacuuuuaaauuuugcuaaaaucuauuuuuuuaaugagaugaugauaucaaaacaaauacuuguuauuacuucuccccuuaaauggaaguuuagaguugauuaucaggaauuguuuguauuuucuuucugggauauagcccaggucuaaagccaugguuucauuuuuaguauugugugugugugugugugugugugugugugugugugugugugugugagagagagagagagagagagagagagauggggagagagagagagagagagaaagaaagcugccuaucugagaccaaucaaauuagaaucuugugagcugggccugugcuuuucugacaacuccccagguuauucuaaugugcagcuagguuuuaucauuuccuagaauguucuguagaaauauacccuguauuaaugacuuguguucaacauaugaccuugaaaaugcuuuuaggcuuuuugcauuaauuugauuauucaaggcauggaaauauauugcauaugaacuucauuuaaaaggcagugaaaauuagugauauagugaaaaucuucaaaucuuuauauagaauuccacaacugaaugucccagcccauaucuuguuuucucuagugaaguccaaggcuuuaaccucauccaaauucuuuuucuucuucagcaagugaucaaauaggacuuugcugauacaguuauuuaauguuuacaucuuaaaaugacuaauggaauuuaagaauuagaccuaaucuaggagguuguuguuaauuuccagaaacuuggagaccagggaggaaacauauuuucuuaguuugcccauaggcuugcucauuuuugguucaucgaaauuaagcauguaguugauuccaaaaugaauuucacauuucagaauugauuucuuugucuuguuauuuuuacuuuugauucaauagguauuacaaaugacuuaauucuaaacuuuuggccucuuuuaguuuuucuuaucuaaagucaaaauagaaaggauguaagugaaaaccguacaaaauuauuuuguuuauuacgaaauuggcaauugaggccaauuaggccuugcgcaagcagaaauacacaucgcuuuuuaauuuacuaagaugccuaaguguuuauccugaguguucagcacauccaucgaggucuuaugcauccuuccugggaagcucucccuugcagggccuuagcaccugucuucaucgugcuuuuuaaaauuugccaucauuuuuauguguuuguugcaugcugauuuccacaggauucuguaaacuccuggagggcagggaccaugucugcuuuauccugaauguguaccaugugccuagcagggcaaaaauugcaaugaccuaguguuucuuuccucagcaucacuuuuggaagccauuuugagggaguaaggucugaauagcaauguacaugaaccauauugugagcaucuuuuucaugccuacgaaaaccagaaaacugcacucucccaaaaaaguccuuuggaagcucuuccuucuaacaugcugugcaggcucuggaaggacaccaaagucauaccguggagagacacccacucugacuuuuugggggguugaaucgucucauucaccuggugacuucacuguucuaggccuguauaucuggaaaggccugaaugagggaauuauagaugaucugugguucuggcagagguguuguuggaaccaaaggucagcauccugguccgaacauugaaauguagcagugugaaugguaggacaggauauuuuaaauugugacaguuucagacaucacagggccugaguuugcaguauauaugucaucgcagcugugucccugagcgguauuuuucgggcagcggcuuauucauuuugggggauuguuauggguauauacccuucuuucaaaagucagccgguacuuaucaaaggggagaauggguccauucuuucauugcauugguuaagaaauacuuauugacccuguagugguguguuagauacucaggagaaaaaccaagggaucuuguauaccuucccuucuauccccaccagcagcuuccuggauguuaacggggaaaaucgagcucuauuuauuuauuuuuauuuuuaaccuuacauagcauaaauuuuugagcauccagaacaguugaaaaaauaauaaaaugaaugccacauaccugcuauuuagguuaaacaguuguuuguauuuguuauacaguauuuucuuguguguauguauaauauguauaagaauacauauuuuucagugaaccaaccauuuuaaguugcagauuuaauaagaaugcacccauagauuuuucaguacaugucucuuaaaaauaagacauuugccuaacuaacauacuguuauuaucccuaaagagauuaacaguaguuucuuaaucucaguccauauucagauuucuucaguuguccucaugcaaaugucuucaguagcuuucuuaaaaaaggcaacuaaaaugccauuuacgcgugucauuugauuucuaugucucuuuauaauuucuuuuaaacuagagcuguuccucuauuuguauucuuuuuuaaauuguguaauuuauuuuuuagggaugggguaucgcuauguugccaaggcuggacucaaacuucugggcuugggauuuucccaaguaauuuuuuuguugguuuguuugaaugauagugacuuuaaagagaccaggccaacuguccuauaaaacauuccccuuucuagaauuauuagauuucguuuccuuguggugcuguuuaauuuuguucaucacuuguuuugccuacaaauuuaaaauuaguucuaaagguuuaugcagguucagguuaaacauuuucggcuggaguacuucauugggggugcuguguauaucaaauuacauuccaacagaauauugagcuaugcugcuguugguaaugcuaacuuuaaucacuuggcaaaaguggugaccacuggauuguuccauuguaaaggaaucuuuccccaucugcaauuaacaaauagucuuuguauugauacuuuagcaauggacagauaccccuuuuucccaacaaccuuugaccuaauaguuuuagcacacauugaugacccuugccugaaucaguuauuucaacugaagacuucaaacuggugauucuuuuaaaauuccaucauuccuuccacauuuauagcuaguauucuucuauaaaagggcaguuucuuucaucauucauuuuaacacuaucaguuucauguuucauauuuuauauaagugucauaacaauuacuguuucuaauguuuccuuaccuggaggauguuggaagcauuaaaguauucuugaaaucucuuaagguauauugauaagaaaaguaguuauggcucaggcugauggucagagaggcuuuaauuguaagaggagggagguaauuguaggcauguuuccuuguaaacuaaacuucaguauucuuuuggugaaauuuggaaccuugcaacaaccucugugccccuagcuguguuucucugauucucauauugccacucuauaauugcuaguaaacaucucacaagguugaucaucaguaguugacuggccgacucgaggggguugcuguggugcucugugaagcugcgcuaucagggaucagcuaauaaucccugccucaguccuugcacaauccagacaugguugauagugaaugucaaaaugagugaauuucuaaaagauaguuugggcuuaaucuaaaggaagccugaguaacuaguauuaggugccaauauaaaucucugaguugguuaauauuauugucccuuaauaauuaagaaagggaugcucagagaaguaaagcaaguagaccucaaaucauuugcuucaaguaaguuucagagccagacucugaacucuaagauguuuuguuucaaagccagugcuuuccaacuuggguucccugcuacuuaagcccaugaaggaguuuuuaggcucagaaguccauauuaguucucaucuagaaaacccugucuggucgauuccaggcccacugggggaucugggccugacacaguaucuacaacagaguagcugcacucagcuccguucaggguuagcuagaacucugaacagucaguagggaaaggcauagcggagggcagaucgcaucguuccugacugcccagccuuaagggggggaaaaaaagauuauaugaauaaucuauucaguaacauccucagaauuagcaugugcaauuuccuuaaaaccaaugaggauuuccugugaaaaggcugggguggaauaugccaauucacauuuuagcaacagcgugaacacuuucuuaaaaauguauagauuauguuuuggcuuugcuuuuugugcaauguaggcagaauaugguuugcuauuauauaaauuuggauucauuauagaucacauuauuguuccaaaaacacaagagcuacauacagcgagauucugaaacaauaccuuuagcagguucuuaaauaugccccaauaauuuuucgauuauggcauuuagcccucaaguaaaauauaugaaacaacagaauaugugcuaggagcauaggcaaguuuuauacaacaacaguucaggcaguuagugcauaaaaagccauugaaauugcuuugagaugauuuaugagacaccgaagaaauggacuccuaguauccaaauugaaauuucaccagaaucaugggauuaacuucucuuuucuuaugaaaaccauuaagcguuuuuaaaauagcuucuagcaauuaggacuacaguucuucaucuuuauguuucugauagguguaaagacaaaggggaaaaaucaauuaaugacuaaagaaauaauugauuuaaugcugagguguaucugauauaauuuaauguugaaacguaucuacauaucauguagagaucaguguagcucuauagccuccuucuguaagaaaggcaguauacucaaaauucaacaucaggauaguguuucaaugugaaaugacagaaauauuuauugaacgucaugcuugauauuauuuuauuguugagagcuuuuuacugaaacucuuuaaaacugaacccccaaauuaaaauauuggcaacacugaaagauagcaacagaagccuguaaucugaaguaauggacuuauuaaggacuucagaaaaaaagacuuuagaaaagaagcauauaucguugagucugcugccgugccugauagugauaaccugcuuagaauugaagcaccccauucuuugaaaaauugugugcgcucuguggauauugacguggguuuguuuacaugugcuuucacucacagaucaacugagcuuccuaaagcauggaccuuucauguucagcguguuguuuucuaaucucauagaaguaguuucauagggaggagaaaacagaaaccgacaagaauauuucuuugcauuugccuuagcauuuccaacaugcaaauguugcuuuuuucauaguauggcacuuauuuuugucagacauuucuuguacuuaacaaagggcaaaguuacauuuuggcgggagagcgacuuucgcccggcacuucaccagaucucguugaauagaauauauuaucacuguuagcauucuuaggguucuuaaugaaagcuacauacccuuuaucuccauuuuccucuccuuuuagaagacaucuuccaaugaacaauuucuaugacuugaauaccagauauauguuauuuucaagcuaccucaaagccauguuuauaugcauuugcgacaauaacaauuccgugcuucggaauaauuauguaggaguaucauugagguuauuaggcaggacccacccucuagaguucuguacaugggggggucucuguguguugggguuuuacugugcaagcacacagaauauccugagcucauuuguaccaugauaaugaacagcagggcacugaaucuuuuuaguuuuauuggcauuguauacaguaaguuauuaaauuucaucucuguaauauaccugcaguaaaauaacaaaauauuggugcacuuaaagaacauguguguguggaacaaugcccuccccaucauuucagcccccugcaaacagcugcuuacagauuucaagauccauuguauguauucccucgagcccaccucuaauaaucgagacacaucugccauugcaguauuauaggcauauguaguuuuauugaaaacuauaccuguaaaaaaauuaaauaacuccugccucaauuaaauuggcaagcuaccuuuugcaaagaucauauugcagaccucuugagacccaagugaguucauuuuauucuuacauuacaaaucacuaaauauguuauuuuuauuuagcugaguagcuagcuuuccucguacuuugaugguaaguuacuuucauccauucucacuuuuguuuuccuucuccccucaucuuuacauauuaaaaaaauuaugcaaauugcaugaagcaaacauuuugagaaucugaacagaauaaaaucaaagggaaaggacccuaacaugcagcuuuaacucugaagugauuauuaaauaaauacaugcaaagguuacaaaauuggggucaaauuuauaacucacguuguggcuugugauuuuuacaaacuucuuugagauccauuugaucaucauaaugguagaauaggaaguaauaugaagaggaaaugaguuaguaggccauacaaagcauaugcagaugaauuccuauuggauuaaauaacuuaacacuuacucuuaagaaaauaauagauacgagaucucacucuaucacccaggcuggagugcaguggugcagucauagcucacugcaaccuugaacuccugggcucaagcaauccucccuccucagccuccugaguagcuaggacugcaggcauauaccaccauggcugguuaacuuuuuuauguuuuguagagccagggucucacguuguuguccaggcugucucaaauuccugacuucaagccauccuucuaccuagacuuuccaaaaugcugugauuauaggcaugagccacugcacccagccaacagucuuaauacuuguugaagauugagucaguaauagaugucugcaaaauaguuuuuuauccaaagaaggaauaagaguaaaauauuuaccgauauaaaaaugugagccuaaacuuauuuuaaguuauguaagguaucuguauaggucuucaugugaguuaaucaugccaauauauagugauuuaaccaagaagaauuuuuuugcuuuauauuuucauagaaaaaauccaaaaagacaaguugcccacuauaugggaaacauauauguguauauaucguauauaucugaauuauguaugucuauauauaugaaacacacacacacacuguuauaagacaguaagcagguuccuuaucuauaguuucuuaguuaaaaaaacaaaacaaaacaacauuuugugcuauucagaugaacuguguauaacuggaccgagggagugguuagaggugaauacugucccaaagugaacauagagucagaggaaagacucuguugaaagucagaaaguagaugauuucauaggaucaagucacggauaaauaugaggugaugacuguuauagagaagguagaaaaucgaaaaucaagcagugauauucuuuuuuuuuuuuuuuuuuugugggguuguuggggauugggucucuauguuguccaggugggacucaaaccccugggcugaaucagucuucccaccucagcccucugaguaguugggacuguagguacacaccaccaugccuggcuuguaguagcaguauugacaaccagucaggauagaaaauaguuacauguuuaaauaaagaauuuccuucuuugggccgggcaugauggcucaugccuguaaucccagcacuuugggaggccgagguggguggaucacuugaggacaggaguucgagaccagccugacgaacauggcgaaaugccaucucuacugaaaauacaaaaaguuagcuaggugugguggugcaugccuguaaucccagcuacucaggaggcugaggcacaagaauugcuugaaccugggaggcggagguugcagugagcccagaucacgccacugcacugcagccugggugacagagcgagacucugucucaaaaaaaaaaaaaaaaaaaaaaaaaagauuuuuuuuuuuucuuuuagaugaagucucacucugucgcccaggcugcagugcaguggcacaaucucugcucacugcaaccucugccuccuggguucaagcgaugcuccuguuucacccucccgaguaguugggauuacaggcgugugccaccugggcuggcuaaguuuuuuuuuaauauuuuuguagagacaggguuucaccauguuggccagacuggucucaaacuccugaccucaagugauccgcccaccucggccucccaaagugcugggauuacaggcaugaaccaccgcgccuggcagaauguucuucuuuuuugauaggaauguugauucaagucagugaguggucguuugguuccacuugggcuuaccugggcccaggagacucugcucacucuguguucucccaggguauuuugugccccacugcugguucacagagaugccagguuucacggaauggagggcugaguccuagagagggucaucacuuacaaguaagauaucaaacccuaagggaaucagaauuuaaagucuuagaaggguuucaguuuugucauauagaaaaauauugaaaauuaaaaaauauauauauuaugaauuguaaacaaacuuuuugaucaaaacucaugaaaguuggggaauacaccuuaacuugcacccugccacugcuuugaagucccaucccugggaugugguucacuccuguggaaauauauauuaucuauuacauuugaacugugaauuguguuugucacacugagcuaagcagcucagaacugucauguguagagugacugguacaauacaacaucaguggugguaaaagauuuguauggacaaugacauguggcaaagaagaaugucaacagcugccacugcuaugacaucgucccucaaggagucuuucugcaucucugccauguaacugucucagccaaagagaaggcacuaacaugaacuucuuccccagaaugcuacucccaacuagcgaccacguaagacucgcuugagucuuuuuugagggugcaaguccugggugccauuugucaccggaaagaacauuuaaguuuggaguuuuauguauagagggagggauuauucuuugauuuauuucgaaagaacauguucuuaauguccuuuugcagauaauacacacacccuaucaguuuuuggacuccagacugucuccauccauaugucauuaugaagcagguuuuuaucuuauuaugauuuagguaauuguacuagccucuaaaauuuuauaauguaccuuucagaagcucauagaugccaagaucagaggcuccuuuggaguuccaucuaauauaucuuccuuagccaacugguacagauaauuuuaucuuuccucuagauaguuacacauauagcucuagaaauaaaauguaguuauccuaaaucagcuguauagagccuuaaccagcaaucagaccauuuagaacauucaacaauaauacauucuaccaaacucugacuuucuguguucaguagauauuuauuaggaaacucacccugugucccacugaagauccucacaugcucucuagguagaugacuucagcuaauaguauaguaaccaugaggccuuaguauuuaugacuuuucuuuucuuucuuucuuuuuuuuuuuuuuuuuuuuuuuuaagagucaggguccugcuguguugcccaggcuggucuugaacucccggccagagugauccucccaccuuggccucccaaagugcugggauuauaggugugagccaccacaucuggaaguauuuaucacuuuccaaauucguauucuuacauguguuuggauuuauuuuucaagaagccagaguaaaauuuggcaauuaccaaauugugaguugagaaaaauagauaauucaccuuugguauugugcuuuugaauuugaauuccauugauuggauuucaguccgucgggauuaguucuuccaucugugucccuuggugugaugacugacucccagccaccaucugagacugcucggucucccucaucuccaaaaguccucaguuuccagaucucaucaauucugcuugcaagauaccaauaaaucugcugcugccuccuagacccccagucaccaccguggcugcccgugcugcucugaucccucuacccaccuucucccucacaugccuccuguccacugcugcuggagugacagucuccacaaaacauuguuccuuggcuuuggggccuguccuuagcauggugguauccuggccccuguuucugccugcagccucagccuucguacucaccauucacaucucauguuccagcccuacugagcugcuugcaguucccucaagaguucuuucacgguucucucugucuuuauaagaaccugaaauaccuuugccuugccuccccuucuucuugccuuacaucuguucuaccagcuaacucaccugcuuuguucaagauucagggacccuggauguuauaaccagggcagagcgagcugccucucuucugugcucaggaagccuuuggagcacuucuuuuuccucacagucaucacacugucuacagccagagaagggcaaaggcuaggggcaagggcuaggcuugccgucucuaucugcagugucuaacaggggcacccaggaagugcuuguuccagagucacaggauggaugagugaaugaaugaaugaacuagcaauaguaagaaauuguaugugagcauguaacuuacuauauuuaaauacuuccaugcaaauuucuugacuuaaauuaaccaugccaaugaccccugaggcuggauuuauuuauuuauuuauuuuuugagauggagucucgcucugucacccaggcugaagugcaguggugugaucucggcucacugcaaucccugccucccggguucaugccauucuucugccucagucucccgaguagcugggaccacaggcgcccaccaccaugcccggcuaauuuuuuuuuguauuuuuaguagagaugggguuucaccguguuagccaggauggucucaaucuccugaccucgugauccacccgccucggccucccaaagugcugagauuacagcugugagccacugugcccagccgaggcugggauuauuuuuaauccaguuuuauugauaaagaaacugagauuuagagagauuuguuuucacucugaaggcagagaugggacuggggaacaaacuccuuuggauccagauuuggcauuuucuuugucacuucuuuagcacuggauaaaguugguguagcuuugugucauagcaaguagcccacagagucuuuucauagaugguuccagcucucuauucauuauuaacuuagggaucauucauggaggcacuuaccuaguuaccaggcugagaccucugucugccaaugagaaaaaaugugcauuucuaaagaggauaugaagaaccuagcaaucuguauaucaggagcauugucuuuacauagacaaaaaagaauauuuugaauguuuccuguaaguaaguaccaguugcaauagcguggugcguaccgcccaugcuaucuauugcccaucagugguaccucuacucucugguuguggugaaaaggaccaugguccuccuggaaauuucuggcccugaagcucaggggagaagugcaacaccagccacaucucaucccccaaguuucauucuccuucacucucccugguacaacuuggcagaggauggggagaacugggaagaaguggaugcauugaguagaucaagcuuuuccucuucauguuuacuuuauaugauuuuaauuuuguaaccuuguuguaggacauaaaaaaugaaugacaguggacuuagcuuuuauuuauaacauugaaauccuuaaagauagaauguuagagucagaaaggaccuagacaucaucuggcauccagugccgcuuuguagcaaguggaaaacuaaagcucagagauguugagguuggucgucaucacacagcaagcagaccuugcucagacacagccacacaauacaaguaaaauuccuagccuguaacacggaaguuuuccuuugaugucuuuguacccgcuuucuuccaaagagcaaaaggucaccuagaccaugaaguaauagccagcagcagccggaaacacauccugaggaaauuucuagacgauugucccuuuguuaagcuaccauugaaucauacugucacagagccagagggugucguuugcuuguaaauacugaguuuuugaaaugucacuguaacacuggaaaaauguugucucugaagguugccaaagugacagaaucccgacauuguaaauaccagccaacacaagugcuuauaaaugacaggaauaaaauauacuugacuaaauccauaauaaucacugauaacacuguuuacccucagugaccaggagcugugaacuuggauaaaaagcacaugugugcagauaucauuaauaugucugagccucuagccauuccagaauauuuugauggaaaagcucccuaaauauguaaaagcuuugcaauaacuaagaagcuaguguguaagguagggugucagucgucccugaugaaacuagagagagccuugacuaucuucagcccccagaggacugauaaggccucccuuguucugguuagacccaaacucugagccaggcuacuagggcaggcaaugcuguauuuucaguagaugugauucucagaaggcccauuugccagaagcaugagcccacaccuauaucauguuccauggagaaaauguggaaugaacuuagagauuaaaaacuuuggagccauaagugggaggaucccaugaacuacccuuugacuuucaaaggguggauggguggucagaccuuuccacaguccuaauacucuauagcccaggcuuuuucuuaauaauaacuuccuccucucuagaaaugauucucucccucuuuuuucuguucuaguguaaaaauggugccuguguguauccgagucuuuaagaggaaauggacacauuggcaaaccagugccuccuuuggcucugugauguggcugcuguuacuacucaacuggagcaccccuuauauuccagucuccccagaaaugcucaggaacaguggagacucaaugacagaggguugagcccuccugguuuuucaacuggugaaagagaaauucagaugguuaaggagauagcagaguagccagcacuccgggagcugcucuuaucucugcuaugaggcugugcauggggaagaguagggcugcuuggaaugaccuccuuacuuuucauauauugaaacauauuucuuuuuccuugauaugcuccuguauuguuugaauuuuauuuuauuuuauuuuuugugguaagcauuguuuucuuaauuaacaaugaaagguuguagucaauaaacuaguacuugaugagauuugagaaaaacuacaaaacuguagauugcaaguuggcauuugaccaagaaauuaugauugugcuccuuggauuuuuaugcuuaggaaagagugcacaagagggaaaaagcuuucggucagaagauacccauucuaguacuagcuggaauggugguaaagaauacgaaauggucugaauguccauggcugugugauauuggcguauuuugcuguccaugggucuaaguggaugguauuauagcuuugaaagagucauggcaaaggagggaacaggugugucccaaacccuaaugaacucagcagauuggccuggcauucuggcaauguagucauucagcggagccguggggacucccuggguggggacccagcaugcuucuggagguaccugggaggcgcugggaguagggccugcuguacugguuugacuaaugugguguagguguugauguuggagaguugguggccagucucaggcucuguucuggcacuacuccagcuuguuggucaugaaugcagauugagauugaauggcuccuuacauuucccuugaagaaaggcagcuuugucuuccaggaaugagcugauggcaguggccguguggacauucugcagcuuuggcacccaguagcgauggccugauugccuugaaacugggagccucuagggcccugagaacuugagcagggcuggacaagccuuggagcagaacuuugcugugaauucuuucauugacucgcaaaagaugaaggacucuaaucccugauaucuaccuuuccacuugaccuuuuuagucuucaguggucuuuuagaaguaauuuuaccuggccgcgguggcucaugccuauaauccuagaacuuugggaggccuaggcgggcagaucaccugaggccaggaguucgagaccggccuggccagcauagugaaaccccaucucuacuaaaaauacaaaauuagcagggugugguggcucacgccuauaauccuaguuacucgggaugcugaggcaggagaaucacuugaaccugggaggcagaggcugaagugagccaagaucgugcauugcacuccagccugggugacaagagagaaaccaucuaacaaaaaaaguuauuuuaugaaaaacauuuggagguuuucuuuuggguauggcaggcagauuggccucuuauuuggcauaggugaagaagaagaguugaauaaaaguaguuggggcauagaauggccaugcaaguucccaacuaaaucagggucaaguuuaaauguauuuguauuuuguucaaauucaucuuuaucuaaaacaggcugaugcuguuuugucucugugcugcagguggauagccacaaauuugacucuauaguuaccaguuaucccccugccaccccuuguuuuucuuccugauuucucuacuuccaaucagcugcucuuuuagaaaccaauagagaagugagacggggugggggcagaggaagagagaaaggggguaagggggagggagaaagaggaaagagagguuguuuuuugucauuagugaguaaaaaucugucgggcucggguaguuucuuagugaauucagcauuuagugauuagauuagagggguauauuugagcugaagauuuugggaacucaccuuucugcucuacagaaucccuagguuucuccuuuagcucuacuuucugauucauuccauccccauccacugaccccaccgccaauauugagguacuugugaaagcucagaaucuccaguguccucaaggagcuagccccaaagugcccccugguggcuagaggagaaaaagacaagauggaggaugggaaaaaggucagguggauggauaacuuuggcucuucuuuuggcucuucuuuucugauaguauuuuuguuaacagcaucuaauggguugucuucuuucaguaucaaugugaaccagcucugaauagguuaguguaucaauguauuucccuuuuugggugauuuugcugcagggauuucuuucccuaugccaguuuuuguuggucugauuuuuguuucuaggcauauugcauugaccugagccuucucacaguacugaugacacuggggguagggagaacaggagcaguugaagacgacacaugcugucaccucaugugcuggugugaguggcgcagggaagggcugugauuuuuuauaggcacacugauuagccaagcacuugucaccuccacugccgcucauuggccuacugagugugagcgugccaucuaauugacagcugucuguugucagagggccaucuuuucuccuuuucaguuugagugaacacaacagagacaucugcagagcucucugcagcucugacaagguugcccugccugccaacccucagacuucuaggcagcauaauugaagagaucagaaaagaauauuaacccguugaccaucuugggcugagguguaaugaccaaaaagucacuuuuuaaggugacugugagucuuucuuaguagaggaagacaugagauucucugucagaagagucaggccaguaggaagugcuauuucuugguagugauuguucgugggguuucaguucaucugagcacuuggaagaggaugagaaguucauuuucaagguagacccaguguuucauggugggguuacacugaagccugaaugcugggucacaucauucaugucugauuuggcuuguguaaugacaguagugcuuuggauguguguaguuuggaugaggguuacucuuuuucuuuuaccgccaggccugacacugcccuuuuagcguaagauuccagaaucucuuaugcaguagcauggaauguauggccaaccccguaguaacguggacugccucuuugggacauuuccuguaagccagagauaucaagguggacuuugugauggguagauuguuuauuauacagauaucagcuugggaauuugaauguuuaauuauuugccuugucguagugucuucaaaugaagcucuauuugagcaucuacugggauugguacaauaugcagacaagcuggcuuugugugggucgagucaccugugcuugcaggaugggggugcuugcuauauuuggaagugauuuagugguauccuagguuuaucaggaggaaaauacaucuuugcauuuauuugaacauuugauuuagaaagggacaguguguggguauuggauaaauugcuuuuacucuuucuuugcuuugcauuguucuccccucugaugauuugcaacuuagcaagccuucaucauugaaccugggugaaaaagaagaucugagaagccuugaguaauuuguuucagacuguuuauacucuaguguuuuacagaugugggcuuauuugaggaauaguauuggcgaaagguagcgucauuaaacugguuggagaaauuucaggcaaguagauagagaaauuucaggcaacuccuuuuccaaguuguugcucacagauuauaauagaugaauucagcagaauguucugaccuccuagacuaggucagauaacugaguucuuguccuaacucaaauccuaaguagcuguuucuuaaagcucuguucugccucugcagaaugaaggcuuggccuauauaguguaugagauuccuucuagcuucaggguuuuguaacuaucagaauagguaaugaggaaggagacuaugcccugguagccuuuagccauaucacaaauauuuaacauacucccaaaauagcacauacaagacagaaauucuuuguacuugaagggaauaauaaauacagaaagcauuugagaaguacacauuuaauuucuguuaacucuuuuuuucuuauuuauguuuauuauuagaugauaaaugacuuccuuuuuuuuaguauuaaaacaaggugaucaggauagugagaggauugggucaggugaaacacaugacucaccugcgugcuuaugauuccccuuggaagaugguuuuggguaacauucugggaaaacuauggauaaagucauaggcuuccauauuuaauuaauucuaagacuuuuuuuucacauuucaacaucucagaaauuuaugguaugccaauucaauuggcaacuuuuuuccucucuugguaggaaauagauaaugauguuuuugacauucaguggcaucuuauaggugaugaaauacaauucugaggggaggaagcaagauuuuuuuuuuuuuaacugagaaaggcuacgugacuaagugacuucuuuguuucaaugcugacuaaagcugugauguccuuuuuaaucacuuugaaagauucaaauugcuuuaggaagacaauucaugcauggagcucacccucccagaacuccacacuuaaugcccacugaggaaggagagaaaugcaugcaaauauauaucccaauauagaaggaauauucuaguucaguaacuuccacuccugagcuuuuaucaaauuuuucucuauagaauuauuuuuguuuuauuguauccaaaaugucagauaucuuuuucaaggaaggucaagggacuuugccauuuucuaagccagaaguauucucaccuaguccaguacuagucaaaguuuuuaguaaaucacuuagaauuuccuuuuuuaaaaaaaaaaaaaaacccuucuagaguuuguugauaccuuaaagaucaucaaauccagcuccuuauuucacaaaugaguaaaaagaagacauaaguugcuuguucagaguucagcuaggaacuagauagaaccuggguagccugacgcucccauucuugcugcuaaauuccaugcaauguaaugaaagcgggauugaguauaaaaccgauacucuacacaucuuuuguugauauuucugagggagaaacuugaauuucuguaagugcacauagcugguuucccuuugcuuuguauuucugaaugcuacacuugucuucugccuacuacacuuaaauucauaggugauuucacaaggcacagaagcccaacuugucacaugugguuuaauauaugccacacuuuaugcugcaguagcaccauuuggucauauuuagugaacucugugguuguugagaaugccaaagcagcaggcucagcuauugcagcauaggccuguacuuaguuagcaagcuuagcuuaaaagcugucagugcagcuaauguuacaguggcuuacugagaccuuggccugguugugauaguucuccaaaccuggguguuuucaccuuugaaauaugaaucuggauuuagcuuuuucuuagaaaacagcaacaacaacaaaauggugaaaucuuuaagcucguuaaugugaaugcaguaagaauguaaauuuaauacauauucacuuauuauuaaaugcuguuguaaauaacauuuuuagauuuaauaaugauuucccaagacauuucgugcuauucuuuacuuugaaacugauggggugagaagagaguugaaucuuaauuauuauuuuuuaguuaauuaacaugugauuuaaaaaaaucgagauauauuuuguguuagacccuaauuagaaaagaugucaagaauaacauaaugcuaacuuaauuuuaaaauugauaaaugagggcaagaugauuggaaaguauccucuagaucacacaggaaacggguuaauauucaaaugaauagcucugaaacgcuacuuuccuaccagcuccugaagcaauuuaguuuuuaagaccuaaaacugacucacaaucugugguaugaaggauagauguuaauaguuuaaauauuuaggcauugcgugggcuguuuguuaaaccauugguagcuugagauugaccacagugggaguguuuucaccaugcgaaugagcaucccugcucacaguggggcaugagcauagcacugcaggauacggaacugacauuuauuacauaccugacauuuccguuacucuuuuauuuaucguuuugggcugcuuguuuguguccuauccccacuccccaaauucauauguugaaaccuuaauccccagugggaugguguuaggaggugaagccuuugggagaugauugggugaugaggguggaccuccgaugaaggaauuaauguccuuauaagaagaggaagacacacuggggccugucagcggugggggacgaggggaggguuagcauuaggagaaauaccggauguagaugacggguugaugggugcagcaaaacaccauggcacguguauacccauguaacaaaccugcacauucugcacauguaucccagaacuuuaaaguauaauuuaaaaaaaaaaagaaaaguaaaggaagagagcuagccagccuucucucuucuccaugugaggauaccacgagaagauggucaucuguaaaucagaaagaggacccucgugguggcucacaccuguaauccaagcacuuugggagguugagguaggaggaucaguugagcccaggaguuucgagaccagccugagcaacacgaugaaacccugucucuacugaaaaaaagaaaacaaaauuagccagauguggugacacauaccucuguaguccuagugacccaggagguuaaggugagaggaucagcugagcccggaaagucgaggcugcagugagccaugaucaugccacugcacuccagccugggcaauagacugagacccucucucuccccaaccccuccagaaagaggaucuugucuggaauccagccauucugguccugaucuuagaauucuagccuccggaacuguuagaaguaaaugcuuguuguuuaggcuacccagucuuucguauuuuguuauagcagcuaaauugacuuagacaucauuaauuauguauuuuaaguccuguguuuuagcauucuggaaugagagcauugaaaaugaucaucaagccgaguaaauuaacugaauuaacuauuccaccaaaaaaaaccccaaaaacugaaauguucguuguuccuggggaauggcuaugcacuuggaggcugguccccuuccucccuccucuucuuccuggugaauccccugacuuuucucaaucaggcuuucugauguggaggcuuccucugcuucccagggacacacucccuucccagggcuccuggagcugcugcaucucugcuacccugagauguaauucuugccugagauuucagcuccuccccuacacuucagaggcuucaguggacuauuucuuauucaucugugcaggcacauuguccaauguacaaccugcucaaugggcuuguugaguuaauaaacuacucuguguucuguauuauguggauuuagauguuuugcuucuuuuucagccuuccuuucgcacccuccaccuacccgaccccugcuaagaugcuaccuuuuaaagaaaagaaauaaguucuucacacuuuucuacauuuauaauucaauauaaauaacugcuacugguauacuuaaucacaauuagauuaaauauguucuuugaaacagggaggucaucuaaugaauagaagugaaauaugucagaaaaugucacauaacugagagugugacaucuuuaguaaauagaauguugagaugauuuuagugcuaggcuaguuuuguaagagacaucuuauuugacaccuuuguucaaacaacuuuugugguucucaaacuagccucuauugaaaagaccaaguucccuacgucuucucuuugaacacuuucuucuuugcauuaaccuguucuugcuagugcguccaaguguggaaagcaaagauuaguuuuaaaucuuccgggucaaaacuguuuuggcuuuuuucuagagcugauaauaaguaguauaguuuucuguguaccauguguaagagaagagaaaaggucugacuuuauguuagauaauccauaauucgguugcucugucccacuauauggagaccaaagucacacuaaauggaugccuuggguaggggagaaggauguagccuuucaaucagacuucuuagcugcacuagucacauggcuagccuggggcagguauuuaaacuugcuauaccuaagucuccucaucuauuaauugacauuaauaucagcaccuucuucauaggguuuguaaggauugaauaauuuaauguauguaagacacuuagaagagugucuuaaauaaugugagcaccuucuucauuaacauuagcacauauuucauaugauuuugugaggauuaaauaauuuaauguauguaagacacuuauaagaguguguuaaauuacagacugugcucaguaaauguugucuaauauuauuuuuaaacugaugguuauuagccaagcuauaccauaucuucaacuuugggugcacaagagugggcaguaucuuugaagaggucguuguuucucaaucugugggucaaguauucuuagggaaacuuuucauuuugguccaacucauaacuuuagugacauuagucuuugcaauuuccugcugagaagagaagguagccuuucuauuuuuuuuaaguuuucaaagccuaauuuuauauuaaaagaaaacaagguauuaaaaccacguauuucuuuuaacuuauuaaaaggaaauaacacaguaacauuaauaaaaaguuacaaaauggcacaguaacauuaauaaaauguuacauugucuuuuuauucuauagcgugaauggaagaaauaaaguaacuuuucuagagcuacaaaguaguuaaugguggcaaagauucacucucuggcaaugugucuuguuucacaaaguaauacaaguucaacacaguauagaauugccuuugauuucaaaugguaacagcauuuauuggauuauuuuuguagauguucaaugccacaaguaaaaugaaguuuucucuuuaaaaggaugauagauguggcagacccaucacugggucccuggacagugguaacaugaugggguuuaaaguccuuuuugaaauagccagguuaaucugcauaaaggcuauggugcuucauuaagcuuuuugaaaacuuucugggguaggccaaguggcuauuuguaucaguuaaacguaaguacaacuacuuaaaauaacauuucuucccacuugugcuugagucugggucuauauuuuuccugauaauaacaggauaaaaugaaucauuugauuccauauuccaagaaaaacguguccauuagguagaggaagcucuuagaaauuaucuccaagaguggcuuguuuuguaccugucauauuuauuauaagguaaagggagauguagacuggugggggugaugguaguaaauugaaaugaguugccagcuguguugcccaggcuggucuugaacuccugggcucaagccaucccaccagagaagguucuuaaaccuuuugcuuuccauugggcaucuuuaucuacauuuuaccucaucaagcucaucaagugaaucagacgcuuugacucagucauaacauguugauggagagucacuuaguuggaaaauauagacaagaagaugggcucugggaagaacugguagguaggcaauggcucugaaaguguggggcccugguuuacaguguaaugacacccaccauuuagugccucagccauuauucaagugugcugugccuuuccuacuggccacguuaaugagaggguggagauagcaaguuccugcugaaauuuucacaggaaagcuaagcccuuaaaugauguuuugaaggaaugguuucucuaccaucuguaaaaaaggcuugauuaauuauuuugguggcagaaacuauaugcugugcuucagguuaaacagcaggaacauauugagguucuugggaagaguuuuccuacagccaucaaauagguguccacacagguuaaccggacugugcaauaagaaugugggacauuggcaugccagugugaagucuggaaaagucggaugugauauaugcaaguggaagagaacugaaacuaugaagagucauuuggaaagccccaguugugaguuugugauaguugagaaauggcaccuccucuuugcauacuuagguuugagcaggaaacaaagaagugacuugaagucauguuaugaaaagaagaauuggguuggaggucagacucuggauucuagaccugauucugaguuaacuaacauuuuagccuaguuucaggcacuccccaguggcccaaugagccaccccuucuugcaggccucaaaaugcacugugauaaaacugcauaguauuuucuuuuccuuauuuucauguucuaagaaauauuauuguccgggcacgguggcuuacaccuguaaucccagcacuuuaggaggccgaggcaggcagaucucuucagcccaagaguucaagaccagccugggcaacauggugagacccugucucuaauaaaaauagaaaaagacaaaacccugguguggugaugcaugccuguggucugagcuacucaggaggcugaagugggaggaucccuugagcccuggggguggagguugcagugagcugagaucccgccgcugcauucaagacugagugacagagugaaacccugucuaaaaaaaaaaaaaaaaaaaaaaggagaagaaaauauaauaaaaauaauacauggauacuuucuuaaaauaucagacacuugagaauguugaguaaaauauaaaaggacuuaaucuggagaucauugccuuaguuauaacauagaaccuuucuacuuaggagaauuucccucucuccuacucccuauuuguaaaaauuuucuuuuguggcuucagucaaguuucauacuuuuaaauguuuuuguuaauuuuauucuuuguguuuuuuuccuaaacuguauuuuuguuccauuaugauuuuuucauugguuagcugagguauaggaaaguugucuuuuuuauugucuguuaaucuuauaacccguaacuccagaacuuucuuacuagccucugguaguuuuuuuuaguuguuuaagauuuuuuaggaagaaaaucauuggcaaauauugggaguguugucucuuaaagugucuuucuguuauauuuuccuugugcuaguacauuggcaaagacuuacaggagaguguuaagagaauaguggaauacaggucagcuucgcauuuuguugacuugagcaaagaaucuucuaguguuucauuauuaaauaaguuuucuguaggcaucuaguagauuaagaaaacuuucuuaugauccaccacuucuuaaaaugaauguguguguucaaacuaaagagauauauguauauaguagaaauauauguguaugcuugugugcauguguguguauaaacuuuaaaucauccucucaaaauuccugaaguaaaagucuauuuuguuguuuuauguggaauuuuauuuuauuuaaauuuuuauauuuauauauuuuauuuaaaauuuucaugaaauggccaagcaggguuuaauauaaaauggaaacaggguuuaucucagaaauuugguggcuaaauuccuuguaucccgucuuaucuagggauguuguuuguuucaagguucuaccuugagaggagccugucauuuucuuuuuugugugcugcuuugccuaguugacaucuuggcuuuaugugcuccuguugaaugcauugggaaauuuucuuucuucuuucuauguccugaaauagcuuauauaagaggggaauuuuugauauuugggggaaauugcaugggacuuuuuuuuuuuuuuuuuuuuuuuuagacagggccucacucuauccucaaaacuggaauggagugcaguggugugaucauggcucacugcagucucuaccaccugaguagcugagacuauaggcacaugccaccaaucccacuaauuuuuguauuuuuuuguggaggcggaguuucgccauguugcucaugcuggucuugaacuccuggacuuagccaucugccugccuuagccucccaaacugcugggauuacaaaugugagccaccgcgccuggcaagacuaguacuucagaacuggauuuuuuacuaauuuuuccauuucuguuucuuuguguuucaauugugauaguuuuuguuauccuagaaaacauccauuuuccagacuuuaaaauuugcuacauaaaauuauacauacuuucucuuguuuuaaaaaacuccuuaucuauuuagcaaauauauuuuguaauuauguugauuucuguuuucucucuucuuguuuuuccuuacacuugccagagguuuguguguuuucuuugguuuuuuuuuucaaguaccuucuuuugguuucauugauaaucuacauuuuguuuuaucuaaauuuaguaaauuuuaaauuuuauuaauucaucauauuuaaauauguugcacuuuuucuagcuuuuuauauuguauguuuuguucauuuaauuuuuauuuuuacaucuugcaauuuaaggccauuauuuuucauugguuacagcuuuggcugcaucccuuagauuuucuuauauacagcuaucacuaucauuuauuuguguauuguuuuaaauguuauuuugcauucuuguguaguucaagaguuacuuaaaacacuguuuucacagucccacuuuaauaaaauguuuuucauguuggcagugcuacuguuuuguuuuuacuauuuaauuuuauugcauucugaguggggaaauggcauggauauuuccuacuuuggggguaaucuaguaggauuuuuaaaaaugcuuaguuuuuuuuaagcauuucauaugcauuugaaaauaaugaauacuauuucccuauuuuauuauuauuauuauuauuuuugagauggagucucacucugucacucagguuggaguguaguggcacgaucucagcucagugcaaccuccggcucccgguuucaagcaaucuucccaccucagccucccaaguagcugggaucacaagcaugugccaccaaccuggcuacauuuuguuuuuuuuaguagagauggaguuucaucauuuuggccagccuggucuugaauuccugaccucaacugaucuucccaccucagccucccaaacugcugggauuacaggcgugagccacugcacccggccuauuuucccuauuuuaauauauuaaaccuuuuauuacuuauuguccuucuaauugauuuaaauuucugagagauauuuguucuagucuucuacuuugauuauggauuuaccaaccgcucaggguauuuauauuuuaaaaaauauaucucaaagcuguaucauaaaugauuagaaguucaggaauauuuuauauuuuugguggacuauagguuucaucaguaugaaauauccaacuuuuuucuuuuuuuacauuuuugccuuagauuggcuuucaauguauaguaauguucucuacaugcuuuauuuuuguagauuuuauauuacauauuuuuuauauauuuuuauuuuucauagucucuguguuuuauuuuugaugguuuguuauacacagcauuuagcuuuacauuuuucuagccuaaugugacagccacuguaacuuaguugaggaauauaauauccaaauaaacauaguuuaauuuucuuuuuuuccuuggcuugaucacauuuccuuuguuuuauauuuuuugcugcuuaaaaaaaggucuuuuuuuuucuaauggugcaggaauuauacaucuuauuucuugugaaaguuauucuugccuuucuaacucacauauuucaaauuauauaucucuauuaaagucuaaaucuguuuggugucuguaucuuuccuaaaaaagaugacggagaguguuagcacauuuuuaauuacugaguuucucccuuuguuccuccccuuuaccucucauguugagguugauauguuuccuuuuugacguuuuaaauugcaucaacagucacauagagucuacuagcguuuccuugccccaucuugcuaauuuuuguggaccauguuguucuggguuuuuuuggguugauuugucauuauacaguuauauauccuuauguaauuuuuuucagaaguguggggguauaaauuuucagagucuuugcauuuucuaaauugccuguaguuagcucaccuuuuugaaggcaaguuuggcuacauauaaaauuugaguuuuaaagucuuguauccccuuuuucugucacauuuuuguucuggcuugccuugcagcucuaaauguagcaccccaauuaaucacccgauuauugcaucacacuccacuccagcuccauguauguauugacccugggauuggagcauccuagauuuagcuguuucuuugcagucuucuugauuggcugcugcuuuuuggcuugugauuuauuuauuuuuccucuguagagcaaauccaucuacuuuuaucuuuaagaauaauucaaaauuguuauuccaccgaagcuacucuuccuuauuuucuggcacuauuuggcauguauaucucuucuaaauucacacacacacauacacacacacccaguaucauuuaugacauaugagguuagaggaaaaguagaagcuuauguuuaaucuaccaucccaagccaaccccuuuauauggaacuuuacacauucuaaaugcuuucaaauacaguaccuuauaaggaaggagaugcuauuauucuccuuuuauaaauuagaaaacugagagguuauaagucauuuuauuuauuuauucuuucauuuauuucuccauuaauccauuggcuaaauuugcaucaucugcuauguauaagcagcccucagugccagagacacaaaaccccagcuuccaggaccucacagcugagaguggaagcaaguggguaacaauagagacuugugacaauaauuucagcauaggguggauuucaguuccaugcauguuugagacacgugcuaggugcagaggaaccuggggagaggcgucucuaugucagacuucccaguggaaguguugaggaguguuucccagcggaaguguugucauugauuaaaauccaugcuguaaauguaggcaugaguugacugcugugcucuugguaucuaguaaaguuccuggucccugguuggcacuuaaaaaaaaauaagugaaugaacaaacaaagcuuccuuggcucucaccgaagcacuccuuuuguacuaacauaugugauagucuccacaggcaugauuucuuuauuucuccaagcaucucuuugaguagguacagugaaugucuccuguccacaaaugaaggggccaaggcuguggggaguuaagugucuugucuaaggaggcuuggaucccagguuccucugacucccgacaggcaagacuccuacuggcccuauggcccccucauccagauuauuuuagccucuuuuuucaaacucuuuccugcccucugaucauguuucuaccaagaccaaguaucacaaacuaaugaagagguauaacuggcugccuccuggaggagguauuaagaagcauacaguggccaaaguggaggaggaauaaaaauaccuccagagaccucaauaauaccaaaauagcuagucacaccauauaugucuaagcuuugauacagccuuucuacaugacauguucauuuggaauuauauuagacauucagguuugaaucagggcaggucacuugaaaugucucaauucaaugcaaaaguuauaagaaaaauaacauuuccccccacacaaguauauagcauaguauaaaacauucucaaaaacuuuguaaaggaaacacauuuuacaguuuaacucauaccuacuucacuuccuucucccucuccuguucucuguucauuauuucccuacuuacuaacuggcucuuaguuaauauuuucguggccucacccccacaccuuuuuaguuggucucuuuuuugugcaaauugauuuuauuccuaucuaaggagaugcuuucauccuuuuuuucaugcuuugaggccucauuagaucacugcacucuaauuuugggggggagaguugucauuugcacuauauguacagucugagcauccuaaaguucuuguucugagaaaaacaucgccauggugagcggcccauuuugaauuaggaggacuggcuaaggugcucacuuaagcucuuuguaguuuuguucagucaauugaguguuucuauguuacaucuaucugucuauaugucugucuaucuaucuaucuaucuaucuaucuaucuaucuaucuaucuaucuaucaucugucuaucuaucuacauaccuaccuaccuaccuauguacugagcccaggcuggagcaguggugcaaucagagcuuaccguccccuugaccucccagacucaagugauccucucaccucagccuccuaaguagcugggaccacaggugugcaccaccauaccuggcuaauuuuuuuucuauuuuauuuucuguagagacugagucuugcugugcugcuuaggcugcuuucaaacuccugggcucaagcgauccuccugccucagccccgcaaagugccgggauuacaggcaugagccauugcgcccggccuucucuuuuuaacguaauauugagauuggggucagacugugcugguuguggguaaagcuauugcagccuuccagcuaugaaggccugcccuccacgaugggauggccaggcugguaccugagacuaguguuggaggcaguggcagcuucccuuugaucuauugcagaaugcauuuucaaacacacacacacacacacacacaaauaaaacucugauguucacuuuuuaauugaaagcuaaaaaugcccagcuccuuucugcagauugacaagcugauauuucagcaguagcuaaagaacccgguuuaguaagcuacugaauuuugacguuuauaaacauuuaaugaauacauuuuuauuuaugucagcuuaaaaaauacagcugcugauaucugcgccccccaacaacuuuuuuugucuuaaugccaaaauuagaauauuuaaauauuuuaaaauuuccugaugagcaccugugcaggugugagggcagcaugaauucacagggagaguguaugaaguugguuaucuugaugugcuuguggggaauguguauuuccuugcaaggacugucaugugcuaccugauccucuuucauggaccucagccacuuucgccucuaacuugaaaaggaaacuggcauuguggcacaggggccaaagggacacauuuguagccuuguccucaaaucaagugggacuucugguucuuucucugaccaucugcuugaccuucagucuggugucuccaaggagugugucucuauggcaguuuaaaaaauucuguuacacugagaaagagacaaaauguaaaucuuaaaggaaucaguagauuuuuaaccccacugcugguguugagaagacaguuugagucuuaaucucuuuccuuaaguuucaaaacauguaggauuuauguuauugacaugucaaacuuuuuguacuuauucauuagggaagguuucaauacacacaaaaauagaguauuauaagaugcgcuacuauguauucauuauccaguuucaacagacgucaccauuuucccagucuuuuguuauauaguauccccuucacuuuauguuccugaaauauuuuaaggcaaagccuugacagcauauuauuucaccuauaaauauuucagaagcaucucuaacaaauaagcccccuccuuuguuuuacauagccauggugccauaucacagcuagcaagacuauuaggaauucuuaauagcauuaagaacugacguuccucaguugucucacaaaugccuuuuuacagcuggcauguuugaaucagaauccaaaccagguucacacguugcauuugauuaucaugacuuugaagucuucuuaaaaucuacaacauggccagucucccucuuuuuaaauauuuaaacuggguccauuuuccuguagaaagcccacauuauggauuuggcuuauugcuucuuuguggugucauacaccauguucaucuguucuccauacuuccuguaagcugauacuugcauuuagggcaagcuugucuaacccauggcccacaggacacaugcggcccaacacaaauuugaaaacuuucuuaaaacacuguguuuuuuguuuuuuuguuuuuuuuaagaagaccaaguuuguuugcaguguaugaaugucuaggugaggcuggguuaauggggagaaugagacuaacauaacaucuauaacucucaugacuuuuuguuauuguuguuguuuguuuuguuuuuggagacagagccucccucugucacccaggcuggagugcaguggcgcaaucucagcucacugcaaccuccgccuccuggguucaagugauucuccugucucagccucccaaguagcugggauuacaggcacgugccaccaugcuaauuuuuguauuuuuaguagagucgggguuucuccauguuggccaggcuggucucgaauuccugaccucaggugacccacccgccuuggccucccacagugcugggauuacaggcaugagccaccgcgcccggcugaaaacacuaugagguuuuuucauggguaaucuuggauauguuauuugcuucauucaagaaguaguauguggccauucauuucucaagaugcuuagauuguucagugaguucaugugcugcccaccagaucucccuaauacagaguuuuacauugucuuucaccuguuuguuuuaggaucuauugaugauuauuucauuggagguugcaaaauagccauaaguaaauugguuuaaugaagcuucuucucccuacuaaaucuuaucuagaguuuaacuaucuauuaaucauucauuuuugcacauuuuuacagcuuuugugggguauuuuacauucuuucuucuguuugaauauagagggugccuugcaaacuucacucauuucacuagaagaggcaacuguuuaaauccuacucuucuaauauauuuccugguucauguuuuccugcacauucauaaaugaggaggacguugauuugucaguuaucuucagugcuuagaauaguugcugaaaugugacaagaauguuuauggaagaaauuaccuuauagguuguacauguccucuaaagacaucauaggcacuccuacauugcauuggugaaggggccaccaaacagcagaauccugcaacuugguugaacuaugaaaauguucuugauacauuauaauuuccucaaccccuuuagccaguauuggccauucaggcaaaggaauagaauuuccaagacuuguacuguauguuugcagaaggagggaggauggcagauagguuuguguguguugggauggagaaaguaugcaaauaagcuaauuaauaucaauuguuuuuauaucuauauuacacauacacacacucgcauacacauaagcacacauaauuaaucacacccaugagcacauguacacagcuggucuacaccagauugcccugacaauuuuagagcugugugcugaaaaauuuuagaggaauuuggcuuugaaugugcaacacguauuacagagcaaagaucaccuuggguccuaagggagaugacuuucaucucuaccaugugaguaaaaccugggugauugaaccauaaauuauuuuggguauauagaacuuucuucaaauaacacuuaaaauuaaauguccagguaagugauuuucaaaucagaacaaccaaaauuguuaauaguuaugaucaugcuuauauacguauggaaauguauauguauauggaaauauggaaauuuguguauaagcaugcucugcaguaaaucaaaaaaugaccauggagcaaacauaugaaaaugcucaccagcaaugaaaaaaaugacccuauggcaaacaauaaaguaaaaugcuacacugucuuccuguagaggaccuacuagguuuggacaaacuggcugugcucaaauacaugugccaaaauugagcaggcugggugcaaauauucuaagggaauugaaagacacuuuuucgugaaauagguuuagguguugacauuaucucuaaaaguaauuaaaagaugauugauguaguaaauuuucuuuuaagccaugccuuuaagcacauuguaggaaaaggacuguuaaacaccacauuuucuuauuuagaacccuuggggccauagguauuucacaauuuaagaaucauuugcauuuuaugaaguuaauaugguguauauaacauguccuguguaacucuccagugaagucugaaacagccgcaauguauauauagauuauuauuucuauagcaaaacauaugaauagauacaccuaguaagacaaaaacaaaaauuauagauacguagauauucucacauuaguucagguuuugucacaaaguacagcuuucaaaccuucuggaauuuuucaauugagggaaagauugugaaccuucaaaugaacaaauaaauaaauaucuaccuuuucugaagaaaaacaaaagccaaauaacaaauaaaucaagaaucacuuuucaugguuuuuaaaccccucaaauaaaugucuuccuucuuucaguucauagaagauuuagaauuauaaaauaaagaaggccuauccacauggucuauauaugucuuauauaucuauaucuauaucuauaucuauaucuauaucuauaucuauaucuauaucuauaucuauaaacaauuuuagaauuagcucgucccacacaaaaauaguuuuuuuguuguuguuguuuuuuguuuugcuuuuuuugggauggaguuuugcucuuguuguccaggcuggagugcaauggcacuaucucagcucagugcaaccucugccuuccgaguucaagcgauucuccugccucacccuccucaguagcuggaauaacaggcgugcaucauuaauuuuuuuauauuuuuaguagagaugggguuucacuauguuggccaggcuggucuugaacuccugaccucaggugguccacucaccuuggccucccaaagugcugggaucauaggcaugagccacugugcccagccaaaacuuuagauuuuuauccuguuugugccucaaagccuauucaguugaaaggcugaugggcucgcucugagguccauuguuggcugggggagagcauuagggagcugacuuuuggcagaugaggaaaacagcaugaucacugcuuuugccacucugcuuuguggaauugacccacucugaaguuguucucacucgacagcaaugcaggcauuuauccagugcuucuacaagaaauaauuugggcaaaagcaguaaggaaguaagccuuaacagaaaagugggacccagcaauaggagaaucuacacaucugcuaagcccagccaucauauauauauguguguguguguguauauauauauauauauacacacacauauauauacacacacacacacacauauauauacacacacacacacacacauauauauauauauauauauauauauauauauauauuuuggagauggagucucacacuguugccuaggcugaagugcaguggcaugaucucggcucacugcaaccuccaccucccgaguucaagcaauucuccucccucagccucuugaguagguggcacuacaggugcaugccaccacaccguuaauuuuuuguauuuuuaguagagacagaguuucaccguauuaggauggucucgaucuccugaccuugugaucugccugccucaguucccaaagugcugggauuagaggcaugagccaccaugcccagcccuuauauauuuuuaaugugcauuaguaaauuauaaauaaugacagucuccauguggaaaaugaaaaucaacuuagcuuauacauuuuuaaaaaucagucaaguggucuugucucauauacauagaccuugaaagauuuguuuucaguacauucuguagaaggcucuugaauaucugauagacuccccuggcagcuuucaccuggugugugcaugcacagauauaaucaccuuagucuuuauccugcaguaaacaaaguucaagagagauuucugaaaugaagauaaucuucauucugccuuuugccgcuaccuaaaguucccuuggaggacucugugaaguuacucagguuauauuuuuuauaacaaauauaaaccacagaauuugccagaaugagaaauauucugaugaacaucaugauuugacugaggauggaggaauuguagggaaugguuaaacuugaagauacuuuuuagaaaaacaggucaugugcuacagaagcuacuuuuaaaaacaugcuuuuucauuaaauguaaauuuaccacauuauuuuauauaucuucauuaauuuaauaaaacuccugcuaggcuuuuguaaauuuucacagauauaauguuaccauaggcaucuaugcacauguauuuuuguacacuuguccaauauuauccauagaguuaaaauuuuuaacuugaaacuucuaagucagaaggcauaugcuuuuaauauucugcaguacauuuuaacuugccuuccagaaaguuuauaccagauuacauucccauuagcuauauaugaaagugaacuuccucacuggcaguugaaaauuugucuuauuuuaauuugccagauagcuugucauauauuuauugccaaauuucaaauucauuccuuuuauaaaggaaugguucauguucuuccccagucuauuuaguuuuauucuuauuacaauguaagagcuuuucauuuauuaggaguaucuucucauuaaauauuuguuaagaaagauuuuuguucaacuuuguaugguuuggauaauguuuucauuuauuuuuauuuauuuauuuauuuauuuagagacagagugucgcucuguuucccaggcuggagugcaguggcaagaucuugguucacugcaaacuucgccucccagguucaggcgauucuucugccucagccucucuaauagcugggauuacaggugugcacuaccacgccugguuaauuuuuguauuuuuaguagagacaugggguuucgccguguuggccaggauggucuucaacuccuaaccucaaaugauccaccugccucggccucccaaagugcugagauuacaggcaugagcuacuacgcccagcuggguaauguuuugaaaaacgaguauguagucugggucccaauauguucuaauuuuucuagcucuaaugucauagcuaacaaaggccaucucuacuuaauugcuuguacuuuauucucaggcuuuuauguuuuaaccuuugcauuuaaacauauuuuaguaugaagugugaagcaaaaacguaaauuuuuccccuuaaaugcuaaacaaacuuuaguuaccauuuauugaauaauuuaucauuuucucauugauuuuuuuuucaaugacagccucgccauaaaucuuucuguaauauuuccugaucuggcagcagccgcacauugcuuuaauuuacuuuguuuaaaauguauauauucucaacuuacaucuuuguaaaaauuuucuuaacuauuaucaugcauuaauauuccagauaagcuuuagaauuugugucuucucuacccuauccauuuuucucucuuuggaauuuguuugaauuugcauuaaagucuccuuuaauuuugagucauccaaucacauuuaugcaaauacuuuccugggaaauauuugugugaaaagauuuucuuuuaaaaauugauauacaagauuauuucggucuuuuagaaguguuuauacugcugaauccuuucaugauuuuuguuaaacuggcuugugaacuaguucagcaagucagugucguaugcugaauaucuaaauauauuuauaaugagaaauauaagaaaacauaauaagaauauuucugucuuacauccguggagagaaaauagaauauuuauaaaugcaaaugcucuacaauuacucuaaggaaacuuaaagaucacaguccuauucuaacucuguaaaguuauuugcuuguuuguuauuuuaacagcaucuuucucauaagcauuuaaggcugguuauaauguuuugugugugaauauugaguaaaccaaaugauuggaggcccguuauuuuuacaaagauuuuauggaauaagcaaguucggaauggauuucgaaaaagagacagucccuguuucaguguggaagggacauuggaguccaaaggucagggucagauacauguuuucuucuuuuuuuuuuuccuuccuuccuuccuuccuuccuuccuuccuuccuuccuucuuuccuuccuuccuuccuuccuuccuuccuuccuuccuuccuuccuuccuuccucuuuuuuuuuuguuuuuguuuuuggagacaaagucucauucuguugcccaggcuggagugcaguggugcgaucauaacucaccgcagccuccaacuccugaacucuugggcucaagugauucucccaccuuggccucugaaaaugcugggauuacaggcaugagccauuacaccuggccauuuucuuuugacuagagcugaaguucugaaacuagcagucauuggagauaagacaggagaagacaguugggaggcuccaagcaugugauuucaggaaaagcaugaguugauuauugagaauuucagaugugagauuuccaggaacagugugaguccagaagauguaagaaagaucaguggaauucacacaguuugguuauucaugcaucuucgaauauuuuucagauaaucucggguggauacuucaguuauuucugccucagcccaccuuauuuguaaagcaguauuaguagaauccccuccuugagggguucuucauauuaaauaaguugcauagccaacagccugaggcauaccaaacacuguauagauauuugcuguuauuuguaugauugcugccuuuuacugaguggcauccugggcuggugcuugggacucaacagugaggacauucccucccacaucugccuguaaugccaaggccuugugauagggaguggccugaagcccgggguagaggaguggaccuccccagcauagcuggggaaggagucucaaggagaugacauuugaccaguccucaugguuguuugcaaguggcuucucugcuguggaaugggaagaaagggucuuccaggaagagggguuagccuuuguaaaagugcagagaaacguuuguaugagcaagagaguaauuagggaaccgugagcaauuccaugugacucugacuauagguaggcugcagggaagggaagagacagaugaggacugucuuccuagugccuagaacaguggcuggcccauaguagguauucggugcaucuuaguggagaaaugugugaaagaggaaagagagggcugggagguagacuacuacuagauuggcuauggguggagcugggggcucagcauuuucaagcucugaaguuuggucuccuugaaggaacaggagcagcucuggauuuuagaaggccaauucuguccacagugcaccaguguucuaggugagguuggaugauggggagagggaagucugaagauagcauccauaaaucucaugacauuucuaucccagcagugcaaucaaauguugagaauauguccuguagcuuucuuuuagaaaagggguuagcaggccaggugugguggcucaggccuguaaucccagcacuuugggaggccagcgcggguggaucacgaggucaagagauugaaaucaucauggccaacauggugaaacccuaucucaacuaaaaauacaaaaauuagcugggcaugguggcaugcaccuguagcccagcuacucgggaggcugaggcaggagagucgcuugaaccugggaguuggagguugcagugagccaagauugcgccacugcacuccagccugguggcagagugagacuucucucaaaaaaaaaaaaaaaaggguggggggcgggcaaauuauggcuuaaggccaaauccaaccaacagcuucuuuuuauaaauaaaauuuuacuggaacacugucugaccuguuuauuuacauauuauguaugguugauuuagcguaacaauggcagaguuggguguuuucaacagagaccacauggccagcaaugacuaaaauauuuucuaucugguccuucaagaaaaauguuuggugaccucaguguuagaagauuguuuuuagguauuuaauggugccauucuggaaaaguuggcauuguuggaagaguucaaauugaugcauguguagccuaagaaaaauggggccauaucacuuccuaugaagaaacacaccaaaauuuuaauucaauucuuaaguuguugucuugauuaucuaaguucugucucuagucuccuauggcuauuuuuguggcuuugacccuagcugacccagccuauugucaguaguuaagaagguagauuccaagugcucaaugucauguuaagacuuccuugcuaccuacuaagggaagucauuuuuuuagccagcuguuuuaaguucuccuaaccuauuucauaugcuauguucccacaauaaccauucccuucucuugccauuucuuuguccucucuccugcaauguuucuucuacugaaagaauacggcacuacugaaucuguuucuccugggcagggcuugcauuaucccaccuguuccaaauucuuuuuagaaccgggcccuuugggugaaugaugaaccauuuaauagccccauguacuauagaaauuuaaccauuuucaaccaaaccugucauagauaagaacaaagguaagccaucaugugucuagaaaaacauacaacugauuuccucacagacauuacaaguucuuacucuucaaauguacuuuaaaggacugagaguguaauuaggaaucagcagaaguuuuguggaaaagaggcauugagccuuuugcauauuaaggaucaaauuuuauguuuuguaugaagcauucaugaggugauguucuuaaaaaccacuccagaggcacaggaggaacgcugaggacaagacugaauauagagauggaggaauuacgugucuacuggguagagauggagaaggcauauuuauacuagggaugguugaaaucaugcaagcaucuuccauagcuaauaaauuauuuuauccaguuggccuuuacugagggcauacuguguaccggggcccacccuguuggaugccaggaauacaaagaugaucagaguucacuuucugcgcuugaggaucccacagauuagaaaggaggaaaaagaguuacuuuccauacaaggcuauaaauguuacaacaguugaauuuuucagaugaaguggaaggaaacgucuagaaggaagaggacugaaaugaaagaagacugggggaaaagaaauaauaauaaacaaaaagaaaaauaauuugaaacuuuuuagagaagaugauugaccccauuguggagaucaagauuaaagaugaauggcaggcagcuguggagagcagagguggagauauugggaggaucagacuaaagaacugaaauuucaguuguccaagcgggcaugcuguucuacagccucacaugucuugggccuauuagaaauauauauaaucuaucuaugcaugacuuauauaccauacaucacaucauuucuuccaaacuuacauuauaauauaacacauucuguauuaguauauaguaagauuuuaaaauguacaacauauuuaaauauacuccuuacaauuaagccucaguaagugcuaggaacuuugcuaagcacuuuguauuaucuaacugaauucuuaccauggguaggcacucuuauacaacauuucccaggcaaggaguuuugcccaccaagguuagacagauuguccaggauuauccaggggguaaguggcacucacaccagggcuugucugacccuacuuaauuagaugggcuccuaugaaguaaauuuuaggauaagcucuugacuuaaaaaugagccuucuaaugguugugggagagggagaaaaaacaaguuuacagaagauagcgggugaguguggagcagagaacuagcauaggcuuugaagucaagccuaacugaauucccagcuuggcuccacugcuugccagccacauggcauuggucaggucacauaaccacucugaauguccccaucuguacauugggguuuguagcaucugccuuguuagcauguaaaggaucugcaccugugccuggcacuuagcagacacugugacuuguagcugcugcugcuccugcuauaccuaccguccuugccacucuucuuauauucacauccacccauccuccuccucauacuacuauuacuaccuaugcuaauacuauggugguuaugaugagcagcaguaguaguuggaaugccucaaagauaagauuuaugcuaaaaaacagaagcacaguaguuauuuaagaccucgauuugaucaauagcauuaguucugcauuuacuucaauauuuagugagcaugugccauggcaggucucugcgccaggcacuguagaaaguuaaaacaugaagaagucauuuccucuuuuagcugccauauccucuaguuugaccuuuacgccauauacucuuggucagauauucaagaaagaaucuugggagggaaagaguuagugcucaucgagugcagacuggcuugaagcugugcauagcuuuggaaggaaugucaggacuuaaauaauuucaggaugaguugaagauuacauugagcauuuacuacuucuccagauaaucucaauuuccgcccaucaugugauggaggugucaccuuauuuacagguucagauuguuagcgggacacuuuguuauagugauaucuuacagaguuggccauuaggcuauaauugagccuuuauguggggugcuggguaggccacaugacccugguuccuguuuccagggaggccaaccuacauaaaaauggcugucauauaucguugcucagaggggcagauauuuacaacaaccuugaaauggaacuuccacccaauaugaugaagacugacuugugacaguuugauaugccuuuauuuugcuaaaauagcaaccuggccaaauauauuuuucagcacauuuauuauagcuacuuguuuauauuuauagcaaaaguguugcuaauucccuaguauguuaacaggucauauucaaauuguucuauuuuuacuuuggcacaaaauugcugaaggaaacauuuuuaaggcaaguagugauuauagcauaucaacucacuacauagugaauuauauauuaaaugaacuuccugaacugagaaggagcuuaaacugacaaagaagauaguuuucuuaaauucuguauuguuuacauaagauuucuucaaauccauuuuuuauuauagguuacugauugucucaauguuuucuuuuugcuaaauuucuaccuucccgccaacaaauauaaucccccuuuuaauauauaauagaugaccugggauuccagaauggauuuucagaaaccaucaaaaaaccuccucgcuuuaguguauacaauaaauaauauauucuuuuuuaaaaauaugagagucaaauagguauaugcguaaaccuggccaacccuugggcaguuguaauuuccauaccaaaaugcaugagucuuuacuugacuguuacucuguuauacauuaaguacuaguuaccauggcaaccuuugcaucacauuaugacauuuaaauauaaggugguguguuuccuuauaaggaaagacaauguauuugaauuuuugaguguuuggugaaauacaaucacuacuaaaauaaauaauuuuguuuaaggcaauugauuucuuugggaauuacguacauuuccaaccaaaccuauggagugcauucauuuauuuuuauuuuuuugugaugucauggagaaguaaaagauuuuuuuuaaaacaacgcuugauaaguauaacauaauaauucauuaaaugccuauaauuacccucguaaguggcaaaacacaaaauugaaccauauuugagguuauuuaucagugaccaauacuguagcaagaguucgaauguaacaucacaagauuuaugaaauucuaucgcauauaacacauuucuuauuuuuguauaucuaguugguuaacuguaacuaguuuugaucuuaccuauaguugaauuaacaguagcaguuugcucaugcgugcaaaagcaaaauuaaaggagccacugaacucauccuuguggcauuuccaggaacauggccacuuaaauuuaauuaugaagauuguugggcaauuucuuuauuaaauauggaaaaaaccuagucauuucuuguugccaguguagcucuaggccauaaggcuaucaucuuuguuauguagacucccauauauaacucauuuuuaacuuuuuauaguaacuuuuccaaauuauuaucacagcuuguacuuuuuaaucugaaaauagagaaucuaaugaucacucauaacuuuuggugcaucuuuucaauaauaaucaguggauuguaauaugggacuguuuugugugggacauaagaaagagguaagcucugugcuggacccuggcucugcggaacauuuuacauauguuguuucaucuauuccugauaacccuaugauagagcucuuauuagucccuuuuuacacgggaagaaaguaugguuuagagcaguugcauaacucacccccaaauacauugucuguauuucuuugagcuaagguucaaccagauuggucugaccuuaaagcccucccucuuuccuuaauagauuugacuucuacuucugacuuguuacagacacaaugugcaugauauguuuaauguagaaauaaaaaacacugacaaaaaaccuuuaaaaauguuugcuaaauaauaauuucaguaauuuguauuucucugcagcacagcaguuuuuuaagucccugauuugcaagauaucuuggucuuuguaaguuacccaaguccucuuuuguugaaaccaagcauaggacagaaauaaaaauaaauuauaaagguguacucuuggaccuucaggaaucaggaaagaagacuguccaaagacugaccuucaauuuugagcuuugaaguucaaaaguggacagguggaaauacuguguucuucauugcccuuuggugcgagauauauucuagguugcagaguaagugccaacagcagcaaaauuaucgccccccuccugcuacuguaguaagucagcaauggcccuucuguggucagaauggcacauucagcagcaacuauucgacagggauuuacagaaacuuccccauggcuguuaggaaucuuauucagcagugucuuugaaaacccgauucugugcagaauuagcuauguagaaaugaccuagguugugauaaaagguauuuuaaacaaaucuaacuuguaauuucacucaauguguauuuugcauuuaaugccacaaagucugguagauaccuacacauauauuuugcauucauaaguuuuauagugguucagaauuuuuuuccauauuaacauuuuaaaaaauccuggcuuuauagagucaguucaccauacaaagccacuauacaucacuuagguuugugaugaaagaauggaauugcagcugugugaguacuagaauacccaaacaugaauuagacucacaagcauuuggcaauaguucagaaaaagagcuuaaucugguuucaucugagacugcuuuucucuguucugcaacauccccccaagauguugugucugauaccggaucacaacguaaugggagugacgcagaaucgagaaagcccugagaaaccaggggcacauuugcuuuucuccagagauuuucuuucuccuacuucuuuuuuccccucuuccaguuuccaacucugaaauucaaggucauucaccuauuagaugcauuaauuauaagccaaaaaagcaguauucaucguacucugaucucagucauaucuauaauuaaguguaaauauaaucuuccuuuuuagaaauguaccacccacccauuacauuuaaagugcugacugaaaugaaauaauaguucagagcaagaugauuuuaguuuaacuagaaaaaaguugauaauuuaagcuucaagcagugaguucuauuuuugauuaccauucaguuauaaaucuaauuugagauauaugcugcuuuucuguuacucaaguuuaauucaugguuugcuuucuugguuguauaagcaaaguucagugguugaucaaggcuguuaagaagcuccccugaaaaggaaugggggcaggguugagaauguguucgaaagacauucugagaccuauaucugauguaaaacaaacaaauccgauguaaaacaaacaacaaaauuuuaauugaaaaagacacucacagagugcuguauuuggggauuugaauggccaaguuaggaauggccauuugcaggggaauuggcugcagagggugaaccccaaaacauuccaaccugguugauaaagucaguguguuuuauucuuugguuacaguauuuuaggucuuuugggaaaaaaaauuaggagcgaguaaggggaagggcuugucucaucacacuguggacaguuaagcaaaaugcuaaacuauggguuuaagauuuacagguuagcucugccagaugccacaucugccuccaguguuuccuggcagauucgggcagccuacuacugggacccagcauaaccgcagaacaugagcuugcacaaugugaaaaaccuaaaaccauuauaauccuauuuaaggccaggaugaauuugcccauuuugaaaguagauguaguuuucaagcuuaacuuuuauuaagcagaaacuugucuucagagcuauaucuauauaugcagguaaauucauaauauaaacaaauaccuuauccauuuugugcaaaauuuaauuuacuuuaaaucaaacgccauucacuuuuuaaaauucauaaacucagguuuuucagccaguggaaaauuuaucuuucucauugcuacagagaguuaaguaucugacguaaaggccagacaauaguaaauggucauuguucgcuuuauaaguauacucuacaauaagaacacauauauuuuuaucuucauuuucccuaaggagguguuuagggcccccuuaaaugugaggaaauguuuauuuuuguugcuuuagaagaaugauucuauuguccaagugagaaagaaauaggaacaaacaggucuaaggagaaagaaacaggaaugugcuuugugaaaaaaauaaagauuaacaggaaccacuaaagguuuguaagugcuaucugguccuagugcuauguuacugcacauaguccuugcgccugcauauguaagaguuggaugcgugauuuauuaugacuggcccaugaaauuauuuucuuuuaaguuaacaacaauaaggucaaccacagccuguagcuguuuuguaguuauuuuauauuuuucacagcucuauugugaaugcugcuaaaagacaguauagcaaguguguguuuuuagguugaccccuugaaugcauuuaauuucuugagagugaaaaccuuugccaccaggaccaagaggaauuaaccaaugguuaaacucauuuaaaaacacaagcaagcauuucaacauauuugcuuagccguuuucugaauauuuaauauacuucuagagaaagaaaaaugaagaaauaggggugauuugugucuagaauacaaaguuauuuucaaacuccucuuuccaaugaaaugaagacucauucguagauuuaccaaacuguaaggagguugugauuucaaaucauucacagcuuuauugauggaaauuucaaagaaaacuuggacacagacuucacuguaacuuucuuuguuaauaagaaaugcgaagagugaaauuuagguugagauucaaaaacuuuugaaugccacuccuaaaugauaaauuauuuguuacuagauuucugauuuaugcaaaacuuuauuauaauaagccuuauguuuuaguuugucauuguguaguguuuuaauaugucucauaaguucaaaagaggcaauaguugagcaugcagaugucagauuuuuaucugauaaaucugguuuuaucagguauuuaugugguaaacauuaagauacuagcaaugaguuuauuacucaaaaugugcuuucaaucugaaaucucauccuugaaguuguauuuugaaguaauguuuauuacauaucucuugaaaaagucuuaaacuggaaucaguaaaggcgagcuugucaguagcugauuaguccuuuauauaugacucauccaacacucagaaaaaccccuuggaauagagagguucucuuuaugauauuuagcuauauggcgguggaaaggggagguuugaauuuuugauuuuccagcuuaugggucauauuugaccaacugcuuucacuagaagacaugccacuuuguugagcuauuuaggaaucaaaaagacugucuuaauuuaaaacaaggacccuuuguuuuaguuggugacugccuugugaaauuuuucaguucucagcggguuaaccagggaacaggggcagagucauaauuggccuauuuagaguauuuugcaugugaauaguguguuagugaagcaucccuaagucuguugugagugacauggugauuagaauuuagauuagggaaaacacauucuguacuuuaucaaggacaguaauuaguucagucaguaaaaguugauuacaaguaacgauaaaguuagauuuuuaguacuuaauuuuaaaauuucuuuauuaaauaguaaauuuguucuuaauauaaaugguacuaucuacucuuguuuuauugcauaucagaauaauuaaaagaacaauguguucaaugcagaguauaaucaagcgauuuauauauuauggguaaguuucuauguaguuuuuagaaaauguaauauuauauaaucuuucugaugucaucauuuuuagaaguuuaauaauugucacacugugauagguuauuguggaaguuuucuaguguucagguaaauguuuaaucugugggaugugucuuagcuuccgauagaccucaagagggcauucugaaguccuuuguggcuguuagcuuggaauaucugcuauuucuguaauuuugagaguuagugugaggauuugaauuuccucuugguucaguuggcauuuucucuucugugggugcuaugucaguucguggagaaucaugauaugcgguacagagaggcaggguucucagucgaguucauaggcuacacuuacccccaguguaugcagccaggggaaguugugugcguucacaaaaugagguucuucuuguuaaggaaggggaugaauaguucccagauaugagccucagucuagagaaaggaaacauuagucuuauauaaaugccauuuguuuugugaaaugaaaacgugagucaucuuaaaagacuuaaaaaaauauuguuuaaagggaaucaucuacuuuccuccuaaaaguaaagaauuaaaaauucacaaacuuugugauagcuucuuagacugccuuucuuuuggguuuuuguuuuguuuuaauugucucagcuuagcagaugcuguuugcuuuauugcauugguuuaaguacuaacaaucaguugggagguggugaaaguaaaaaauuaaccuuauauguuuguuuucccuuuuuaaccuuuuagcagagucuccuuggaggugacauggauaugggcaacccaggaacccuuucgcccaccaaaccugguucccaguacuaucaguauucuagcaauaauccccgaaggaggccucuucacaguagugccauggguaagguauuccuuuguuugaaugccugagggaugauuaugccuuuuucuuuuuuucuuucuuucuuuaaaauaucgcccccccauccuaccucccaccccaagaaaaccauaaaauuuggcucaguugucagccuggagacuuccccccuaguacacugaguagguacguuaacagcuuaugguagcagaacuuuuuuggugucugcuuaugucuaguuuucucuuagcugcacccauaaggaagcuauuaaaagaucaaaguagcaaaaaguuaaauaucuucauuuuuaugaacaaagcagaauuugauuucugcuagaaucgaaugugaucgugguaacuacaguuugcuaagguaaugauuuaaggaaaugugguaucaucuagaagucuuugugguuuaaccuaucuuaguuaggaaaaugggcauuugggagcugaaagcaucuucauuuucuuucagagguacagacaaagaaaguucgaaaaguuccuccagguuugccaucuucaguaaguacugcuuguuucugcuuuguauauugcuuauuuuguucuguuuuguauugaugggaaggagauagaaguaaaugaguuuccaugcgcccagagcagcacguuuaucuagaagguggaugagguagaaaugaccugcacauccagccaccugacccacauuggagugauuaauugcacauccuggaagacugggugguuauguugauauucagcagguuaagcucuaaagagagccuugaaaaggugccugaaguuugaggaguuuuaccuguacagggcuugcaagagaaugaguauuaguuucauguguugguuaaauucuuugucaguauuaugaugauuuauggauuugcaugcgaaaggagauuuguggagaggauuuaggaaaaauuuacauggguuucagcccagagugcaggaagaaugucucuauuuucuggagagguugcugaauaaaggcugcaaagguagcugcaucaguagccauuugugucuuuacuaccaggugacaacuagaaguagucagcuguaaccaagagcauucugggucuuuuuaacagcuggagcucuaugcagaaguugcugauaucccccacccacccccaggucccuaguacagcaaaaguugguugugaucacaacucaauacaugauaucauauuuugaauucuuacguuccuagauaauuguauuuaauuuuauuuaggacuaguccauuucuaguaauuuucuccucauauaaaaugaaaacauaguuuccucucuucuuucuuuguuucuuuauccuuccuccuuuuuuucauucuuccuugcugugauauaaaguuuugauuuaauucuguagaguacuaguauucuuugaaaagaaugcugagacuuauuguuuuuauacuuuaauauaaaaucauauuuagauuucuuaaaguauauuaccaaucaaugcuugcauauuaguuucauuucauuuuuaauguauuagaagaauaauaggucuugcaaaugugcuaagauuagauuaacccaaacaccuguguauuugacuugauuucaguucagcucauccaaacaauuauuaaaugaauauaucagaauaagucuuaucaggaaaaagaguaaauuuuguaugcugauuaucauagaguuggugauguugaagaagcaucacaaaauuauucauaaauauagaaaaauauuguguaaauaagauugccaaugguguauagucacuuucaacuagcaauaagucacuuaaaauuguacucaguuguuuauuguuugaauuucuguguuguauugaaauugacuaauaugcccaaaggauuuuauaagcauauuuuaagcuugaaguuagggguggauuuaauguugaugaaacuuuagcuuuuaauagguuuuaugacaacuucaaaugauacaguccuaacagcuguuuacauuuuaaacaugccugaacuuaauauggacaauauuaaaugcauuugguggaccuuugaauguucugaaacaauggaauaacuguccuauaaaagccauaaaaaacuuaaagcuaucauacccuccuuaugcuucauauucaaauuaacuuguuuuauccaaugcuaagauuaggcagaaaucuagacaauuucuaaggagugcauugguguggcauuggaugguauguaucugcuuaaucacugucaacaacaauuuucauaauucguuguaaauguuuaaguauuucccuauagcuaacuggccccuuuagaaaauuuuacugguacaguguuuucuuugcuguuaagacaauuuagguguugcugcuaugucgugauacauucagaaauauaaaaauaauuuuccuuucuuucccaauaaacaaaacuugggaauuaggaauuuaguuuuauucuauuuaauuuucuguuuuuaguggucaguuuaggauuuacucuucuuagaagauuuaucuugacuaaauguuuucaugguccuuaugaaacauuuugaugaauagccuuuuuucugaaauauaaggaggaagaaaauacaauucaaaaugaaauuuuuauugcaauuuuuugagcaagaagaacaaguuuagguaauuuuauaauuuaaucauccauuuacucauuaccuaaaaaaaucccagcucuauuuucauagcaauuuaacuuaguuuauguaagcuuuguuguaaauaucaauugcuuauuacuuacaacaagauccacauggcuuaccaccacacaaaauauuuauuuuaacuugauuccaaaaaaggucugcaguagacauggucacacuuuucuaguagcagaucuguauuucuauauuuuuagaccucugccaugcuuuuuuuaaagcucaaauaaaauuaugacuauuugauaagagauacuucuuaaauuguuucaguauguaugaguauuuguauaacagauacuaaaagauuggagauaauaaaagguuuccuuuggagugauuaugacuacauaagacacuuauauguuuucuuugauacauauuuaccaugacaaauaguaauaaaucugucacaaucuguuguggcaacucacuuuaccccccauuuugaagugggcccucucuuucccuuauaauaaaaggaagaaaacuuaaacggugacacugcaucaucagguauuauuugugacacgccugugguacagagacuggacuucugccgccauuaggcugggucuuccucccaggcaaucaggagagagaggggauugccuagcccuguuuugaaaacacugcagcaucugugggagagagaaaacguaggccuggccagacaucaugccauggaucuggcaggauccacgaauguguguuuguacugugugcugcaccuagagaccucacgucacuguggaaguaugacacgauggugggauaacagaagacccaccaggcagggucuacaggacaagcacagcgugucggggggaagccugucccucuagugcacauagaccaguacuugcuaaggugauuuuuuuuuuaaaggaaagccugugugaaagacagcuaucuaauugcccacgagagcucugcuuauuacugcaguacauuuuuaucuucucgguucguauuuuaguauguugcucuuuuuagucacgucccaauuucucguagcccucguuuuuugcgaagaccuuaguaauaaaguguugucuuuuguugaugucagaauuuauuuugcaugucuaagcucuugaaucuacaugagaacaucuuguuuugcuagauuucuacauuuugguuuuccauuucaaaccauauuucaucuuaaacucaauauuuugcaacuuuacugcucauuucaacaaauuuguuuuauauaaccuaauaaucauacacauugaaucaugaauucauacacagaaaaauguacuauaguaaauuaaaguuggaaaaaaaugauuuaugauucuuaacagaaauuaacaugaaaguacuaaaaucuagaaaguagcaaaaaauuuuauauugugcuguuuuaagauacuuucaucaaacacagaaacaaagcaaaggcauuaucuuuuggaaacuuuauucugcccaucaacauguaaacauguaaaacuuuuaucuuagaauuugaaauauuucaaaauuauauacguuuuaucagaaacuguuaacaacuacaaacuuucuacuucagacuuugguggaauuugucuccacuuguaauccgauuugcaucuuuaaugauggucucaccaugaccccaguuggaaucucuugaacaucagauuuuucuggaaauaggauauuuuauccuuagaaauaguuuaugaccucucaucuccagugaucuuuccuaaagcuguacuucucaguaaagucuuuuuucuacguuaaaguacagagggguuuugugugucuguuuuguuuuaaaacucaggaggaccuggcaaacuuuaaguggucagagauaauuugggacacauggaucccaagauaaacaauuucuacuacuauaaagauucuaaaauaagguuuggacgcuucaagaauauuugugacauuaguuaaucaguagguagguuugaaaaauaaaaacaauguguauuagauauuagguucaccaauuuucauaaggaaagaauucuuaaauaaaaugaaauauuuaaguauggauuagaguuuccuuuacagaagcaauuauuagggguaucaagaaaaaugaguaaugcuaauggccuuaaauguccuauguauuuuguguuauauaaaaacuuuccuauuugaagauuucaaacaugauguugaauccauaucuugagcuauuuagggaaaaccccuuuuaucccaggugcuugaagaaaucacaaacaauuuaaaagagauauugguaaacuguuuuuuccuuauuagugggcuggaaauuauguaugauuuaaaaaaucaguacugaacucagaaauauauaauuuccuacaucacuuuugaaauugaucauagggaaaucagaacgaugcuuuuucaugucaacaaauuuuaacaaguaauaauacaauuuucuuuaagaugaaaguuuuauugaaauaugauaucgaucacaagugaacgaaauaucagccaucugggcucuauccuuuuuaggaaagucuggaaguagccgauugugugguaagacguaaaaggaggaaacucuucaagguucaucccugcagggauagauacuuugugaagaaguauaauuguuaaguguuuaaaauauuaagauagcucucaguauucacuuuuaaacuuagugugcccauuuucuaauuaaagauauuggaauaugagguuuggauauuaaaauugugcuuauuaauguuuaggcaagaaggagguuaagaguggcacaauuaagucaucucaaauaggacaaaacuauucacacaauuuacacggcauauauaacaugacaauggggaacagugaaagcugagaaaauauucaugacagagaaaguauuuuugugugugugcaguuaaugcugaauuugcuaaaccagacuucuaguucagcaugugcguuuuuuuuuuuuugugaaaaccaaucuuaucuucucuauuacacauugagacuauagaguuuaugauuuuuaugaauugcugauauaugaaaaaauauaggagaaucuuuauauuuguuuugauuggaggcuuuuguuccauuaaaaauuuuucagaaagcacacaagaggcuugcacauacucaacauacauacuauuaggcauucuaauaucccagaaguuugcucaaggauuucugaauuuuuguuuggaauuuuggaauaaugagcuccuucauccacuauccuccucuucucugccuugaagcccaauccugcacccuuuaagaaagaaggcuucuggugugcauauuuuagauagaaagagagaagaaauauaaaggaaaagacaagcaugaagguuaacuguggaugaaagguuuguguauuuuugagcuauuccugcuuuaucuuuacaaacaaaaagguuguaugccccaaacacucaaacaaaacaccaccaguucauuccuucccccagaaagaagccuuccuggccagcagcaccccauuuuucuacucagugaucucuucuaaggaguggugccugauguaucuuccuacucuccaauguguuuuuauuuuuaaucaaguauucaaaauaguauuuugcaugcuaagauuuaucaggacuuucguuaagauguuagcagcugcuaacauaaacaauaauagcauuuaguguaaaacuggacuuguugagaaaagagaaauacauuucugggaacugcuauuuugaacuuuaucauuuucacugaagaguauauuuuggugugaaguuuuggacucgagagugguuuaaauuacugagaaguguaggaaaccacugcagggcugcuuuacccagagagaauuauaacagggcuugcauguauuuugaaaauaaaaccuuuuucuauggcauccagcuuaacugugaauuuauauuuacgaaauaauguagauaaaugccuugauaauuugauugaauaccauuuuuuaacuuuuaaaauuuaauugauugaaauaguuuuauuugcuaacauagcaaaauguucuccuuuuuuccagaucacugacaauuucugcauuuucuauguuuucuugguuuugaauaauucuaaagguuuucauugaaaguaaugaaucaggaauuggagggcuaaauaagauucucuuagaagauguggcaguaauccuaaaagaauaaggagucucuucaagaauugucaaaguuguauuuucuuaaggcagaauccauacuugucaggcuguugacagacacuugcuuugucuuggcuuuuguuugauuuuuuacauaacugcacuggauuauuaaacugaacauaaaauugcaccucaaagcaauagcacaggauuuucagccuugaucaauuucuacuauccccggaugugugugugcacgcgugugugugugcacccauguguaugagugugcuucuuuuaaaggaauaggagcuuuuauacaauguggugcaaaacuuauaguuuuaaauacuuaauuauuuuaucuggaaacagcagcaugugagugauucuuuuuuaaguugcagcugcugcauagguguagagcuauuugaggaguuugaugcuuuacuugagcauauacucccucuucagagaaguuaagguagugcagaaguuucugcauuuuguaaaauuucaggguugaaaauaaagaugcuuuaugauuuggugagauggauagauuucacuucugaaagaaugugcaaguuguauuuugaaaggaacauuuuaagaauucuacuuaagugguuuagugacacccacucuugucucuugucugacuuugucaucugaggaauuaaucauaaauaagccacuagggaugaaacuugauauauaagugcuuacuuccagaguaauaagaagaggaacuguguguguguuaaauuucacuaaauuuauuuugauuauuccguagagcaggaaauaggaacauuucguagugaagcucucuucauagcaaacuguaaagaaaauuucucaguguguugccauauguuggcagugauuaaagggcauuuccuuugugaaacauggagccauauuagaaagacuuauauuuucucauaaaaaugaccuuugcaaguacauuuaaucaugaaaacuggugucauucgucacauacacauacaaaaagugucacuguuaccauuagggauuuuaggaaaaugcuacuuuggaacaauuauuuugauggcaucugagaaagaauaccuaagugucuacaggagccuccucccuccauggcccauaucauucuaaauaugccuccugaauuacgcuuauaauaauauuguaaugucuuucauucuaccgauuggcacaguauaucauuauaucauuagcugcuaugagaaagcaguuucaaguagguggcagauucuuagcauuaauguuuucaaguaacccuguuuggagaauuggguuguuucacaggugcucagguacauuaacacaguacaauaauauuuucuggcuugcuuuuuaugaaacgaacuugaaguacaaaauaauuuaauaacaaguggaguauaaaaacuggagcucuagcuuaagaaaguuuaauaacucaagacguuaaaggauaagaaaaaaauugucuaaggaggcagcaguguuuagcucauuuugcguuacuacuaaagcugaaauuuauuaggagaauguuuauggccugauuauuuagacuuguugaguuaguuuaaauuuuuuaaacgauuuggucaaguagaaaagcacaguucuguaucuauuguacuauuugaaaguauuguuacauaaaauaaauucgaaauucugccauuuaauacucaggcauaugauucaggagugaaauugcauugccagaaccuuggggucccucauguaucuuaauaugaauuuuauuuuuagagguguauaagacauuggcacauauaaucuguggcuuaauugauaacagcaaagaaaauggaauuaaaaauauuuauuauuaacagauacaguugggauuacaaaauucaaacugcagucaguaauuauuuuacaaauaaaugcuauuucauuuucccuuuaguaaauauaucaguaacuucacccaauauugauguaagugaaacccgacaguaacaagcugggagugcccagguagaaggggaaaaaagcauguucauuuauucauucauuccuuucuccguuuauacuuauucaaagaguauuuuucauugcagcuaaaaacuagacacaccauguaacauggaacaugucuuuuucuucuauguauucuuauuuaaaucguggagcuuuucaacugagauucuucacguuuaaugaaauuugcagucuugugucacuugcgucacaauuuguaggaauaaccuuagcauuuuaaagaguauaccguguagccuuuugagaaagucaugcauuugaaaaauaaaauaacccacaaaguguaacacauggacuuuugucccuuaagcugauugcccuuacucacuugucaccaccuuuacgagagugagggauauguuuuagauacauuuuuuuuuguccuauagaaaccagacucacugcuuuacuuaugcguauuacucugaaauauauuuccagugaaugaauauaguaguaaaagugguguagcaagguagaaaaaacacugcacuagacauaaaaagaccuuucaaguauaacgucugacagccucuacuuacacacccaguggccuugguuaggucacaaaccugcuucucugucuacaaagcagguauaaaauagugccugcauaauaagguggugucaauauacugauaacaaaccuuuaucaaaguacuuauuccaugccagaguacuuauuccauguucuaagugguacacuauuacaucauuugcaucuauugaaucauuuauuccuauaaaaauccugugagauggguacuacuguuuauucaagagacuuaaaaaugagacacagagaggugaagaaacaugucugcggucacacauaguaaguggcagagcugggagugagaccugggcagccugucucuaaaguuucuguguucuuaaccauagugcugucuaugcugccuagcguuucagacacucuguagaccaaaaagcucucuacagcaagguugucauuaaguuagcaaguauuugacuaucuacaauaaauuaauauucagaaauuucauuucacuguagagugaucaucaguaucucuguauagucauguccuauaacuuuugcccaagcaaaucaguaugccaggcaguccaggggagcaucuguguaaacaaagacaguauaauauagugguuagaguaugaaaucugaucaacuggguuuuuagggggcuaugucacuuccuagcuacacaguuauuuguaaaauaaguacucauugggguuugaaugcauuuauguaauauccuugaauguuacauacuauuguuacacauaauaaaaagcacugucaugcuauuaucaguaacaagguaacuaccuuucauuuggcauuugagaaacaaaucuaacauggcagccuacuuaggaguaguuagcaguagaauagaaacuaagaccagggucucagcuauguucaaaagaauuuuaccuaacagaggucacuugcuuuuucugaaauuauguaauauugcuuuuuuuuuuuuuuuuuuuugagauggggucuugcucugucaccuagguuggaguacaguggugcaaucauaguucacugcagucucaaacucccaggcucaagcgguccucccaccucaggcuccugaguagcuggguacacagguucacaaccaccacaccuggcuaauuuuuuucuuuuuuuuugguagagacagggucucccuguguuucccaggcucugcaaacccaucucuaucaaaccaagacacguagucagcccuuuuaaucauuagaccuaguggucugcaaaguuuguguuggaaauacuuuaucuucucucuuuugaacugguacaucggcugugaugcccggagcugcuuauacugugguucccuuggccaauaauuuguuuaugccuaaaucagccuugccucuaagugauaaggagauacgugcuuuuucuuuuguuuugugucagugguauucucuaauaggccgggaacgggucugcccaagugaugcacagccccuugguggggcuggcuauagauccccccgcaaaacugaagguuaggccuaagauauuagcuuugccuggcaagaugaagauguguggacuagguagaccuguguggcagucuguuucuuuuauaaaguaaacagaguucaguuuguuuaggacugcuuagguagauuucuuacacugagcaggaauauuuguacagauguuuuaagguaaagucaaagaauggcuagauuguagccuuugacgcauuauaauguaucuuuucucagugccccuguugaauucacaaaagaaaagguauuuuugaucaucggcuaugagaaacuuaaaacacuuuuuuuuauauauaaaggcugauuuaguuaacucuucuugcauuuaaagaaaaaaacaucugcugaaaguagggaggggggaggugugagcggaagcguggucuccacauuccacaaugaaugucuuuucccagccaauuuuaauuugcagaaaaaccaggcacugaguuagauuccucgggaaaagucccuguuggcugaugagcccugaacuucuuccguguacacccugaacagggacugaugcuucaguucacagagauaauuuuucucuggaaagccgauagauccgauuuagccaccccucauuuguagucauugccaccuuguggauuacaaaggauauugguuuucaucaaacuuccauuucgauuuggcuuuuuauggcaaguacacguuggcaguggauugccguguuccucaccaaaaggauccugguuuguucagcaacaccucacuucuccacucacaguucauuuaugauucugaugagaguguuuuuucaggaaacacacauuucacuuuuugaccuaggagcaucuguuagaauuuuuuuuuaauacuacuuuggcauucugaaaguguuaaugucuuucauaucuguuuaaugcuauuuagggauauuuaugaucaccucuugguuacucaggguaaagugugucgcaauuuuuuuuaaacagacaggaaagcauucacaugaggaaacagauugcuuuaaacaugugcuuccugugacaguaaaaagaacaaauuagauuuaacacuguguaaugaaugcauaaauguguacauuuaagcuuuuaaaagcuuuauguucaguucuggucacaacaaaaauugagucaccuguaaaaauuaaagaugcccaggguacucucagacuuuugaaaugcccagcaauugcaguccucaccugacgaugccucguuggaauuauaaaaagcaugaucuauuagugcuggagagaacuagaacauuacaaggcacauucagagguuaaaccagguuacagucagauuccguacauuuagcaaauaaaucagaauuuguugugggggggagaauacuucacucucaucuuccucccuaagaaucaaugaaaaaaucaauuuucgggaaccccauauauuccucugucuuucaugaaagaaaaagaaggaaaccugauguuuacuuacuagcauuuacuacaauuuaauuauauaagaaaaugacucuuuuucuuauguaauucaguuuguguuuuguaugcuggcagggagugaauagaaucugaguuaauauuuccaguuagacuagaguguggaauuggagggccugaauccucuccccggaagaagaggcacucauggccauuucugucugagccugcggauagugccucuccguccccugugcuuucaaagcuaaggauuuguggcacgcuugccaucucucuggccaaggagggccaggagagagucccucgggggagggcacauaguuugaggacaucugacucucuucuaucacauacugagguacuaauaucaaaacagacugcuugucgucgcacgguggggcagugcuuuuuuuggcugccguggucgaaaugaaaugggcaagcuguaguccgcuuggcaucagaaugggcuaagggaagcagggaaaucagagucagacugugaaugcaagucacagccaaugguuaacuuccuuuuugugugucacuuggcagcagcgagacugauggugauuuuuuuuuuuaacaugggugagaguucagugcccuaggaagagccguagaugcuguuauugugcuuccucauacaguugacuuguguugauuucuugaggccaguacagcuguuccaagagccagcuccaggagcuuuguguguauguacauggccaucggacgucggaugaaaaagguaaacagaugagaggugauccauacaaaaucucacugcugaucacuaggcagucuuaggggaaucagguucuggcauaaggcaauaauaccaaagaauaauauauagugcacuugaagggauacucccuuguauacagacacccaaagauauuuuuaaauuaucaccacuccgcaccccucaucucacauacaggauucaaaucaauuuuggacugucuggaaaauguaggacuaaaauagccagauugaauucagauaaaauuaccuucugcuuuuuugggagguuguugcuuuuugguuagccacauuauuuucuuugaagauucauuuggaagagaguuugguagaauuucuagccucucucaagauuuuccucccauuucucuguuugcaaagagcuguuccccaaaggcaaaaagagcgaguugccaucuugagcgaauuguauguuuagugaacaccaaauggucucagaguuacccuaaauuuucauuauaucugguugcuuucaaauacuauuuauuccccucaaaacuccuaaccauuuauauaagauaucaguaagaugaccaacuucugacaacccaaaagcagggaaggaagcuuagaaauagaauaccauuugucugguaauuagaguguaucucuuaagaguucgagagaauucugauuaaccuuucuguucccacauucucacguaaaauuagcacaccuuuuaaauuauuaucuaguauuuaaacacauauuuuugagucuucuuaaugcaacagguucuggggacacuaaaaguguguuauaguuuucuaaaaaacuucauuuuucuuacauuuuaaauguucuguuugugcaaaauuucgagaaucaccauaagggcuucuuugcauuuuuaauuuaguaacuaacauaugaauaaauuugcauauuaauuaguugcagauuaaaucaugcauacauaauugccuccuuacuguguuuaauguuugucaaaaucuccagccugguuugauggaugucguaugaaagauuacaauuugauguacccuuggaaguauuuacaccaauaaugcaagauucuuaauagcagaauuuucuaguuauauacaguuacuaauaaacauguaagauagguacaugucccuuugacuaaaauuuuuuucuuugcaccaaaucauuuacuauucauaaucauuaaugcaucuccuaauuauacagcauaugucuguuaacccuuucauugcuggccuucaaaugguagcuucuuucuuuuucuugcccccuaaagaaagcaaaauuguuugauaauacucugaaauuacucgauugccuuuuauuuauuucucuccuaguauauggacaaaccucauuugccauuuauuuuaacauacaauagauaauuauaugaucauuuuguauuuucuaguuaaagaucauaaaaugacccacgugcacaugguuaguagcugaugggcuuuugccuuucuuuuaccaaugcugaaaaaaauugaaauauuucagauacuucauauaguaguaaaaaaaaauguauacacagacauacucucuauuuaggaggguaauuguagaauaaguaaaaguauuaaaauuauauuuaaauucauuuugaauauugaaaugcauuuaauguaucaugaucaaacauaggauggaaaugugauuuuuuuuauuagaauugagaucucugaaguagaaacugacaagagaauagaugcucuugauuugacauaauuuuaaaaugccaauaaauguuuucucaaauuucuucagguauuuaauuuuuuaaguuuuaucuuacucauauaaaaaguagaccaacuggcuuuuuuuuuuccuuuuuacuauuuugaugucuaagcugcuuaucacacuguauuacccugcauuaaugaguauuccuacugugcaaaauucuaucaaaaaugauggugugaaugucauuuuuaauuggaaguuuauacagucaaauuuauaguacacaacaaaaaauauguauguaguucugcuccaagccuuuuuuuaggcuuuugaucuuuuuaguuuaaguauacauuuuuauuaaucuaagugucauuugaaaaucuacacaaauaugacuacauuuuuuauuaauaccauuguauuauggaagagagggaaacuaaggcauagaguaauuauaaugucuguaaacuguaagaagaacaaauacaagaaugaccaagaauagauuuucaggggucuuuuuuagacaugaaaacuugcugaccgguucuguauguuucacauaagucagacuguaugauuucugucuucuuuauuuuugaaugccugcauuuauaugccuaguaaaaaggcaaagguuaaaaugaguugaaagcauaaacagcugauuucccuucuuugauucuuucauaggagaaauaaugucuccuggucaccuaccucaggagcauuuauuugcuuaucacaggacacaaugaacuauuuauugauuuaacacaacauucuuuuacaacacgcaauauuacauuaaauuauuuagcaaugugaaaaaugaaaugaaagcugcaaaacuuauaaaaggaagcaaacagucagaccugaaacauauuuauccacagccauugugccuagguaauucagggcauaugguauguaaaugauauuuggagauccuugccaaaucuacacacgacgggauaaauuaaggacagguuucccugggugugagucccaugauuguggccggcacacuuccugcuugaauguguguguucuguucuugucuuucagcaagagcgucacagagcauucaguggccaaaucugguccucagcugacuucuaagacauuauuugcaauucccaagaauugauuuuaugauuaaauuuaaaacauaguaccaauuugccaaacuuucccuuugcucucacauuugaaaaguaagaucugaauaauuugucaggauauguuuagauauuaagccauuuaaauggguaucuuugacauuagaaauugagugccucugagcuucuuagucacugaagaaagguguuccugagcagugacuuuucucuaagcuaggauuaagauguuuccuagaacagacuaugaauuauuuugaacgauugauaauuuugguuccagguuggcccaguaauaauuuauuaauucaacuugacaacccaaauuacugguaucacuuauuuuauuuuugaauuauuauuuugaagcauauacucucauuucuagaaaggugaaggcacugacuccuauuuagaauaaauuuuaaguagguaagagguuaugcuguuuucuuuuuuuuugaaaggaaugucuuuucuaagcugggggucuuagcucagaguuuuuaaugcuuuaaauuaagguucauuuuuaucuuggaauuaugcaauuggagauuuugauuagaaacuauggcagaauuuuuucuccuauaauuuauuggacuauaccuaaagagugcauuuacugugcacacuuaauuauaaauacaagacuuauauguuauuuauaaaaguuauuucgggguauuuuaagacauguagaguauggcuuaggauguuuuauuguuuuuacuauuaagaauaaugcuuuuacuaaauaaaacuguguuucuuuuauaaaagauaaugcucuuaauauuaugguuuuauuugaauuagcaguuuagucuguguccccacauuccauuucauuuauggaaugcaaauaacacuaguuacugcauagaaaaugaaauuaggcugaguccuuguucauugcuguguaaauuggguaaaaaucagagaaaaaaaaauacccuugagaucaauguaaaucaauacuacuugagacagauccagcuaaaaauucaugaaaggggucacaguucuggaggaguuuauauaauuaucauguagccuauaguuugugaacucagggcaaaguucugagcugguuguucugggaccauuccuugguucauugaaacuacuuugcacagcugugcuucaaacucaacaacagagagcaaaaacaauauucacuauaaaauaaaccucguccugccuuucaacuucacugugaacuugcagucuugaaaacaacaaaagggauaaucgcaauugagauuacagaauccagauuagauguaauacacaguagggugguauggcccaauuuuacuuacauggggcaaguggaagugcugugaaugccaacauguuaagcaucauagccacuuauuaagauguuagcuuuaaaugucagucuuuggaccccauuugaaaugaagcaccugcauuuuauucaaagaaauuaagauauauuggggaaugcggaggugaguugaggguuuuuuuuguuuguuuuucuguuuuguuuuguuuuuuuuuucuggugggagaaagugccauagacaauagagauaaaauaucucaaguauuaaaagucuauuuuuauacacuguaugauucaaaaugacugagcaguuuugaaauuuuguagaaagaaaggaauauaaggagaauaagaaaugauauuugcaucuuuacagacaacucuguauagcacauuuaagauucuggcaauuuccuuacaaguaucugaaaauuaggaauuaugaaggaaacccagacagauacuuaacuauagcauugcuaccaggugucucuuugauaucaaugaguuaggaaaccuuaagaaaaaaagguuaaaacauccagaaugauaacuuauuuuagaauaugcuuucagacaaaauauuucuuuguuaagaauguugaaagguuuuauuuaauuguucacauauauuuaguaaauuuuuugguagacuugaccgauuaggcuuguuucauaaaagaugugggcuucuguguauuuagaucuuaaguuuauuucaaauuggccuuuauaaaacuuuagugccuuucucuuagaauucuagucaacaaaauuauauucaucaaguguauacaucacagaaguaacuggugauacagaguauaauuccuaccauauugucaaauggagucuauaucuccucaaagggaaagaaacacugacgugagucagaaguuuucacucacuuggcacugaaucagcuuaaaguucgagguugaaaaauucacaaauauuuauagcacaccuacuaagugccacgccuccuggaagguggacagcaauggccaauguuucugccauuggaaagauuugcaccgaaguguguauggccacauguaguuguacaaaucagaguucauuuuguaaugcuuuauaagggucugguaccacugauucuccuugcagacuaauaaacacagagcuuauaugacucuuaaaaauacagugauagcaagugcauccuaaauuauguaaucaugugguccaugauaacaguguaauauaugauauacagauggaaucagccaccuggcuuacuguaauuguuguugagguccuuuguuaugaacauauauuucuguuaacaaugcaacaaaauaauuuuuuaagcuguuuuuuuuuuucuguacugccucaaaucuagauaaacggaauguguuggaaaggacaacaaauaagaaguuaaauauguggaaaugacauggaaagcaccuguuucuucccuuuguuuucuucuacgucaucaggaaauaauauuuaaccauagaauauggugucccucuaagaaaauguuuauaauugaauguucaaaguagaauauagauuaaauaaguaaagaugacuugccaaaaaaaauuaaagaacauuugaaacaaacagaagucugcaucacacauaauaaguggcauaacaguaucaccucucaaaagugacaauagauguguccaucuuuaugccuuuagcauguuguuggcauuauuaguuauuguauugagagaguagccacgcuauacaagagaaaggaagguaaauuagaucccucacgcccccuucuucugugaauuguauauguuuuugaauacacucucugccaggacagcaaauaaaauuugguucaucccugauccucagcagauuauaaucuagguaaaggacagaccagguucaugaaaucaaaaauaauaauuagaacauuuggaaacuaggggaacagguccucauauugugugcauguuuuaucagucuaaaguagauauagcucuauugaaaauuguuggcuaguaauaugcucauuuucccauuucaugaagacuuauucucaaauggaaguuacagcuggcuaucguguuuuuccgacaaacucucuucucuguggacaugaugauuucuguuguuguggaaaggaaggaaauaaaucucuuuuuguuccucauucacucaaugagcaaagugugauugagcuccuauugugugcagauuauauuguuggagcacaggacaaagaaagcuaaauuaucaucuuuguuuagaaauuuaagauauuugggagcagcaagguagaugccuaugccuaguuuauuuaacaaggcacugaacuuugcuggagaauccuauauucuagaauauaguccuuaucuggaagugacuacagaaccugauucuggaucacagagagcugcagaucuggugugauuaagacaguggccacagauacuccacugagcuucugucuugcagcuucugucugucucuucccugaaaaucacagggaccacagauacuccacugagcuucugucuagcagcuucugucugucucuucccugaaaaucucagggaccguguggaguuuugcuuggucaacuggagaaacaacuuuugauuguuuuuauguuuuucagagauuuauuugccagagauauuacauuauaauaaaaacauaaacacagaaguuagggauuggaacaaagguuauauggucacaauuuaacucauaguuauuugaaaauuauugguuuauaaggaaacagauuuagacaaagcuagaacuuaugcagguaaguuacaaagcuagaacuuacucaggcaguugcucacgucuguaauucuagcacuuugggaggccggggcgggcggaucacgaggucaggaguucaagaccauccuggccaacauggugaaacccugucucuacuaaaaauacaaaaauuagccaggcgugguaguggugcaugcugguaaucccagccacucaggaggcugaggcaagagaauugcuugaaccugggaggcagagguggcagugagccaagaucacaccacugcacuccagccuggugacagagcgagacuccgucucaaaaaaaaagaaaauguaguggacacaauacauuuagauuuuuaauaaaguagacauauguuuauugcagaacauaugagcaguugauuaguuaaagauauccaacaugccaggcgugguggcuaacacuuguaaucccagcacuuugggaggccgaggcaggcggaucacgaggucaagagaucgagaccauccuggccaacguagcgaaaccccaucucuacuaaaaauacaaaaacuaucugggcaugguggcacacaccuguacuccuagcuacucaggagcugaggcaggauaauugcuugaacccgggagguagagguugcagugagccgagaucgugccacugcacuccagccuggcaacagagugagacuacaucucaaaaaaaaaaaaaaaaaaaaaaauccaacauugcuggcaaguuugaaggucacagcccauguacaaaauugguauaucuugaggaacucuugucuuuaucauauguucuguaccauuuccuugcacacaacacaguuacuauaugaugguacuaaguagauacagguccagaccccauaaagaauguggcauucaguucuugaacagauguuagagaacacaacccacucggcaguaagggauaucuucaacuagagggaagggugagaguugaccuguuuguccuuuugacucauauuuagaaaugcuaaaguuguuuuauguucaaaaugcauuugauaaucaugccugaagaggucaaagugcugacauuguugaaaacaaauaccccugucaaacaaauagagacaauuuucaugucuuugguugguaagcaccauaauuuggccuuuggcauugcugucaguaaagcuaguugaugacuuuuacaucaauuuuuggcccaaccauaaaugaaggaaauaagaccaauacugccacaguacuuuuucucacucaucacccauaccugauucagcuggguuaauguuaaaagccaaaauuuaucaauaucaauuuuuuucccaaaucauucuuauuuuaguacuguuuaugcucaauaaaaguuuaugaauuucuuucacuguuauuuaaugaaaacccagaauuuuuuaaaauugcacauuaucucuuuaaaaaaagucuuuuagauuacucgugggauuuacucuaaguuguugucuuuuaauagaagaugaugcaaaacuugucucaccuguuccuuccuggucgugucuguguuuaugugugggguggguauauaagugcuuuugauuaacagaaugaagagagugcuuauuuugaaaacucagucguuaaaauucaaguuuauuuugaguuaaagaacaccauauuuagauuaggaauggaccaaugaccugcuuaagcuuuaggcuaucgauuggccuugagggaacuuagaucugcuaaacacgaacuugaaaaggcacuucagugauggauguacguuggaugcucucacuguauggucauucacuugcauuuuaaaauuuauguuuuguuuuuccuuuauaccuacucuuuucauuccguuugucagagguggccauuuaaaguauuugacaauuguuuguucucugccuagcaaguuguccuauugcuccaugaugugaaagaacaaagguaaucaacaguuagaaaccucaggaaauugcuagaaucuucacccccaaagaggguuaauaaacccuagauaauuaguucauuuagaaugaaaaccauuuucauuguaauaaucacauuuccccucugauuaucgagcaaugcauugggaagccugauauuuauucacaaauuuuuuaaaauugagaacauccugugcugagauuccagucagcuucauccauccauuuuuuguuaaaaguuucucaacuaucauccuucauccagacaaauaaacauaaccaggauuuccccucuaacuuuuugggaauucauuuacacguguaccauuuugagggaaaaaaacaauuguccucgaauuucauuugacucaggugauugugguaagcucgcuaaccagcuucaucuaggaagugcagcaaucugagucaacuuccuccaucucuguuuuuacauuguccagugugaugcuuccucauuguaccaaaauagaaaugguuuguuuuuguaucaaacuuggagacuggcuauggauuacacuggguuaggauaaggguuuguuauuuuuuuuuuuuuaagaacauuccacuuaucccaagggaaaaagauugacggccuggggaaaaauaagaggcauaaugaagucuuuucuccuuaaauaaaaaucacaucuagucuucagaugugucaauugcacuauguuugccuaauuucauuuaauauuugagagauuuaguaguaaauuuaugacuuuugcaguuacuuugcaaaaaauugaggaaggaagaagugaauuucacuuugagucaaauguguagguuccaguguaauuaaaccuaaaaaucuauauauucuggucuugcuacuugguauuacacuuugccauaucacauaaugcuauuagcuacauuuuaccuuguuugcagggugaugccauuuuguaucucugguuuguugaauuuccuagaagauguuauguucauguagauaauggcauacucauugaauucuuuaccucagacaugaaaauauguggaaaaguggggaaaugaaucugaucagauuucacuguauacugaaauuugagaaucugguuuuugcaucuauuuugcaugcugcugucucuccaaaccauauaugucugugugaguuuuuauaaugccacauaaagcaaaaugagaagucucuucuuucuucuaaagggaaauagugccacagaaagguagaagucaaauauuuacuuauggaucaaaaaucuaguuaaaaaacaacccauugcuuaccuuaguaaucaaugugaauuacuuuauaaucaauaugaauacaagcuaucugaccagucacucagaaaauaaauauuugaucaugugauaaaccauuugaaugucuacauaugaacccaggccauauaaaaauaaccaauucaagauaacauaggaagucacuaaaaaagacacaaauaaaauuagauuucacaguuuacgcugauauuuugauacuuuucugugauaaaagcaucuuccaaacuaaauguguccauauuugaaccauguaaauaguuaaaaguauuuuaccugagaauaucuaaaugaugccaagaaaauaaguucaugccacuaaaaagauugagaugauuugugcuuuaucugacuucuugguguaauauggauuuacuucagauaaguauauuuucuacuuauccgauaaguguguuuaucugagauaaauauuuucuccagauacguguguauauugaaaaaaaauuuaaaauaauuaggaucccaauugaaaaaguaaaaaucuuaauugcuuaauaagaaaacaguuauuucauagucuuaagauuucaauacaaagaaauaugggaauauacacguaagagguuuguugguguucauuauuaaauugcaaggcugucucaaguuauugucaucagaauaaauucugugugugugugucugucugucugcguccuccuguuaguaauuagaucuuuuaugaaguuguacucauaccuauuagggauuuuugucauugcaguuuuaaguugaauaugacacauggauccuuuguugggucuaagcuaucaccauuuauuacaauuuuuuauaacauuccauauauaugcaucuacuaacuaaacaucagccuuaauuuagcuuaugaauuaaauuuuuuguuaggagugacuccugcuggagagcaaaaaauaccaauuaguuuagcuucuaaauaaacuauacuccuuuuuucaauggacaaggguaaccuccuauuccuuggcuuggcaacauuuacuauuccucuaaguuuaaagaugagaacauagauuugaguacuaacacaucagcagaaauuauauuuuuaaguacauacauaauucucaggccagucguguuuggugcuccaaaaagauuugugauugaauaucuuugcuccauugggaagaguuuagcauggugcuguauuuuuauaauucuuuuuuccauuuuagcagacuucaccuaagucuauuuuagguggagauuuuuuuuuuuuuuuuuuuuuuuuuuuuuugcugcugcucuuuaaggcacucuugcauagaggaaacagcagaggagacacaaggaaaugcacucuccuuuauaacaugcugcugauucucugaacuagguguccucucauuuaagccucaaaagaagcuguguauuaacuagaugaaggaacuaacacucaaaccugugauacagcuuggccagagucacacugcuggggagcagcaagguuacucaucaagaugugucugacccucaaguuuaagugcucugauuuaauaacuuugcucacacccugauuccagugucuuaguagcuuuugaucuauaaaaugucaucuaaggaucuuugagccuuaauucuuugucuuuaaagugggaaugauaauaccugccacagaguacuaguuauggagauuaaauaagugaaggcaauuauuauauguucuuuaaauugugugucacuguacugugcauguauuaagugucguuuuauuagcaaauaucuuuuugauggguagauguuuaccugaggugguuauuuaauuuauaggcuggcuuguucacacuauguuauguaaucauuguauauuaaugaauaucacuauuuuccuuaggauaugauguuuagcuaauucagccaugcuaggcaaaagaggucagcauuguagaaauaagcaaugucuuauacugaaaaaaagaaagacaacaacaacaaaacaacaacaacaaaaaacaacuuuccguguucagugacuuaaacagaaacauggaguuguucaaauucuaccaaguuauauucgggaggagaaaaaugggaauuccuuccauaugaccauucuucauucauucauuuauucagcuucuauuuguugaguugccugccuuacacugcaauaugcagggcaguuuguguguguguagauguucauuagguuuauuugcacuuugcaguaaccauguaauauuaucauuauucagaaauaaagguagaaucuacucuaaugagcucuguggucgaguggauaguucagcucuuuacccuguaauaguuuguuaucuaauuguuuaauguaugugcgauugccuucacaauuaaagcauuauucuuuagucauauuuucucucuuuucucaauuuucucaggaagaaaauugacaugucugugaacccugugcauguccccaaauggagcuuaacccaaaguugggaaucacuaaauaauuguucaugaaaugguugaauauagcucuucauucaagugauguagauucugaauauuuacuuauucuuuaaugcaguuauucauucauucggcaaguuuuuauugaacaucuaccuuguagguaauacuaugccaaugcauuggggguuuuaggucaaauauuucccaguuucuuauaacaaauguauguguguguugucaguucugcuucaccucaaauauaucugucaaagacuuuuuggaaaauuacaaaagaacuguaaacuuuagauucuagaagaaaauaagaaucguguggguuucauuuaaguggucaacacuucuagacaguuugcugguaagaauuuuuuuccccaaaaguggcagaaaaagacaacuggguucauugccuacccccaguguccucaauagugcuuugucuaagcaccagagagggaugguggcuuucuguauaguguggcuaaccaucauuccccaucauuucagcgauaacaaggcugggcauggggggugggggugguaccaaguagguaaccaaguuaccuacugcuggcaagguaacuuguccaguuauacacuacugugaaaacugugucugugaaacaagcaguagacuaguucaggguccuguaaaaauuggcugcuuaagauuaagacuucuuuaaaauuauucugaaacacauggauuuaugcauauagcuucaguuguucuuauacuucuguucuaacuccccacgcaucacacuaaaaauuuaucauggaugauauuucugucacaaagaaaacuucaaaggcugagaucgcagaaaugucucaguugacaagccacugacuugaguucugugauugaaauguacuccaaggucagcaaaccaaaaccaaacaucacuggaugauaauacguucagugucucacuggcuauaauucguagaucaccuuucaaagcauuauaucuuuauuaaucauuguaaauuugugcuuuugaaaucuuagacucguuuccauuaggcaaugaagcccagaagcuuaauguucuagucucauuuuaauuuuuucagucuuaugugcugaauugucaggguuuaaaaaucgauuucaccucaucagauuaaaaauauuuauuuaugcacauguuaacaauauauuaaaagaaaugagagcuucaauuuuaaaaauaggaauuguagcucauuaagccaugacaauuugguuuauauuuacauaauuaauaggaaggcauuuauauguuugcaaaauagguaagaaaagguauuuaacguagaugaagcagaaugauuguuuaucaaaagaguuuagagaucuuucuagcagucuacccauggaaaguuaggaucuagaaaagccuucucaauaagggaagaaacaacaaagaaacaacaaccaggaaacuccccaacuuaucucuuuaaauuccagccucuuuucuaaguggugguuuuuacauacuguccucugguagguggguacccuggccuuguguauuaagcagugagggugguuuaaagguuacaaaugugauccugucagauugacaacuaacuguucuaaugaggaaaaaauccucaaagcaugaaauuugaaugaaaugugugauuauaauucaaguacuguuuacacaaaccucuggggaccuuccgaauaaaugcagagcaagugaguuagacaaaccucugggccuucgauacguguguguggaugugcgguguguguguguuuauuuuagagaguggggaaacuuuccaccauuagcccgggcuuugcuccucggaaccaacaccacuauuccuccuuguuuauuaauacuguauguguuuuguuagcauauugaguuguaaggaaauaggugcuuugaauuauuaaaguugauucuugagaauagauguaugcucggguggcauuugcuucggcauaugcaaaugauuuaguuucauuugggaucaauucccagaggcccuccuuuccugugaugcucugaauuuggcaagcucaagucagcccaucuccucuccccacaucccucccuuucuuucuuuccuuuuuuuguaccuccccccgccuuuuuguugauugguauaauauuuuuaaaagacaauaaauaaauauaucaacuugcuugugagaaaccuugccaucuauaaggauucuauuguucaguugugaucaauaaaggugaacaaagguuuucacguucuuaaaguuuagcaaaaucgaaguuuaguaaaaaugugcaugagauguuugcuaaaauauuuauacagauacugggcugcggggaugcugcaaaacucugaaaauguggucucaggggugccuuuggggaaacugacagcuguaagauauucgucgguucgaagguaccaauaaacuugcuuuagagcccagcaaauagcgugaaguugcaguagauugucuaaagcuacagugaaagcacccaacuccagaguggagaacgugcgcccuuggggcgcccagcgccagcgaggggagcagcgccccagccccuccguaggcucugggcccaugcggcugucugcggcggggcgaggugaaguucaugggcggccgcgcuucccaccagcuccggggaggccggggcccgcggagcccggggcgggccgcacugcuacucuguuucauuccgcaaccccguuuuguagguuguugaccaagcagucagaaaacacugcccccucucuccuuuugagcgaggucagagacgugguguuuuuuuuuuuuuuuuuuuuuuuuucuucccuccccuuucccuccccuuucuccgagucgaguucucaggcagcugcguacaaugcugggagcuagccagcagcagagacagauggcagaguuauuagaugugcaucauacgauucccuuccugccacucgcuuuuuaaucaaauuaaaacaaaaaagaaagagagggagagagagagagggggagucaauuaacugcauuuguauucugcucaauaauggacccuguuccacuuuuacccuaaggcaguugaguggaaauuuuagagaagaaaagggugccuagaacaaaacaaaacaaaaaaaaaaaaaaaaaggaaaaaaaaaaagaaaagaaaaagaaaaaagugaagacugcagaaauuuguaagaaucggcauuauucgaggaacuaauaaaaaccccucggaaaaguugaaucgaucucgcguaugcauuaggauuucgagcuccaucagggccgggcugccuuccagcuccgcugcgcaaaguugagcgucugacagcagcgccgcggccucccccgcccgccaggaauggucucuuccugcuuugcauauucaccacgcuuggcccggccauaugggaaaaugcaacugaaggaauuguugugaaaaaagggacagcgaguuugaaauaaaaguuguuagagugguacugaggagaaaaaagaauccgagaccauguacugcgcauacacaaucccgggcaugggcggcaacucuuugauguacuacuauaaugggaaagcgguaagcgaaugcgggcugcgagggggauuuuugacaaguuuuauugucgcagggaugagcauccuagguggugaucauuguuugcaaaguugugcaggacugccgcaccuuccugggugccaugaaauauuuaucauuugccaauccuaagaucuucuucuugccuacuucuucuccuucgucuuuuuuuccccccacuccucccccagaguagaaaaauagaugcuuucagagcuuuagagaguggauccuagagcgaaaguuugcagucagguaaaguugagaggugguaugauuuuuuuuuuuuaaagaguuuuggaaaauucuuauuccuuccaaaugacuguuagaaaggaaaagcagauaugagaagcagaauugagaaagcccaaguuaggcugagaggaaauuugggguaaguuucucccuggauugagguuuugugauaucuaaagucuuacuaaguuggaagcuugagugcaguggauagaguggagagaaccugaaagguuaaaauagagcaaacacauaaaacugagagaucaaauuaaggaguagauuauauaagcuuagauauauauuuaaagccaaaauggggaaggaaaaacaaacggguucauucaugcauauaacaguauugucauaaguuauuugugcuguguggcuucuucccucaauuucccccccuuccaacagaaacgcuuuauuuaagaaaaaaaugugucugguauuuugugcauaaccccagcagaagguuuauacuugccaucuggagguuuauuuuuuuuuuccuucgucugggcccacugaaggaaaaggauuucaauauuuucaaaucgguauguggggcucucgggaagaguuguugggugauagaggagcaaaaauuuauuguuuuaaaauagaaaagaagaaugagagaaaagugaaaagcagccauuuauaaacuguucucuuuguguacuuugaacuuccauuuggauugaucuuaaucagggauaguugggccaaaggggacagaucagagcuuucaggaaggcccaguucagcuguagcaauuggcgcaaacgaauuaaacauguguaugugcugcuauaugccugugaguguauauacauacagaugcaugcauaacgguuauuucuagaugagcauauucuguaauacauacauauacacaacuguuugaaggugcaguuucagaagauuaauaauuucauuuaagaagccaguuuuaugaaugggcaacuugaaauaauaucguuuacuuuuauuuugaaaaguacgaguaaaucaucaaaaguucauagcgcuauccuauuuuuaucuuuuuuaaaaaagagcacgguguaauuaaaauaguuaagugugguaagggaaauauaauuuuaaaacaaaugguuuucguugugauuugaucaaaguguuuaaaucuguaaacauaaauauugggauuauguaacaucuuuuuuuuuuuuuaacaaguacaugauuugcaauugguaguuacucauauauagauaagacuuuugccuauuaucuuuuagauguucucauacauaacuuauucagcaccuuucauuuuaaagcacuuuuaaugaaaauuuugugaaugaugccaucguagucaguaagcaaaagugucucugaagcagauucagggauuagauagcccuuauccguaaugaaagacuuacauuauaaaagaauauaaguuuccaugguuuuuaucuuucaggauuaccaaugaugugacuuuuacauguuaauuguuaauuuugcaucuuaaauaucugaacugacaaaauuuuaauuuaaguuuuguaccuuuuaacucccuuuuggccaaaaggaauuuucaaaaauauguauuccauucccacagcuugccaguugccuccaccguaagaaaaugcugaauaugacaucauaucacuaauaugcccucucaguugccaaauauuuugguuguuagauuuuuuuuuuuuuugagaggaugguacucauaaaaucaagaucgcucugucacaggaaauguauuuauaggaacuguuuuaaggcguuuauuaaaaacaaaucuggugauguguaucucuauugauucaaacacuagaaagaggcaaauuguacacacauuauaguuagaaaaaaaauagccauuuggaacaccagcagaaagcuuuugaaacugcggauggcuaccaguuguccaucuuagcuuuaugaaacagacagcaaaguccaguugugugugucccaaggaaggggccaauucuauaccauuuuuuaaaaugcccucaugcauacacugaggaagcagauuuuuguuuauucuacaguguguauucugcuggcucuaauucugcauugaguggcuuuugauuuggugccagacauguuguggagauuguauauaccaugcguuaauuguucaaaaugccuaucgaagagacuuuacauuucuugaguuuuacuuaucguuuggagguugaauaucuaugcuuuuuuguguguaugugcaugucuaaccaauguguguuugaaccugaauuguugaaguuaaguguggucagcuauuuguugcacaaguuuuccucugaagagaacacagcacugaauuccuucuuuuuucccagugacaagucaauuacuuguuuaaauucaguuugaacucccugaacugagagaggccagaggaagcagguuuucccugugaauaaacaaaagaagaaaaauggaaaaucauuccaaaacacagugauuuuagcuugugggaagaauauaauuaagcauuacaagaauuaugguuucuucuuuuaugaacuggcaacuauaggguuuguaaaaucaguuguccucuaacuuucuagcagaaauauaaucaaugauauuuuaggacaaacgaaaaaaacgugaauuuuuuuacuaccuuaaguuaugaaguguuuccauguccauaucccacaaaaaaauuuuuccuuguuucugugaacaacuguaccuguccagaaguguggacucugaaaaaaauacuuaacaaaaaaucguaacacaagagcuaucaaagaauaaauuuuggauauaaaccagaauguauuuuuaaaaaucaguuucuccucaggugagaguuucaugaacuugauaaaauaauuuuugugauuuuuuuuuccucuaugcauuagagguuuaaauacuaacggauccaaaucuaagcuuaaaaaaaauuaaagcaccacuucugaacuacgaaacagauuuuuuuuugcagagaaaaucaguagcuuauuuuguguuggaaauacaagcuuguaucaaagugugccaaugugucuguccuuauuaaggcuauaagaaguauuaggcauuaccugcucuccaauaaguguaguucuagcucuaaauuuugaucuuuauggcuucuugcauguucauugaagaagaauuuuaauaagugauuauuuggucaaauuucacauaucuaauauuauagcauauccacgaagauaaaauuauggcaaauaaaacugaaaacaaaaguggcgaaauguccucguaaugguaauugaagaucacaucaucagcucucgccagcaugugcauguguuaaaccguagagagaaaccuguaauuauuguaauugcucuuuuugcuuuauacuaacaagcuucaaaccauguuucaaaguaguuguuuugaaauaguuauuugucaaaucaucaaaucucggaaaguaaaugguaaugagcuuuuuauguuuauauucugacuguuggucauauuaugcagcuuuucaaguccauaaaguucagagaugaaacuggauguuaauuauuucugauaucaaggccaaagaauaaaauaauguuacgaguccugcuuaaggugaaaaauuaggaauauuugaauaucagaaucucucaauugggaaacucucuauucuuagaagaaaguuuuccuguaaauaagugacaauaucagucagcaaccuaaauuuuuuaaagcugaaaauugggguaugaagaguguagcuuuuucucauuuaucacaggaagugcuaagauaaaaagaucaauauuuaaaugacgccacuaauaacauuuuucaguacauuuuacauauggcucuuuuuuuuccccccaaaccucacaguugguuggaacagccacacauaggacauagguagccacuggguuuuaaaguuuccaguagagugucaacuaugcaaauuacauuuggcauuuuaaaaauauauuucuuauacuuacuauuuucagaaccaugauuauaaaugaaagcagccaguauaaaugcuuuuauuuuuuuuaauugcuguuuacuugcuauuacacagcaaaaauuugcuuaggccacaaaguaaucaaauuuuuaaauuccccacugguucaauaaaauaaaacauaucaaagagaaagcauguaggaaaaacugcuuuuuugugagcuuauuuuuuaaauauaguuggcacuuuaauuuacccauuuaaaaauaacaaugaaauuuuuuuuuaugcuucauuacuuuaaaacaaaauuauguugauuuuguucuuuauguuuaagcugauaaaaauucaccagacacuuaaucuugacauuguggcuacaucuugccuuccugccucugauuaaauuuucaaaaucccugcaugagauucacagauaccaguuugaacguuucugugaggcuaauuucucagggaaaaaauauggaucaguuacaucuuugguuaauuuuaucuaguuccuaauuucugcuaggucuaagcauuuuaaauauaguguugguaaagcauccuucugucgcugggugauggcauuauugcaggcagaauuaggagaaaggacauuggcauaggagaaagaggguuggggagaaaaguggucaggaaaaaagaucuaauaguugaugcagucuuuuaaauaccuuuccaacugaucuacaggaaauugugcugaagaaucauuuguuuccuguuccacuauaaaugugguuugcauuacauccccuguucggcuuuuuuuguuguuguuuuguuucuacuaaauuguaguaccacgauggaggcuugagaauaagugaugucuuccuuuauaacuuaucuuuuaauggcuugaucauaguuggauuuuagacacugucauauuucauuauaugaauuuuguauguguguguuuccaagccuacuugaaacuucuauuacugcucugccacuaagaaaaacaaugcugcagucuaaguucuuuagaaucacuauuguaggucaaauacauggucuacaugcugccaucagggaucuauuaaaugaaucucuuguuuacucauucagaaaauuuagagauuuuagaugugguucuggcaauuguaaaaguuguuagaauucagauuuacuuuugccuuaagaagaaaauacaguggagacauauauuugcucugcacagcugaccuaaaugcaugccuuguaccugugagaauuucaguaugcggacacauaaaagauuacugggccuuuuuucccccuccaauauuaucagaguuacaaaauaaauaaucuuucacagucaacauaguuuaaaaguaauuuuaguuuuaagcuuuuucaaguuuuuauauguuuaauugcacuuuauuagcccuuaauacuucaaacauaacucuaagaugacacaggcuaaaguuguauaugauaaacauuauugauuacuuaaaaaaaagggauaucuguauauucauaaaacauuuauaaucuauuuaggaaaucaucauaguccuaaaaaaaaagcaguuguuuguauaccaggaaaaagagaucaguagugacaaaaguggaaaagauacuuguauaaaauugucuccuuuagugugaagugaucuacugaaaguuauacuuggaauuuucagaaaauguccauaguuguaggcuuuauaacauuucaaauucuguaauaaacuauuuggcacauuaucauaucauuuuagguauauagauaccauggcauuuuauuaagcaaaacaauuuuuuucuucugaagaauacuuaaggugaaauuuacugguuuugagcuugaaagugguuugagaauuauacaugaacuccacuuaaacuuuggagacuuuccuuuuugcagugcuaaagauccaugacuugguuccaaacuacaaccuuuuauuugcagauguauuuauggcacaguaccacauucugauuagaauuuaagaguucacauuucugauauuucugucucuaaaugcuguguugcuucuguuuaccuaguuuucuuccuauucuuccuaauuucuuaaagaaaucugcacauauucauugagguauuuaauccaaaaagauuuaaaagagacacuacgccucuaacauucuguuuaggagaguauacuacuuuaaacuccguucuccccaccuaaaaaaggggggcuaaagaguggguuugaacaccugagaagucagaggugggaacaguguagaugauggucuaauuucaggcucaaccaaaaaaaaugcaggcuuuggcuggcauccuccagggaccuagcucugugcuuuccuagagaccaaauuacacucaucuugagagagggcauguugagguaauuggugggagagaguggggagaguugaauuccagcugcuuccauuguagcuguccugaaaaugaauaggggauguuaacaauggaggcuaacauuugacuuggcuuuuucaccuccacaaaccuaagggugagaauuauagaguacugaaugacugcaccaauaaugauccuguuuaagugggaauugcuauguugggaaaaacucacaccauuuuaaaaauaguugaugcauuuaccaaccacaguccuauuacuguagcccaauaaaguuuauccacaguauggaaacacuccuuuuuuuuauugucagccaucuaguguguguauuggaucuucaccucuuugguuaccauuuuaaaaugcuccuacugaaagacauuuggaaggcaccagaaucccaucuccaagaagggaagcaagauacaagugcccuguacucccuuucuccuagaauguguggucuuuuuuuuuuuuuaaggagaauaaauacuguaugacucaauagcuuuucuaacgaauaaaacaaauuaaauugauguuacaugcguauuuaaacccuauccaguuaaguacugaugugauuaaaauaaucaaauguauuacuuaaaaaauuaaaaaggauaaauucugcaccccauuauuuuauugacuuuuaaauauaaauugcagaaauguuuacauuccuaauggcauuauuaagcuaaacugacaaaucagaggaaaaaguugauuggccagcacauuauuauuucugcaccuguuauuacagaaguggaggcucagcauuaaaggagcuggauggaugcuguuuucuuaggcuuccuuugugugauguggggguugggauaaauguguaacaaguguaguuucacuuuguagugccuuuuuguguguugaugugauuaaaagacuacaguguuuuucaugucgcuuugaaauuaauaugcaaauaauaugggauauuagggcuucccucuaccugcugcacuaagcuucccuaagccaaaugggguggggauuggugucaacuuuuuucauacaaguuguuuaguugcaaauaucgccaacguuuuaucucuacucugugaauuuguaagggggggagggaaaugucaaacucauugaaguaggauugaagaucugggaugaaaauacuuuaaauuuuuauuuucuacuuauauaucagccaggauguuaggagaccuugaaaacauuuugaaaaaguuguguaacauuaccaaggcuuugguauaagauuauacuuuucuucugguugaguucuuccuuguauuaaucaugcaauaucauuucucagacacuugagcccggcucuccccuggagcauagguggcaauaauuguuuguuauuauaauucuagaauuucuuggguguucauuguccguaauucauuucacacagagaaaucuaaacuuucuucagccaguagaauaaauaaugccuucccuguccuuuccuuuucuuuuuuaaauuuugaguucuuuaggaaugucauuauagucuuugaaacguaaugacauuaaauuuggauugaaggggaagggagaggaacuuuuauuucaugccauccaguggcuaguuugaguuugcaaagaaauagauacaaugccauuauuuucugcaagauacuaguuaacacuauucucauaucaguuuagacuuuguccuguguaauaauuuaaauuccuagauuuuaauaacacuuaauauguagcauggaucccacuuaaucuccccccggcuucacaacaaaauguuuacauaaaugaacucucaauuuugauaucaacuauuuaacucacucuuuccugaguuaauacuuccauaauuaaacauguuccacaguugccauaggaguguaucuuaaaaaugauguucuucucuguucuuuugagccaucuguuugcuaggucaguaaagaaaugggagccugauuuuauuuuaaagccaauaaguuauuacucuacuauuguauuagacauucagcuucagagggaguaaaagauaaaauuccaucacauuuccacuuucuuacauuugcagcagaaacuuguaugcucaaauugguuauuuucaacucaugacagcugugauauuuaaaaugaucacagcuguugugacuuaaaauugauuuuucuauuaacaccugagaaaaagaccugugccguauuaaaaacuuaaauaagguaacuguaaaauuagauguguugaugugaaucugguaauccuacuucccagagguugcaaagugcagcacaccucuugcaugcuuccagggaaugagcuaaaacugcuagaaauagaugcaugauuguuaaaagcguuuacauuuuaaaggauuccuguaauagcagauccucuuggcccaacuuuacagugucacuuuugcugauaaaaucauuuaggauucaguuuccuuaauuaaccccaagaaagaugacuuacaugaaucauuaugauauccuaaccucuagacuagagaagcugcuuuaccuuucagauaugacauugaaaaaugcaaaaccauacggaauuguuucuuaugaaggaaguuuugguuuuauggugcuuuuccuccauuaucuuuagaugacgaaaaaggaaaaacagaugagaaaggacaaauagaucauggcuaaguagcuuuaggcuagcacuuguuuuuggaaucuuuaauacauuuuuaaucuucauguugaagauccauuuaaccuguuuuaaaguuagauggugauuccuggguucaguuggucuguuuaaauguuuaccuuuucaggauaauccguauuagaaucuugcaucucucaauagauuaccuauuuaacaaaguaaccaauuuaagaaaaccuaaacacauuuauacauuaagauauuuuccuguuucgaguuagaugauguaguauauaaaauauauggcuggccugauguggaauuauguauagacaacagugucuucacagaugcauugccaauagggagcuauguagauuaaacucuuuggccaguccuaggcuuuuuaccuguguaacucaaucagaauugaaagcaugacagguuuuaugaugaugaauguauggcuggauuggagaaaguaugguuggguggguagauagauggauagauuucauaacuagacaguaauagauaaugccaauuauuuauuacucaaacuuguuuauuccucagaaauuuuucugcagaguauuauuuugauuauugcauguaguucagaacauuuaguugaaaaugauaaaauauuugcugucacauaaucaagacugcuauagaguugguucuaaaaguuccagagugaacauacauuaccugugucaaaguuagaggcuaagacuauggagggccauaagaucacaaagucagacuaucacauacuaagugaucaugggugucaauggcuauuuccuuguuuaguugaaagaagauacuccucgagauggacauuguuuauaugaagauuuaagaaaaucaaaguggauauuuguugcugacagacuaagauuacaaacauauaucuuuagaacaggguguuccccaggggacauacggcaauaucuggaaacgcuuuugauugucacaacugugggggucaggcaggagcuugcuacuggcaucuagggcuggaggccagggaugcuacuaaacaucuuaacagcgugcaagacagacccucagaagugcugagguugggaaguccugcuugcaaagugauauaucuggaccuuaagaauuaaauaaugucauaauaaguuccauaauuaaaucuuggcauugugaggcauuuauagaggauaacauuuuuuuguuuuuuuucuuucccuuucuauuucccuuuuccuuuucuuuucuuuccuuuuuucuuuuguuuccaaaacauuguuuuuuguuuguuuguuuuggcauagcacacuauagcauugcccagguauuucuacguuuuaccaugaaaacgugagauuuuauaguguauuaaauauuguacauuauuugugaaccaacuggaauggcuucaaagcagcuguuagaauauguugagucaguaacacaacaugucugcauacccuaaacauauauuugucuuaccuuuuaaaauguuuagaacccucuaucaguguaacuauugguuugucuugaaucauccuaaaugaggaaguguauuaccauuuuuucccuacaggacauaaaguggaaagaagaaauuagcauaaagaaacuaauuaauaauuauguuuuaaguuuuuuggcauuacggacauuguuuacaucaucauuaacaucauaacaucauaucgucuguuaucaagaaaagauuaaaauuuaaagccaacauugaagauguucuuuccagcuuucccaauaaugcaacuccuuuaccuccucacaacuggggaccucucucccugccacugcugcgcuucuccucaauguggauaauucuuggccaugauacggaagugauuuugaaaccucaguugccuucuguagcacccuguggaggaagguggcaggaucugguggcugagucuuacaucugccaacuucuagaccucacuccuuaggugccacauuuuggagcuaguugccaagccucacaguaacuugagccacucuucaauuuccuccccaugauauacaaaguucuccaagguuuaaugagaguagauauggaggcugggcacgggaauggcagcucugauuugcaguauaucuuugguguacagauaugcuuucauuuauugcuuagcccauuagcuaauggaauuucaauuccuucccacaggcauucucagacccugcacuucacucuuccuguuucccuguccagcuugguacaacacauucuaguaaaaucacacugauguguuuagguuuacuuuguacaucacaucuguaaccaucuauaaguuugcccuaaacuggcauuuauuuugaacugucuuccaccuuuuauuguacagcguugucuguacucaaagugagcaacugaaaagaaaauuuuaacauucuuuuugugugccagacaaguaauaaagauuacuauuuuuaugguaauuuuuuuauuugaauauuucuguuucuggaagaugguaauuuuuuuaaaucaugaauuuccuguaagugaaacuauuugagggaguauugaccuuuuuuugaucaaucauugauuaucuguguugcacucucaguauuucucuuauaguccauaugucccucugaauaauuguagaacaauaacuugcuuacacaguguuuuuagaauaugcuucaggaagcuugccugugugguauuuaacucagacauuuauggaguauaaaaccaaucuuacugugacuuuuaauuauuaggaaaguggcuuacaguuaaaauaaagcuuacagaaaauauuguagcaauaauuaauauccaguaaaauacaguuguaagcuucgguucuuucagacauuuucucaacccaguucuaauuugaucguuacugcaccucaguaagauaggugaugcaggagucaucaucccauuucacaggcaaagccuggccuguucagugagguagccacuggccccauguggcuauuaacauucaaaugaaggccaggcacaguggcuuaugccuguaaucccagcacuuugggaagcugaagcgggaggauugccuaagcccaggaguucaagaucaacaugaucaacauugggacacccugucucuagaaaaaguuaaaaaaaaaaaaaaaauuagccaggcaugguagcgcucaucuauagucccagcuacuuaggagauugaggcaggaggaucauugagcccaggaagcugaggcugcagcaagcugugaucaugccacugugcuccagccugggcagcagagcaagacccugucucuaaaauuaaaaauaaugauaauaauaauaauaauaaauaaaugaugucagucaaugagaauuaaauaaaacuuuaaaaagaucacuuccuugguugcacuagccaaguuucaauuacugaguuuucauauaugaucaguggcuacuguauuagcacagauacagaauauuuguaucauuguagaaaguuccauggggaggugcuggccugggaaauggaagcauugagggauuaaaacuugcugaagaucaugugggucaugacagaauagagucauugcugcuauauauuccaauaggauauuuuuacauuuuucuuagcuuuauugucaaauaucugauguaagaauugacauuuuaaugcuaccuuguagcacuuuacugaaugcuuaucucaacugaauuuaaauuuagagcuugaguuacacaaacuuuucaaaggauacagcccuuugccugucugcacacaauggggaccuugaauuuccagccagugauacccuccagaagggaccaugucuuaaugcaucuuuguagaccuuuuggcauauuguagacaaccaagaaauguuuaugcagccuaaugaaugugucacauccaccauacgggcauauguccauacauacaguuagacaagaccuuuggguagaaugcucccgagagagcuggugucugccaaauuuuacagagcucaugccucugcucuugcuguuuuaguaaaaaguaguauuuuaucaaaaguuaaauuggguucaauauucaccauuuggguaauggguacauuagaagcccaguccccagcagcaugcaauauuccauguaacaacaagcacguauaccccuuggaucuaaaauuuuuuaaaaauauguauuuacucacauaauccaaauauuuuucauaguaaaugaaaacgucuguccaucuuguccuuagcagucauuuagucccuaaccugacuuuguguuguuauaaaguugugucacuuaaguaguacuuaaguaaguacauaccuacauccauacuaucuuuccauuuccugcaucacugaguuggacaaaugugcccaguuagcguugguagugcugaagaccauguucauucauacaugcacucaaaaucauauuaauuacuuuucagugauaaccauagguggcaacagaugaaugggcuagcccuaggcuauuauuaagcacugggaaugagauuguuggugccuuguaccugugcuacuuuaacaggugagacaauuccagagcuuuccccaucauccucucguugcuacagucuagacauugggagcacuggaagccuauggugacacagacuggcagaugccuugggcuucuaaugguguauauguaagccaucauuuuguuuguaauaauuaugguguugagaagcauuugugugcugugcacucuuucagcuugugccacguuuaguuccuguuaugcaaauaccacuuuaaacuuagaaauuccaauuugcauuaauauuuugguuucauagagcuaacuauugcauuucacaaacaagugcauuuuaaugaguaccggcagaaugauuuaaaaauguuauuuauuaaauacuauuguagaaaaugcagucuuugguugccagaaacuauuaagacgaaauauaauguguguugaggccacagaguacaccucuucaagaguauuugacccuuauggcuuucagugauacaacagccaaugcucuucaugcaggcuuggagggcagagguaauuaauauaaaauagaagccagcguaccauugacguuuggguuuacuuuuaaaauguaaacauauuuuuacuauuugacauuugucauaagaccauaggucauuuaccucugaguuaaggugaaggacuuuaccagucauaaacacccaaguuuuaaagcaguguuuucuuauaucuuacaucuugauguuaaauccugaaauggaguuuguugcugcuuuauaauuuuuuucccucuuccuaaaagccuuuuuuuaaaucagaauuguggauaaaaaaauuuugauguacaaugugugggaaaauaaaaauuuugcaacuggauuuucagaaaugaacuauuuuaacacauggacuuugaaugcugcugucaugguugucauagcuugugguuccuaauuauaaugagcuuuuuuggugguguuauugcaguuguuuuauucccccugcccccacccagucuucaacucacuuuucccagaaggagaguuccaagccuuugaaaauucucaugauuuugcaaauccacucuauuuuugucuagaauacaggaaaguuaaaacuguggcugguaugaugccauguuuugaauccaauuuuaaagcaacccuuugcaacccagggaguaaagcugacaucuuuguaucuguaaugaagauaauuauaccugcaaggugacaucacuagcaaaguaacaaauacccuugaaaacggaguuccuggucuucucugaauucuguagaccacauuuggcauuuaacaccagacaccucuuucaugccugucguuugagaaguugcuuucagaugaauuuacuaaagcugacugacacaggguuaaauuaauucuuuucuuuauuacucaaagugauacagaccuuucuuggacuaauguagcuuaauuaguggucaauuaaaacugaacauugcugaauugaaguucuuugaucaaacucccuggcaugggcuugcuuucuuuaacuagccaccaucuugaauucauuuggaaucaguaguauaaacaaguuaaaaacugguucuuuuauaagaaagucagcaggcuuguauagcugugguuucuuuuuuuacuucuguaggcggcaauucaaaggcaugcuaaaugaaaacaguacuacacccugaaaaaauuacauuuuuaaaaguaacacuaagcagucagaaaacagucaacacccuuaccuguuuauucuagauacauuuaucuucuauguagaacaaauaauuaauaauucacuucccaauuucagugguugauuuuguuguuacauggaaggugaaaacuccccacccucccuugcaaagucuauaguuauaacaaaaagugaagcaaacaaaauccaaccugguuguugggaguagagucggaaggggcacgguaaaugaaggugugcccaguugcuccuaaauucauucuuugucacucuugggaaaauaguucaccucuguaucuuuggagugggagugacacacuacuucauuuacuuauugauuucaucauuuauuuugaagggcauuauccuaucaguauggaaacugauaauagcauauauuucauaugaaucacuugauuaaaaauacacauugcuuuuguuagaauuugggugaaguuacaaaaaaagagaauuaggggagcugaaaacuggggcagaggaaaucguaagcauugguaauaagaucacccaccuccauuuauccaguuacaugucuuaauauuuaaaguguauauaccauucuugucuaaacauaaauugauaccauuccguaauccuaguuuuugaaagcuuaacaaccaaaaacauacauccuagcuggcauucaguuagugcugugcauucuggaguauuaauugaaacugguacuuuuguacuggaaauaaaaguaauagauuagguuuaaauagauaauuugcuuaguucauagugauuucuucugguuuuuggaaauuuucacagagaaagaguuaaaggaaauuuggaagugaccauguacaguguucccccuguaagugacagaauuuuugugguuuucauuacuuagaucgaaaaauuguaguuauaaucaauaauuaaaauuaaaaauuuuaccaguugacagaaagagaaauuguuuauagucaaugugccuuucagccuucucucuugccuucucccuaaaaggcugauuaggauguaauaauuggggaugauagcgggaggaagacgacaauuccauuuaauuaaagauaauuuauuuuacuucaaauuggugaugucccacaugaauaagaguagcuuuagcagauagauuuauuaauggguacugacaucucaguugacagaaaaagcaaacauuuucuuuccucauuguuuuuauugugucccgucaccugaaacugcugucaccaugcuuccuuugcugcuugacagagcuguagacuuuuccaccaaauaugcaauuauugguuuaucauugaaacaaaguugauccucuucugaguuaaaaacuaggccaggagcuugaaaggcgguucaggcuuucagagcuaaugcuacaaaugcucucuucuuaaaucacauuuucucaacugauccuucccauaucuaguucaugaguagauugaaccuuuugaauaaggaccaaagauuuccuuuggucuugggugaggugcuugcaugaauauuccuuuaauaccuugaaugucuuggauaaugaaaugugccccaaaaaacuaccauuugcauuacuuagguucauuccugacaaggaauucugcccucgugugauauguucguuguugucucaugcaaucguaaauggaucuuggaaguugggacaguuuuuuuuaauuaggaaguagauucaagaaaugcaugauauuguuuuucauauaaucuccucagucuauagugguuguaaaggugugcuguuuagcauaccuuuagcaaaacuguauuuauaauucuauguaucuuaaggcacuuuuuaaaugcuucugacaaacugcauucuguuuuuccaaugucuauuugaucucuguuacauuaggcuuauuugucuuacucucacaucgaauuccuauauuuuuguuuauguuuucugguguucagucauuucuguaugcuugccuaguauguuucuuucauaccgucuucuucacugaaugaaaugcagaccaccuuggccacuuccuuccuucugggcuucuuuuccuauucacaacuuccgccauucacacugacccucuagcuuuacuuauaucuauugcuccugcugcuuuguugcucuaauuuucauauauauuuccuuuaugcuaauauccuuuccuuaacucuuuggauuucacugguuugucuuuccagcuuuauuuagaaaauuaggccauauaacuaauguuuacaccguagaaaggaaaaugagauucuuucuuucuuuuuuggaagugaagaggugagaagguugugguagagguuuucuuuuauuuuaaaccagauggauuuauuuuguccugcuuugcuauuucacuauuucaaauugauuuuaaaucagugaugguguuuucaaggauuaauuuuuauuaaaucuugauuuucaugucguguuaaccuuuuccuuccccucagccaaagggucuucuuccuuuuuucuguccauuucacuuguuuguuuuaauaaccugaucucuccagccauuauuuuauccucaaauccugccacuuuuauccaucuuuuuuuauugcacuguuguccuuacuucaccuuauaucuuuucuucuucuguaauuauuacagaauccaugauaccuucuccaaaauucuaacaaagaauucuggaaaaggagaaauugggaaagagaaaaauugcaaguaauguucuuugcugagcccuaggaagucugcuuggauuuuuauauucgacugauauuccucccuagaguugcagucaugauucuauguaguagggacacgaaggcaaaaguuuaaauagacuaacacugacccuuaauuggaggugauaauccuacauauaaacuuucaggagggaaagcgauccugcauuuuacaucagguaaacucaguugcacccauugccaguagcugggucagguguguagggguguguguguguguguguguguguguguguguguguguguguacguacugggagccagguuggaaguaggaagagaaggagguucuucuuuccucucccacuugcaagcuauuuucuuucuuuucugucuguuuucauuauuucuauggcaaguuuacuugccacgucuuaaacaccuucaaccuuuuugucucuuccuuuacuuuuuugcuuuacugcuaucaaagaguuaaggaaguccauuaaauuggaggccauuccucaccauaagagaaaucuggaugggaugcuuuugacaacugggcucucuuuaguagcuucucucuacuugggaaaaugucagauauuuugagaaauaaaugcauugccccaaacugaaaacaccacuuuuauucuguaaaagaggcauucagggaaggagaccuccucuauucccaggaggucacaggaacugggaguggcaagaaggaagcugcuaaacgggcuccagaugcagcuuuauccaggggacgccucaugccuggucauuuggguggcugggcuugucccaccuccccuucuucaugcccuccucccggucucauccuaggcccucccaccccuaggccagccacaggccucacagcggacaucugcgggucugaguuucauauauccagcaugaaguucccucucucccucccauuaugaauucugggcugugguccugcuugcuccuugugugucagauugaaguucugaugcugucagccaugucugaccaaucagcaaacaacaccacaggaugaaauuuaaacaaugcagaugcucagauacagggcuauguugccuggaccacgaagggaaagcagagguaaggucagagucuccccaaaguggucuauccugagccugccugacuugacaccucuugggcugcacugugcugcuuugacuuguauguuacccauuugcuuugcacuacuucugucuucccuggcauucaccagaacuuucauuuuaauucgcucugcccggguuacuuuaccaccuucaucugcucacguccuuuucuuuuggauuggugcugacugucauuacgaauguuccuggauugccucguggccgaggguccuuggcaagugccaccuuguucaggucuuuuguggccagacuuuuaggaauagaggacugcugaggaucagggcaaacggacggaguuaauaggccuuauuaauuuucccucugcaggacaguggaauuuaucauucgguuacaaccacgguuuuguuucuuaccauugugauguauugaauuguaaauugagcuuaaaucaucuuuuuuucucagaaacgguuuacuuagaaaagauauaaauagauacaaccuaaacgaggaugaaucagcucaucuuccaagaguuuuggagggggagaaagggaauugauaacucucccccacccgaauccccccccacuuuuuuuuuuuuuuuuuuuuuuuuacaguuuuugguguuagcucacuagauuacuguuugcaaaagaagaaucucaucaucauccucuucuguuuuaaguguuuacuuggcccuuuuauaauuuaaaguguuuacacgguucugugcucccuaggcccaucuggaaaauauuuaaacuucauaagaucuauaagacuagaauaucacauauaaugggauagggggaaggaagaaaaauuagagccguugcguguguuuagaauaaguuaguuguuuguucagaagcggcugcuggaggaauuggaacaaauagcugugugcggugaacgauuggguccagagcuguacauuucaccacagaaugagccuugguuugugaaacugacauucuguugugacuucuaaauccaaacaaaucucugcaaauuucugcccgaucgaguuaauaagaaaauauauacaugcagaggcgagagccguaugcuacuuguacuucugucaguguugguggaaauaagagacggauuuuaccuacuguauuacauucaaccagcaauuggcagaacccccagcucagcggguuuucuugacuuuuuuuucugcugugagaacaaugggaugcaaaagggcuucagaaaaggagagcagcagauacgggauuggggucacuuuucuucuaauugccuuguaauuggggagugguuuccacuuucccacuaucucacuggugggaggggaggaagacagauguggcuuagcgguaacgagcuuucuccaggccggaugugcugagggaccaggggggucauucccugcucugggccugugaucugcuucacaccugugcucauuuucccccaugaucgaugaccuuguauuaacccagagugaccuuuugccuucgccuguucucugggacgagcucuuggcuaguggacccuccuuucucucugauuuacaggugguuacuggagccacauacacuuguuuuucauggugcacugugcacuuagcagcccggcaagaccugcaauuucaucccucucaaggggccaagcaggggauuggaaggugggagggaggagggugccgcgagagugguugcuguuugcaugugcuuuucuauuuuguggcucauaugguaucaauuaccauuugauggcaacgccaggccugaggcccuucgcauguuuguccugugagaaagaucuggaagaaccgacauaugguuuugauugcagcaauugcagguugauagaaugaacgcaggggugagguggguggguuuuccuuccggcccuuuccacucuggguugcuaaugugcuucgcuuguggaacuggucuuuucaucauccagccccucccccacuuaccccucccccacccccaacucccugccacuuugcauucccugccccugccuuccaaaugaccgccaggaacauguggcccacauuaaggaccuucaauuaaaacaaacaaaaaauuguccacucuucuguucagucccagagcaggucaguccaucaagaugguuggaaguguaccacaguuaagaaacaaaugguuggcauagggggcagauucccuccagaagcuugggacauguuuuaaaauggcuguuaguucagauuguuaaacaucgaaaugaugcugaaaaauagcagcaauagagauuaaugugggguguguguguguguguguguguguguauaucuguauguguguguauuucauuuaagacaccucuuggaaucugugcaucugcugcauagggacaggaagaugaugauaauggauaggaguucuuugggguuccaucuuucuguacaucccaggccauaagaugauggaaaagcaagugaggcaugugugucucuaugagcauuucccuucagaaggaagauguuggagacucaucucccaugcacagugacuucucucuuacuaaauuugugaugguaggggguacuccucauuacuguggcucagcagggauugcaucugugaauaugccaagggagggucuacuauuggggaauggugagaggcaaagaggagaaaagaacauuauaggcacuuugaauguuacccagcaacauuuuuuuuguuguuucaaaguaacaucuuucuauaaugcuuucaaauuuaccugucugguaaucuguucuaagaugggcagcccaugagguuuugacuuuuuucacuuuggcuauugcauuucaaaauauuacucacaauuaggaauuuauaccauuugaaacaauaaugugguaucucaugaguaaaugcugccauuaacaucuuccuucuuuuaaacugaaaacaagcaaaccagacccaaaaaaaaaaaaaaaaaagcagaaacaugcucccccaagaaagcuuguuuuuuucuuugagauggagucucgcucuguugcccagguuggagugcaauggugcgaucucgacucacugcaaccuccaccucccagguucaagcgauucuccugucucagccucccaaguagcuaggauuacagguguccaccaccacaccuggcuaauuuuuuguauuuuuaguagagaugagguuucaccauguuggccaggcugguuucaaacuccugaccucaagugauccgcccaccucggccucccaaagugcugggauuauaggcgugagccaccacaccuggccaagaaaguuuuuuaaaugugagaugaauuuuuaguuuugaaggccagcuauugaaaccuaaucacacugcuugacauacuucuucauauuuaucuuuauauuagagcugaucuuuaucaaaagguaguagaaacuaaaaaacuuaaguuauugaccuaaauuguagggaaaugucugucugaucgacucuagagagaaaauuggccguaucuuuauaaugguuacugaauguauaucuucaugaggcuacaguuuuuuuuucuuugcuccaacuuucuccuuaugauguagagauugguguauuaaauaaucacuuuuucaacagucuugaugacaauuuuauuuugcuauuucauaaucuucauacaaugggauaaguguuuucagagauacguuugaauucagagcaacuggcaauuaagugauuugcucuagucacauguuuuaguaguagcuauuugguuauuugccugauauuuaaugcacacauauguacccuuaaaucaucauucagugugauagcuuaagacaacauuucuguuugcugcucaugccacuauuagcuacguuugaagagugauauacugagaaguuuaauuugcugggguuuuuuucuaaaaacauugcuuuccugaaauauauaguauugggggcucauagcaaaaaaaccguaguauauggguugugagccugucuucgaacauggugggucacuuaacagcagcugugcuggagagauauuugauuugagaagacuguuuugaaucuucucagcccuaacaccauucugguuuugaaaugggaaaauggaaaagaguuuuagggaauagagauaucucagccuugaaaggaagcauagguagaaaucuuucaguucucacucagaugaaccagcauuccuaaucuggcuacccucacagaggacaaagagucugcugggaaauguggguuuauauuuguagagacacacuucagaggcaugagauaguguuagauaccgacuggaugcuucgugcccaacaucaauuugguuugcagauugaaauuuaggaaagcuugcagaggagccaaucuuuuuuauauacagcaccuuuaaaaaaaagacuguccacuacuauuaaaaucugauucagucuucuaaaauauuacuacauucaagacaacuuuuaaaaugaucaaauuuagauagacaucaaugauguuaaaagauaaaagcccuccuacauguaauauauagugucuuaaaccuuauuuuuuaaaaaagggauaccacuuuugccaaaaguuucaauguagggauacucaaacuguccuuggaaguccuaaaaauugcuaguuuuuuuuuuguuugcuucuuuuuuuguuguuuuuguuuuuuguuuguaguuauucacaaauggagaaauauuuauaaaauuauauuauaauuuguaaugcacgcaaacaaccaucagaccacacuugaaucagagaguuacaguuauaaauugaggaaagaggaugccagcacaaugccuaauggagugaaaaauugugcuuauuuucacaggacucucuuggagaggagcuaacuacuuuccucucucuuaauacccagacccucucccucagcccugacagcacguuacagaaugcauucacuuagugugugaagagcuagcucaccaccucccuuuaagaucuauucuuguuauucauacauugcaaauuuguacuuuuguauccacaaggaagacauuacuaacuucaagaaaggcagugucaaugaggagcaggaaaauacaguaugauacaagccugccaaugaaagaauuauacucagacucuaugcgcucuguuaaacaaaauuugaaccuuugaggaaaaaauauuggggauucugaugaguguuuuuacucuuucuuuccuuuuuuuuuuuuuuucuauuuggaaaucauggcuuccugauccuaagggauaaaaaaaaaaaaaaaaaaaaaaaccucaaagaaaagacucaacaggcuuucuggacaucaaauaguuccuacaaaacaacauucugaugacuugcauguaaagaaaucagaaacauaugaauuaagcuucucucgaaauacauauggguugaaaaauagagagaagugcugagaaaauguguuuuggguuuugcugagcccaugacguuugaaaaauaguaugagacauugaacaaacacaaagcauggcuuggcucacccauuccuaauauuagccuucuaguucaacggcaaaucaguuuaccaugugccuaaaugugagccaccuuggugcacucccccacacuuaauuauaugcaguuuaaauuuuuucaauuaggagcucaaaaauaacauugcauuucaaggaaaugcaaaucuuagcauuuucuuaccugguuuguucaccucagaccauuuuagaaaacaccacagauuauuucaccuuaggagcagucacacugauguggcccucuuugauguggcuggcauauaacagaagaaacguaucauuuuuaagaaacuggcuccaaagacaauauugcuauuaaauugaagccaaaaaccacugcagguaaaacaugaugaagaugaaggacgcccucucuuagccauauaguagaagcccgaucauagacucucacccuuacaccaugacuugaguuccugcucauuuuuaucccugagcucugcagacuucuaagcaguggaaguuuucauucucuuucccacauugcacucaagagagcuaacaugagagauucuaaauccugggauuccucugcaucuggcuuuaaguacaggagcagaacacagggaauuuaaggaacaaaaauagccagagcuucaggcuucuuccacugaugguaagucauugacaugcacuuggaugaaauccuguaucuguucuuuggacuagcacuaucgccugagauuaucaguuucagagaguuacagagaggcaguagauuucaucuuuccuauuucaggaggaguuauuuugguuguuuaaaaaaaaaaaaaacacuuuaauguacuuuuccuaacuccuucacucagaugguggcaagaaguuugacagaauaaaguaauucagcuaauauuuaucaaaugccuacuaugagugagcuguuagaauauaacccugaacaagacaagcaugagauaggcaaacagacuauuaaaaccuagacugauaaugcauugauugggguguacaggcuccuuaagguagauauacaaaggacaacuaguccacauuuggccuuagaggaagugaagugcaaggaugaaugggaauuaagcuggcaaaaugcaaggguuauaacuggaagcaggggugagcauggcauauccggugacccagaaguaguucagaaugccagaagcuuaugguacaaaaggauaacauaaaagaugagacugaaaagguaaacaguggccugaucaaaaagcgacuugugagcccuauuaaggaguugagauuuuaucaugaaugugacgaggagccuuucaaauggguaugccugagaaguaauugaauuuaaaagucaagacggauaggaggaccuggaaaacuuagagucagagaagccaagggaggcagaucugaccagaaggaggaaauugucaacagugucagauguugcugaaagauagaagugacauuuggcugcagcauccaggaggucuugagcaguuucauugaaguagugaguguggaaggaagguaaagaaguggagaacaggcauugcaagauaauuuuccaucaucgucaucaucaucguccucaucaccggaaaaugagcaucaauuaucuuaucuaccagacauagagagugaccagguaaggaaugacacaccugcagccugggagauuucagaaaacagaucauaaauauaaaacagaagacagcaacacaugguacaacacaugcaaagggcaaaaugagcaguguaggccaacgggaugaagaacagaaagaauuagggggcaggugaaaugggagaguuuuucaagcagucagugcgcuugagguuugcauucuggauugugccuccuuauaagucaguccaaccuguuuuugauucuccauccaguggaaauaggaaacaccaucaaagaugaugcauagucuuaacuugccugugacuucugauuauguuuccgaauuuugggaggaagauuaaagucauaaacugacucuugguuuguuauaauuucuugcaacuguuauuuuaaaaauccggacacaggccaaggcaggaggauucucugaggccaggaguuugagaccagccugggcaacauagugagacccugucccuacaauaauaaaaguaaaauaaaaagaaaaucuggaugcagaaacugagguguagauaaauauagcaagucagagauauucguaaauucuacaucgaugaguuucuugagaaauucugcacacccagugcuggacaacuguggaauugcagcgugauaccuuucacaucugggucaucuccauaugauaucuucuuccugguacaaggccagaaguucaccccacgcacaacaccuauggaagccacuuacgauucaaaggacaguuuuucugaaaaagggugcaugauguauacuucccuucaacacuaaaauucugcugcuuaaacuuuguaagugaaggaaaggacugguucucuucuacuuuggcugucuuccuuguuuccuauuuauugggugcuugcuuugggcaacccauuguauuggaugugcucuaaaccacaaucuuugcuccuaaggaguccguaguauuuaucgggggauacgaccuggauaauucauauaagauaugaauuucuuucuuuuucuuuuuuuucuuuuuuuuugagacagauucucacucugucgcccaggcuggagugcaguggcgcgaucacggcucacugcaaccuccgucuccuggguucaagcaauucucaugccucagccccccaaguagcugggauuacaggcacccaccaccauacucagcuaauuuuuguauuuuuaguagagauggaguuucaccguguuggccaggcuggucuugaauuccugaccucaagugauccgcccaccucggccucccaaaguccugggauuacaggcgugaaccacaaugccuggccaagauaugaauucuaaaaaaaaaaaaaaaaaaaaaaaaaaaaaaaaguccuuggaaaguuuagaagaugaaauacauuuaaugaaaauugagcucauucuuccccaauauuuguuccauauuccucuccauauuauacuauuaguacacaauccuguuuggacuuacuggaaaaaagagcugaauagcuuauccacaugucaagaaacuuucuguuuaagaacacugagguucaucaacaucaaaaaauauuuucagcaucauucaggcacuggacaugcucuacaaauuaaauaccuuagggccccuacuauuucaguguuuucucagugucuuguugcaguggcaaaugcuaugaacuacauuuuucaaaugaauauugaagauugagaaagagguuaagaaccucuaucuauuaacgauagaaccaaaucuagaaagaugucuccugcucuguagagcacauuagggaucauuauuuauagccauuuggcucucuuaagacauuuuggcaaugagggaaaaaucauagguugauuuucuugguggaaugaagaacauugaguuugcuaacaaagagagcaugagugacuuugguaagagagcaguuuuuauuucaguggaaaggcagccuccucuccuaauaauagcuacauuauuuaccuaaauguuccauguagcaacugauaacaaggcuuacugcuuaagaaauuuggccaucaucuuguccucucuacuagaauuccaucugccuacagaugggcccuugcuaauauuuuuuuucugaaggacaacauguaacuuaagggcccacuacuguguguuauuuuguuuuuuuaauugaggugaaagucacauaauguaaaauuaaccauuuugaaguaaaccauucaguaauauuuaguacauucacaauguugagcagucaccacaucugucuaguucuaaaacauuuuccccagcccagaaggaaacucuguauccauuaagcaguuccuuccuaucccccuacuucuaggcuuuauaaaccuuuaauuuuaauguuauauacacacacaggcauacacauacauauaugcuauacacacauauguauguauauauguauaauguguguaaauaauguguaaauauagacguauaaagauguauaauguggguaaauaaauggauguguguauguguauauacauauauguacauguauacauauauacguauauauguauacauauauguaucuacgcacauguauauacguguauacacacacacacacacauucaugucuauuuauagauuaggaaguuccaaacagaggaccuaauauuuccuaauuauguaaacaaagaacuaucuacuuuaaugaauguuucuccaccaggaaaaagaaaaauaggaaacauuccuugcuucuuuuaaccugucuguauauuucucuuaaauucucacuagaugcuaauuuaucaaggaagacaaaaaagacagaaauaauccugagccuuuuguuguguaaaacugcugcucuucuuguaaagacauuuucucauuaauuucaucaacacugagaauuuuaaacugcuucucaauuuuaagcaauuguauggguuuuacauuucuauuuuugaaaauccaaaauuauugaacaaaguaauuuaguuagcaaaguuuacauuucuuggaaagaaauaugaaagggucauucuuacuauaauuuuuauuguuaaagaaauugcuguuguucacauguauuuaugcccuccucauuccggaagaauauuugagguagccaguagcacauuuuuuugaauuaagaaaaaauuagaucaaaugaaaaaauaccuaaaauuuaaauauuuagagaaagccaacucaauuauauuuuaaauaugccugaagucgugaacuaacuaauguugaucauuuagucuucugguccuaucucaggaauauuauugcccuucuuaauucaucuuucaccuccuuuaagaaguauuucugaauaacccuauaggauaacuuccuuuacauuucuuuagcucauaugguuuauacaaaaggcuacucacuuuaucacauuuucuaguugcuuauuguacuucauaaaucucccaacuaguuccuagugaaaauucugcccuucuaauuuuuuguauguaauuuaccaaagcaccuagcuuugugcuagcuaaaagcucugcucugaguuaaauuagugaaauauugcugguugauuucaccuaaaaguuugccccgggcaggagggaagagggugggcauuugaauggguaacagacagagaagcagcugauuggacauagauguugacaacuugcauacuuauuuuuuucauuucaaucugugccacagagucauacauuugguaauuauuucaugcuuuuguuuucaguugaaaguaguuagggccauauguuuugacagaaaaaagauaauucguacuuuuuuucagcuuuaugaaagggaagaugggguaacaauuuuacaguguaccauggcagugauuccuguucaaaacuuuaccagauuggaaacucacuguucauaacaauucucuugguaagcagaagaugaaggcaucuguuuaaagcacccagaguuaaguuugaugcuucaaagcacagcagaguucauuuauaacucuacuuagcacuauuagauaucuuuaacaaauaugaaaaguuguccaccagauuccuuagacuguaggugauuuggaaggauauucuggucaagugcuaacuucugacugaggauuucaaaugaaaagaccuagguuauaaccccauuccugcccuuacucugucuugugacucauggaaaaggaaggcacuuaacccgcuccaagcuuauguuccugaauguauaagauggguagcaugguugaccacuuagacagauaauccaucucaaaaugaugauuaaagaagauaauggaugagaaaaguccuuuugauuuaaaauacuaugaagaugugaacuuuuaauaaugacuaaugauagaauuuugucaaauuugcuuuacguaauuaaguucaagaucaaagaauauaucuagagaaguaccuauguauuuugugaaauguuucuuugaguauuauuauuaucauuuuaugucuguuagaaucuuggccucacugucuuuucauucuugcuugaaugucgacucuucaaagugugacuuucugcuugugucugaugcaacuuucuuccugaucgcucuugcuuccugagaaggaauagguacuuaggaaugauggcuuuuuggcugucugugcuuauuagguacaaacacagcacuaaagacauuugggacuggagaaauaagaagagcgccuuuaggguuguaugcaaaaggucaaacuauaauguaguuagcauuuuucuuuguacugcuuucccuucuuguaacaaccucucaauacccucauaccuucucugcuuuccagaaaugcuuucuaaaaauugauuauugggaaaagaucugagaccucauugcccugaaguguaauuacugcugacaaacugugacagcauuucccaaagacagggagugauuggagaugugaugaaaaguggguuugugacuguggaaacucuuucagggauguaggcuuuuaccccucuugguaauguaccuugacaaaagucugcagcaaugaaauuaacuuguucacuccaaucgcaucuaaaguuauuugagcuuaaguccuuucuuaaggaugucagcuuuaggcuucaggcaucaaccuguggacuagaauucaaagggaaaaggguagggaauggugcucuuaaaaucuuuaggaccauuauagguaauuccauauccuaaagaaagcucagcccuaaacacauuagagaaguggaaugcacuaaaauauauuuuggcagaaccaaugaauguuuaucuuucucuguguuaugauguuauucuuaguuugacguguaucccaugugugguguguuuauucauucaugcaugcaugcacuuaguaaaguuuugagccuauucugugcccggcauuacaugcacacacacauauguccaagcacaccugcacauuuuuuuuuuuuugguaaugccuuuuuuaccuuauuguuucugcaacuggcuauccuuagcaggccuucuuaauguacaauaggguauagaagaaauaacaaucaacauuggaguaaaccuaaaauuaauuucugucuuuauuguagagucauagaauuuguuuuccucuggaagaugugcugcccucauuuaauugauaaaacagugcuuucagaggucacaaagcuauuuuuuggcagauauaaccaaaccuauuuugauguuccagcaccuccuaaugaagcaguagucgucaucuaaaacaaaaagcagucgguugcuaaaggaggagaaaguguugagaugugagaugaucuguuagacauaauugacaaucaugaauuugauaugauagguguaaacagagauagaaauaauuuaguuacaucuguuuaagauuuaagauaaccagaagcaauaauguuuaauugaaauaauauaucagguucuccuuaacauuaccuugaauuucuucacaugcacaucaaugcauuugguaaauaaaaguuuggaaacaacuuaguuaaguguuuagaacauauuagaguugugaugugcuuagcauccgcagucuuuuaucugugccaacccugagccugguaaugaagccaacucccacaugaauaaguaacauaaggaguguaaccaggaagaagucaggguuucaccuggaccaaauuuuaggcaauuaaguguuucaagagaucuuuagccagguguaacuuaaucaguuuaaggcacucucagcuagggccaagguacucauaauguuggcagugggcauucgucugauacaccacguugaaaguaauaggaaacauagagugucugcucaguuauugccaagagcaagagaaaugcagguguaaaaauauaaagaaguauuuggagccagaggcuaguacacauagacaagacuguauuuacacuuggcuuuaauaguucagauaauaacauggugguuuuuaaucaguuuagugugcugauauuuagucgugggucugguuucaccacuaaacccuaguguaacucucagccgguuacuuagccucucucugucucuaguaauauuaaacaaguguauuaauaccugcugcaucuuagcucaacuucaugucuggaagacagaugaaugguccugcuucuugcaguaacacacaagaaccuccuuugugcugcccugacugagaugaucuuguguucuucucuacgggcaaaacagcccuaggcugcuaaauggccaggcaguauaggggacuuaggacucuacaaagcuggguuuugguaggaguccaugagcaccgcggagagaauucuuaguuaucaggagauacgguuguaguacuuaaaaacucaaacuccaaaacaagacuacgugguuuugaaucucaguuuugccaguuuauuagcugugugacuuuaagcaaguugcuuaaccucucugugccucagaucccuuagccauaaaauugggaugaucaugcaacaauaggauuaguauguaagcaaaaugaguauauguacaguuuggcugcaauagagcugauagguguaaacagauauaaauaaugacuucuuuucugaaaaugacuucuuuucuguuuuucucguuggugaucccugcuuaugucacugggauggcugcgggaauucaguaggauaauauuggaaaauagcuuaaaucucaaauguucuauagcuaugauaacaucacuaugacgucauagcagagugaguccacucacaucucuccuggcaguuuugcugccucagaguuggaauaauaacucacugaaaauacuuccaaaauagugagccacucugcagauuuaauuuguaauauuauucuuucuaauuauuaguggcucugucuuaaguuccuuuguuuuaauugaagcaggguuuuuuuucccccuuguaaauuucuauacaugucaaaggcuaccaacucauuuuuauuuagaguuugaaauuugauuugaaaaauauacugcagccagcuauaugaaaaacauaagaggauauuguugacuuuugaugaagggaagaaagaacaagguagagcugccuagccaugaagaacgccaggguuuuuguaaccccuggugugcuuugcacgcagaaggcacacacuuaaauuggcauggcucacuuuuuuuacugugccuuugcugagcuugcugcaggcugagugcacugguagaggagugcagggcuguguucuggccaucccugccugcucaggccucuccugcuccuuuguggaucgcccaggucucugcugcuuccuggugccgucuccuggauccucuugacauuuuuccguucuguaauuugauugacaguuacagacaaggaaggggacugaaauucuuaccguuuugugacuuccuaaaacgggaaaggaaauuuggugaaugagaaggggaaaacgccucuuggcugaaauuauuuacaggauuuagccccagguuuaauguacucaugaaugaauaaugacucagcugauauuuagaagccgggaaaauuaugcgauuuuugugaugggguguauagauauggauguauacuugaagugguuuguguucuaaauauauuaacaugcucagggaauuucuuuuuggggaaauacauauauucuuuuucauagauuuuuguggugcauucugguagacggaagaugggucauugcucaguuaguaaaaaugaaauaugaauaucauacacauaagugguacauuuuacacuuuuugauaguugugaaauacucuuuuuuuuucagacuaccaauaaagagaauuugaggaguaaaacucuucuuaccaugaauuguuuuggggcacuuagaacuauuuaguuaauucuuuuaaauacuccaacugauuuagauagaauaaaagugucacaauuuuaacagcuuacaccagugaaauguuuccacuuauaagaaauacccucuuauuugucagcauacugaagacauauauguguuauuucuaagcacauuuccuauuuaugugauaauggagaucgcccuuuaaccaucacuuggacgugaaggaggauucuucuuccuccauuaguaaauauuccuugacuugauaauacugaaaauaugugaggugaaugagcuuuaauccugugguuugguuugguuuuugguuguuugcagucuuggacuguucaccugcacugucuugugccuuugaguaugauuaacugccuugacgccuuacagugcauuacacaacucuacuucuuccauuucuugacuaaucucucaugcuguuugacugcccauuggaaucuuuaaguuagcuacuuaggaaagacuuuaggaaggagaaugcuaagagaacuggcagagaagucaggagccugggcucuguccaggcccuggcguaaguccuuucaccucuuccuuugacuccuuuacaaaaugaaguugaacucauucgagcuuuaaaaagaugacgccaagaggcaagacagagggcaguagaugugaaaguaacaugaaagagaaaggaacaucugaaaaaaaaaaaaagguagaaaaagauuuugacaaauaguacuaaaaacaaagaauauagaauagagagacccaauuauacugauaauuacaauuaucaguauuguaaaaacuacagcaaaaaagcuaaaaacauauucagcuuuuauuguccauaaaaagugaucacaccaugucuaacuguaauucguuugucaaaaacacuagaggccaaggacuaaauugcggauuaagaguuucuuccuuuuauuuccugcauauccagaaaccuggggucauagauacucuuccaugguguguuguuuggcacaacuugcaaguauuuuggcagaugguuagaaaaaaagacuuuaagaaauaugcaauaguacucaggacucuaaauauaauaaauaaagcuaagauaccaguauccugccauucauuacaaucaacauuuauugaacagcaguuauaugccagguagcagggauaccuagaacuugccccucccacuagcacuccagaagaguuccugcuuucccagccuaaagcaacagcaagucuuacaugagcuaggcuuacugugauagcuguccugacggcgaguggcaaacauggcccagugccuuccucauggaugaacaugacucuacacugggacuccccgguagaccuuuuugugaugaugagaaaguccuguguuggugauguucaguaugguaacuagugacuguaugugcuguugagaacuugaaauauggcuacugugacugagggacagaacauuuaauuuuauuuaacuuugguugaguuuaauucaaauaacuacauauuacuaauggcuacugauuggacagcagcuuucuagacccauuguuaaaaauaauuauaagcaaugaguaccucuuaugagauagaauuaauaaucccauuuauugagggcccaugacagauuaagaauuauguuugacauauauuaucccuaauccucacaagaaugguucauuugacaaauaagauaacugaaguucugagagauaaauugcuuuguuauguccucgcaaggaauugugagagcuggaauuugaaccuaauuggucagacuccagagcugggugauuucuaguaaucugccaaaucuguguauguacuguccggaugcugugucuucugaguacaucuucuccuugcuuuauggauuaguuagcaaugucuuuaucuuggucacauaggacaguuacaggguccaucuuaucucuucugaauauggacguaucacugcacuggaaccauucauuuuucuuacugaggccuauguccuucaaaaaauauuaagaguugaggguccaacccagcuucuugaguaguaagcuaaucaccuacaaguauauuuccccaguagaugcugagagaagcaucaaaguacauggguaguucuguggacaucaguggcacucaguaaacucuuggcauuugaguguuuaacugucacaguugaggauaucugugaacucucccaaggccugagucacugaaugagcccagccaguacuugggcgucuguggcuccauucugcuuugcuguuuucugcuuuccauggaacauacaguaacucucuugaagggucugaaagccucaauuacaacguuucagugauucugaacugauuuuucuuuggaaaguauauaugcagaugguacuugcagaaucaccaggggguaguaacguggaggagugguaaaggucuacuggacaaucagguggcuaccacccaaccacacauggugaugugauaugaagccacuuuucuuuauuccuucagauuuaagguuuccccuucaggaagcagguuacuuaacaaguacuugauuucaccauaacaugcauuaugacauuaucuuuuuuucuuuuuucuuuuuuuuuuuugagacggaaucuugcccugucgcccaggcuggagugcaauggcacgaucucggcucacugcaaccuccuucucccagguucaagcaauucuccugccucagccuccugaguagcugggauuacaggugcaugccgccacaccuggcuaauuuuuuguaucuuugguggagaugggguuucaccauguuggccaggcuggucucgaacuccugacuucguuauccacccaccucaaccucccaaagugcugggauuacacgcaugagccaccguuccuggccgauauuuuauuuucuuaaaaggucauuaucagaugccacaagaguauuucuauaaacuaugacccaaguauagccuaauguuaauagcuuaaaauagguuuuauuuaccuuuuuugcccuuuaaaagcaaggaauuauuuuuuaauggaaagaacauagacuuugaugaucaguucacauccuugcuuuaccccuugaaaaaugugcaaccuggaaagacagcuuaacauuccugagucacauuuguccaaauaauacaaacaauggcaacaagacuucagcacuaaugucugauguuuuuuguaugauuaaucugugccagguuccauucuaguuucuuuacacacauuauaccaucuaauucucacaacaacuuugcauagcaggcauugucauuuccacuuuacaagcaggaaucugaggaccagaguuaaaaguaacugguccaagauugccuaguuaauaaaugguggaauuugcagucagacccaagcugguuugggccaauacacuugaccuucuuaugauacgucagccuugugaaauagggcagauacuauuaauaauauccaccuugugugaucauuaugaagguuagauauaauguauguggaacucuugccaccaaagugguuccacaagaggcccuaaacaaaugaguaaucauuauuauuuuaaaauguccguaagugaaaccgauaugccaagaccaguaaaaaugagagcuucuuaaggaaaagaguaggaggcauaccuuuguuucauuuuguuuguugguuucugugcuugcuuuuuguucuuuucuguuaggcacagguuuuauuuagaauaaauuaaauuuuuuuuucuuugaugagugcagaaauaauaguuggaaacauugaauggaacagcuaauguaccauaguaauacuucuuggauuaccaaaaaaaaaaaaaauuaaaucuguaaaaugaaaacauuuuuguuuacuuuggucaguucaagguucaguguuaucuagagauuuuuguuaaacucaggauuucuauauguaugauugucugcuaaauucagaauuagaagagaagagauaauggcgcuaacuuugcauguuaaauauacuguguuacuaguuuuccaugaaguuuuuacucaacaaauagguuacuaaaagagcugugaccuaugaguuucaccaagucuuuccauuuccaauucggcaacaaaaguuucacacuucucaauuacucuugugggaggaaucagaaugccaacagucaccuugaucuaagcguauuauuggagaaaaauucaaggauagauauuuguuucucauuagauuuuccucauauuuuaucauuggggucacucuaguacaugguacuagaauuugggauuuuuauuucauuuuagauuggacugauuuucugguguuagucauuaaaaauaauuccaacucuuugaagagaucugggauguuuguuauuauucuauugauuaaauaaagcuauuuuauuuaacaauuguguuguuaaacuuucuauauacuuagaauaauaauacuaaaaacugaauggguaugagcuuuucuuauugaauuuaaugucaguauuaaauaccuuauugaaacccauacuuugaaagcuugauugagaaauuggcaaaagaguugacugaaguaaaaguaaugaagcaguucacuggucauccagguuaugaaaaauuaaaccauuagagauaaacugaacugugaaaauuaugaucaugguguuuucauaaauaccaucuaugucuccgccaccauucuaaaaaaaaguacccuaucaaauggugaaaaauaagagugauguuucugugaccauuucauuauucaguuuucuuauauuugaaaugugggagguugaacuaaaauuuguugguucccuucuuuaaaaaaguauaguuauaugugauauuuauuuauuuauauaaacaaaaauauagagaucuuaccuugaaaauaacuuuugagguaagaaugauaaaguaucuaaauggaagaugaauaacauuguaucugauuuguaaauuaugauauaaagaaaauguauaaaauauguagaaauugucuguauaaaaaacuauaaacagugguccguugccuauuaacaaagaguuucauguuaucuaaaaagucuucaauuggcuaaaacagcagaaaaauagaaauuacauacuauaauauauccuaaaaacauuucaauuccauagauacucuucuccaugcagccaauauuuaugaauuuggaguaagugaccuacucuuagauauuugagcuugauuauaauucauagucaaaguagccuccuuguaaauaaccaaaauuaaccaaagauuuuuccuuaucuuccaaaagcaaugccaaguaauucuauccaaauuggaaaaaaaaaaagaaaaaggauaaaccuuauuaggugucaucaaaugguguugacauaaugauauauauguuuaaggauaauguaauagaauauguaauuaaaauuaaaguauauaugaaaagaauugauuuuaauuguuuuaaaacauaagaugauuuaauaauaugggucggagauucuuuuuaguuuuauaauaaauauauugauuucugaaauuuggguauauuccauaguacacuuagcuuauguuaauacugaggccagauugcugucaggcuaauagcguguagauauauuauagucacacuacaaucauuccgucaguuuucaguuucccuuuuuccugugauguuucuuucaucuuguuagauuauucucaagaccuucucuaaauaccuucaguaguaauucacaaacucuuuguuaguuaauaguucucaagaaaauucugagaugugguugacagaacuuagaucauugguuuguuuuuggauuccuagccaaaguuuuauucuuuguuucuuaaaaauacucaaaaaaguuuuuuuuccuuauuguaagcccucuggaaauagaagcaaaucacuguuuauacauuuaaaaugugaugaaaauuacaaaauaaaguccagugaaauauagggcuuguauccauuagugccuuaagaaaaaucccuguuuucugaagugcgagugggcuuuucugguuuguuuuuguuuuguuaaagcuccaggaccucccaauuuucaagggcacuuuggggcauguguagcauuuauuugauguauggauguagaugcauauuuucccacaucugucucuguggaccuauccuuugugaaauccuaaaccuuguauuaaugcuuaguuuaugauucaugguguucugagagcaauuauauaauuuuucugggguguuuauucgaugugcacuguaaaaaaaaaugagaguuauuuuuugguaacccugcacuugccuuuuuauuggugaauuucuuuuccuuuuacugugaccugugaauaucacuguaggcucacugccaauuuugugagccgcugccugcuucaaaauggaggcaggaagguauccauuuucaucaagaggaugacaguguuucagucuuucugaccaucuggagagaggaacuuugagagcaaaagaaaauggggauuaaaaaaaauuauauuuagcagaaaaggcaagggggaaaaccaauuaaaguuaaacuauaccuuaugaauuugugcuuuucuacuaugcuguccuguuuaaaaaaaacauaaacaagaaaauacacaggcuauuuguauaaagaauugguuucccaagucucaugaguauuaguaaaugaauguaaguaaauuagguuuuuggcacacuuuuuaaguuuauuguacacacaaauauaauaagcaugaaaaaggagggcucccuccucccgcuuccuaugcacacacugauuguugguggucuuauguagauccaggcuuuuaauggccuuuuucaugcaucucugcaaaaagcugacacuaugggaauuuaauauucuaagauauauuuaucacuuucugugguuuggauaguucauuuguguucucucugucuccccccucccuaccuccucucuguaaaagugaaaauuuuaauugaaagguagaguuuuuacucuaccauuugaaagagguuugaugcaugucuuucuguuuuuaccauuuucacaugcuuaugggccaucuguguuuagaagaaaaagaaagaagugcuuagacucacaggauuacccuaugggcauuauacaguguauuuacaacuagacaugguuuacaucaacuggaauauaacacaccugguuauuuucuguucgcacaaauacaccgagcuuuuguuucguuuuguuguguuuguuuuaguguguucggaaagggcacuguuucuaggguuuguucagauuuaaacuggaaaggguagaaauguagcacuuucugccuacuucuuauauaagaauggagcuugggcugcuguggucaaugcaaaaagcaaaacucaguugguucuuucuccucaggucuaugcuccaucagcaagcacugccgacuacaauagggacucgccaggcuauccuuccuccaaaccagcaaccagcacuuucccuagcuccuucuucaugcaagguaagaugcugcugcuucugagggaaaggccacuggauagcauuuuccugggucacuuaaugucacagauggggcagaagaaauggaauaguaggcaaguguagaauuuuugaagucaugcucuucuuaggaauugaauuccuuaaaaauugauguauuaauuaaaacuguacuaagucuuucuuuacaauuaaaccccuuuaagcaguaauggguuaagauuagauugaucugcuucacuuagagccgaugcuuaugauggucuuccacucaugaccaaccauuucagcaucuucaccauccccaagacgauguagcuguuuguuuagaagugguucagcuccauguauguuuugaacauccuggauuuagccaacugggaacaaguuggccuaauguauaaccuuauguaaaauuuucacccacuuacuaauuuguagguaagaacaaggguccaagaugaaguaaccuaccacagacuggaauauuacauggugaaagcucugucccaacauaguaacugguuuaggauaaaaggcccaacuuuugggggagaagacaaauauaggaaauuauggaauuguccaguauguuuaaauacauggaugugugcccccacccugagcuuguagucuugcuacugauagcguauaccuuucugcugcucaaaaaagaccaagauguggccgagugcgguggcucacgccuguaaucccaacacuugggaggccaaggcaggcaaaucacaaggucaggauaucaagaccauccuggccaauauggugaaacccugucuguacuaaaaauacaaaaaauuagccaggcgugguggugggcaccuguagucccagcuacucgggaggcugaggcagaagaauggcaugaaccugggaggcagagcuuacagugagcugagauugcaccacugcacuccagccugggcaacagagcgagacuccaucucaaaauaaauaaauaaauaaauaaacaaacaaauaaauaaaugaauuuuuuaaaaagaccaagauguuugaaaugauagcagcuacuucaagaaugaaccacuuggaggaugccccuaagggcuccauccugauauguguguggcacuuauuuucuaauguaauuaucuuguuaccaaguuaaugcccugaauuuagauguggaauuuaccaagaaccccugugugcaaaauguuaacucuuuuugcccaggugugaaaaccuuauuuguauaagccuugucuacgggccaugggguuuccuucuuuaugcaucucuaggaagggccaugucacaggaaggggagcacauuuggggcaaagaguaccagggaagcagccugauauaguggacacacucaaaaucauucucauuaaaagauacuaaucuuccuucccuucaguguguuagcucuuuuaguuuguuaguucacgugugaaauuccauggaaaucuauaaaauuggauggaauggcucuguuaggaauagagagaauuuguuccacgcauaauagagcccgugugucagaaguccuuuaacuuugugacccguccuagguguaacucaaagggacacagcaggcuaugucaccugggugcguuuugugccgugacaaaaagcuaaucaccuucaguuauaaacaguagcuaccucagcaucaguccccuguuuugugagcagugggagauauuguccuacaggagcuuacagagauuggcaacucaaggauccaucacucaaaacagauuucgauugaaaacauugacggaaggauauauuuuuucuaucugcccaggaaaguggcuuucuggaagggugcacauugcaggagaggccagguagauuauaucaguaggcuccuuucccuagcagaccacacaaaauauggggaacaaauuuguuuaucugcauaugcauacccgaaaagcaaaaaaaaaaaaaaaaaauugaguugacauuuuugaugagcacaauuaauuugcacacaucuaauucuauucuuucuuucaaaagaacauuaugccaagaucaugggaugugauaaauauuaauuuacugugaaaagcauaauuuauguaaaauauguauuuuuauaagucugcaucaagcagaguacucuguguuaacaguccuaaacgcauugccacccaggguaucacauugucaggagacucuuguuuagugauauauguuuucaauuuauuugucauaugugccaucuauuuaaaauguuagugaucuugaacuucauauuugaauuuaaggugacauuuaaaccucuguaaucuaaggacuaaagcucaaguacaugaaugauaacuuuaaaaaaaaucauguguuuucacaugauggccacagaaacaguugcaucaugguccugucccacaucagcuuccuuucaguagagggguacuuggugcccugagaauucaagacuugaaggaauaugcaauuaaggugaaagauguucagaaacugucuggggcauauuguaaacucacuacuguggccucuuauuuguaacuucaauuuccaucuucuaguuaaaacucugaaguugucaaaaucacagacaugauuuugcuugcaugguucuuaaagagaggaaucugcaaacuauuccucccaauaugaaaugaguccaguuacaaaauucuaacuuccggauuuaagaacucaaugaaaaagagcuucacgaaauacagugucagauuuaacuuuucuauugccuaacuuuuuaauaggccuuuacuauauaaaauguuauggugaaaauaaucuuauuuucaaggaagcaauaucugcuauacauuuaacagccagcugauggccuaguguauaccuaguacucaauacuuuuuguuaaacuauugaaacaaagaaaaaaugaaugaauuuagcaguaauguagaucaucuuuucccuuaggcuugggaaaccaaaccuaaacauuagcaaucauuaauaauaaccuguaggccaauaggcccagagaaugaaaaaauccguagggauguuuuuaauaagaauguuaacaaaagguuaaccuuauguugaaagauacuuuauauaauuuuaaaccucuauaauucauaaaucguuuuauaaaauccagagacucucaaaaauaucuguaauauaauagcuaccuagggcauguuuguacccuuuggauugcuacugaagguuuaagauagcuauauaccuauacaccaaaaaauaaaaauaaaauauccuaagaacuauauauuugagauucaucuucucugcaugccguaauauaauuauaauuccaacuuuaauucuauuuauuguauauguuaaaaaugaaauuaaacauuuucaaucugagauuuuuuaaaauuaauacuucuuuacaugcuuuuaaaacuugucaacuuuguaauuucucaaguacuuuucaccccaaaguuuaggaacaauuuaacuuuuuaguugguuuucauagaaaaaacaguuagaagacuucuaagaaauguuuccuuuagcaguaauuaccuugcgacuugacauaauucaugguagaaauauacucuguuguucuuuuacaguucaauuuuuaccaagaacacuuuaacuuuuuuaaguguuuauauuuguuugacaauauagagccacuugggaagaaaugaugacugucuucugauguaaucagcuaaccaacacaaagaugaauaacacaacaggcagucauuuucaaguauaugaaaaaacccuauucuauaaggcaaggcugaaugccucagaaagucaugguugucuuuguccuuuacagauggccaucacagcagugacccuuggagcuccuccagugggaugaaucagccuggcuaugcaggaauguugggcaacucuucucauauuccacaguccagcagcuacuguagccugcauccacaugaacguuugguaaggcagacauacacgguaacgggaaugucacagcuaguugauuaaaccucguccucugucuuuccaugcauauacacaaggacucugcaaauaagugcaaaaauggcacacacccauuauucuuaaguuguauuguuucugugaucaaagacauaacagguucaaaucaccuuuguaaauucuuccagauucucucuggcauuguucuuuuguuuauuguguuuugcucugugccuucuuuaucacaaugucagcuuccuuggguacauaaauagauaccuauuuaaguuguagaaucuuaacauggugguuccugguuuuuuuuuuuuuuuuuuuuuuucuaucuguaguuucaaaagauguacugcagagggcagagugacagucgguagauuauaugcaucacccaggagcauuucauuucccauugacuggccuaugucagcuuuggccuguugugauguauccaaaagaaggaguuuguauuuucuguagacuuccaucaguaagagaaaccaugagguuucuacauagaucagauucccauuuuucaguauuuuaacuuuaauucccaucccagccugccacucauacuguguuuugcgucacuccaggugaaaacuggugggcucuagaauguuaggucuuucauuacuaaacauuuccacucuguccaucaccuacauucaucuaucauaguaugucucuuuauccuggaggaaacaacucagcugacuuucuucuagccuuaaauaucaccacagcccagaauccacuguugaacuuaagucugucauuaaagagaggaaagagccuagaucuugagugagauuugggaugcagauaagaugaaacuugaaucccuugugcaagaacauagcuuaaacaauauguggaccucacauccuacaaaugcgaaagcauaugggaaauccagugaucccaggugauacuuacaucacuacuauucaucuugcauuugccccuuuuucuucuucucauaucuacacuuagguuucuuucucuguucugauaaaggaaaucauucuggauucauguggucuuugcucucuuuugcucaaccaguacagauaagaaacaggaucugaucuccuacuccaauaaucaaaaaaauuccagaaguuaagauuucugauauccuugaaaauccguauuuaguugguccuagugguagagaugcuaaguagucaauuagccuauacauuccugagaggcagacaguggaaaugguauuggccuuuuuguaucaccucccaagauugaauguguaaaucacaaacuaucucacauuucagcacauuuccaguaaauagcagaugacuuauuuucaaauuuucucuuuucccaccuccuauuuggagauauuagagugaaagcuuagagaaauaucaacuauaucaacuauuauuaugcuagaauccguuuuggcuaaaauuuucauuucugcaccaucauuuuccacuucugugggaacucauggucaaaacuguauguguccuaugagcaaggaaaguuuugauuacaaauaaaaguuuuaggcacuauaccgcauguuggaauuucaguucuuuuaagaguugcccauuugacauuaauuuuucuucccuucuguguuucuuucuuucuucuccuaucaugcucaagaguuuugaguuaggcgauuugauuuuauccuaguccaguucacugcaugggaaguagcuuuaaaaugugcuuccaugcacaaaaaguauaauuucaaaauggaaaccaacuauauuccuuuuagaaaaaauuuuacagaaccaaaacaauauuaugaacuagagagaaaauaucauuuugaaguaguaacccaguaggcuauaucagaagccauauuugcaaugccauuuaccuaucacgaaacacaggauuuucauuuuucaucugaacaguuaacagauuucagagaguagaguuuuuguuuuaaaggagacaugaauaagcuaucuugcaauguauacuaaugaauuuucccacuguuagugaaacuauugaauuauuauaucuaguugucauuguacuuucaguauuuaaccaugugaaaaucuuuuacugaagugacuuagaagaaucugacacugacaauacuuugaauauauaguagcaguugguguccuuucaguugaaaauaaugguaguuccuuauaauuuuauucuuagcaucuggcuagccccauacugaacaaagggauaguuuaagaaaaagcuaagcgcuguuccuggauuauuugggguauaauuuggccaaguugauauuaucuguaaagauaaaauauuuuaaaaacaucauugccuucaucacuuuaugccauguuauaacagaauguguaauuauaaagcuuaagauccacauauuucaguagcgacugucaaguuacugauguuuagucuuuaaauccccuuuacaguuuuagccuguccaacagaaucccacagcuaaucauuacuguguuacacauacccacacaaaaucacucagaugaauggaguuugcgguuaaaguuuggaauggguuguuguagaugauuuuauguuuggaaugacuuggcagaguucuuuuuaagaacaggauagaguccucacugucuggcaugauuuaggcauggucuuugcacuacagggcgaaacaguccuaggagucuggaauuuuccuuuaaaggaaguucuguuuucuuuuauuuuuuuguaacauaaacccuuacuucaguaauucucaacugauggcaguuuuucccuucagggaacguuuggugaugucuggggacauuuucauuguuacaacuaggggcuagaugcuacuggaauccagugcguagaggcuaggggugcugguaaacaugacgucauguaugggagagccuccacagcaaagaauugucuggcacaaaagaucaguagugcuaagguugugaaauccugcccaaacccaaagcaugauuuuauucuuauuuaugugcaccaguuauuauauuuuucuaauguuugaauuaucaaccaguauaucaguaauggaaacauuuccaacaauuacucuguuaauagacacgaaauacaggacucuugggcaucauaaguuaaaaugaacgaauagugggcauguaaagccucgcacuuugucacacuccucauguccuuuguagcaagcaggaaagacaguaauagcuggaguaagagacuaagaggaccucuuauaguuuaucccuaaauccucuaaaagagacauuauucucugugguguauuuauuacaucucugaaugacaguaguuuucaagauaguuuuuaauguaaaauaaucuaguuauaaaucucguuaguuuauuucaacaacuaauuuucuaugagucucuaaaaauaacugauuuacauggauuccauugguucacuccuuuauaaucuauggggauuaauuuuucuuuuuauucugugaacucagcguuaacccuuugucaaaucccaaauuacugcccauuuuacauaaaguuaaaagggcccaaagauucucaccgaugugauuaucuguuuuguuucaucuucugauuauuauaguuaguuaaauauuuauaauucuucuccucuuuuuuugauuuuugcacauuucaggcagauuuguaguucgucuguucuucagaaauuccacauggaauaggacuguguagaagugagguuaaaguuagucaucucuuuuuuuguucuuuuuuccacauucuguuucuuuuccuccauuuuguuauagugcuuaccucuauagcagaaauaccucuaucccugcuaagcuuucagaauagcuguacuauggaaugggcccacuauauuuuucauuggagaaaauuccauggacuaccuuggguguucauuagguggcaaguagaaaugaguuuaacagguggccuaaggaauuuuggggucaaggaaagaaagagguccauggaauuuaaaaauuugaaaggcauucucaggaacuuggaaagauuuaaaggcaucaucucaacuuuuuuacggaagucuuuuaaguugggcuauuuuggucauacagagguaauauuuucaaaaacauucaugcgucuuugaaaauccuaccucuaauacguagauucauuuccuuagacuaguuggcucucaaauaaguuauacuucaauccacuguuuauuaaauucugacugauaaccaauuguucauugagcguauaguauaauuauguguucaguaguuagccacaaguugugggaugcagaacuauaagcucuauuccuuuaaagaguuuacaauacaggugaaaauacauuagaaaaagcaagaaaugaaaggccaaauauaauuaaguguuaaagacaauagugcagaauguaagugcauuagggaccuagagagaagagaugguggaagaguuggagguagucagggacucuucaagaaagagguagaauucaagacggaucucacagaguaaacagggcaacacucaagagacuaugguuucauuccucgugagcaaaugcuuggguuuuaaauacccgugacuaucagcaucauauucaaucucuuauuuugaaauaaacaauuuuuaacagcauuuccaauaaugauauaauaaagacucauaauccauuaauauauugcauaugaagaaaaaguguauuuuagcuuuaauauauugccuuuacauaacacauucagaugccuaugagaauaacuuuugaagcugcuuuuuaucuugaaaauagcucagcacuuuuuuguaaauuacuauguccauuuuagugagcuguucauucccaagcagauggguggauugcaacuaauuugccaccuuacaggcacuguggcauacccaagaaacacagcuuauuuggaaaacuaauauaauaauuaaacucaaagcagagucuuaaaccaagugauucuguaaagauguuguucuuucauugccagcuaugugaggauugcuuguagguggggcauggaaagaaaguacucaaaccaaaauaagucaugugguccuaauuuaauucaguauagucaauaguuacauauugaugaguaagagagauauuuaaccauuagugcuuuuuaaauuuuuuauuuacuaaauuuuauuguugcugggguucaaaaaaauuuaauuugggaggaagaagauuugagacugguuagucuuugccauuuaguuucaagaagaucaggaugaaauguaauauaagcccuguggaucauaauguuguuuuauucauuauauaguggaaucuuuuucacuugaucaauaggccacacaaaaaaauuaauaguagaguggucuuuuauguugccgaaacccuggagaugauuuuaagcaguaaucuguagauuucgagauugugaucauuucucaaugucccucauugccauuauaucccuccacaguugaugcaaacccaagcuauguuucuguauaacuuauuauuugaaaaaugaaagcugucagaucuaaacaagauauauucuuggcuauuuugaaauucuaaaagcugucuccauuguaaaauagagaguugugagaaaaguauuugaaaauaacucacuaaauaccuuaugauuaaauauggccaccuuuuucugcuucuugcuauagagcuauccaucacacuccucagcagacaucaauuccagucuuccuccgauguccacuuuccaucguagugguacaaaccauuacagcaccucuuccuguacgccuccugccaacgggacagacaguauaaugggugagucacagaaaugccaauucugauaccaacaauuggugucagaguuuaaucaucaaggaccucuuuuucccuuucauaacugaauagcaauuaggcacuaaauauuagucacaugacagaaugaacacacaaauguaccaaacagaaguaaaaucacuggcuugagcauaaccauauuuuucgucacaagacacugaaauuuagcuacguucuacguugcaagucauuagauugaacaaggguucaaacagaccaaaacuaucuuguuccucacauucaaaaagagugaacaaagucauaagaugagccaucagugacuagugagcuacaaagcagaauagcucuuaaugguaguuauugaccacuucccaaaauuccagucauugugcuaggcucuuauccaugaugugccacugucuuccgaggacugguuaaugugaaauucucaggugacugcuaauaacuacaugagguuaaucuccuggagaaugugacacuguggagucccucagaggggaagaaguauuuguucacuuaugagagaggagaugcgugggcaucaguuggccagaaauuauuugcugcuuuuuuaaauuaauuaauuaauuaauuuuuaccaaggacauuuacuaaugaguuaagguccaagaagaaugcuguucccaugaacugagccaucauccucucauuucuugugauguucacuguagucuuuuccauaggugguuccccagucaguauucccacuuugaggaaugaacugggcuggauguccagcugccccuggagggaagagguggaguugguggggagauagcuaccugcuucugaaccagcuuugacaccuuguuguucagaugagcagcacagcuuagugccccagggucuuauuaaaaccucagacuucucagguagucacuuucugcgguuauagcucaaacuaacuccuugcuuggccugaaugucacugucagagcgucgguggggagaauacucaguguaugucuuugagagaagauggcgcaacagaauaaugcugcuguugaguccucuuagcucuuugcacuuguuuucuuuagagaguguguagaauuuggggaaguggcgugaaucacuuauguaggaaaguuuuugauguuggaggagagauguguuuugaaauguuggaaauauaauuucugccucaauaaugcccucccugcguauucaauaauauaucucacacuugagaugagcuaucucgcagccucuccacuccgcuauccugucuaagaagcaaauugaggagagaguuuccauuuuuuuuaacuuuuccuaaccaagcuucuacaaauauguugcaucaguuugaccuuggagagcuacagacagaggucacauggggaaguuuguuagcuaucaaugcaguuuuggcagauuugaaaaacaagaagaaagaaagcagugcagaacugaaagagugagaaaagcauauuucacuucagugugguuugacaaauggaaagccccuuucugcagucaugaggucugguuauaaagaaggaugaccggucauucauccuuuuacaagacagauuuccugucuacuugugguuugaguaauuuucuuuuuuaggaagguaugaagguggagcagaaccuugaguugaggaaaacauacuuaggcucuguuugaaaaaaaacuuuuucugauugauuugcaaaacaguccucuugagagagaggcacuaugacuuggaagggacauaucaggaaauagggugguuaucuccaugagcuguagacagcuuagccacagcucucagugggaaugaguuuugcuugguuuuagcuggucaucuucauuaguuuguggaugaacaggagaaucuacuuguuggucuagccagaguggagcaauaggugacuucuauaugcugagaauagacuuaacuuguuaaaaaccauagggccuuauuuaagggucuugacaauaauaaaggagcuauaauuuaaaaacaaaaguaugagauuuuuagaacccagaaaagggcuuuuuagaaauuuauuucauacauuauuuuacaauaauggaugcacuugucaaaauccacuagcggaaugagaaaaagaugcauaaucuuuaaggaaauagguagacaugguaauucagcauuuuggaggagcaaaccuuuauuauuaugcauagauacagauauuacuuuaagguuacuuuaagggagaacauucuagaauguuuuucuuuaaaauaauauguucaccaauugcguacgugaaaaugcagaggaaaauuuaagcauaauaagccuuaguauugcgugaugucugaguggcccauguuuuuucacacuuaaguucucuuaggcuuugguuugauuuuuugagugugguagaagucagugauggcagcgugucuguauaacaagaagagaagcuuucucuucugauguuagugauacuacccuaacaaacaguauggauuaauaggauacaucugcagacuuuugaaaauauuuggcauauacucacucauucugaaacgcaggaaguaaagaaauauuacguugccuguaucucaaagaacaaacagagcuaauuaaauaauuggcaaauagggaacacauagccugacacauguuugagauuacacacgauucuguagaaaaugacuguaagcaauacuaaugccuuaagaaugggguucgagcacuaacacauggacaucacauuuuucacguuuuccugguaaaaaguugcaagacagugcagucuuuucauacaugguguugaugucuuaggaagcugcuuuuucaguucagaagagggcugcugcccuucgucucagugucauguuauaauaugucuuucugguggucagcaguuguccugaacugacacuagaacaacgcagugcauguggggugagauacaagcucuagaacucucggaagggaaccucucuguaaccacauucccuuucuucuucuguucucugcaucucaaagguggaagaugcccacugagguuugcuguuuguuuggcuugggggagugaccagguguuucuuguuuuguuuucuuuugcccuauaauacccaauaucauuuuuugagaaauccauaagaaggauaaagcuuacuuggauuacauuaaugagagauuuuuuuuuuuucaugacacauucauccauggauuuucaagagaauuguagaacaagguauuuuacucauugcauacaguccacuacuuuucucaagccuugcuggcaaacucuggagaucauauuagaccuuucugaauugaaaaggucaucuaauuagcccuccaauuagaggaauauaauguaugggacacagcauggauucacaguaguucagcugguggcgcacccaguuaaggaaagaagcugucaggggucuuugggaguuaccagcaucagcaccuucuacucaguucuucaaacuuuuucaauguuaugccacuggguauucucagaagcagugcaguucagugccucugcaucugagcauacauacggaggaggaaguguaguaaguuauuagauaccagcuauagagaauaggaaugucugcaggauauuaaccauacacauuugguuagccacauacuuccuuccuauuugcaauaauauccaguagcccuuccugauggaaagaaguaagaggaccuccuaccauagcacagaccacugagacugcucaagggugagaaugcgucgucuccccauugggacauaccaucuguauacauucacagggugugacccuuugugguuugaggcuacacacacucccuugcccucagagagaacuggucauauaacuaacauaaugguuauaauaacuauuauuguuuuauuagucuuuaacuggccugcauucuaauacguggucuuuuccacguuuuuaaaccucaaaccaaacaggguugaaggaacagacuaccaagauugauuuaauacaccauaugcuaaagauuacccuggaauaucuaucugguucaugaauuaaucuggcuuagaacuuuaacuucgaaugacauguuaguauguggcuugucuaguagaaacauuauguccuuuucucuuugaggacuugguuucacaguaauuuuauuauuagaguagucacauaauguucacuuuauauuuuacaagaauauugagccuugaaguagucaggcgaugaacaagcacagagcauaagaguaauaagaauuguauccagcaaugugaaggcaucuuaguuaccaagaccaccagcagagaacaauaaacuaguuugauuuaaaucuccuccauuuccugugcacgaucaggaagcccaacuucccccugaauuccuaggaaucccuccuguuaaaaaauagugcauuguagucuauauacuugcguuuguauuuuaaaaugguuguaguaggagugcuggaaauguuccuucuuuuugucaucuuuauagauaagcacauggcauuguuaugcuguuucuaaugguuuaauaacacgagggucacucggacacaguuuagaaaaaccuacuuugaaagcagucaucuucucucaggcaaacacagugugaauugugcugcuuauucuuuugaugccuucaugauguucccagccuuagaugaugggugugcauuaaaggggcaacacauuuuccaaauucugauuuuuaguaguugaucccaaggcaccacucaucccaguguuuuguugaggguguguucuaaugggaaugaacauuuccccaaagcugaggcugagacagaggguggucuagcauguaacccaagauacaaaaccuuucuuucugcuucaucuucuagccagcaacaccaccuguguucaagccaucugaacaauacuuggguggcaggcagugucgaagccuccuacaaaaauuacaguuccucuuaauaacugcucaucuuccauucauauuuguauguuacagcucuacuuagggacugauuauauuucucuugggcaagauaaauugauuagagccaaaauuagaaaucgauaaagucuuuaccaagcaaaugcauuaguuuucaucuuucuguuacauggacauuuugaucaucucuaauaugaauugacaaaaaucuugggccucaaagaguaaucaaguccuguuacaucaaacccacauuuucagcuuuaauguaucuugcuaaacauggcccacuucucaaugcaaaaaaaaaaaaaaaauucugccacuugagaauuaaaauauauuucuuuuccaguuauacccuuuguuauaucugucacacaaauaaaaagagaaaucuguaagagaaagacucauguagcuuaacauguucaggcaaucuagaaaauguagcuucuccaguguuuccuggaccagaacaaaaggcauuccaagugaaagggcaaacuggccccaguaaacugcuuugaaauuuaagcccuuggguuuggcacuccagcuguugcaagguaaaaucgcuucauguuaaaaaauagucuguucuuaucagugguuuccauggguagccuuuguaguuuucugaaauauuuucaugacgcgaugagguaagaaguugauucuauuuuuaauucuauuuccugagucauaauaucucccugcauaaaacaggcacugauagaauguuuaguuagaaagguguaguucuaaagaaaucagauuggucauaauaucuugccucuucuaacgugugauuuuuggggcguauauauuuaguuuuuaaaugcuccuaaaauauuuguauugguuuucaauacuuuguuuaguuucauaaaaauauauauauuauuuguaaucuucauuuuaaaguuguuuaaaggaagaauuaaucuuuugaaagccacuacuguagcagauauuaucuguagugaagcaauaucuuguucuuuuuuggcuuagguucuuuguuagauaaugugauuuuuccaauguagcucugaacuuuuugugaaaaucuauauucaaaucaagcagauaucacagauuauuuugacugauagaucuaauuuuuagguauauaauaaugaaaagaaauaucgcuucuaggaaaaaaaaaaagauaaguacccccaaauaccaugguaauacauacugaaaaaagguuaguaucaucuauauuucacaucauuauuauuuucucuuuagaaugguuuuuagguuuguuuguuguucuuguuguuugaggcagaguuuugauccuguugcccaggcuagagugcaauggcgcaaucucaaucucggcucacugcaaccuccgccucccagguucaagcgauucuccugccuuagccaggcauaguggugcaugccugcaauccauguuuuuaguuuuuaaaggacuccuuaaugcagaaauucuucucauuuucacacuagauauaauuuguuguauuuuaucuuauauuaaauauuuuuaauacucuugauaucugagcugcucccagugguccaauuguaugaugucagacccucauuucaaagaacuugcuuauacaauaccuaucaugaguacuaaugacucauguauuuuaauaucauaacuuugugauauggaaguuuauuuugucacgagauaauuguguucuucuuaucaugugccagauuucuuucaguauuuuagcaauuaacaaauaaauauggguguggguuuuguaaaccaaauaaaguauauaucaaaacauuaucggcugggcaccgugacucaguccuguaaucccagcacuuugggaggccaaggugggugguucaugaagucaggaguucgagaccagccugaccaacauggugaaacccugucucuacuaaaaauacgaaaauuacuuggcgugguggcgugugccuguaauccuagcuacucaggaggcugaggcaggagaauugcuugaacccggaaggcagagguugcagugagccgagauugugccacugcacuccagccugggcaacagaacaagacuccaucucaaaacaaaaaagaaaacucaucugacaaacucaacauauaaauauaugaaaauaacaagcauaaauuagcuaugcuaagcagaggucaggagaauuaaauuaugaccuggaaaagccauagaauuggaccacugaagauccgaccccacuacugcauuuuacaaguguggaaggugaugacaacacauuuguaagaaagaaggcucucuuaguucaagaauggggcuggaaagucuuugaaauuauauaccuguuuaaugaaguuuugcuuggauucauugggugauuuaaccuuuccuuuucuuauuucacaaaauagugaaaaacaaucuucccucagaacuuuaauagguuuuauuuagauacuaugucuauuugcuaauguugaggcuuuaguaaauacaacauaccccaagugcuaggcauucuguuaauacugaagaccacaagaauccuggaaaucccauuuuaucacuuaguucuaaaggcaagauaccuuccaaugauacauguuaaagaaagcuggcuuugaauuguauacuguaauauaugucuuuuauuauucacaauacucuuuguucuucucuuuuguagauaaaaauaccaguguuuaaggcaguagagauaagcuucaugaauauguagacuuacuuuaucucuggaauucgaggccauauugacuuuuaguagcauaccaguucacuuuuuuuagugugaacacagacuuuuaaauauguggagaauauauguuauuuaaaacauuaaaaauauuuucucuccuuguuagccagaccuguuguggaaauuuuuguuuguuuguuugguguacuguaggacugugagacgaauaccccguuuugcuauguaucaaauuucuauuuauuugaaaacagauggaaguuauuugugaagauaauuccauuuacuauaaaauaauauaaagaaaagccagacucugaggacuccagagaccugaaaguagucuauacuugucagcaaugaccgucacauagcuugcuacauucaccagcucaucaacagcaaggggaaagucauagcaaggaaaccacuuuaucuuuaaaccaaggugucagguuuauauuuuaucuguaaaaaaguaacaugaauauauuugacaucuaccucagcaaacaaauuaaugcuaauuaaagauuaauguguuguaauuagcauuaaaaaugcaauuaaauugugaguaaauggaccaggaauagaaaauuguuagacgucucacugccugguuuucauauucugccuuuuguuuuugcagcaaauagaggaagcggggcagccggcagcucccagacuggagaugcucuggggaaagcacuugcuucggugaggaaauauugacuuuggacuccauauguaccauuguaaagggugaacuuuaaucagaaguggacauuuggaauuuuagaaaaugaauggcaaauagcuuugauuuuuggaaaaugcuagcuuucuugcauaacagucacuggaaaauuugagaaggcucugaagcuuccaguauauagucucuuucucucauccucaaaaugguacuaagcugcacucaauuauggaugugggaauauucuccuggucuuuggguuuauagguuuuuuauacugaugucuuauuuuucucuaaaguaauaugggugcacauugaccagcuaagacugucuuagcaaggaauaguucuaaaacacuuugaaagaggcauuugaaaaaaaaaaaaaaaaaaaaagacaauaacugagguccaugaagaacugucacauaauuggcaccugggggacucagcuucucugcuuugcccaccuacugccagaaagcuaaaauugaacauuucuugcauguucccugaugacaaaauggcauaccuucauugucucagagaguauaucugguauuuuagucaaaagcuaaacauggucauuuagaaauguaaguggagggccagguaguguggcucacacugguaaucucagcacuuugggaggccgaggugggaggaucacuugaggucaggaguucaagacuagccuggccaacacggugaagcccugucacuacuaaaaacaugaaaauuaacuaggcauggguggcacaugccuguaaucccagcuacuccggagacugaggcaggagaaucgcuugaaccugggagguagagguugcagugagcugagaucaugccacugcacuccaacuugggugacagagcaagacuccaucaaauaaauaaauaaauguaaguggagauuucuuucucuaagauuuugucucuucaguuggcuuuuaccauugagagcauuaaaaaaguucacacuguauuagcauugugcccuaaguaaaaguuuuuguuucaucugggccuucugaugcuaugcaaucaaacgccuagaucuggcaaaagaguggcaaaauaucuuaggaaugauccuguucaaccucucauuguguagaugaggaaaggaaaguucaaaguaucugcuuggcuugcccauagccacacagccaguaggaacgaagaguugguuugaagucugcugaccccagccuggcucuuuucccaccaucccauaccacaucaguaauucuuguuuugaaaaauuaaaauaauuguuaaguucuucauuugacaauuuugguacuguaguugauuauuacauguaugcuguaacuuguaaguucuaaaugaauugcguugacaacuucguaguuuagaaaagugugaauuauuuuaaugaaugaggguguuuuuuuuuucuccuuauuguuuuaagaucuauucuccagaucacacuaacaacagcuuuucaucaaacccuucaacuccuguuggcucuccuccaucucucucagguaguguauuucaaaucccauuucaucauauaacaguuuauaagaaugauuccccccuuguacuuccugauuuuguagguggaaacucacuuccccccaaaucccaaagcuuuaacauuccuauaacagacaaauacaaagggugggagagacaaauuaccagauaacaguauagucguuuacauccaaaccuuuucuuaaaaauuagauuaucuuuuuaaaauauacaggcauauggaaaauguauuucuuacacuuuucuuagcucugcagaagacacccaacggcagaauaauguauuccaauaaaacgucucagaugaaaaaaacucaguuaauauagucaugaauaugaauauagacuagauagucaucaaauauagacuauuuaaauggaucauuuccugcaggaauuucaggcuuuccaaauucccucuuuaaaguacaugccauugggauguuuagagaaaacuauaauuuuguaaauaaauugugaaauaauugugugggguagaagggauguuugacuucaaaguauaauacauucguaugaccuguggcuucaaauugaauaacuauaauuuguagaauuaugucaguaaauaauuucacuuuucagggguccguuuaagagacucauugucuuuccaauauaaaugcuuccagaaagccuuccuugguucaugucucugcucuuugguaaggagacagguggcuuauuaaaaaaacaaaacaacagcaacaaaaccuaaaucacaucuguaccugauggaaaccuuaccuuacuguaauuuauaguggaguuacuugcguuuguuauuuccugcaugcagcucucauggcccaguguaaacucagcuccuuggucgaggacaggagguuucacauugccacaaaacuuucagaaaugauggccauggcuuagcugggauuuaaugucaaccucuuccaagccuccgugguaugagaagaucacagaauagagagggcagugggauucugaagucucuauguccagagagaccgcguugaaacugggaagcgauugaggugauuuuaagaggauaaucaaacguucccccugguggaaauagaaacuagaguucaguauuguuguacuccucggguucuguaccagauucuuacacucugaaaaaugauuucaauugucaguaacccccuuucgagacaacaagagauacaacaagggauagaggaaucugagcagguggaacuccaguuuccacauuucaaacaaaguagcuuucauuuuauucauuuucuaauuuagaaaaagaaauguucuaugguaucauaauguuugagaacgacuaauguagucugauacccugauuuuacagaugagaauacugagucccaaaaagggaguugaguuguugaguuuauuaccagugguaauagcagagcuuggacaaaaaucuggugcucacaguucugccauccauuucuagauuaauggugggaaagaaaaauuaggaugcacagucauucuagaaaacaucacaaauucccucgaccugaguagcaugaucucagugaaaggcacagaaacaaggcuagagaugccacuuuuugggucuugguaaugcaucauggaagaccacauguuaggaagaaagaacuuuuaugaagaugcaaauauggggacagauugcuauuuucacaccgacggcucuguccaaauucugucaagaaaaguaauugaacaaaauauucuauuuuuauuuagcauaaaaauauacaugcacacccagaaaagacaggaagaguggauuuuaaaagugcuaacagugucggggcaugagauuucagugagaucauagcuauuauuuuuuccuuuuuugaauuauguauuuuccaaguuuucuacacugaauguguauuauuuuacauuuaaaguguuuuuuauuuuguagguuagacauguaauauguauucuaacagcaaucuuuuuuuaccuucaaguuuaaugaaucauaaaaaaauuauuuucuucagaagaaacuuuuagucauugcuguauauugacuuuaaauuucuggcuuaguggaucacugauaacuaaucuuauucccuuaaaaaguuuuucaagauuuaucuuuuucuaaagauuguuuuaaaaacaaguggcaaagcuguuuuccacuggugcgagaauuuugguuuaacauaaacuagccuugcaugaaggucuaacaaaaucccauuuuuguacccuuaaaaguaccuugauuccauggugauaguuuuucuuccacaggaacccuucuuaccaaaauucagaaucaauuaaauguucucuuuuaggagacagccagccugggggaauugugagucuauguaaagucuacauauuuuacauuuaaaauguuuuccuugucccaaaauucuuauaugggaaguuuacauguauuuacguuguuguuuaaaugaaaaucaucauugccauugccauuuccaaaaggacuguuuaaaauauuggcaagcgucuuuuuacaugugucuagaucugauuguaauucccacuuuaauaucagcaggcacagcuguuuggucuagaaauggaggacaggccucaucgucuccuaauuaugaaggacccuuacacucuuugguaugucucauuugcuaaucucugucccacccauuuucaggucauguucuuucuuguucagucuccuuuacucuccaagauuuugauuuucccuguuaguaacuuuaagucagcauuaagcacacagguuugcgggagccagagucauuagccuaugcuugcuccuauuuggagaugggaacccagauacuacuguaauggcagccccagggcucuaaauaucuaguagcagauaaaauccuggaagggcaauggccuucuccccaucucuaggaaagaucccugucaaugauuaaaucacuuuccugcuaucagagugcuggaacuccagccagguccuauaccuggaacauuugauucccucuaccucugcuuuacuuuccagaauaacagguuuacaggagcuuuccuucucguagaaacccagugguauccuucgugguagagaaaugccuacucuuccaggagugaauugcugaaaauuuccauggauguaguuaauuauuauaaauacucacaugaugauucagugucugacacuucagucuuucucuccucaugauggugggggccagaaauaugcaggaaacaaugcugguugugcagcauuuaggcuguacaugaauuuagcgggaaggaauagcaguaagggagaggagccuuuuaguuccucgggguugagguuuucuuuucucccuccuaucuugagaugacacauggaagaagacauagauuuaucuaucugcuuuaguguugucuuauauucuucccuuucagcuuaaucuuaaggaaaaucugaaaagaaaagcaaagguggauuucccuccuuugcuguguucuuccuugcuauaguguaugaaucauucagcuaugcauuuuaaccaguaaaggaaaccagacagugaaacauauaugcacuacccagcccaauuaaucugcggaccacauccacauaauuaguuguuuuaguguuuaccuucaucaguuauucucuggggccuauucaucaaaaccaggcuucguccaacuauagaacuguaaagacgggguguauaguuaugggccacagcuuccauucuguuugaauucugaacacugaagaagagauuuacaagcagaaacugcugucucuaccaggaagcugugagccagaaacugugauaggcacauguaugauuucuuuuccugcauacauuuacacucagaaguaaguauguauuaucauucccauauuuauaaauuagaaagcaugcacuccaagagguuuaguaacuuuuccaaggccaaauacguagcaaagcuagcagucuaggggagguaguuuaacucccaaacccaccaaaucagaauguucuguaccauagacuacuauauuagacacacauucuuccugucaguauaaaauagaaauguuuuuucucaugcaauagagcugguacacuuguuugcacagccgauucaaaaucaaagucaauuguagcaugaucuagugcaaagagucacuagauuuaaaauaaaaagaccuagauuccaacucugacuuuaccauuuccuagcagugugacacuacguaacuaauucacuuugugucuuugagccucauuuucaugucuguacggaaggaaucauaaugucuucccugccugcccauacacacgugaaacaaggaucaaugagaugguauauuuuaaaguguacacuggagagugguauuugauaucauuauugaucaguuuuuaaaaugaauacauaccuuuaaaaugaauacauacauuuucuucacuaaaaacuauacgcauugucuaguugugaaaaacuagaauccuaauggcaaggaugaacaaagguugguugguuuuuaaugguuuaaaguugcgaauucuaugcuauaguuggggcuuugaacucaguuagaugcccccagugaacaguugauucaaguguuugugauucuucagucuuaaaaucuuauacuacuuuaguugacagaauuuauauaauuuuuuucuguaaccauuuugaggcccuuacacgcauaccaccacacacccacugguuuugaugacaggaagccagaaacaccgguaaaaacucaacaagaaauuaucauccauuugcuuuucccugucucugauuugguacuuagcacugggucauauaccacagggaagaccaaagaaauauaccuucaggaaaagaauuuaauuaagaaacuauaaauaggucaucuuuccagugguaauuguuuaaaacucuuuaacuuaauaccugccagaaaguuccuuaaauucagugaauguuuuucucuucuaaaauaaauuuaaauugccuuucaaaaggcaguaccguauauagcacauguauguuauaauguccuggaauaauuauugaauuuaguuuguucaugaaaaauaacacuauaauuuuaacauuaacacguucuaccaguuuucuggaaacaacacuauuuguauuauuguuuuaaggaaauacauuuuauuggaaacauguauuuagaaacacaguguguuuuuugucgacuaaaauuuuacuuguauaauuuaggcaccccuuuugaacuaaaucaaauuuuacaucauuuguuaaccaacagcaaagccgaauugaagaucguuuagaaagacuggaugaugcuauucauguucuccggaaccaugcagugggcccauccacagcuaugccugguggucauggggacaugcauggaaucauuggaccuucucauaauggagccauggguggucugggcucaggguauggaaccggccuucuuucagccaacagacauucacucaugguaagugaugaaauuuauagacucuauaguuaucauauagaguuagaauuucagauauagauacuauuguugcuguuuuuuaaaaaaucagcuuuauugagauauaauucacuuaacauacgaugagcccauuucagguguacaauucaaguguuuuaguguauuuacaagguugugcaaccaucaccauagucuagguuuugaauauuuuugcccccugcaaaaagaaaagaauccccguugcccauuaagcagucauuccccaucccuccacuuccagcccuuggcaaccacuugucuacuuccuaugucuauagauuuaccuauucuggauauuuugaauauauggaaucauacaacaugugguggucuuuuuugacuggcaucuuuuacuuagcaugacuguugcaguuuuucuacaguuugccacguauuagagcuuuauucauuuuuauugucaaauaguauuucacuguauggacauaccacauuacacaguuggguuguuccaacuccuuggcuaugaugaauaaugcuucuauaaauauucauguuuaaguuuuugugcagacacauguuucccuugaggaugaauugcugggucauuguugguguuugaaauuauucauuuuggugacccuggccaaaguguacaauuugaguucauauuauaauaugacauugcuaguaauucaaauauuaguguuuuuuuuuuaauuaaagaagccaaaauagugucugucaauucugagucugggagauagaaauauaugguauguuuauuuguauaaauacauugcaugugacuguguaauuuaauagaguagcuuuacuacuaccuauuuagaauaagucuuuauuugaauuauauuuaagcagauuuguccauauuacaauugugauuuuuuuccucauuacuuuugaaaggauuuuggagauaauucuuuuugaggaugauuaugaagauucagagacucuucuuaauagaauauuaagugaugacaauuaaugaggugaccagagugguggagaauguaacuugaccagugauucucuguaguucugauccucacaagcucuaccucgucucuaagcaccuuaguguccuauuuugccccuuacaggcucgcuaaaaguugcuuggaugaagguauauuuuccauuaucacuguagcauuucucguuuaagcauggucccaaaaggaaaugcaaaauacauacaaauuauuaugagguucuuuuaaguucuugcucaguaguauucuccuguccaucuuucaguuucucuuaauaaaagucuaagauuaagaguaccauucugaacgguguaguauugaaaucugcaaccaauuugaaaccaaaaauacugguuuauaaauagaagcaacgaacucacaucuaaaauguggaaagauauuuuugaaugccaaagagaaaucuuuuuuucuuucccuugaccucugcccuaaaaauucaucauugaauaaaaauuguuuauauguucauggcaguugcuuagaguuuacaaaagaaaagucuagauuuuaauuuagcuuggccucagguaauguguuaaauacacuugggaugcauauaauaugagauuuucguuuguacagcucuuuuuuuucuaacuacaauguuuaaacauacugcuuuuaauuaagaaaucuggcuuuauuaaaagccagaucugugacuuauaaccauuucuguauaucugcucucaaucaacagaaaaauaguuuaauuucuguagcuguguucauuuugcauauguuaaacggauguaacaugcacccagggcauugcuucagagacuauuuuuuccauaaauauguaaaguuuuucuuaaauaccauauguagguuaagugguucuuuuaaauauuaaacuauacauaaauacuuuuggggacuauuugaccuuugaauugacuccuuuuugagucagauucagaggugggaugggaggaaaagacuagaauuauuuuuggagaugggaaguuggacugaccucaguagaaccgaaagugagacgacugaauagaacgguagaaaaaaggaaauaauuagccaauauuacauagaaaccccuuuaauuugaucuugauauacacacacacacacacacacacaaaagcaauaaagccgccaguuuugcugauaaggauaaguuccuguuuucuccucugaagacauuuaauauucaaucaaggacagccacagagccaagcagaucauagcguaacuccaaagauauggcaugucaucacccugcugcccuuugaaccaaaugggguuuugcagucucucuccuuucuuccugaaaaccauucaacguguccccagaaucugagcuccucagccugaaacacuaaugugugugaaaaggauugguuuggccuaucuuucccgugcaaacugguaugaauuuuaaaacaaaaacauaagaacaaaggaaauaguuuuugaauuuaaucagucugaaguuagccuuugaccauuugauacauuccacaauaaaaaggaaguuuaaggggaaggcaaaaaaaaaaaaaaaaaaaccucaucccccuuccccacaacaacaaaaaaauucaaggaggauacugguaauguuuuccacauuugaauuuuaauacaugaaacaggcuauaaaacuuuggccagcugcaguaaauaaaguagccgugggagguaugcaccggaaacuucagcagagagcacuggugagagucucauucccaacuacacaccuucguuuguuguucugggcggaagcgaguugcaguaacuugauacucaucccagucccgguuuuguauugagcacaucgccuuucuaacucuccucaguaauuccuucugauuaaagaguagacagcucugaauccucucgaccuccguacgcuucucauuuccuuucucccugccuuccaaaaaucaaaacaaaauggcuugauaacuuggaaggugauauaagcauuucuuucugcagcagcuugaaguugugguggggaaaacugugguucugccucggcuguuauguuaucucauuuaauugcuaacauauuguccuuagcuuuugauucauaaaauguuuuccuuggaguucugaaguaggucuucagugauuuacuaaguauuaguauaaugaaagggauuuuuuuuuuucacagcggcauggcucauaacacaagagcgaauguuuguauacuugcaagcucucuggaugauauuauugagcuaugcuuauuuccugcucaaaaaccuucccugccuuuccauuuucuacaagauaaagaccaauuccuuagcucagcauuugaagccuauuaccauuuaccgaaagccuuauguugagcucuuccaaucugcaacaagucuuccagcaagacaaggcugggcauauuaccagaauucacccuguauguucuccuucggaacuuuuguaucucuuugucuuguccagcccuaucugcuuaucucuguacaccuaauacccacccauucucaaagcacugacucaaaucauucuucuuccaggaagccuucccuugcuaccccacucaugcuagccauuuuuuucucuauucuuacagcccuaugaaucauaccauuucuagauauuuaucuuaaccagcuccgcauagcugugcaucuuuuauagauaugacucugccuuaccaacuguuguaaauuccucgagucucacauauuauauuuugucucucuccccccgaccccuguaaauagaucauccauagaaacgggagaaaagaaacgaggaaacuuaacauucugugagugugaguuggcagccccucugcuaggcgcucugcauguguugucuuaggcagucuucacaacagcccagugaggaugauaauaguggucauuucaggugucgguaaagugagccuuagaaguuugagcaguuagucucaaguccugcagcgggauuuaaacucaagcacaucaacuccaaauucaaugcucuuuuuuacuaccaggcauacucuccagagauuaucuaugagaacaccuuuucagaacuuauuuuaaaugcuaggagcuugugauuuucaaaacuugauaaguguugguuggcaaaagaaguuuccagguauuccauggcuggguucccagagcagcucucuucccaaauguauagacagagaacuuucccuccaaagugguggcaugcuuggauuaaaacccacauuaucuaugcacuuauucuuaaaccaacauguuugcgcugagugccuaagaggugugaacucucccuaccaggguccuugagguagcaaauuuuaaguuaucaaguuauuuuucuuacuauaaccacccacuuuucuuccaaaauuaaagcagaaaucucugaaugugggagaauaaggaaauagccaggucuucacuacccuaguuagaaacucuuaccaaguaugauucccucucugccucagagaccuccaugauuaauccugauauuaaaugauuagauuucuuauaaauuauggaaagggcaauuuuccagauagaauucucucuguuacucauucaguauucacauccacagaugaggccugaaaagaagcguuucaaaugaccuaaccgcuuuuuuaacugacuaagaacaaaacccacaucaaacuugucuuuaugugacucuauguguucccguuuauuuguugguagagucagcaacuacgugaucauugagcuaaaaauccccucuacuauucauauaucgcauuaguguagcucucagauccuucuuguuuaaagucuauuuauucauuucaauaacauuuauccgugguuaccaaguguagguucugugcucucaaggaauucacaggcuaguaggaaaagauguguacuuaagcagauugcucccugccagucugcuaugcccucuaaaagaccaggggccugacccuuauccaguagugaaagaucacaugguuguuuaguagaggaguggucaucuccaguugacuuagggaugggggagucaugugcaacucaccccacacaccuguccuccacagcaucccuucagaguccugcaggugggggauguggaacccauuucagaaaucaccaauaaaaguggaucuuugcccaguuuuccucuuuucaguaacaauuuuuguuuuacuuuggauuaaaugcagucuaucaaaagagcauuccuuaggaaaagugguaucuuuuuauuuaacugacauuauauacaugagaacuuuuaccucuuagggcuucauaggacaaacaacuucaguuaguuuuccuuguauaguuaagagcucagaccacugaauuuuagauucuaaaaguacccuggaaaucagcccauugcccuucuuugaagacuaaggccuaggaaggggaagugaccaaaccauggguacucacuaguagaauuagaaaccagacaaaagaggcuggacacgguggcucaccccuguaaucccagcaauuuaggaggccgaggcggguggaucacucgaggucaggaguucgaggccagccuggccaacauggugaaacccugucucuaccaaaaauacaaaaauuagccgggcaugguggugcacaccuguaaucccagcuacucaggaggcugaggcaggagaauugcuugaacucuggaggcacagguugcagugagccaagauugugccacugcacuccagccugggugacagagagacccugccacacacacaaaaaaggaaaccagacaaaacagcaagcagaccagcacuccuugugcuauauccuacacugcucagccgacuuccucuuuacccuaauaccauaaccauuucaaaacugugagugguagaaauuagaaaccauucuguuacucugacuuaacuaaugaaauccaagaaaacucuguaguuggcccuaggcugccugcaaugaguugcuauuuagcucuaccaguaauauuuggcaaaaagagaggguagugggcauugaugugauguggcaguuauugguacauagucaugggagcagcaggagucagaagauucuguuucuaugugggccucuucaacaaagauaugaucaacagaggcaucagcaucuucaguugauaaaguugauaaaauagaaaacuauuuucuaaauagccuguuacagaauuucagcgaagcuauugguggucagcaucaucuuuuaauagcuacuaucuuguuuuucuuuaaauuaggauauuugccuucucuaguguucugucaucucuccuaaucuccacaacuaucagguauuucggagagcagauuaguaaccucaacugaaaguuuugaucuuuaucaauuuaucaguugcuccucuugggcuuucacagguuuugauuccauaaaguucugugucuauuugagugcauacuucauuucuaagcaguuauucccauggacucucagggaauuuaagagauuaucucuacugaaaucucccuacagauuuccugccaagcagucaacaagucuugaucagccuccuuccuucaagggugacuagcuccaaaugcccacaaaguccauuuucaucaaauauuugaaaguucuuccuagguccagcccaaauuugcuuuuuucuacaguccuuauguuucugcccaauagaauugcccacaaaucaaguccaacaagcacuugagaaacucaguuauuugaagacagucugcugaguguuuuuucccucuagacgaaacaucacuaucuucaaauauuuaaccugaaaaaaaguuuggacucccugucaugaacuccauugcuucccagugcauucucccuaguuuagcaaggaugccuuuuucuccacaagaaccuuuuaguguguggaaccgcaaacugaacacagugcuuaagaaaggaucaaguggacuaggguggaucuaucuccucccccauucaguaccuuguaucuucauuaaggccaccuaacaauauccuguuuugcuauguuugaugcuuucauuguccugcugacauauauucaauuuguaaucaacugaaauccauaagccaccuaucuccccagucucauuguguacuuuuuguugugucuguacaaaacuucaugaaaccccauugaauguuauguuguagccucagucugauuccuguuuaaugguuucccugaagcccucauucagucacauacucugccaucucuguugcuggcaaaugugaugggugugacuaaugcccacaucaaagccaccaauacaauauuuucaggggaggggauugaccagaaggccaugaggcucaguguuacagacauucuuucuacacgagugcugucuucuauccuuugaguuuaaucucagcugguucugucucccuccuuauacaccguauggcccaccuuugcucauuuuguccguagcguugucacagaagccgggcaugcagcacucacugugaagcaggaaaugaggcuuguccagaaugccuugcucugguggaaccaaacugaguuugagaggccauuccuguguuucagagcacuuucaaaacuauuuucuaaauacccuguuacagaauuucacccaagcuauugguggucaacaucaucuuucaauagcuacuaucuuguuuuucuuuaaauuaggauauuugccuucucuaguguucugucaucucuccuaaucuccacaacuaucaaguauuucggagagcagauuagcaaccucaaccgaaaguuuugaacuuuaucaauaucauacuuuauuuuuuuaaaacugaaaaaaaaaaggacagaaagguaaaagaacuugaagaaauucuuuuagccauggaugagugauaacagcugagaauccuugagcuuaccauuugauauuucuauauuaauuuaaagaaaagucaaaagauuuugaaaacagcaauagaaguaagauccuuuaagcucuauucagcagccccuaagaaaagugaugaggacacugugcaugcccauaugugaacaugguuggccaccuuagguauuuccccuucucuccacaugaauacauauuuuacucaaauucagacucuaugauguugaaacagucuggcauuggauguuuaccucaaaacccugcucucucugcaccuaggacaaacaaauccuaguucucugguguuuagcaucuuggagccaugaauuuuaaauaaaucaaagacaaaaaccuugucuuucccaguuuuaaaauauaaaagauacacacacacacacacacacacacacacacguguauuuaaaauagacccuauaaccucaucauauucuuacauccuuacaugguuuucuucuuaaauuguggaggaaaaggcaggcagacacauuuaauagcacagugaucaucauuuuuuaaaugaacuguuacagggacauaaucuuaaacuauccauaauuuggaauaggcacaacugugcauuuaaaaaaaugcaauauuacccuuauuuucucaggaaagcagauuuucuggagggaaaaguauauauuguauauauuagaaaauauacauauguucauucacucuuucugcaucugcugugcuucagaugcuuuuggggaugcauaaacguguaaaagaaaguaucugaucuuacaggccuuuuauccugguagagugauaauacaaauaugggucuaacuauaaugcaagguagaauuaugaaaugaccuaaggagcaauucagaccgcuaggaaaagcuucccggagaagaugccauugagcucauauucgaguccacauagaauuucaacaauuagagacaggauagaaaaggcguuucagagccauauaauaaacaugauuuaaaaccaaaaacagaaaauaaaggcucaugcaccuaaauggaaguaagaaaacugccugaugauaccaguccuugcagcuugccagccagggcugcauugggugaaaagccccuccacagcacggcagcuccagcaguuggcucgaauauuucacaugagaguccacaggaagagcgagcuuucauguauauuuuuuacauccaaauuaaguuaacucauggaauuuuccacccuuaggaauuaaaguagcaacucaugaaguaauucaguuaugucauucauaccaaaacagaaaauacuggagcaacuuggcacuguuuaaaagccaagauuaggccuuggccauuuuauauuuuuucacauuccauggccguuguguuauuuuaacuuuuauuauggcuguaaauuuuucaaaucaaaaguaucuuaauugcuuagaaaacagaaguugaaaauggguucauaguaagaagaggguuuaggcaaagcagcuuuaggagugagaacugaaaaaaagcuguagcauuacauuuucuguaaugcgaggguucuaccuauuugguugacauucacaguugugcauaauuauagcuuccucuauauccauaaaucaucuuagaacuauaaaguugaguuuaaccaaaagaucuguccaauauuagugaaaugacaucuuuagggaagcauuguccugauacaauagccacauucauuuuaaagcaguuaauuggacacauugucaaaaaccacgguauugaguuuccacauuuuaauuucacauuugccuucucccuggcuucugcacacggacgggucucuuuuggagcugaaagugugugaaaguuauuggagaaugguagucucuggguaauguuucuguaagcugcccaaaauuuucccccuguagucuagaugggaaacagcugguauuuguuuaaaaagcuguuuugcaaaaugucuaaaccuugagauauagaacugaggucaccauuaaagcaggugcuuaagagcaagugagaaagacuucagaggccgacuggcucuggaaucuucugcagggcacuuccuauuagaagaaaaaguguugaaguuugcuccuuuauuuaggacacggcuauaaguauuaauaaguaagugcacuagcaauacuacuagaaauugaguauuuuugaacauagccagcccucaagugaauaauuagcucaguaugaaaggaacuaaaauggucauuuuucucacagggcuucaagauacaagagcccaaggcgcucuagucuccuuuggguguuugaauuuccucuuuaaacacaccaacaguaaaagaacuacuauuucaaauaagcaguaccauaacugacuauaucuuccaagguuuuggaugcaaucuaagggaaagggggaaaagagacccgacuuggcaagacccguaccgaagcagucuggaaaaaaagcaaagcaaaaaacauguggaaccacuaaaggccagugcacgucagguauccaccagucugaagaugaaaggaaguaagccuccuccccugggagcuggagguuauuagcagcuguuuauccagucgggaauagagauuaacauuguacuuuuuuuuuaagaacuagaagaaaauuuguuugggaaguuggcuuuucauaucaagucacugugcuuugccaaaaaaaacuuccuuucucagaacucauguacuagcauugagcaauguuaugauucucugagaaacucugaauuaccaaaaagucuuucuccauuaaauagaacagaaaaggacagagaaaugggugaacguuugccauugacacauugcaguuguacucuuuaccaugugaaauuugccguuuggucuauuaccuguucuccaaccugacucuaaaugggacacucugcccucuaccccucacacguacccucacaacuuaaucauugccacucuaaggugcacacaauggguucugcagauaccuacugcuugcaaaaagaccuuucaugagauauuggggaaacugccuaguacucugggugcuuuauucucaaaaaacaaacaaacaaacaaacaaaaaacgaguuggauauagguauuuuuccccugauuuaaugcuacucuuaaugucauuuucuuuuauuaaauccuuucuucugcuuuugaucuuauuuauagcagagccacuggucauauggaaacuauuacuguauagcugcgagaugaaagacuucauggcaauuaaauaagagugaaucauuugggccaauaauacacacauacagugagguaccauuuguguccaaaaugcccuguguuguucacuuuguagcaaagccauugagcuuuacaaagggcuuuacaaaaaucugcuuuuugucagaaauauguagucugacaauaugaaaacacauguuaacacacaguccuuagcugcuugcuucuucacacauacacaguaucuaaaucaugccacuuauugauauaaaaugaaauuuucacuuaaauuugggauauuauuuaguuguguuaagcgucagcucuuuaaaaauauauuuggauaaucuauaucaaaauucgacccaucacucaaaaccugccuaaaaugucauguucuucuuaaaguagucccugguuuccuaaacggguaugacuucaucauuuuuuaaaacccuacaugaccuuguacuccuuuaugacauucaucguauuuugccuuguauaguaauauuaucccaucauuaaaauaucagugccugggcuaggcgcggugguucaggccuguaaucccagcacuuugggaagccaaggcgggaggaucacaaguucaggaguucgagaccagccuagccaacauggugaaaccccgucucuacuaaaaauacaaaaauuagcugggcguaaaggugcacgccuguaaucccagcuacuggggaggcugaggcaggagaaucgcuugaacccgggaggcggagguugcagugagccaagaucaugccacugcacuccuuucugggcaacaaagcaacacuccaucuuaaaaaaaaaaaaaaaaaucagugccugcaaagucauagacguguuuauuuuuccuugcaaaugcccauguagugccuugcauauaguacacuuucauaaggcgcuugucaaauuaagugaaauguuuauuugauagaaacaugcuaaauguauauuuggcaauaucaaacaauuaaauuucagacauagucucacagauccauagcauuugugucaucauuugcuaagcaucuaacugcacauuguacuauuacacucccgugcagugaccugugcaguuccuguccuugggaugggaugcccacaaauggagacaaguauaggcuuuacgaauggcagcaaaacaaacuuauugaaguuuaugcccugcaccauucaacaaugaccuugaauguguuuuaaggguggugucuguaaugcauagugagcucgugaggugacaagaaaguggagauuucuggagauccacucagcccugaagggucagagagugaggggaucugugaggcuaauaaaagagaagcaguuggugaguuaggaggaaaaaacuagcccagcagacagagcagggagggcuuugcucaagccuuagugaugugggcguuaacccagcagaugagaggccaugcguagguaauugaacauugauagugaggaauuuaaaaauaggagggaacugcauugguccugggagucuaggugaaggaugcaucagcacaagguggaccucuuagacuggauccauacagcaagcaagagccaggcugaagccuuaauauugcaucaacugauggagagagaauauugcauuuaaaagaugaguauuuggaaagugauggggaagaaaugguucauucguuuaggugagcuucuuuauacuucuacucucuuuucaaauauauuacaguaagcauguguuacuugaauaacaagaaaagcauuuaagaaauaaaggccaauggguaaugguaaaucccuagggauccuuagggaugggccaccuggacuggcuaaaaacuguguggaggucagcagcaugacugugcacucucacagguaugcuugcacuucaggcauucagaauuccaaguguaaaucaaguguccaguugucuuuuccuuuaaacaaaagcuguuuacacauaauugcuagacuucaccauauucucugugcuagauauguuugguucacuaggauggauuaacuuuaguuccauaccaucuacuuacuagccugcuauguggagcaaggaagagauagaggaaugggcucuguuaaucugccaguguccccgcuaggugagcucucuccaguuaugguuuccacuguauaggaaaaugaugucgagaauugagggugugggacacagaagagagaaaugaaacaguuuuaauagauggaacguaugaguuaguacaagaaagaugaacugaggucggcucacauccguuugcauuucuugaacuauaucauagaaucauucauuuaaccauuuuggugaacauccaggggaguuucagcccagcugaucauaugauagacaagcacugccaaggucaggaucauuuagaucauguuuaaauccucuugaaaauuacuuuauuaucuggagaaucaauauuaaauaaaucuccaagaauugcacaauaaggaauuaccuuacauuucauacagaacauaagagaagcugugauguuucuggaaaacaauguagguguucucaagacaguuaugaaaucuucucccgacauacauguuaagaaucaaguaaaaauccaaacaaaagaauugaauccagaucugauguuaaugaaaagucucuuaaagguuuaaucacauguacuaaagaaaaaucaucugauaauuuuuuaaacugagaaauauggaaauuauguuugugguuggagugucccagauguuagcucuuucucccacaacaggugguuauuagagguaggucuuguuuucugcagagccucugugccucuaguguuguuccucacaguaucuaucuacugcugccauuccaugaacuuccuaauucccaucugugagccauuaaaaaaguuugcaugaccgcuucccaccucuuuaaaagaugcacuuuuguacuaaaugguguuuugcacauuugagaaaauaaguuugcuuuccucuaauaugacagaggucuggcaagauaauugaaacugaaaucuaguacucuacaacugucauguauaauugauauuucauggggagauuacaguucagacaccaaaacuguuuucuguaucaauggguuucuaauuacagugaaaacccaucagcuuuucuuuuguguuaauggaaaaacaacagagaaaaguaacaguaaguugcaguuaccaggacuucugucuuugucccauuuuguuguuguucuucuuucuaaaaaccaaaaaaaucuauguccaaaauuggaaaccagaugccauuaauagcaaacuuuaauuuugauguaccaaaauguuuauaauaguauauccaguuuugugucauuaucacuuggucuagaaacugaugacaaguuuccuaaaguucccauuguauacucuuuuagaaggauuaugguagaauagaagugacugaggucugaaagccuguuuugaagcaguuaucucuggagauaacauuaacuaggauugaauaacugccaaaugaaauuuaauacauuuucccauccaugaaauaggccucuuaaauacaacagaauaauuacuuucacaauacucccuggaaacaaagagagcaaaaauauugaaugucuuuuuuguuugugguguuuguuguuagcuagaggauaaggacaaggauauuuaccacaaugcugaaugcaucuccauauaaaaacagccuugccaacagccaccuaauuugaaucugcaugucuuuuaaaucuguuuauguuggagggaucguggcaaauauuaaauuuuauaauuuaguuagacaucuuggccuuggccugaguuaaugaacuaugauuuucccccugcaauaaagaaaaaggaaaugauuuuccucuaucuauauauguacguauauauauguauguuauaugcuuguaccuagguguguguauacauguauggacacacacacacacuguuuuaaaacaaaagcucugggaaauaaacgcaucuugcccccuaacucuccuccccucuccuauauaauuguucaguguuguaaguuuucugaguucaaaaucuguuuuagaucuccaacuaagcaucgaaaguuggaucuuaagucacuucaccauucuuggccuuagcuuucuuuguaaaaugaagaguuugaccuaacugauauauaaccaagguccuccaagcccucgacgucuaaguucugugauuuaaaaguguuucuaucaguuugucaagcccuuucuuggaaacuaagguuauuuaaaauuauauggugcuuacgugauucaaaauaauuauugcauaucuaaugacauuuaauuauuuccauugacaaauucacacaggagaauucaaauagcuguguuggaauuugaauauaauuugaccuaagauacaauguaacucagacauuuacaccuacauguaccagucaauauguggacgggacaggccaagccgccuguguuuggacuacaugaucuuauccccccuuccucguuuguagcucucuggaccgggaaaaugccugucauuaagguggcccauucauaguaugaccuaugucugcuucaaaaugagcugggccauccagugaucuuggcauucugagcuuagaaauacaaagacaaagaggaaauuagcaggagguacagaaccagaaagaaugcaccaagagguaucaugaagaaagaguccaaucugucaucaugagagggcagaagccagagagaagcagagguccccccagagagaggagagaggcugaauagcccagcagaggcgaggaguggcauucgguucccaagagcucucugaguccaaaaccuaagcuacagaaaacuauuuaugauaaaucuuuuauuugaacaaacucaaauagguuucucuuccuuacuauuaaaacuaccccacuaaauugaucagcauacaaaaauccccccaagaaucauuaugaguuccacaaaaaccaggaccacaucugaguuauuucucauucuauccccagugucucccaaagugacaggcaugagcuagauuagaaaauguuuguuaaauuaguaaaugcauucucugaucaaucaaugaauaaucauugaauaauuuuuaaauuucacuucuaucuucuauuuuuagcauagauaucacuaaaacugcauuauacgugacuaugggaagauucacauuuacaaugaguauuaauaaaauuuucauaagcuggcuuuuaacuuuagacuauuguuaucucuaugaaaagguuaucaaaauagagcuuuaacgaaguauggauuuucuaaaaauagggacgaaaugucaugcuuagaauugacuugugggaaucuccuuucuccuagucacauuaugacguauuuaaguucagaaugccaagaucauuggaugccccagcucauuuugaagcagacaugggucauucuaugaaugggccgccuuaaugccagugggcaaaucccugacccuuguauauacagagaacagugugaguuucuccaucuauuucuguguuauucuagcgauggauuugugccgacaguccacuguguuucuucccuugucucuuaugugaccagaaauaauguuucugaaagagaagaaaacaggguuagaauaugccaucuguggccaaggaaacaagcaaagccaagccaauuauucaaauuggaauacucuuccacagccacaggcaauggaguugauccuauccuggagaaucaagcucauuauuacauggcucuggaccuaucagagggcauucacaugaccuggaauagacacaaggggagucuuaaaacaucacgacaaauuagccggcgugguggugggcgccuguaauuccaguuacuugggaggcugaaacaggagaauugcuugaaccugggaggcagagguugcagugaacggagauugcaccccugcacuccagccugggugacagagcaagacucugucuccaaaaaaaaaaaaaaaaaaagucagaacaacuuugucucuaacauucuuuauggaaaaugauugauauuauuuaagaugaucuauagaaaauagauggaguuagguaacauaugggccuaaaauccaaacaaaaauguaguuggaacaacuauauccucagauauauuuauaauauuuaagaguuuacagucauuguauaggggaaagauuuaaaauuaaauggauuuuaacaaaauagagacaaagaucaccguaacugaagauagcuugaguuuugaggggguucuugaacuacacaggcuauuauuucuauauaacaugcaaguauuuucagucaaaacacaugauucugucugcaguuauuauguaccuauuacauaccaguugucauguacgauugcauggguucucuuuuucucuuuugagaacuuaccucaaugugaucuagagggaaaaaauuucaggagcaguaacugaauauauuuuaaguaaaaagcaaaacauuacucuuaaguuaugucacagaugcuugcaaagaaaucuugagaguguuaaugauucugaaauaggaguacacuucuccucuaugcucaaaucugugguuaccuucagugauuuugacuuagagucauccuuuguagaaauucaagaaauuagauccauugggaauacaaauaaauaugaaucagcacgaagaauuauuuagguuuauauugauugacagacauaaagagccaccauuugaucaaggccuguaaaaauucaugcuuacaaguugacaucuuagauugaaaggauaaucauugauugaauccguuuucuaaugcaugaauauaaaaauagcaaaucaaaaccucaauggaaaauagcuaucaugcuucugaauaaaaauuaaaauauauaagagagugaguuacaaaugguugcuggagcaggugggcguggucugccuauaagagagcagacuucagucacagaggaaaggagugguguggcaggcaacaggguugaauauguuuaaaaaaaaaaaaagguuuguacuuaacgccacagagcucuagaagcugaaacuagaaucagugagugaaaucuacaaagaggccaauuugugguaaaaauggaaugggcuucuuugggagauaucagucucaguacauuugaagcaccccacagaggccaaauaaccaccauucagaaaguucuguguugcgacacaggcaccggggagcagugcuggacuuccuacaucucucugcugaaacauucauuuauacuuccugaggcucauaagccucaaguguugucuuauucuugcuguauuuugaauccaaacaauuaauaugauuuaugugaucaucuccacccaaaauuuaaaaaaaaguuggagugcauacacacacacacacacacacacacaugcacacaugaauauaaaaauggcauacuucaggaucaauuacuuaaauauauuuucaguaaaaagcaaaauauuauaggugauacuuaauacauggcugccuuuaaauagcaugugcuuauuagguccugugaauuuguuguugguucagauacuuauuguugaugcauucuuuggaaauacccuuuuaaaauauauugguaacacaagagugaugauucuccuuucugguuucauauuuuugacuggaaaaaaaaauaaaccugauucauagcaguauaaauguaugguuaauuuuuuguguuuuagacccaccguccuguguaaaugcucacuuaaccauaggcuaagaaaauacuuggaaauagaaaagaaaaugugaacuacugauuguccucuuaguugacaaaugcuucauguuuucgcuugaaggcaugugcuaugaaguaggcaguugcugucucagugccacaaguucaaugucucuggaccccagagucgauaguaguaguuaauaaaaagcucagcaguauuuuuuuaaugaaguaaucaugcuguacucuauaauuuuauucuuggaagcauaaagaguauuuacaauauggugucuuucuagggucagaauagugaggaaaaaaauggaaaaauguccaaacauccuuccuugcauggcaaugauggcauuacugguguguuuaauaaaaccuuuauugguacauuuuccggugugguggcauuggcagaaaccaucccccuuuggauuuggaacucagcagcugaugaaauacaguaaacauuaauuuggaaugggcugccaguuuuggaaagccaggugacauuuuauuauauuuguaccaagcagaggcugugucccauacugcuguagcuuccgcugucagaggcuuagcuggcauuauggaaaaaaaaaaauggcaggccugagaaucuuauccccugaaaugaaagucgaaugccaaauugaaauuccuguaggauuuccgauagcaaugggggaauugagaagcucacaauuaagcauaugggcauuaagauaauugucagaucuguuggcggacaugauagaagacagauggguacgaaucagugcgcuccacugcagcacccugggaggcaauuugacguuuuaccugccugagcuacucugccauauuugucacugaauguacagcacggcaucuuacugaguguuaaguguuuucgccgggaacuauaggugcaugugcgguccuucagcgcccucuagugaaacgcguuugggaguaugguuuuugaaaagccagccuucaucagguccucuuggccucuggaaauagcugucgcaccuccgguuccugcucaccucucugguuccucucgcccuuucagguggggacccaucgugaagauggcguggcccugagaggcagccauucucuucugccaaaccagguuccgguuccacagcuuccuguccagucugcgacuuccccugaccugaacccaccccaggacccuuacagagguagguuggccucaccagggcacuucugaccucacuuucacaauaggaccaguguugauacccagccucuugguguucaucccucaagaagcacuggcagaaacccaggaaucaaauugggcacaaaaaugguaaggaaauggcaaaguauuuagaacuucgcccgcuaauuguguuucuccagggacuguuuuccucaaacauccucugaaauccugguccuauaucagcagggaaugaggccacagacugaugagaggaaauuuuauuuuagcuauuuccacauuuuucucauucagguccucuaaugugguuaguuguggccugaaaaugauauuuccaaaugaauaggaaggaaggaaauuguuuuuguuguuuaagauggaaggaaauauaggugcauuuaaaaaauggagcuugguugcaugauuuucgcucuugagucaucuagcccucuaaugauugccucauaccggugauuacgagcggcuuuucaugaccccaggaaguugggcuauugcuggccagcugacuaggagucgcuuagauaacaucuucucagucccuucacauuuaauauaaaaaugauaacauugccacaggaauacaugugggcauuuuuucagcuguucaacauuguacagaucugagugucaauuauauguauggguaugucugcccauuuuuuaugaauaauaaucauuuuauggacuuuuuuuuuuuuuuuuuuugacagagccucacucugucgcccaggcuggaguacaguggugcgaucucagcucacugcaaccuccaccucccagguucaagcgauucuccugccucagccucccaggggguagcuaggauuacagacaugcaucaccaugccuggcuauuuuucguauuuuuaguagagacaggguuucaccacauuagccaggcuggucuugaauuccugaccucaagugaugcacccgccucagccucccgaagugcugggauuacaggugugaaccaccacaacuggccaggaccuuucuuaucaggaggcuuuggauuuugcccucuuuguccuaaaccugugcuucucaaacugcacauaagcacaaccugagcaucuuguuaaaaugcagauuccacuucuguaggucugggauuguccauuucuaaugggcucacagaugaugaggccgcauggaccaaaguuugaguggcaagguucuagaauacacagauuacaaauaaagaggaauacuugacagauaugcuucuaccuuuaaaaaaauuacuacauuagggucguguuuuaaaaugcagugugacuuggaaaguugagcaaugauaaagcuagaaauuucuaaaaugaguagcaaacugccuuccauauguaccauuuuaaaaugcugauuacuucuugagaauaagagaagccuaauuucagaauaucauuaggguaccuauugaagucuugacugcacauauuuagcauacucccugggaauuauauuuuaaggacauuuuucuauuaaaucauugcauauggaagaaacucaauauaauagcugauauuuacuuggguucuuaaucagaacauuggcugugugauuuucaugauuaugauuuucauugcaauuaaguugauguuuuguagacagugaaauuaccaucuacuccaaaagauugcaaaauagaauuuaaccuuagagccaaugcagggaaaacuuguuucugcaggugcauuuuuugaaacuucaacagauagcagggggaaaaaaaagugacagaaggaucacaguucagcaguaugaauugucugcuggcagccuugcaaucuggugugcaggcagugagauugugguguacaugucaccugauuucucuuuuucggcaggcaugccaccaggacuacaggggcagagugucuccucuggcagcucugagaucaaauccgaugacgagggugaugagaaccugcaagacacgaaaucuucggaggacaagaaauuagaugacgacaagaaggauaucaaaucaauuacuaggucaagaucuagguaacaguauauaauacugucgcuucauuuaauuccuuuauuggacuuugaugaagugaacagaacgggaagaaacuauucaguuuuuuccuggcagguaaauuuacagcugaaaagaaaauuaaaggccuacucuagaaguacuaaaaguaucguuucagauaccuguacucuauuggagccuaaacuguuuuggcauuuaugaaucuggacccaaugcuaaugacacacagugaaaaaauuugucucugauucaaguacaguuuauuuguaaaacuauacuuauucuacaaauuuggucagaaauguugugucuauaauauuucuaaaaagagauuguagccauguuaaaaacucaacugauguaugugccaacuauaacucuuuucuuaccucuaaaguaagaaaauaauuuccuagauuuauccuaaacaugcugauguauauaagaguaauaccuuaauuguuuaugguuuuucuuccuggacacucuuuucuacagaaaacacaacugcaggaaaauagcuucugucugguuuucuuaaauaucugcuaucuuuaaauucaaaucuauaucuccuugaacuuuaaucugguaaucagaugguuuuugaauaccaacacccguguacuuugccucaauucccugagguuguuuuuauucacaaauucaaccaauuguccuaagacuacagcuuuccuucuaaaggcugugguucucaagguucuaucuggaaucuuuugugaauuaagaacaugcugccucuuuauguugcuguuguaauuauugagauaaauuccgugucuugccacaaguuuaaaaaugccgaauacuucuagauaaccccuuuccuuccuuguugucuuuuucugauucuuggccacuuuggcaagaaaucccaaggaggggauuucauaccuuuagcagcuucuguguuagaccagucaguucuugguaauuuaacuuauuguggccaaacuuaugcauguuaauggauucuuugaaguuuuggaacaacauuuucauucgcuguugagaaccuucuuauuuaaaaaggucacucuuaugacauuuacuuauguaugccuccaaaacuguauuauaaggcagugcuuuuucaaaucuaggcaguuuuauuugcauaacuaguuuauuuguaagugaauaaccaauucuaauuggucguuagccugaaaaucuuuggaagaaaaguuccuauuuuccagucuccuuuguguaagguguagcauuuguuggauguauaaaaauaucacccaaaugcucagcuuccggacaggccuggcagagacuguuuucauuugcuuuuuacagccuauuugcauaguagaauauaggagugaauuaaucauuacugauuuccuuggcacuggcagcaguugggggugagggcagaggagggauccgcagaaggcagagaaagagggccuuuuccaguggacucaguugacuuccauguuuaccauacacaccuguggcagacagugccaucuggaaaggcgcuuacgcuauggagagagaggagccuggucuuacagcauccuucuguggugucauccuccuugccccuaacuuuucuccuucacccaaguguucuugacuuacgugcauuaucuuuauguguaacguauacuugcaaccgaagaauaccacucccacuuuugauugauuggagcuucucaaguguaauugguccuuauugccacuuggaaguuacccagagauucuccaaaauggaacaucagagucauauauuuuaaaccagcauucauuaaauauacauuuaauugaguagauaauuucccacaucuuccaacuccgaaauguugugauuaaucaucuuuauucugugaacauuuccaaugugugaaauuacccuuuagguuaauuguuagucacuuccauggaguuucuugugauggggagucuacugauguucagugaaguuuguuucauuuucugugucucucauaagccccccaaaaguccucacucauguuuauucacaauagucauucagagcuuuauagcacgugcugcucugccuucuugagacaagacgucgugcacacuucucuuuuuuacaugacagcccuuggaauauuugaacccugcugcugugacgacuuccucauaugauaugcuuuccagguggcucaucauccucuuugccuuccauucaaaaguuucuaauuugucacuguaacacucagaaauggacagaaccgaucuuaucuuuucagacuauucugggcccggccaugcauuuguuaugaaucauggaauauuuugguuuucacaauuagaaauuaccuuuuggcuuuuuuuuuuuuuuuuuuuuguaagagacagagucuggcuguguugcccaggcuggagugcaguggccugaucacaucucacuguagccuccaccuccuagauucaagugagccucccaccucagccuccugaguagcugagaccgcaggugugcaucacugugcccagcuaauuuuuuuuuauuuuuuguagagacgaggucucacuauaucguccaggcugggguuauaggcaugagccacugcacccagcuuucuggcuucauuuuugacucacaaugaggucauggucauucauaagcugcagguguuugguuuguugaaucguuuugcaugacugauaucaguucagguuucccaaacuuguucuguggaucauaaacaucuauaagauuaaagaccauggaagucauguuuuuguaacuuuuuguuuaauacauagagaaaaugagacucacauaguggguugaccaggccuucaaagcaagguaauggggacaccugaauaaaagccucacugucuucacucccauugcucuggugucuuacauauaggccuuucuucuuacuccuguuaagcugccuuguauuuuuuugaccuaucaaaaucauuuuucaauuacuuguuuccccuagauuucagaugucacgguaugaaagguuuuauauauauuuaaaaaauaaaguauaaacauaaagucuuuuugaagcgugguuaugcaacauaugcuaggcguaaguuggugaaugccugcuuugcagaguguaaccccauugaauaaaaaaagcuuuguuuucccuuucugccccccuguaucaguaugggcacacccugcacucuaacuuuaaucuacgucacccucaccuguuugguuuggguuuaaugucugcgagaaaaccaaauaucuuguguauugugaacugucaaagccaucuaaaccaaucccaaggucaaguggauauaaaaauucugccaaaaacauggcauaagauggaaaaguucccugaaaacucuggaagaaaacaaaguaauguagacaccuucuuuuuccccacaccauuagaaaauguugcaucccuuuugucccacagcaauaaugacgaugaggaccugacaccagagcagaaggcagagcgugagaaggagcggaggauggccaacaaugcccgagagcgucugcggguccgugacaucaacgaggcuuucaaagagcucggccgcauggugcagcuccaccucaagagugacaagccccagaccaagcuccugauccuccaccaggcgguggccgucauccucagucuggagcagcaaguccgaggucagugcaggccagccuccuugcagagcucgugaggagcuuguggcaggcacaagcugagaugggcacgccagucuugagcaguggcagacaguagacuuucaagcaucauuccaaagaauuguuuccauugcagacugugucuaaauccauaaggcagcaucccuuucuccuguaauuaaguugugggauucucuuauaacuaagauuauauugcaacuuucccuauauccuuucaguaauuugagcuuaguuuauuugcuuuaccaaccuuugcuuacuguaaaguggcuguacacacucacaugcaguucaccuuuuacuagugacugaccaaauggauugccacaguacuuaguaacuguuccuuuuguucuguaauauaaacacugagaaaaaggucagacacgcaagaagagugcauugcugcccucugccagaagccucagcauuaaacaaagguucugugcuuuaauccuccacagaaaggaaucugaauccgaaagcugcgugucugaaaagaagggaggaagagaagguguccucagagccucccccucucuccuuggccggcccacacccuggaaugggagacgcaucgaaucacaugggacagauguaaaagggcaaguuuguuuucagccauuucugagaucgaucauucaaaacucucaucaguguaucagccauaaaagugaauuucacccaaauugacagauauuuucuuucauggaaaaagaauuuuuuuuaaaaaaagcauacuuuuucuguuacaaauauauuaaugaauuuuuucucucuuuuuuccuuucucagguccaaguugccacauugcuucauuaaaacaagagaccacuuccuuaacagcuguauuaucuuaaacccacauaaacacuucuccuuaacccccauuuuuguaauauaagacaagucugaguaguuaugaaucgcagacgcaagagguuucagcauucccaauuaucaaaaaacagaaaaacaaaaaaaagaaagaaaaaagugcaacuugagggacgacuuucuuuaacauaucauucagaaugugcaaagcaguauguacaggcugagacacagcccagagacugaacggcaaucuuuccacacuguggaacaaugcauuugugccuaaacuucuuuuggaaaaaaaaaauauaauuaauuuguaagucugaaaaaaaaauauuuaauuuaaaaaaaauuguaaacuugcaauaaugaaaaaguguacuucugaagaaaacuacaugaacguuuuuguugguauucaagucagcuaguguuuauaauuacuggauauugaauuaggggaagcucggcugcccuaguaacaaaaccagcaaacguccugaugacaacgaagugaugacauuagccauuccuuaggguaggaggaacagauggaucuuauagaccuaugacaaauauauauauaaauauauauauaaauauauauuaaaaauuuagugacuaugguaagcuuuuguucauuuguuucagacuuuuuucuccuguaaaaaaauaguacugauuaacuuuuuuaaaagaaagauuuuacuguaaauauggauuuuuuuuuuuuuggucuuauuucugucccuuucccugguuuguuaucguaaccuguagugccaacucugcuuccagagggguagugcaggaugaaaugcugacccugauguugcuucucauucauaaauaaguagaaaguuguuucuccagucuuuugggaacacaggacuuaaaagucacaucauguguagauauuacaagcagcauuaccaagacauggcaaaaagaguuugucugaauuguaauguugcguuugugaaccuauucugggauuuucagagguacaagguuagaaugcuacaauguuaccacugugccuuccaauguuuauaucaucggaaacauaacauaaucaaaguggcugugauuuaacaaaaugauuaaaguguuaccuaccuguguagccgaaguagugugcagugaggcguuucugaauacauggucagauuuuuggaaaaaaacaaaaacaaaaaaaacaaguaaaguucaaaaaccgucaaaugagaaaauugcaaguagugugacagagcugauugauuuuguugcuuucuugauuuuuuuuuucaaaauggguuuacuaaaauguagaugacuuaacugccuccuccuucgucugaaaaaugccaauauucaaucaucaugcagcauuauaacaagccuuauaaguccuaaagcauuaaguugcacuuuuuugaggagggguagugcaguauuucucuggccaguaugaaugaaguuuauacuuaccauauuugauagaaacauagaucaagcuauggcacagcgacucaucagauagcuagcuuugacgucugggcacaauugaaccaacuuccaucgugaaucuuuauaaugauugacuuugguguauagugcaguaaacaaauagugcuccuaguuaaguauuugucagcauccuuuugucucuaacuuguuucuauuuuuacagccacacaauucuuggcauguauuaagaaaaaaaaaaaucccuguucaaguaguuuuuccaccuaucagcacugaguaaaugccauaaauccauugaaauggucuaaauguuccaucuguucuccuguuuugccaguuauauaguaaugaaauacauuuguaaauuuuaugcaacaaauggcaaacguaucauuauuuugaaauuguguauguaaaaguuauauuuuuacauguagacucuuguuauuauguguuuuaauacauuguaucaguuuuuguuuuuuuuuaaaaacugugguuuaaaaagaagucucauuuaaaugaaauagcuacaagaaucagaauuuuauguucauuucugaaaauguaagaacaaauaagauaguuaccacguggucaucuuuuacaaacccauaaacauuuugauuagcuguguguguguugaaaaacuguaaauauguucaguagcgauaaaacuaaaauaacuuugauuuguugauaaguuccuaaaauguggagguggauuaaaaccuuaggagaauagcagaaaucaaacuucaugaaaaguuauuuuggggcuuuccugugaaauguaugaacaaagaggcucagagaaggacauggaagacaauaauguauacucucuccuccucccugaauaaugaaaaccauguguauuuguucccuccguauguuaaagauuuccuuuuagugguacauucugcacucauuuuguauagucuaccaaggcggguaucccuaggaacaauauuauauaggaagcagguauacucugaucacauucaggauaaguguacagaagaaaauacgguguuuacucuuuagggaacuggaaacacucccugcauugauguacauuuuaagaauggcacuuuugauacauguuaucauaaaggugcuuaauagagcugaauuaaaguuuuucaaaucuguaaacaaagcaaaaaaguaaauuguagucauuugauuauuuuuuaaauuggugcuuuauauuuuguucucacucagaguaaaagcugcaauuuauuguucaccagcuuugauguauucauuacucaguaaugcaauaccucuauuguugaauucccuuuggaaauaagugaaaauucuaacggccacugaaagcugcucgcuagguuuugcuugguggagaaacauaaucugcaccuauccauauuaauuggguuguauccccauuaaaaaagaaaaaaagggaauguggccuuuuuaguguguuuuuuauuguuguuguuuuguaauuaucaaacccagguaagauauugguauccugcacuggauuuucaaaugaaguucagcagaagacaguuaagauuaaaguacuauacaaaaauuucaaaaggguccauacuacgcuaucuguaugacgacacuuaggcuggggaucucuuucagaaacucggacuuuaaaagcaacuuggagcaguugauccaccuccacauucaaguaauuuaugaauaugcagaauagggaucuguucaucuagaaauuuuuaccauuugucuucuguguagcugcaaggaacacuaauguuuauacaacugucaguccacccaguggugcaacugguucugauucagucuuccgauuccuuuuuauuuuucacuuuuuccuauuucugaauuuuuuuuuuuauuugugaucuugauuuugaugagggguuggggaguggggagggagucgaaccaagacuuggaguuaagaggauuuucaucuuuugcauccaacaggcagaauaugaucuguguccaaaagugaacuugagucaggaaugaaucaauuucagcauaaacaagcacaaaaauuuagucugcuggcugacuggaagcaaaaaagucaagauggaauaugaugaauuccaacacaauggggcaccaaggccuuuaggccucucuuuuuauuuugcuuugguuuuguuuguuuuucuuuagagacaugcucuuucucaugggacuugaaguggacucaucuuugugcagugcugguuuugccauacucauuucaaguauuauagacauauguaauggugaaaauauaugaacuguggccuuuuucauucuuguuacuugugaugcaauuaagugaagauaagaaaaaaaaaaaaaaagcagagauuuaccauguaucagugccuggcuuuuuguuauaaagcuuuguuugucuagugcucuuuugcuauaaaauagacuguaguacacccuaguaggaaaaaaaaaaaacuaaauuuaaaaauaaaaaauauauuuggcuuauuuuucgcaggagcaauccuuuuauaccaugaauauuacaaaaaaauugucagauucugaauauuucuucuuuguagauuuuuggaaucauuaugaguaaaaguuuguuacuuuauuuuacuauuuaaaagauguuauuuuaccauguguuaccaagaugaaacuguauggguagcuuuuuuguuuguuuuuuguuuuguuuuuguuuuuguuuuuguuuuuaguuguaggucgcagcggggaaauuuuuugcgacuguacacauagcugcagcauuaaaaacuuaaaaaaauuguuaaaaaaaaaaaaagggaaaacauuucaaaaaaaaaaaaaaagauaaacaguuacaccuuguuuucaauguguggcugagugccucgauuuuuucauguuuuugguguauuucugauuuguagaaguguccaaacagguugugugcuggaguuccuucaagacaaaaacaaacccagcuuggucaaggccauuaccuguuucccaucuguaguuauucgaugaagucauguacaugaccguucuguagcaauaaaugugccauuuuuauaaacuguuucugacacuuguuucauuucauuuugcauuguccauauagcuaugauucucuucuguaaguaaaacgcaucuauauuucauuuuccaaguguuggagguauugacagcuuaacaaacaaaacauacaaaaaaaaucacaaaaacaaauugaaaagcaaagcacaugauugaucaaggaagagaugcccuuaaugaaaauggaacgggaugcaugcaaaacaaaaagaaaacugucuagaggauuaacuaauugaaggaauauaauuaauguguguguaacacugaagcuaugcauuugaagagcucugaacugcaccaguguuuucgguugugcugcagguugcuaagucaagucagccuuaaccuuuugcaccaguuggucggcuguuuggcagaacauucucagaucuuuucagucaaaaaucuaagaugauuuauuuuguaucacuuuguuaaaagcugaauauuguuaacuacaguuaauauuaacacuguauuuauacuuucucaaacuacauccgccccaccacuucugguugccucuguugacuauuaauccagauguaaacaaccagauguuuuuuucuaacuuguacaaacugacgugugucaacuaucauggaaggaaaaaaauguacagauuaaaauuauucaguguuauguacuguaaguuaauauuuuuguagaauggacaucaaucuacuuugcaaaauuuggaggcuauuucaacauugcacuguagaaauguaaaguaauguaugcaauguaaaggaaagcccgcgguagcugagcgcuucauaacagaauguucuaaucaaguacgugguauuuggggaugucuccaauauugcucuuguauucuuucuaauuggguuuagugacuaguugaaggaaaauguuauaacgccauuugguucacaugugaagugcccuccauagccaaauguugggauuuuuuuuuuuuucguuuuugguuggacuguuugcagauauuuaaauuuuaugaaauuuccaaagauuuugguugauaacccccuuuuaccuucuaaaugauuugagauguucuuauguucuuacuguguguuuuaaauauauauaaaagagccacaagcauuu

SEQ ID NO: 6319 - RNA, 181665 nt, Homo sapiens
gacucagaauuuugaauaguuucuuugcuaaauucaccaucuggagagccugugauugauuaguuuuggccucacuauuaagugucaauauaaucaaugggaauuacuaggcuagggucauuacauagauaauuugccugcuguguaaauaaaaaugaaauuguuuaaauuuugugcaagagaaagugaaaauaaggaguuacgauuuguuuguuagagaaaguggaggccauuggaaugacaguuuuuggaaguguggagcaguuuggcuaagaauaggaaugaaggauauuuuuuuccaguuuaucauagccagagugaggaaguguuauucccucucuugcuugcauacauugccaguagugccuacuuuacguauguaaacaucggggaagagcaguagaugucuguuaccuggaggagauuuuuuuuuaaggaaaaacacaauuuacacuuuuuugucguuucucuuggcagguaaaacagaaaggggcucauacucaucuuaugggagagaaucaaacuuacaggguugccaccagguaagugagaaucucuguugcggaaggguugagaggauuaaccugguaaaucaguuuguuuucuaaauuagaugaugcauuuuaaacugugacaccaaagaugcaccggcaagucagaugauggcucucucuuuaaguaaugaaauaacacagagcuuagaacuaauaaacaccucaucuuuagaucgcugcuguaucagaacuacauucaugggcuuguuuuuauuuuuuaauccaucagccgguaccaguggcacuguuugcaaaccagcaaugucggugaaagugguucuauuaaaagaguuuauuugcaauuaagaacuuaagaauuucuuacgcaggaaauacuucgcggagucaugugucagacccuggguuucggguggcuauugcccuaaauuauaguuuucauaggggcuguaugauguugugugaaaacaggguuguauugagggauaaaaaugucugugaaaauaugauuuguugucccuuuuuguuucugaauuguuuuuggcuggaagucaaggccagcaggcuaacagcaaagccgucucaagggaagcaugcgugagcuagaaaaauaagaguacuuuaauuaaauaauaaaaugccaguguaauacaaagguauagcauguguguguuugugucucugggcacuuugcauuuguauacuuuaaacucuccagagagagccuauuucuaaaaauacugucaauagcuaaaaguauaagcuuuguuucaagacaacugaguuuuuauagaugcuuucuuuuucaguucaguaucaguauuaaucauguauuuaaaaucuuuuuuaaaaauuuauacuuccuuuuuauaagugcauugguuucuuacuuuggaaaacucuugauggaauuuaauaauccucuuuaauauucagagcucucuacuguuuuuauuauucacgcaaacaaaauguacuuuuuuuuuuucaaaugcuggaaaggggaugcuuacucucuugaacucucucacccucugauguucuugaugggggaaaaaaaucuauuuuaauuuuauuuuaaacagcccauuuaauauaccccugaaaaauguaagcaaaguuuuguuuuuguaauuaaaucgagccuaugaggaaaguuuccuuuacguaccagacauaggaagguacgacuucugguggguugguguguuuguuuuuucccuguauauauuugcauuuuuaaaguuuacucccuuggcccagccaccaauucagucauauucggcaucugaaagauuuguugcauugaggugaacagugcuugguuaagagcuccugccggagugcaguucauggcaguuuguuuggaaagaauucugcaggaaagaaauuuacagccauuccagcgcaacggaaacaucuuuggaaugugagugcaaauguucgggcuagauagccugggcgacaagccucugagugcugugucucugguguaaagcucucaguuccugcagaagaccguguuccugugggucugguuucugagggucaaggcggaggucauuagaguuuuggggagaagaaaguugacaacauccuuccuuucugcagauggucauggcagaggucucuguuuucgcugggccccuuuuucuggucauugagagaauaggcuuccucaccccuguauccuuucuuacuaauaggaauuggcgugauuccucacagacacaaagauuuccucugcugaguaagcgugaggccccuuaacuugugaaagcaucauccagaccgugugagucugucuguguaugugcagaacacagacccuccuuucuccguuuguggggaauacuucccucgggugaaacugaaguuaauuuuuuuuuuuuuccaaacacaaggugagaaguggaaaggggcagaggguggaagagagguggauggauuggcaugugauggcugaauuucugggccuugggagguucguuuugaggcauuaauguccaggaaaauucuuuuguauauagcacuaugacugcauaugcuuuucuuaaaaagccuucguaauguagccguggaguguggagauuccuucauucuuaauuugugcuucaugguugugagucuugcaagagucuacuaucucugugcuuagcguggucgcagcaaucuccauaaacagugugauuacuuagggauaaauaaaagugaaauuuuggaaauuugcugacagagggaaaauagggacugaagaugaaaaauguacagaguaugaauuucugcuuucugugaaauuugagaauagaacagaccauagugugucuuccagugaaucaguuucucuugugccguauuguuauuugaaucccugucuacaacaucagcuaugcaaaccaaagagaaaggcaaaaucucaguaucuugggcuucaagucuaaauagcagaucacagcugaaaugauuccccacugugugacaaggugagugacucguggaggggaggcuuuuguuuucuucuguuuacuacaugauugagauacggaauaggaaaccuucagauggugugcccuaaggagcuccaaaagcugcuuuaucguauuauaacaguguauccuauggacuuaaaggggugagcagugcuauauggaaacaugcuucuuccagucucaauagccuuuuguuugguguagagacagaguggugguaagcaacagguagcaaagcgcuguccuggaggaauacauuauuauugugagacguguguuguuucagaaauauaucaaguuaaaaauagauauauauuuuagauuucuccuaaggauuuaacacuaauacugauggacauaugacgcuuuuuuaaauggauauauuuuagcagaagaaugaaagccggcagguucuuuauuagcaauuaaguuguuuucauuaaaaauaguaaugagauauuauuucauuaaugcauuuccaccugaaguuaucagaaauaaacauggugacuuuuugagacuuuuaaaauuguguugaaaaugaaucaauagauaagcaaaaguagccaaacgaacuuuuuugaguucuuacuaaauaugacaaaacuaauuuaaaucaaauugggguacagaaaucacacccagcuuaacauguucuugccaaaugguaaccucauacuccuuuuaacuggcagagaaaaugaaauuuauaauggaaagucugacagaaacgaaaaugagugggaauaaaguuuuuugcaagcuaguccaaccuuaauacuauaauagccaauaacuaaaacuuaaugggcaucauugcaaaugccagaagggaaaaaaugucauuuguuuugguuucuuuuugcugcuuugaauagaauguugggugauuugcaaacuuuuaaauuuugcuaaaaucuauuuuuuuaaugagaugaugauaucaaaacaaauacuuguuauuacuucuccccuuaaauggaaguuuagaguugauuaucaggaauuguuuguauuuucuuucugggauauagcccaggucuaaagccaugguuucauuuuuaguauugugugugugugugugugugugugugugugugugugugugugugugagagagagagagagagagagagagagauggggagagagagagagagagagaaagaaagcugccuaucugagaccaaucaaauuagaaucuugugagcugggccugugcuuuucugacaacuccccagguuauucuaaugugcagcuagguuuuaucauuuccuagaauguucuguagaaauauacccuguauuaaugacuuguguucaacauaugaccuugaaaaugcuuuuaggcuuuuugcauuaauuugauuauucaaggcauggaaauauauugcauaugaacuucauuuaaaaggcagugaaaauuagugauauagugaaaaucuucaaaucuuuauauagaauuccacaacugaaugucccagcccauaucuuguuuucucuagugaaguccaaggcuuuaaccucauccaaauucuuuuucuucuucagcaagugaucaaauaggacuuugcugauacaguuauuuaauguuuacaucuuaaaaugacuaauggaauuuaagaauuagaccuaaucuaggagguuguuguuaauuuccagaaacuuggagaccagggaggaaacauauuuucuuaguuugcccauaggcuugcucauuuuugguucaucgaaauuaagcauguaguugauuccaaaaugaauuucacauuucagaauugauuucuuugucuuguuauuuuuacuuuugauucaauagguauuacaaaugacuuaauucuaaacuuuuggccucuuuuaguuuuucuuaucuaaagucaaaauagaaaggauguaagugaaaaccguacaaaauuauuuuguuuauuacgaaauuggcaauugaggccaauuaggccuugcgcaagcagaaauacacaucgcuuuuuaauuuacuaagaugccuaaguguuuauccugaguguucagcacauccaucgaggucuuaugcauccuuccugggaagcucucccuugcagggccuuagcaccugucuucaucgugcuuuuuaaaauuugccaucauuuuuauguguuuguugcaugcugauuuccacaggauucuguaaacuccuggagggcagggaccaugucugcuuuauccugaauguguaccaugugccuagcagggcaaaaauugcaaugaccuaguguuucuuuccucagcaucacuuuuggaagccauuuugagggaguaaggucugaauagcaauguacaugaaccauauugugagcaucuuuuucaugccuacgaaaaccagaaaacugcacucucccaaaaaaguccuuuggaagcucuuccuucuaacaugcugugcaggcucuggaaggacaccaaagucauaccguggagagacacccacucugacuuuuugggggguugaaucgucucauucaccuggugacuucacuguucuaggccuguauaucuggaaaggccugaaugagggaauuauagaugaucugugguucuggcagagguguuguuggaaccaaaggucagcauccugguccgaacauugaaauguagcagugugaaugguaggacaggauauuuuaaauugugacaguuucagacaucacagggccugaguuugcaguauauaugucaucgcagcugugucccugagcgguauuuuucgggcagcggcuuauucauuuugggggauuguuauggguauauacccuucuuucaaaagucagccgguacuuaucaaaggggagaauggguccauucuuucauugcauugguuaagaaauacuuauugacccuguagugguguguuagauacucaggagaaaaaccaagggaucuuguauaccuucccuucuauccccaccagcagcuuccuggauguuaacggggaaaaucgagcucuauuuauuuauuuuuauuuuuaaccuuacauagcauaaauuuuugagcauccagaacaguugaaaaaauaauaaaaugaaugccacauaccugcuauuuagguuaaacaguuguuuguauuuguuauacaguauuuucuuguguguauguauaauauguauaagaauacauauuuuucagugaaccaaccauuuuaaguugcagauuuaauaagaaugcacccauagauuuuucaguacaugucucuuaaaaauaagacauuugccuaacuaacauacuguuauuaucccuaaagagauuaacaguaguuucuuaaucucaguccauauucagauuucuucaguuguccucaugcaaaugucuucaguagcuuucuuaaaaaaggcaacuaaaaugccauuuacgcgugucauuugauuucuaugucucuuuauaauuucuuuuaaacuagagcuguuccucuauuuguauucuuuuuuaaauuguguaauuuauuuuuuagggaugggguaucgcuauguugccaaggcuggacucaaacuucugggcuugggauuuucccaaguaauuuuuuuguugguuuguuugaaugauagugacuuuaaagagaccaggccaacuguccuauaaaacauuccccuuucuagaauuauuagauuucguuuccuuguggugcuguuuaauuuuguucaucacuuguuuugccuacaaauuuaaaauuaguucuaaagguuuaugcagguucagguuaaacauuuucggcuggaguacuucauugggggugcuguguauaucaaauuacauuccaacagaauauugagcuaugcugcuguugguaaugcuaacuuuaaucacuuggcaaaaguggugaccacuggauuguuccauuguaaaggaaucuuuccccaucugcaauuaacaaauagucuuuguauugauacuuuagcaauggacagauaccccuuuuucccaacaaccuuugaccuaauaguuuuagcacacauugaugacccuugccugaaucaguuauuucaacugaagacuucaaacuggugauucuuuuaaaauuccaucauuccuuccacauuuauagcuaguauucuucuauaaaagggcaguuucuuucaucauucauuuuaacacuaucaguuucauguuucauauuuuauauaagugucauaacaauuacuguuucuaauguuuccuuaccuggaggauguuggaagcauuaaaguauucuugaaaucucuuaagguauauugauaagaaaaguaguuauggcucaggcugauggucagagaggcuuuaauuguaagaggagggagguaauuguaggcauguuuccuuguaaacuaaacuucaguauucuuuuggugaaauuuggaaccuugcaacaaccucugugccccuagcuguguuucucugauucucauauugccacucuauaauugcuaguaaacaucucacaagguugaucaucaguaguugacuggccgacucgaggggguugcuguggugcucugugaagcugcgcuaucagggaucagcuaauaaucccugccucaguccuugcacaauccagacaugguugauagugaaugucaaaaugagugaauuucuaaaagauaguuugggcuuaaucuaaaggaagccugaguaacuaguauuaggugccaauauaaaucucugaguugguuaauauuauugucccuuaauaauuaagaaagggaugcucagagaaguaaagcaaguagaccucaaaucauuugcuucaaguaaguuucagagccagacucugaacucuaagauguuuuguuucaaagccagugcuuuccaacuuggguucccugcuacuuaagcccaugaaggaguuuuuaggcucagaaguccauauuaguucucaucuagaaaacccugucuggucgauuccaggcccacugggggaucugggccugacacaguaucuacaacagaguagcugcacucagcuccguucaggguuagcuagaacucugaacagucaguagggaaaggcauagcggagggcagaucgcaucguuccugacugcccagccuuaagggggggaaaaaaagauuauaugaauaaucuauucaguaacauccucagaauuagcaugugcaauuuccuuaaaaccaaugaggauuuccugugaaaaggcugggguggaauaugccaauucacauuuuagcaacagcgugaacacuuucuuaaaaauguauagauuauguuuuggcuuugcuuuuugugcaauguaggcagaauaugguuugcuauuauauaaauuuggauucauuauagaucacauuauuguuccaaaaacacaagagcuacauacagcgagauucugaaacaauaccuuuagcagguucuuaaauaugccccaauaauuuuucgauuauggcauuuagcccucaaguaaaauauaugaaacaacagaauaugugcuaggagcauaggcaaguuuuauacaacaacaguucaggcaguuagugcauaaaaagccauugaaauugcuuugagaugauuuaugagacaccgaagaaauggacuccuaguauccaaauugaaauuucaccagaaucaugggauuaacuucucuuuucuuaugaaaaccauuaagcguuuuuaaaauagcuucuagcaauuaggacuacaguucuucaucuuuauguuucugauagguguaaagacaaaggggaaaaaucaauuaaugacuaaagaaauaauugauuuaaugcugagguguaucugauauaauuuaauguugaaacguaucuacauaucauguagagaucaguguagcucuauagccuccuucuguaagaaaggcaguauacucaaaauucaacaucaggauaguguuucaaugugaaaugacagaaauauuuauugaacgucaugcuugauauuauuuuauuguugagagcuuuuuacugaaacucuuuaaaacugaacccccaaauuaaaauauuggcaacacugaaagauagcaacagaagccuguaaucugaaguaauggacuuauuaaggacuucagaaaaaaagacuuuagaaaagaagcauauaucguugagucugcugccgugccugauagugauaaccugcuuagaauugaagcaccccauucuuugaaaaauugugugcgcucuguggauauugacguggguuuguuuacaugugcuuucacucacagaucaacugagcuuccuaaagcauggaccuuucauguucagcguguuguuuucuaaucucauagaaguaguuucauagggaggagaaaacagaaaccgacaagaauauuucuuugcauuugccuuagcauuuccaacaugcaaauguugcuuuuuucauaguauggcacuuauuuuugucagacauuucuuguacuuaacaaagggcaaaguuacauuuuggcgggagagcgacuuucgcccggcacuucaccagaucucguugaauagaauauauuaucacuguuagcauucuuaggguucuuaaugaaagcuacauacccuuuaucuccauuuuccucuccuuuuagaagacaucuuccaaugaacaauuucuaugacuugaauaccagauauauguuauuuucaagcuaccucaaagccauguuuauaugcauuugcgacaauaacaauuccgugcuucggaauaauuauguaggaguaucauugagguuauuaggcaggacccacccucuagaguucuguacaugggggggucucuguguguugggguuuuacugugcaagcacacagaauauccugagcucauuuguaccaugauaaugaacagcagggcacugaaucuuuuuaguuuuauuggcauuguauacaguaaguuauuaaauuucaucucuguaauauaccugcaguaaaauaacaaaauauuggugcacuuaaagaacauguguguguggaacaaugcccuccccaucauuucagcccccugcaaacagcugcuuacagauuucaagauccauuguauguauucccucgagcccaccucuaauaaucgagacacaucugccauugcaguauuauaggcauauguaguuuuauugaaaacuauaccuguaaaaaaauuaaauaacuccugccucaauuaaauuggcaagcuaccuuuugcaaagaucauauugcagaccucuugagacccaagugaguucauuuuauucuuacauuacaaaucacuaaauauguuauuuuuauuuagcugaguagcuagcuuuccucguacuuugaugguaaguuacuuucauccauucucacuuuuguuuuccuucuccccucaucuuuacauauuaaaaaaauuaugcaaauugcaugaagcaaacauuuugagaaucugaacagaauaaaaucaaagggaaaggacccuaacaugcagcuuuaacucugaagugauuauuaaauaaauacaugcaaagguuacaaaauuggggucaaauuuauaacucacguuguggcuugugauuuuuacaaacuucuuugagauccauuugaucaucauaaugguagaauaggaaguaauaugaagaggaaaugaguuaguaggccauacaaagcauaugcagaugaauuccuauuggauuaaauaacuuaacacuuacucuuaagaaaauaauagauacgagaucucacucuaucacccaggcuggagugcaguggugcagucauagcucacugcaaccuugaacuccugggcucaagcaauccucccuccucagccuccugaguagcuaggacugcaggcauauaccaccauggcugguuaacuuuuuuauguuuuguagagccagggucucacguuguuguccaggcugucucaaauuccugacuucaagccauccuucuaccuagacuuuccaaaaugcugugauuauaggcaugagccacugcacccagccaacagucuuaauacuuguugaagauugagucaguaauagaugucugcaaaauaguuuuuuauccaaagaaggaauaagaguaaaauauuuaccgauauaaaaaugugagccuaaacuuauuuuaaguuauguaagguaucuguauaggucuucaugugaguuaaucaugccaauauauagugauuuaaccaagaagaauuuuuuugcuuuauauuuucauagaaaaaauccaaaaagacaaguugcccacuauaugggaaacauauauguguauauaucguauauaucugaauuauguaugucuauauauaugaaacacacacacacacuguuauaagacaguaagcagguuccuuaucuauaguuucuuaguuaaaaaaacaaaacaaaacaacauuuugugcuauucagaugaacuguguauaacuggaccgagggagugguuagaggugaauacugucccaaagugaacauagagucagaggaaagacucuguugaaagucagaaaguagaugauuucauaggaucaagucacggauaaauaugaggugaugacuguuauagagaagguagaaaaucgaaaaucaagcagugauauucuuuuuuuuuuuuuuuuuuugugggguuguuggggauugggucucuauguuguccaggugggacucaaaccccugggcugaaucagucuucccaccucagcccucugaguaguugggacuguagguacacaccaccaugccuggcuuguaguagcaguauugacaaccagucaggauagaaaauaguuacauguuuaaauaaagaauuuccuucuuugggccgggcaugauggcucaugccuguaaucccagcacuuugggaggccgagguggguggaucacuugaggacaggaguucgagaccagccugacgaacauggcgaaaugccaucucuacugaaaauacaaaaaguuagcuaggugugguggugcaugccuguaaucccagcuacucaggaggcugaggcacaagaauugcuugaaccugggaggcggagguugcagugagcccagaucacgccacugcacugcagccugggugacagagcgagacucugucucaaaaaaaaaaaaaaaaaaaaaaaaaagauuuuuuuuuuuucuuuuagaugaagucucacucugucgcccaggcugcagugcaguggcacaaucucugcucacugcaaccucugccuccuggguucaagcgaugcuccuguuucacccucccgaguaguugggauuacaggcgugugccaccugggcuggcuaaguuuuuuuuuaauauuuuuguagagacaggguuucaccauguuggccagacuggucucaaacuccugaccucaagugauccgcccaccucggccucccaaagugcugggauuacaggcaugaaccaccgcgccuggcagaauguucuucuuuuuugauaggaauguugauucaagucagugaguggucguuugguuccacuugggcuuaccugggcccaggagacucugcucacucuguguucucccaggguauuuugugccccacugcugguucacagagaugccagguuucacggaauggagggcugaguccuagagagggucaucacuuacaaguaagauaucaaacccuaagggaaucagaauuuaaagucuuagaaggguuucaguuuugucauauagaaaaauauugaaaauuaaaaaauauauauauuaugaauuguaaacaaacuuuuugaucaaaacucaugaaaguuggggaauacaccuuaacuugcacccugccacugcuuugaagucccaucccugggaugugguucacuccuguggaaauauauauuaucuauuacauuugaacugugaauuguguuugucacacugagcuaagcagcucagaacugucauguguagagugacugguacaauacaacaucaguggugguaaaagauuuguauggacaaugacauguggcaaagaagaaugucaacagcugccacugcuaugacaucgucccucaaggagucuuucugcaucucugccauguaacugucucagccaaagagaaggcacuaacaugaacuucuuccccagaaugcuacucccaacuagcgaccacguaagacucgcuugagucuuuuuugagggugcaaguccugggugccauuugucaccggaaagaacauuuaaguuuggaguuuuauguauagagggagggauuauucuuugauuuauuucgaaagaacauguucuuaauguccuuuugcagauaauacacacacccuaucaguuuuuggacuccagacugucuccauccauaugucauuaugaagcagguuuuuaucuuauuaugauuuagguaauuguacuagccucuaaaauuuuauaauguaccuuucagaagcucauagaugccaagaucagaggcuccuuuggaguuccaucuaauauaucuuccuuagccaacugguacagauaauuuuaucuuuccucuagauaguuacacauauagcucuagaaauaaaauguaguuauccuaaaucagcuguauagagccuuaaccagcaaucagaccauuuagaacauucaacaauaauacauucuaccaaacucugacuuucuguguucaguagauauuuauuaggaaacucacccugugucccacugaagauccucacaugcucucuagguagaugacuucagcuaauaguauaguaaccaugaggccuuaguauuuaugacuuuucuuuucuuucuuucuuuuuuuuuuuuuuuuuuuuuuuuaagagucaggguccugcuguguugcccaggcuggucuugaacucccggccagagugauccucccaccuuggccucccaaagugcugggauuauaggugugagccaccacaucuggaaguauuuaucacuuuccaaauucguauucuuacauguguuuggauuuauuuuucaagaagccagaguaaaauuuggcaauuaccaaauugugaguugagaaaaauagauaauucaccuuugguauugugcuuuugaauuugaauuccauugauuggauuucaguccgucgggauuaguucuuccaucugugucccuuggugugaugacugacucccagccaccaucugagacugcucggucucccucaucuccaaaaguccucaguuuccagaucucaucaauucugcuugcaagauaccaauaaaucugcugcugccuccuagacccccagucaccaccguggcugcccgugcugcucugaucccucuacccaccuucucccucacaugccuccuguccacugcugcuggagugacagucuccacaaaacauuguuccuuggcuuuggggccuguccuuagcauggugguauccuggccccuguuucugccugcagccucagccuucguacucaccauucacaucucauguuccagcccuacugagcugcuugcaguucccucaagaguucuuucacgguucucucugucuuuauaagaaccugaaauaccuuugccuugccuccccuucuucuugccuuacaucuguucuaccagcuaacucaccugcuuuguucaagauucagggacccuggauguuauaaccagggcagagcgagcugccucucuucugugcucaggaagccuuuggagcacuucuuuuuccucacagucaucacacugucuacagccagagaagggcaaaggcuaggggcaagggcuaggcuugccgucucuaucugcagugucuaacaggggcacccaggaagugcuuguuccagagucacaggauggaugagugaaugaaugaaugaacuagcaauaguaagaaauuguaugugagcauguaacuuacuauauuuaaauacuuccaugcaaauuucuugacuuaaauuaaccaugccaaugaccccugaggcuggauuuauuuauuuauuuauuuuuugagauggagucucgcucugucacccaggcugaagugcaguggugugaucucggcucacugcaaucccugccucccggguucaugccauucuucugccucagucucccgaguagcugggaccacaggcgcccaccaccaugcccggcuaauuuuuuuuuguauuuuuaguagagaugggguuucaccguguuagccaggauggucucaaucuccugaccucgugauccacccgccucggccucccaaagugcugagauuacagcugugagccacugugcccagccgaggcugggauuauuuuuaauccaguuuuauugauaaagaaacugagauuuagagagauuuguuuucacucugaaggcagagaugggacuggggaacaaacuccuuuggauccagauuuggcauuuucuuugucacuucuuuagcacuggauaaaguugguguagcuuugugucauagcaaguagcccacagagucuuuucauagaugguuccagcucucuauucauuauuaacuuagggaucauucauggaggcacuuaccuaguuaccaggcugagaccucugucugccaaugagaaaaaaugugcauuucuaaagaggauaugaagaaccuagcaaucuguauaucaggagcauugucuuuacauagacaaaaaagaauauuuugaauguuuccuguaaguaaguaccaguugcaauagcguggugcguaccgcccaugcuaucuauugcccaucagugguaccucuacucucugguuguggugaaaaggaccaugguccuccuggaaauuucuggcccugaagcucaggggagaagugcaacaccagccacaucucaucccccaaguuucauucuccuucacucucccugguacaacuuggcagaggauggggagaacugggaagaaguggaugcauugaguagaucaagcuuuuccucuucauguuuacuuuauaugauuuuaauuuuguaaccuuguuguaggacauaaaaaaugaaugacaguggacuuagcuuuuauuuauaacauugaaauccuuaaagauagaauguuagagucagaaaggaccuagacaucaucuggcauccagugccgcuuuguagcaaguggaaaacuaaagcucagagauguugagguuggucgucaucacacagcaagcagaccuugcucagacacagccacacaauacaaguaaaauuccuagccuguaacacggaaguuuuccuuugaugucuuuguacccgcuuucuuccaaagagcaaaaggucaccuagaccaugaaguaauagccagcagcagccggaaacacauccugaggaaauuucuagacgauugucccuuuguuaagcuaccauugaaucauacugucacagagccagagggugucguuugcuuguaaauacugaguuuuugaaaugucacuguaacacuggaaaaauguugucucugaagguugccaaagugacagaaucccgacauuguaaauaccagccaacacaagugcuuauaaaugacaggaauaaaauauacuugacuaaauccauaauaaucacugauaacacuguuuacccucagugaccaggagcugugaacuuggauaaaaagcacaugugugcagauaucauuaauaugucugagccucuagccauuccagaauauuuugauggaaaagcucccuaaauauguaaaagcuuugcaauaacuaagaagcuaguguguaagguagggugucagucgucccugaugaaacuagagagagccuugacuaucuucagcccccagaggacugauaaggccucccuuguucugguuagacccaaacucugagccaggcuacuagggcaggcaaugcuguauuuucaguagaugugauucucagaaggcccauuugccagaagcaugagcccacaccuauaucauguuccauggagaaaauguggaaugaacuuagagauuaaaaacuuuggagccauaagugggaggaucccaugaacuacccuuugacuuucaaaggguggauggguggucagaccuuuccacaguccuaauacucuauagcccaggcuuuuucuuaauaauaacuuccuccucucuagaaaugauucucucccucuuuuuucuguucuaguguaaaaauggugccuguguguauccgagucuuuaagaggaaauggacacauuggcaaaccagugccuccuuuggcucugugauguggcugcuguuacuacucaacuggagcaccccuuauauuccagucuccccagaaaugcucaggaacaguggagacucaaugacagaggguugagcccuccugguuuuucaacuggugaaagagaaauucagaugguuaaggagauagcagaguagccagcacuccgggagcugcucuuaucucugcuaugaggcugugcauggggaagaguagggcugcuuggaaugaccuccuuacuuuucauauauugaaacauauuucuuuuuccuugauaugcuccuguauuguuugaauuuuauuuuauuuuauuuuuugugguaagcauuguuuucuuaauuaacaaugaaagguuguagucaauaaacuaguacuugaugagauuugagaaaaacuacaaaacuguagauugcaaguuggcauuugaccaagaaauuaugauugugcuccuuggauuuuuaugcuuaggaaagagugcacaagagggaaaaagcuuucggucagaagauacccauucuaguacuagcuggaauggugguaaagaauacgaaauggucugaauguccauggcugugugauauuggcguauuuugcuguccaugggucuaaguggaugguauuauagcuuugaaagagucauggcaaaggagggaacaggugugucccaaacccuaaugaacucagcagauuggccuggcauucuggcaauguagucauucagcggagccguggggacucccuggguggggacccagcaugcuucuggagguaccugggaggcgcugggaguagggccugcuguacugguuugacuaaugugguguagguguugauguuggagaguugguggccagucucaggcucuguucuggcacuacuccagcuuguuggucaugaaugcagauugagauugaauggcuccuuacauuucccuugaagaaaggcagcuuugucuuccaggaaugagcugauggcaguggccguguggacauucugcagcuuuggcacccaguagcgauggccugauugccuugaaacugggagccucuagggcccugagaacuugagcagggcuggacaagccuuggagcagaacuuugcugugaauucuuucauugacucgcaaaagaugaaggacucuaaucccugauaucuaccuuuccacuugaccuuuuuagucuucaguggucuuuuagaaguaauuuuaccuggccgcgguggcucaugccuauaauccuagaacuuugggaggccuaggcgggcagaucaccugaggccaggaguucgagaccggccuggccagcauagugaaaccccaucucuacuaaaaauacaaaauuagcagggugugguggcucacgccuauaauccuaguuacucgggaugcugaggcaggagaaucacuugaaccugggaggcagaggcugaagugagccaagaucgugcauugcacuccagccugggugacaagagagaaaccaucuaacaaaaaaaguuauuuuaugaaaaacauuuggagguuuucuuuuggguauggcaggcagauuggccucuuauuuggcauaggugaagaagaagaguugaauaaaaguaguuggggcauagaauggccaugcaaguucccaacuaaaucagggucaaguuuaaauguauuuguauuuuguucaaauucaucuuuaucuaaaacaggcugaugcuguuuugucucugugcugcagguggauagccacaaauuugacucuauaguuaccaguuaucccccugccaccccuuguuuuucuuccugauuucucuacuuccaaucagcugcucuuuuagaaaccaauagagaagugagacggggugggggcagaggaagagagaaaggggguaagggggagggagaaagaggaaagagagguuguuuuuugucauuagugaguaaaaaucugucgggcucggguaguuucuuagugaauucagcauuuagugauuagauuagagggguauauuugagcugaagauuuugggaacucaccuuucugcucuacagaaucccuagguuucuccuuuagcucuacuuucugauucauuccauccccauccacugaccccaccgccaauauugagguacuugugaaagcucagaaucuccaguguccucaaggagcuagccccaaagugcccccugguggcuagaggagaaaaagacaagauggaggaugggaaaaaggucagguggauggauaacuuuggcucuucuuuuggcucuucuuuucugauaguauuuuuguuaacagcaucuaauggguugucuucuuucaguaucaaugugaaccagcucugaauagguuaguguaucaauguauuucccuuuuugggugauuuugcugcagggauuucuuucccuaugccaguuuuuguuggucugauuuuuguuucuaggcauauugcauugaccugagccuucucacaguacugaugacacuggggguagggagaacaggagcaguugaagacgacacaugcugucaccucaugugcuggugugaguggcgcagggaagggcugugauuuuuuauaggcacacugauuagccaagcacuugucaccuccacugccgcucauuggccuacugagugugagcgugccaucuaauugacagcugucuguugucagagggccaucuuuucuccuuuucaguuugagugaacacaacagagacaucugcagagcucucugcagcucugacaagguugcccugccugccaacccucagacuucuaggcagcauaauugaagagaucagaaaagaauauuaacccguugaccaucuugggcugagguguaaugaccaaaaagucacuuuuuaaggugacugugagucuuucuuaguagaggaagacaugagauucucugucagaagagucaggccaguaggaagugcuauuucuugguagugauuguucgugggguuucaguucaucugagcacuuggaagaggaugagaaguucauuuucaagguagacccaguguuucauggugggguuacacugaagccugaaugcugggucacaucauucaugucugauuuggcuuguguaaugacaguagugcuuuggauguguguaguuuggaugaggguuacucuuuuucuuuuaccgccaggccugacacugcccuuuuagcguaagauuccagaaucucuuaugcaguagcauggaauguauggccaaccccguaguaacguggacugccucuuugggacauuuccuguaagccagagauaucaagguggacuuugugauggguagauuguuuauuauacagauaucagcuugggaauuugaauguuuaauuauuugccuugucguagugucuucaaaugaagcucuauuugagcaucuacugggauugguacaauaugcagacaagcuggcuuugugugggucgagucaccugugcuugcaggaugggggugcuugcuauauuuggaagugauuuagugguauccuagguuuaucaggaggaaaauacaucuuugcauuuauuugaacauuugauuuagaaagggacaguguguggguauuggauaaauugcuuuuacucuuucuuugcuuugcauuguucuccccucugaugauuugcaacuuagcaagccuucaucauugaaccugggugaaaaagaagaucugagaagccuugaguaauuuguuucagacuguuuauacucuaguguuuuacagaugugggcuuauuugaggaauaguauuggcgaaagguagcgucauuaaacugguuggagaaauuucaggcaaguagauagagaaauuucaggcaacuccuuuuccaaguuguugcucacagauuauaauagaugaauucagcagaauguucugaccuccuagacuaggucagauaacugaguucuuguccuaacucaaauccuaaguagcuguuucuuaaagcucuguucugccucugcagaaugaaggcuuggccuauauaguguaugagauuccuucuagcuucaggguuuuguaacuaucagaauagguaaugaggaaggagacuaugcccugguagccuuuagccauaucacaaauauuuaacauacucccaaaauagcacauacaagacagaaauucuuuguacuugaagggaauaauaaauacagaaagcauuugagaaguacacauuuaauuucuguuaacucuuuuuuucuuauuuauguuuauuauuagaugauaaaugacuuccuuuuuuuuaguauuaaaacaaggugaucaggauagugagaggauugggucaggugaaacacaugacucaccugcgugcuuaugauuccccuuggaagaugguuuuggguaacauucugggaaaacuauggauaaagucauaggcuuccauauuuaauuaauucuaagacuuuuuuuucacauuucaacaucucagaaauuuaugguaugccaauucaauuggcaacuuuuuuccucucuugguaggaaauagauaaugauguuuuugacauucaguggcaucuuauaggugaugaaauacaauucugaggggaggaagcaagauuuuuuuuuuuuuaacugagaaaggcuacgugacuaagugacuucuuuguuucaaugcugacuaaagcugugauguccuuuuuaaucacuuugaaagauucaaauugcuuuaggaagacaauucaugcauggagcucacccucccagaacuccacacuuaaugcccacugaggaaggagagaaaugcaugcaaauauauaucccaauauagaaggaauauucuaguucaguaacuuccacuccugagcuuuuaucaaauuuuucucuauagaauuauuuuuguuuuauuguauccaaaaugucagauaucuuuuucaaggaaggucaagggacuuugccauuuucuaagccagaaguauucucaccuaguccaguacuagucaaaguuuuuaguaaaucacuuagaauuuccuuuuuuaaaaaaaaaaaaaaacccuucuagaguuuguugauaccuuaaagaucaucaaauccagcuccuuauuucacaaaugaguaaaaagaagacauaaguugcuuguucagaguucagcuaggaacuagauagaaccuggguagccugacgcucccauucuugcugcuaaauuccaugcaauguaaugaaagcgggauugaguauaaaaccgauacucuacacaucuuuuguugauauuucugagggagaaacuugaauuucuguaagugcacauagcugguuucccuuugcuuuguauuucugaaugcuacacuugucuucugccuacuacacuuaaauucauaggugauuucacaaggcacagaagcccaacuugucacaugugguuuaauauaugccacacuuuaugcugcaguagcaccauuuggucauauuuagugaacucugugguuguugagaaugccaaagcagcaggcucagcuauugcagcauaggccuguacuuaguuagcaagcuuagcuuaaaagcugucagugcagcuaauguuacaguggcuuacugagaccuuggccugguugugauaguucuccaaaccuggguguuuucaccuuugaaauaugaaucuggauuuagcuuuuucuuagaaaacagcaacaacaacaaaauggugaaaucuuuaagcucguuaaugugaaugcaguaagaauguaaauuuaauacauauucacuuauuauuaaaugcuguuguaaauaacauuuuuagauuuaauaaugauuucccaagacauuucgugcuauucuuuacuuugaaacugauggggugagaagagaguugaaucuuaauuauuauuuuuuaguuaauuaacaugugauuuaaaaaaaucgagauauauuuuguguuagacccuaauuagaaaagaugucaagaauaacauaaugcuaacuuaauuuuaaaauugauaaaugagggcaagaugauuggaaaguauccucuagaucacacaggaaacggguuaauauucaaaugaauagcucugaaacgcuacuuuccuaccagcuccugaagcaauuuaguuuuuaagaccuaaaacugacucacaaucugugguaugaaggauagauguuaauaguuuaaauauuuaggcauugcgugggcuguuuguuaaaccauugguagcuugagauugaccacagugggaguguuuucaccaugcgaaugagcaucccugcucacaguggggcaugagcauagcacugcaggauacggaacugacauuuauuacauaccugacauuuccguuacucuuuuauuuaucguuuugggcugcuuguuuguguccuauccccacuccccaaauucauauguugaaaccuuaauccccagugggaugguguuaggaggugaagccuuugggagaugauugggugaugaggguggaccuccgaugaaggaauuaauguccuuauaagaagaggaagacacacuggggccugucagcggugggggacgaggggaggguuagcauuaggagaaauaccggauguagaugacggguugaugggugcagcaaaacaccauggcacguguauacccauguaacaaaccugcacauucugcacauguaucccagaacuuuaaaguauaauuuaaaaaaaaaaagaaaaguaaaggaagagagcuagccagccuucucucuucuccaugugaggauaccacgagaagauggucaucuguaaaucagaaagaggacccucgugguggcucacaccuguaauccaagcacuuugggagguugagguaggaggaucaguugagcccaggaguuucgagaccagccugagcaacacgaugaaacccugucucuacugaaaaaaagaaaacaaaauuagccagauguggugacacauaccucuguaguccuagugacccaggagguuaaggugagaggaucagcugagcccggaaagucgaggcugcagugagccaugaucaugccacugcacuccagccugggcaauagacugagacccucucucuccccaaccccuccagaaagaggaucuugucuggaauccagccauucugguccugaucuuagaauucuagccuccggaacuguuagaaguaaaugcuuguuguuuaggcuacccagucuuucguauuuuguuauagcagcuaaauugacuuagacaucauuaauuauguauuuuaaguccuguguuuuagcauucuggaaugagagcauugaaaaugaucaucaagccgaguaaauuaacugaauuaacuauuccaccaaaaaaaaccccaaaaacugaaauguucguuguuccuggggaauggcuaugcacuuggaggcugguccccuuccucccuccucuucuuccuggugaauccccugacuuuucucaaucaggcuuucugauguggaggcuuccucugcuucccagggacacacucccuucccagggcuccuggagcugcugcaucucugcuacccugagauguaauucuugccugagauuucagcuccuccccuacacuucagaggcuucaguggacuauuucuuauucaucugugcaggcacauuguccaauguacaaccugcucaaugggcuuguugaguuaauaaacuacucuguguucuguauuauguggauuuagauguuuugcuucuuuuucagccuuccuuucgcacccuccaccuacccgaccccugcuaagaugcuaccuuuuaaagaaaagaaauaaguucuucacacuuuucuacauuuauaauucaauauaaauaacugcuacugguauacuuaaucacaauuagauuaaauauguucuuugaaacagggaggucaucuaaugaauagaagugaaauaugucagaaaaugucacauaacugagagugugacaucuuuaguaaauagaauguugagaugauuuuagugcuaggcuaguuuuguaagagacaucuuauuugacaccuuuguucaaacaacuuuugugguucucaaacuagccucuauugaaaagaccaaguucccuacgucuucucuuugaacacuuucuucuuugcauuaaccuguucuugcuagugcguccaaguguggaaagcaaagauuaguuuuaaaucuuccgggucaaaacuguuuuggcuuuuuucuagagcugauaauaaguaguauaguuuucuguguaccauguguaagagaagagaaaaggucugacuuuauguuagauaauccauaauucgguugcucugucccacuauauggagaccaaagucacacuaaauggaugccuuggguaggggagaaggauguagccuuucaaucagacuucuuagcugcacuagucacauggcuagccuggggcagguauuuaaacuugcuauaccuaagucuccucaucuauuaauugacauuaauaucagcaccuucuucauaggguuuguaaggauugaauaauuuaauguauguaagacacuuagaagagugucuuaaauaaugugagcaccuucuucauuaacauuagcacauauuucauaugauuuugugaggauuaaauaauuuaauguauguaagacacuuauaagaguguguuaaauuacagacugugcucaguaaauguugucuaauauuauuuuuaaacugaugguuauuagccaagcuauaccauaucuucaacuuugggugcacaagagugggcaguaucuuugaagaggucguuguuucucaaucugugggucaaguauucuuagggaaacuuuucauuuugguccaacucauaacuuuagugacauuagucuuugcaauuuccugcugagaagagaagguagccuuucuauuuuuuuuaaguuuucaaagccuaauuuuauauuaaaagaaaacaagguauuaaaaccacguauuucuuuuaacuuauuaaaaggaaauaacacaguaacauuaauaaaaaguuacaaaauggcacaguaacauuaauaaaauguuacauugucuuuuuauucuauagcgugaauggaagaaauaaaguaacuuuucuagagcuacaaaguaguuaaugguggcaaagauucacucucuggcaaugugucuuguuucacaaaguaauacaaguucaacacaguauagaauugccuuugauuucaaaugguaacagcauuuauuggauuauuuuuguagauguucaaugccacaaguaaaaugaaguuuucucuuuaaaaggaugauagauguggcagacccaucacugggucccuggacagugguaacaugaugggguuuaaaguccuuuuugaaauagccagguuaaucugcauaaaggcuauggugcuucauuaagcuuuuugaaaacuuucugggguaggccaaguggcuauuuguaucaguuaaacguaaguacaacuacuuaaaauaacauuucuucccacuugugcuugagucugggucuauauuuuuccugauaauaacaggauaaaaugaaucauuugauuccauauuccaagaaaaacguguccauuagguagaggaagcucuuagaaauuaucuccaagaguggcuuguuuuguaccugucauauuuauuauaagguaaagggagauguagacuggugggggugaugguaguaaauugaaaugaguugccagcuguguugcccaggcuggucuugaacuccugggcucaagccaucccaccagagaagguucuuaaaccuuuugcuuuccauugggcaucuuuaucuacauuuuaccucaucaagcucaucaagugaaucagacgcuuugacucagucauaacauguugauggagagucacuuaguuggaaaauauagacaagaagaugggcucugggaagaacugguagguaggcaauggcucugaaaguguggggcccugguuuacaguguaaugacacccaccauuuagugccucagccauuauucaagugugcugugccuuuccuacuggccacguuaaugagaggguggagauagcaaguuccugcugaaauuuucacaggaaagcuaagcccuuaaaugauguuuugaaggaaugguuucucuaccaucuguaaaaaaggcuugauuaauuauuuugguggcagaaacuauaugcugugcuucagguuaaacagcaggaacauauugagguucuugggaagaguuuuccuacagccaucaaauagguguccacacagguuaaccggacugugcaauaagaaugugggacauuggcaugccagugugaagucuggaaaagucggaugugauauaugcaaguggaagagaacugaaacuaugaagagucauuuggaaagccccaguugugaguuugugauaguugagaaauggcaccuccucuuugcauacuuagguuugagcaggaaacaaagaagugacuugaagucauguuaugaaaagaagaauuggguuggaggucagacucuggauucuagaccugauucugaguuaacuaacauuuuagccuaguuucaggcacuccccaguggcccaaugagccaccccuucuugcaggccucaaaaugcacugugauaaaacugcauaguauuuucuuuuccuuauuuucauguucuaagaaauauuauuguccgggcacgguggcuuacaccuguaaucccagcacuuuaggaggccgaggcaggcagaucucuucagcccaagaguucaagaccagccugggcaacauggugagacccugucucuaauaaaaauagaaaaagacaaaacccugguguggugaugcaugccuguggucugagcuacucaggaggcugaagugggaggaucccuugagcccuggggguggagguugcagugagcugagaucccgccgcugcauucaagacugagugacagagugaaacccugucuaaaaaaaaaaaaaaaaaaaaaaggagaagaaaauauaauaaaaauaauacauggauacuuucuuaaaauaucagacacuugagaauguugaguaaaauauaaaaggacuuaaucuggagaucauugccuuaguuauaacauagaaccuuucuacuuaggagaauuucccucucuccuacucccuauuuguaaaaauuuucuuuuguggcuucagucaaguuucauacuuuuaaauguuuuuguuaauuuuauucuuuguguuuuuuuccuaaacuguauuuuuguuccauuaugauuuuuucauugguuagcugagguauaggaaaguugucuuuuuuauugucuguuaaucuuauaacccguaacuccagaacuuucuuacuagccucugguaguuuuuuuuaguuguuuaagauuuuuuaggaagaaaaucauuggcaaauauugggaguguugucucuuaaagugucuuucuguuauauuuuccuugugcuaguacauuggcaaagacuuacaggagaguguuaagagaauaguggaauacaggucagcuucgcauuuuguugacuugagcaaagaaucuucuaguguuucauuauuaaauaaguuuucuguaggcaucuaguagauuaagaaaacuuucuuaugauccaccacuucuuaaaaugaauguguguguucaaacuaaagagauauauguauauaguagaaauauauguguaugcuugugugcauguguguguauaaacuuuaaaucauccucucaaaauuccugaaguaaaagucuauuuuguuguuuuauguggaauuuuauuuuauuuaaauuuuuauauuuauauauuuuauuuaaaauuuucaugaaauggccaagcaggguuuaauauaaaauggaaacaggguuuaucucagaaauuugguggcuaaauuccuuguaucccgucuuaucuagggauguuguuuguuucaagguucuaccuugagaggagccugucauuuucuuuuuugugugcugcuuugccuaguugacaucuuggcuuuaugugcuccuguugaaugcauugggaaauuuucuuucuucuuucuauguccugaaauagcuuauauaagaggggaauuuuugauauuugggggaaauugcaugggacuuuuuuuuuuuuuuuuuuuuuuuuagacagggccucacucuauccucaaaacuggaauggagugcaguggugugaucauggcucacugcagucucuaccaccugaguagcugagacuauaggcacaugccaccaaucccacuaauuuuuguauuuuuuuguggaggcggaguuucgccauguugcucaugcuggucuugaacuccuggacuuagccaucugccugccuuagccucccaaacugcugggauuacaaaugugagccaccgcgccuggcaagacuaguacuucagaacuggauuuuuuacuaauuuuuccauuucuguuucuuuguguuucaauugugauaguuuuuguuauccuagaaaacauccauuuuccagacuuuaaaauuugcuacauaaaauuauacauacuuucucuuguuuuaaaaaacuccuuaucuauuuagcaaauauauuuuguaauuauguugauuucuguuuucucucuucuuguuuuuccuuacacuugccagagguuuguguguuuucuuugguuuuuuuuuucaaguaccuucuuuugguuucauugauaaucuacauuuuguuuuaucuaaauuuaguaaauuuuaaauuuuauuaauucaucauauuuaaauauguugcacuuuuucuagcuuuuuauauuguauguuuuguucauuuaauuuuuauuuuuacaucuugcaauuuaaggccauuauuuuucauugguuacagcuuuggcugcaucccuuagauuuucuuauauacagcuaucacuaucauuuauuuguguauuguuuuaaauguuauuuugcauucuuguguaguucaagaguuacuuaaaacacuguuuucacagucccacuuuaauaaaauguuuuucauguuggcagugcuacuguuuuguuuuuacuauuuaauuuuauugcauucugaguggggaaauggcauggauauuuccuacuuuggggguaaucuaguaggauuuuuaaaaaugcuuaguuuuuuuuaagcauuucauaugcauuugaaaauaaugaauacuauuucccuauuuuauuauuauuauuauuauuuuugagauggagucucacucugucacucagguuggaguguaguggcacgaucucagcucagugcaaccuccggcucccgguuucaagcaaucuucccaccucagccucccaaguagcugggaucacaagcaugugccaccaaccuggcuacauuuuguuuuuuuuaguagagauggaguuucaucauuuuggccagccuggucuugaauuccugaccucaacugaucuucccaccucagccucccaaacugcugggauuacaggcgugagccacugcacccggccuauuuucccuauuuuaauauauuaaaccuuuuauuacuuauuguccuucuaauugauuuaaauuucugagagauauuuguucuagucuucuacuuugauuauggauuuaccaaccgcucaggguauuuauauuuuaaaaaauauaucucaaagcuguaucauaaaugauuagaaguucaggaauauuuuauauuuuugguggacuauagguuucaucaguaugaaauauccaacuuuuuucuuuuuuuacauuuuugccuuagauuggcuuucaauguauaguaauguucucuacaugcuuuauuuuuguagauuuuauauuacauauuuuuuauauauuuuuauuuuucauagucucuguguuuuauuuuugaugguuuguuauacacagcauuuagcuuuacauuuuucuagccuaaugugacagccacuguaacuuaguugaggaauauaauauccaaauaaacauaguuuaauuuucuuuuuuuccuuggcuugaucacauuuccuuuguuuuauauuuuuugcugcuuaaaaaaaggucuuuuuuuuucuaauggugcaggaauuauacaucuuauuucuugugaaaguuauucuugccuuucuaacucacauauuucaaauuauauaucucuauuaaagucuaaaucuguuuggugucuguaucuuuccuaaaaaagaugacggagaguguuagcacauuuuuaauuacugaguuucucccuuuguuccuccccuuuaccucucauguugagguugauauguuuccuuuuugacguuuuaaauugcaucaacagucacauagagucuacuagcguuuccuugccccaucuugcuaauuuuuguggaccauguuguucuggguuuuuuuggguugauuugucauuauacaguuauauauccuuauguaauuuuuuucagaaguguggggguauaaauuuucagagucuuugcauuuucuaaauugccuguaguuagcucaccuuuuugaaggcaaguuuggcuacauauaaaauuugaguuuuaaagucuuguauccccuuuuucugucacauuuuuguucuggcuugccuugcagcucuaaauguagcaccccaauuaaucacccgauuauugcaucacacuccacuccagcuccauguauguauugacccugggauuggagcauccuagauuuagcuguuucuuugcagucuucuugauuggcugcugcuuuuuggcuugugauuuauuuauuuuuccucuguagagcaaauccaucuacuuuuaucuuuaagaauaauucaaaauuguuauuccaccgaagcuacucuuccuuauuuucuggcacuauuuggcauguauaucucuucuaaauucacacacacacauacacacacacccaguaucauuuaugacauaugagguuagaggaaaaguagaagcuuauguuuaaucuaccaucccaagccaaccccuuuauauggaacuuuacacauucuaaaugcuuucaaauacaguaccuuauaaggaaggagaugcuauuauucuccuuuuauaaauuagaaaacugagagguuauaagucauuuuauuuauuuauucuuucauuuauuucuccauuaauccauuggcuaaauuugcaucaucugcuauguauaagcagcccucagugccagagacacaaaaccccagcuuccaggaccucacagcugagaguggaagcaaguggguaacaauagagacuugugacaauaauuucagcauaggguggauuucaguuccaugcauguuugagacacgugcuaggugcagaggaaccuggggagaggcgucucuaugucagacuucccaguggaaguguugaggaguguuucccagcggaaguguugucauugauuaaaauccaugcuguaaauguaggcaugaguugacugcugugcucuugguaucuaguaaaguuccuggucccugguuggcacuuaaaaaaaaauaagugaaugaacaaacaaagcuuccuuggcucucaccgaagcacuccuuuuguacuaacauaugugauagucuccacaggcaugauuucuuuauuucuccaagcaucucuuugaguagguacagugaaugucuccuguccacaaaugaaggggccaaggcuguggggaguuaagugucuugucuaaggaggcuuggaucccagguuccucugacucccgacaggcaagacuccuacuggcccuauggcccccucauccagauuauuuuagccucuuuuuucaaacucuuuccugcccucugaucauguuucuaccaagaccaaguaucacaaacuaaugaagagguauaacuggcugccuccuggaggagguauuaagaagcauacaguggccaaaguggaggaggaauaaaaauaccuccagagaccucaauaauaccaaaauagcuagucacaccauauaugucuaagcuuugauacagccuuucuacaugacauguucauuuggaauuauauuagacauucagguuugaaucagggcaggucacuugaaaugucucaauucaaugcaaaaguuauaagaaaaauaacauuuccccccacacaaguauauagcauaguauaaaacauucucaaaaacuuuguaaaggaaacacauuuuacaguuuaacucauaccuacuucacuuccuucucccucuccuguucucuguucauuauuucccuacuuacuaacuggcucuuaguuaauauuuucguggccucacccccacaccuuuuuaguuggucucuuuuuugugcaaauugauuuuauuccuaucuaaggagaugcuuucauccuuuuuuucaugcuuugaggccucauuagaucacugcacucuaauuuugggggggagaguugucauuugcacuauauguacagucugagcauccuaaaguucuuguucugagaaaaacaucgccauggugagcggcccauuuugaauuaggaggacuggcuaaggugcucacuuaagcucuuuguaguuuuguucagucaauugaguguuucuauguuacaucuaucugucuauaugucugucuaucuaucuaucuaucuaucuaucuaucuaucuaucuaucuaucuaucaucugucuaucuaucuacauaccuaccuaccuaccuauguacugagcccaggcuggagcaguggugcaaucagagcuuaccguccccuugaccucccagacucaagugauccucucaccucagccuccuaaguagcugggaccacaggugugcaccaccauaccuggcuaauuuuuuuucuauuuuauuuucuguagagacugagucuugcugugcugcuuaggcugcuuucaaacuccugggcucaagcgauccuccugccucagccccgcaaagugccgggauuacaggcaugagccauugcgcccggccuucucuuuuuaacguaauauugagauuggggucagacugugcugguuguggguaaagcuauugcagccuuccagcuaugaaggccugcccuccacgaugggauggccaggcugguaccugagacuaguguuggaggcaguggcagcuucccuuugaucuauugcagaaugcauuuucaaacacacacacacacacacacacaaauaaaacucugauguucacuuuuuaauugaaagcuaaaaaugcccagcuccuuucugcagauugacaagcugauauuucagcaguagcuaaagaacccgguuuaguaagcuacugaauuuugacguuuauaaacauuuaaugaauacauuuuuauuuaugucagcuuaaaaaauacagcugcugauaucugcgccccccaacaacuuuuuuugucuuaaugccaaaauuagaauauuuaaauauuuuaaaauuuccugaugagcaccugugcaggugugagggcagcaugaauucacagggagaguguaugaaguugguuaucuugaugugcuuguggggaauguguauuuccuugcaaggacugucaugugcuaccugauccucuuucauggaccucagccacuuucgccucuaacuugaaaaggaaacuggcauuguggcacaggggccaaagggacacauuuguagccuuguccucaaaucaagugggacuucugguucuuucucugaccaucugcuugaccuucagucuggugucuccaaggagugugucucuauggcaguuuaaaaaauucuguuacacugagaaagagacaaaauguaaaucuuaaaggaaucaguagauuuuuaaccccacugcugguguugagaagacaguuugagucuuaaucucuuuccuuaaguuucaaaacauguaggauuuauguuauugacaugucaaacuuuuuguacuuauucauuagggaagguuucaauacacacaaaaauagaguauuauaagaugcgcuacuauguauucauuauccaguuucaacagacgucaccauuuucccagucuuuuguuauauaguauccccuucacuuuauguuccugaaauauuuuaaggcaaagccuugacagcauauuauuucaccuauaaauauuucagaagcaucucuaacaaauaagcccccuccuuuguuuuacauagccauggugccauaucacagcuagcaagacuauuaggaauucuuaauagcauuaagaacugacguuccucaguugucucacaaaugccuuuuuacagcuggcauguuugaaucagaauccaaaccagguucacacguugcauuugauuaucaugacuuugaagucuucuuaaaaucuacaacauggccagucucccucuuuuuaaauauuuaaacuggguccauuuuccuguagaaagcccacauuauggauuuggcuuauugcuucuuuguggugucauacaccauguucaucuguucuccauacuuccuguaagcugauacuugcauuuagggcaagcuugucuaacccauggcccacaggacacaugcggcccaacacaaauuugaaaacuuucuuaaaacacuguguuuuuuguuuuuuuguuuuuuuuaagaagaccaaguuuguuugcaguguaugaaugucuaggugaggcuggguuaauggggagaaugagacuaacauaacaucuauaacucucaugacuuuuuguuauuguuguuguuuguuuuguuuuuggagacagagccucccucugucacccaggcuggagugcaguggcgcaaucucagcucacugcaaccuccgccuccuggguucaagugauucuccugucucagccucccaaguagcugggauuacaggcacgugccaccaugcuaauuuuuguauuuuuaguagagucgggguuucuccauguuggccaggcuggucucgaauuccugaccucaggugacccacccgccuuggccucccacagugcugggauuacaggcaugagccaccgcgcccggcugaaaacacuaugagguuuuuucauggguaaucuuggauauguuauuugcuucauucaagaaguaguauguggccauucauuucucaagaugcuuagauuguucagugaguucaugugcugcccaccagaucucccuaauacagaguuuuacauugucuuucaccuguuuguuuuaggaucuauugaugauuauuucauuggagguugcaaaauagccauaaguaaauugguuuaaugaagcuucuucucccuacuaaaucuuaucuagaguuuaacuaucuauuaaucauucauuuuugcacauuuuuacagcuuuugugggguauuuuacauucuuucuucuguuugaauauagagggugccuugcaaacuucacucauuucacuagaagaggcaacuguuuaaauccuacucuucuaauauauuuccugguucauguuuuccugcacauucauaaaugaggaggacguugauuugucaguuaucuucagugcuuagaauaguugcugaaaugugacaagaauguuuauggaagaaauuaccuuauagguuguacauguccucuaaagacaucauaggcacuccuacauugcauuggugaaggggccaccaaacagcagaauccugcaacuugguugaacuaugaaaauguucuugauacauuauaauuuccucaaccccuuuagccaguauuggccauucaggcaaaggaauagaauuuccaagacuuguacuguauguuugcagaaggagggaggauggcagauagguuuguguguguugggauggagaaaguaugcaaauaagcuaauuaauaucaauuguuuuuauaucuauauuacacauacacacacucgcauacacauaagcacacauaauuaaucacacccaugagcacauguacacagcuggucuacaccagauugcccugacaauuuuagagcugugugcugaaaaauuuuagaggaauuuggcuuugaaugugcaacacguauuacagagcaaagaucaccuuggguccuaagggagaugacuuucaucucuaccaugugaguaaaaccugggugauugaaccauaaauuauuuuggguauauagaacuuucuucaaauaacacuuaaaauuaaauguccagguaagugauuuucaaaucagaacaaccaaaauuguuaauaguuaugaucaugcuuauauacguauggaaauguauauguauauggaaauauggaaauuuguguauaagcaugcucugcaguaaaucaaaaaaugaccauggagcaaacauaugaaaaugcucaccagcaaugaaaaaaaugacccuauggcaaacaauaaaguaaaaugcuacacugucuuccuguagaggaccuacuagguuuggacaaacuggcugugcucaaauacaugugccaaaauugagcaggcugggugcaaauauucuaagggaauugaaagacacuuuuucgugaaauagguuuagguguugacauuaucucuaaaaguaauuaaaagaugauugauguaguaaauuuucuuuuaagccaugccuuuaagcacauuguaggaaaaggacuguuaaacaccacauuuucuuauuuagaacccuuggggccauagguauuucacaauuuaagaaucauuugcauuuuaugaaguuaauaugguguauauaacauguccuguguaacucuccagugaagucugaaacagccgcaauguauauauagauuauuauuucuauagcaaaacauaugaauagauacaccuaguaagacaaaaacaaaaauuauagauacguagauauucucacauuaguucagguuuugucacaaaguacagcuuucaaaccuucuggaauuuuucaauugagggaaagauugugaaccuucaaaugaacaaauaaauaaauaucuaccuuuucugaagaaaaacaaaagccaaauaacaaauaaaucaagaaucacuuuucaugguuuuuaaaccccucaaauaaaugucuuccuucuuucaguucauagaagauuuagaauuauaaaauaaagaaggccuauccacauggucuauauaugucuuauauaucuauaucuauaucuauaucuauaucuauaucuauaucuauaucuauaucuauaucuauaaacaauuuuagaauuagcucgucccacacaaaaauaguuuuuuuguuguuguuguuuuuuguuuugcuuuuuuugggauggaguuuugcucuuguuguccaggcuggagugcaauggcacuaucucagcucagugcaaccucugccuuccgaguucaagcgauucuccugccucacccuccucaguagcuggaauaacaggcgugcaucauuaauuuuuuuauauuuuuaguagagaugggguuucacuauguuggccaggcuggucuugaacuccugaccucaggugguccacucaccuuggccucccaaagugcugggaucauaggcaugagccacugugcccagccaaaacuuuagauuuuuauccuguuugugccucaaagccuauucaguugaaaggcugaugggcucgcucugagguccauuguuggcugggggagagcauuagggagcugacuuuuggcagaugaggaaaacagcaugaucacugcuuuugccacucugcuuuguggaauugacccacucugaaguuguucucacucgacagcaaugcaggcauuuauccagugcuucuacaagaaauaauuugggcaaaagcaguaaggaaguaagccuuaacagaaaagugggacccagcaauaggagaaucuacacaucugcuaagcccagccaucauauauauauguguguguguguguauauauauauauauauacacacacauauauauacacacacacacacacauauauauacacacacacacacacacauauauauauauauauauauauauauauauauauauuuuggagauggagucucacacuguugccuaggcugaagugcaguggcaugaucucggcucacugcaaccuccaccucccgaguucaagcaauucuccucccucagccucuugaguagguggcacuacaggugcaugccaccacaccguuaauuuuuuguauuuuuaguagagacagaguuucaccguauuaggauggucucgaucuccugaccuugugaucugccugccucaguucccaaagugcugggauuagaggcaugagccaccaugcccagcccuuauauauuuuuaaugugcauuaguaaauuauaaauaaugacagucuccauguggaaaaugaaaaucaacuuagcuuauacauuuuuaaaaaucagucaaguggucuugucucauauacauagaccuugaaagauuuguuuucaguacauucuguagaaggcucuugaauaucugauagacuccccuggcagcuuucaccuggugugugcaugcacagauauaaucaccuuagucuuuauccugcaguaaacaaaguucaagagagauuucugaaaugaagauaaucuucauucugccuuuugccgcuaccuaaaguucccuuggaggacucugugaaguuacucagguuauauuuuuuauaacaaauauaaaccacagaauuugccagaaugagaaauauucugaugaacaucaugauuugacugaggauggaggaauuguagggaaugguuaaacuugaagauacuuuuuagaaaaacaggucaugugcuacagaagcuacuuuuaaaaacaugcuuuuucauuaaauguaaauuuaccacauuauuuuauauaucuucauuaauuuaauaaaacuccugcuaggcuuuuguaaauuuucacagauauaauguuaccauaggcaucuaugcacauguauuuuuguacacuuguccaauauuauccauagaguuaaaauuuuuaacuugaaacuucuaagucagaaggcauaugcuuuuaauauucugcaguacauuuuaacuugccuuccagaaaguuuauaccagauuacauucccauuagcuauauaugaaagugaacuuccucacuggcaguugaaaauuugucuuauuuuaauuugccagauagcuugucauauauuuauugccaaauuucaaauucauuccuuuuauaaaggaaugguucauguucuuccccagucuauuuaguuuuauucuuauuacaauguaagagcuuuucauuuauuaggaguaucuucucauuaaauauuuguuaagaaagauuuuuguucaacuuuguaugguuuggauaauguuuucauuuauuuuuauuuauuuauuuauuuauuuagagacagagugucgcucuguuucccaggcuggagugcaguggcaagaucuugguucacugcaaacuucgccucccagguucaggcgauucuucugccucagccucucuaauagcugggauuacaggugugcacuaccacgccugguuaauuuuuguauuuuuaguagagacaugggguuucgccguguuggccaggauggucuucaacuccuaaccucaaaugauccaccugccucggccucccaaagugcugagauuacaggcaugagcuacuacgcccagcuggguaauguuuugaaaaacgaguauguagucugggucccaauauguucuaauuuuucuagcucuaaugucauagcuaacaaaggccaucucuacuuaauugcuuguacuuuauucucaggcuuuuauguuuuaaccuuugcauuuaaacauauuuuaguaugaagugugaagcaaaaacguaaauuuuuccccuuaaaugcuaaacaaacuuuaguuaccauuuauugaauaauuuaucauuuucucauugauuuuuuuuucaaugacagccucgccauaaaucuuucuguaauauuuccugaucuggcagcagccgcacauugcuuuaauuuacuuuguuuaaaauguauauauucucaacuuacaucuuuguaaaaauuuucuuaacuauuaucaugcauuaauauuccagauaagcuuuagaauuugugucuucucuacccuauccauuuuucucucuuuggaauuuguuugaauuugcauuaaagucuccuuuaauuuugagucauccaaucacauuuaugcaaauacuuuccugggaaauauuugugugaaaagauuuucuuuuaaaaauugauauacaagauuauuucggucuuuuagaaguguuuauacugcugaauccuuucaugauuuuuguuaaacuggcuugugaacuaguucagcaagucagugucguaugcugaauaucuaaauauauuuauaaugagaaauauaagaaaacauaauaagaauauuucugucuuacauccguggagagaaaauagaauauuuauaaaugcaaaugcucuacaauuacucuaaggaaacuuaaagaucacaguccuauucuaacucuguaaaguuauuugcuuguuuguuauuuuaacagcaucuuucucauaagcauuuaaggcugguuauaauguuuugugugugaauauugaguaaaccaaaugauuggaggcccguuauuuuuacaaagauuuuauggaauaagcaaguucggaauggauuucgaaaaagagacagucccuguuucaguguggaagggacauuggaguccaaaggucagggucagauacauguuuucuucuuuuuuuuuuuccuuccuuccuuccuuccuuccuuccuuccuuccuuccuucuuuccuuccuuccuuccuuccuuccuuccuuccuuccuuccuuccuuccuuccucuuuuuuuuuuguuuuuguuuuuggagacaaagucucauucuguugcccaggcuggagugcaguggugcgaucauaacucaccgcagccuccaacuccugaacucuugggcucaagugauucucccaccuuggccucugaaaaugcugggauuacaggcaugagccauuacaccuggccauuuucuuuugacuagagcugaaguucugaaacuagcagucauuggagauaagacaggagaagacaguugggaggcuccaagcaugugauuucaggaaaagcaugaguugauuauugagaauuucagaugugagauuuccaggaacagugugaguccagaagauguaagaaagaucaguggaauucacacaguuugguuauucaugcaucuucgaauauuuuucagauaaucucggguggauacuucaguuauuucugccucagcccaccuuauuuguaaagcaguauuaguagaauccccuccuugagggguucuucauauuaaauaaguugcauagccaacagccugaggcauaccaaacacuguauagauauuugcuguuauuuguaugauugcugccuuuuacugaguggcauccugggcuggugcuugggacucaacagugaggacauucccucccacaucugccuguaaugccaaggccuugugauagggaguggccugaagcccgggguagaggaguggaccuccccagcauagcuggggaaggagucucaaggagaugacauuugaccaguccucaugguuguuugcaaguggcuucucugcuguggaaugggaagaaagggucuuccaggaagagggguuagccuuuguaaaagugcagagaaacguuuguaugagcaagagaguaauuagggaaccgugagcaauuccaugugacucugacuauagguaggcugcagggaagggaagagacagaugaggacugucuuccuagugccuagaacaguggcuggcccauaguagguauucggugcaucuuaguggagaaaugugugaaagaggaaagagagggcugggagguagacuacuacuagauuggcuauggguggagcugggggcucagcauuuucaagcucugaaguuuggucuccuugaaggaacaggagcagcucuggauuuuagaaggccaauucuguccacagugcaccaguguucuaggugagguuggaugauggggagagggaagucugaagauagcauccauaaaucucaugacauuucuaucccagcagugcaaucaaauguugagaauauguccuguagcuuucuuuuagaaaagggguuagcaggccaggugugguggcucaggccuguaaucccagcacuuugggaggccagcgcggguggaucacgaggucaagagauugaaaucaucauggccaacauggugaaacccuaucucaacuaaaaauacaaaaauuagcugggcaugguggcaugcaccuguagcccagcuacucgggaggcugaggcaggagagucgcuugaaccugggaguuggagguugcagugagccaagauugcgccacugcacuccagccugguggcagagugagacuucucucaaaaaaaaaaaaaaaaggguggggggcgggcaaauuauggcuuaaggccaaauccaaccaacagcuucuuuuuauaaauaaaauuuuacuggaacacugucugaccuguuuauuuacauauuauguaugguugauuuagcguaacaauggcagaguuggguguuuucaacagagaccacauggccagcaaugacuaaaauauuuucuaucugguccuucaagaaaaauguuuggugaccucaguguuagaagauuguuuuuagguauuuaauggugccauucuggaaaaguuggcauuguuggaagaguucaaauugaugcauguguagccuaagaaaaauggggccauaucacuuccuaugaagaaacacaccaaaauuuuaauucaauucuuaaguuguugucuugauuaucuaaguucugucucuagucuccuauggcuauuuuuguggcuuugacccuagcugacccagccuauugucaguaguuaagaagguagauuccaagugcucaaugucauguuaagacuuccuugcuaccuacuaagggaagucauuuuuuuagccagcuguuuuaaguucuccuaaccuauuucauaugcuauguucccacaauaaccauucccuucucuugccauuucuuuguccucucuccugcaauguuucuucuacugaaagaauacggcacuacugaaucuguuucuccugggcagggcuugcauuaucccaccuguuccaaauucuuuuuagaaccgggcccuuugggugaaugaugaaccauuuaauagccccauguacuauagaaauuuaaccauuuucaaccaaaccugucauagauaagaacaaagguaagccaucaugugucuagaaaaacauacaacugauuuccucacagacauuacaaguucuuacucuucaaauguacuuuaaaggacugagaguguaauuaggaaucagcagaaguuuuguggaaaagaggcauugagccuuuugcauauuaaggaucaaauuuuauguuuuguaugaagcauucaugaggugauguucuuaaaaaccacuccagaggcacaggaggaacgcugaggacaagacugaauauagagauggaggaauuacgugucuacuggguagagauggagaaggcauauuuauacuagggaugguugaaaucaugcaagcaucuuccauagcuaauaaauuauuuuauccaguuggccuuuacugagggcauacuguguaccggggcccacccuguuggaugccaggaauacaaagaugaucagaguucacuuucugcgcuugaggaucccacagauuagaaaggaggaaaaagaguuacuuuccauacaaggcuauaaauguuacaacaguugaauuuuucagaugaaguggaaggaaacgucuagaaggaagaggacugaaaugaaagaagacugggggaaaagaaauaauaauaaacaaaaagaaaaauaauuugaaacuuuuuagagaagaugauugaccccauuguggagaucaagauuaaagaugaauggcaggcagcuguggagagcagagguggagauauugggaggaucagacuaaagaacugaaauuucaguuguccaagcgggcaugcuguucuacagccucacaugucuugggccuauuagaaauauauauaaucuaucuaugcaugacuuauauaccauacaucacaucauuucuuccaaacuuacauuauaauauaacacauucuguauuaguauauaguaagauuuuaaaauguacaacauauuuaaauauacuccuuacaauuaagccucaguaagugcuaggaacuuugcuaagcacuuuguauuaucuaacugaauucuuaccauggguaggcacucuuauacaacauuucccaggcaaggaguuuugcccaccaagguuagacagauuguccaggauuauccaggggguaaguggcacucacaccagggcuugucugacccuacuuaauuagaugggcuccuaugaaguaaauuuuaggauaagcucuugacuuaaaaaugagccuucuaaugguugugggagagggagaaaaaacaaguuuacagaagauagcgggugaguguggagcagagaacuagcauaggcuuugaagucaagccuaacugaauucccagcuuggcuccacugcuugccagccacauggcauuggucaggucacauaaccacucugaauguccccaucuguacauugggguuuguagcaucugccuuguuagcauguaaaggaucugcaccugugccuggcacuuagcagacacugugacuuguagcugcugcugcuccugcuauaccuaccguccuugccacucuucuuauauucacauccacccauccuccuccucauacuacuauuacuaccuaugcuaauacuauggugguuaugaugagcagcaguaguaguuggaaugccucaaagauaagauuuaugcuaaaaaacagaagcacaguaguuauuuaagaccucgauuugaucaauagcauuaguucugcauuuacuucaauauuuagugagcaugugccauggcaggucucugcgccaggcacuguagaaaguuaaaacaugaagaagucauuuccucuuuuagcugccauauccucuaguuugaccuuuacgccauauacucuuggucagauauucaagaaagaaucuugggagggaaagaguuagugcucaucgagugcagacuggcuugaagcugugcauagcuuuggaaggaaugucaggacuuaaauaauuucaggaugaguugaagauuacauugagcauuuacuacuucuccagauaaucucaauuuccgcccaucaugugauggaggugucaccuuauuuacagguucagauuguuagcgggacacuuuguuauagugauaucuuacagaguuggccauuaggcuauaauugagccuuuauguggggugcuggguaggccacaugacccugguuccuguuuccagggaggccaaccuacauaaaaauggcugucauauaucguugcucagaggggcagauauuuacaacaaccuugaaauggaacuuccacccaauaugaugaagacugacuugugacaguuugauaugccuuuauuuugcuaaaauagcaaccuggccaaauauauuuuucagcacauuuauuauagcuacuuguuuauauuuauagcaaaaguguugcuaauucccuaguauguuaacaggucauauucaaauuguucuauuuuuacuuuggcacaaaauugcugaaggaaacauuuuuaaggcaaguagugauuauagcauaucaacucacuacauagugaauuauauauuaaaugaacuuccugaacugagaaggagcuuaaacugacaaagaagauaguuuucuuaaauucuguauuguuuacauaagauuucuucaaauccauuuuuuauuauagguuacugauugucucaauguuuucuuuuugcuaaauuucuaccuucccgccaacaaauauaaucccccuuuuaauauauaauagaugaccugggauuccagaauggauuuucagaaaccaucaaaaaaccuccucgcuuuaguguauacaauaaauaauauauucuuuuuuaaaaauaugagagucaaauagguauaugcguaaaccuggccaacccuugggcaguuguaauuuccauaccaaaaugcaugagucuuuacuugacuguuacucuguuauacauuaaguacuaguuaccauggcaaccuuugcaucacauuaugacauuuaaauauaaggugguguguuuccuuauaaggaaagacaauguauuugaauuuuugaguguuuggugaaauacaaucacuacuaaaauaaauaauuuuguuuaaggcaauugauuucuuugggaauuacguacauuuccaaccaaaccuauggagugcauucauuuauuuuuauuuuuuugugaugucauggagaaguaaaagauuuuuuuuaaaacaacgcuugauaaguauaacauaauaauucauuaaaugccuauaauuacccucguaaguggcaaaacacaaaauugaaccauauuugagguuauuuaucagugaccaauacuguagcaagaguucgaauguaacaucacaagauuuaugaaauucuaucgcauauaacacauuucuuauuuuuguauaucuaguugguuaacuguaacuaguuuugaucuuaccuauaguugaauuaacaguagcaguuugcucaugcgugcaaaagcaaaauuaaaggagccacugaacucauccuuguggcauuuccaggaacauggccacuuaaauuuaauuaugaagauuguugggcaauuucuuuauuaaauauggaaaaaaccuagucauuucuuguugccaguguagcucuaggccauaaggcuaucaucuuuguuauguagacucccauauauaacucauuuuuaacuuuuuauaguaacuuuuccaaauuauuaucacagcuuguacuuuuuaaucugaaaauagagaaucuaaugaucacucauaacuuuuggugcaucuuuucaauaauaaucaguggauuguaauaugggacuguuuugugugggacauaagaaagagguaagcucugugcuggacccuggcucugcggaacauuuuacauauguuguuucaucuauuccugauaacccuaugauagagcucuuauuagucccuuuuuacacgggaagaaaguaugguuuagagcaguugcauaacucacccccaaauacauugucuguauuucuuugagcuaagguucaaccagauuggucugaccuuaaagcccucccucuuuccuuaauagauuugacuucuacuucugacuuguuacagacacaaugugcaugauauguuuaauguagaaauaaaaaacacugacaaaaaaccuuuaaaaauguuugcuaaauaauaauuucaguaauuuguauuucucugcagcacagcaguuuuuuaagucccugauuugcaagauaucuuggucuuuguaaguuacccaaguccucuuuuguugaaaccaagcauaggacagaaauaaaaauaaauuauaaagguguacucuuggaccuucaggaaucaggaaagaagacuguccaaagacugaccuucaauuuugagcuuugaaguucaaaaguggacagguggaaauacuguguucuucauugcccuuuggugcgagauauauucuagguugcagaguaagugccaacagcagcaaaauuaucgccccccuccugcuacuguaguaagucagcaauggcccuucuguggucagaauggcacauucagcagcaacuauucgacagggauuuacagaaacuuccccauggcuguuaggaaucuuauucagcagugucuuugaaaacccgauucugugcagaauuagcuauguagaaaugaccuagguugugauaaaagguauuuuaaacaaaucuaacuuguaauuucacucaauguguauuuugcauuuaaugccacaaagucugguagauaccuacacauauauuuugcauucauaaguuuuauagugguucagaauuuuuuuccauauuaacauuuuaaaaaauccuggcuuuauagagucaguucaccauacaaagccacuauacaucacuuagguuugugaugaaagaauggaauugcagcugugugaguacuagaauacccaaacaugaauuagacucacaagcauuuggcaauaguucagaaaaagagcuuaaucugguuucaucugagacugcuuuucucuguucugcaacauccccccaagauguugugucugauaccggaucacaacguaaugggagugacgcagaaucgagaaagcccugagaaaccaggggcacauuugcuuuucuccagagauuuucuuucuccuacuucuuuuuuccccucuuccaguuuccaacucugaaauucaaggucauucaccuauuagaugcauuaauuauaagccaaaaaagcaguauucaucguacucugaucucagucauaucuauaauuaaguguaaauauaaucuuccuuuuuagaaauguaccacccacccauuacauuuaaagugcugacugaaaugaaauaauaguucagagcaagaugauuuuaguuuaacuagaaaaaaguugauaauuuaagcuucaagcagugaguucuauuuuugauuaccauucaguuauaaaucuaauuugagauauaugcugcuuuucuguuacucaaguuuaauucaugguuugcuuucuugguuguauaagcaaaguucagugguugaucaaggcuguuaagaagcuccccugaaaaggaaugggggcaggguugagaauguguucgaaagacauucugagaccuauaucugauguaaaacaaacaaauccgauguaaaacaaacaacaaaauuuuaauugaaaaagacacucacagagugcuguauuuggggauuugaauggccaaguuaggaauggccauuugcaggggaauuggcugcagagggugaaccccaaaacauuccaaccugguugauaaagucaguguguuuuauucuuugguuacaguauuuuaggucuuuugggaaaaaaaauuaggagcgaguaaggggaagggcuugucucaucacacuguggacaguuaagcaaaaugcuaaacuauggguuuaagauuuacagguuagcucugccagaugccacaucugccuccaguguuuccuggcagauucgggcagccuacuacugggacccagcauaaccgcagaacaugagcuugcacaaugugaaaaaccuaaaaccauuauaauccuauuuaaggccaggaugaauuugcccauuuugaaaguagauguaguuuucaagcuuaacuuuuauuaagcagaaacuugucuucagagcuauaucuauauaugcagguaaauucauaauauaaacaaauaccuuauccauuuugugcaaaauuuaauuuacuuuaaaucaaacgccauucacuuuuuaaaauucauaaacucagguuuuucagccaguggaaaauuuaucuuucucauugcuacagagaguuaaguaucugacguaaaggccagacaauaguaaauggucauuguucgcuuuauaaguauacucuacaauaagaacacauauauuuuuaucuucauuuucccuaaggagguguuuagggcccccuuaaaugugaggaaauguuuauuuuuguugcuuuagaagaaugauucuauuguccaagugagaaagaaauaggaacaaacaggucuaaggagaaagaaacaggaaugugcuuugugaaaaaaauaaagauuaacaggaaccacuaaagguuuguaagugcuaucugguccuagugcuauguuacugcacauaguccuugcgccugcauauguaagaguuggaugcgugauuuauuaugacuggcccaugaaauuauuuucuuuuaaguuaacaacaauaaggucaaccacagccuguagcuguuuuguaguuauuuuauauuuuucacagcucuauugugaaugcugcuaaaagacaguauagcaaguguguguuuuuagguugaccccuugaaugcauuuaauuucuugagagugaaaaccuuugccaccaggaccaagaggaauuaaccaaugguuaaacucauuuaaaaacacaagcaagcauuucaacauauuugcuuagccguuuucugaauauuuaauauacuucuagagaaagaaaaaugaagaaauaggggugauuugugucuagaauacaaaguuauuuucaaacuccucuuuccaaugaaaugaagacucauucguagauuuaccaaacuguaaggagguugugauuucaaaucauucacagcuuuauugauggaaauuucaaagaaaacuuggacacagacuucacuguaacuuucuuuguuaauaagaaaugcgaagagugaaauuuagguugagauucaaaaacuuuugaaugccacuccuaaaugauaaauuauuuguuacuagauuucugauuuaugcaaaacuuuauuauaauaagccuuauguuuuaguuugucauuguguaguguuuuaauaugucucauaaguucaaaagaggcaauaguugagcaugcagaugucagauuuuuaucugauaaaucugguuuuaucagguauuuaugugguaaacauuaagauacuagcaaugaguuuauuacucaaaaugugcuuucaaucugaaaucucauccuugaaguuguauuuugaaguaauguuuauuacauaucucuugaaaaagucuuaaacuggaaucaguaaaggcgagcuugucaguagcugauuaguccuuuauauaugacucauccaacacucagaaaaaccccuuggaauagagagguucucuuuaugauauuuagcuauauggcgguggaaaggggagguuugaauuuuugauuuuccagcuuaugggucauauuugaccaacugcuuucacuagaagacaugccacuuuguugagcuauuuaggaaucaaaaagacugucuuaauuuaaaacaaggacccuuuguuuuaguuggugacugccuugugaaauuuuucaguucucagcggguuaaccagggaacaggggcagagucauaauuggccuauuuagaguauuuugcaugugaauaguguguuagugaagcaucccuaagucuguugugagugacauggugauuagaauuuagauuagggaaaacacauucuguacuuuaucaaggacaguaauuaguucagucaguaaaaguugauuacaaguaacgauaaaguuagauuuuuaguacuuaauuuuaaaauuucuuuauuaaauaguaaauuuguucuuaauauaaaugguacuaucuacucuuguuuuauugcauaucagaauaauuaaaagaacaauguguucaaugcagaguauaaucaagcgauuuauauauuauggguaaguuucuauguaguuuuuagaaaauguaauauuauauaaucuuucugaugucaucauuuuuagaaguuuaauaauugucacacugugauagguuauuguggaaguuuucuaguguucagguaaauguuuaaucugugggaugugucuuagcuuccgauagaccucaagagggcauucugaaguccuuuguggcuguuagcuuggaauaucugcuauuucuguaauuuugagaguuagugugaggauuugaauuuccucuugguucaguuggcauuuucucuucugugggugcuaugucaguucguggagaaucaugauaugcgguacagagaggcaggguucucagucgaguucauaggcuacacuuacccccaguguaugcagccaggggaaguugugugcguucacaaaaugagguucuucuuguuaaggaaggggaugaauaguucccagauaugagccucagucuagagaaaggaaacauuagucuuauauaaaugccauuuguuuugugaaaugaaaacgugagucaucuuaaaagacuuaaaaaaauauuguuuaaagggaaucaucuacuuuccuccuaaaaguaaagaauuaaaaauucacaaacuuugugauagcuucuuagacugccuuucuuuuggguuuuuguuuuguuuuaauugucucagcuuagcagaugcuguuugcuuuauugcauugguuuaaguacuaacaaucaguugggagguggugaaaguaaaaaauuaaccuuauauguuuguuuucccuuuuuaaccuuuuagcagagucuccuuggaggugacauggauaugggcaacccaggaacccuuucgcccaccaaaccugguucccaguacuaucaguauucuagcaauaauccccgaaggaggccucuucacaguagugccauggguaagguauuccuuuguuugaaugccugagggaugauuaugccuuuuucuuuuuuucuuucuuucuuuaaaauaucgcccccccauccuaccucccaccccaagaaaaccauaaaauuuggcucaguugucagccuggagacuuccccccuaguacacugaguagguacguuaacagcuuaugguagcagaacuuuuuuggugucugcuuaugucuaguuuucucuuagcugcacccauaaggaagcuauuaaaagaucaaaguagcaaaaaguuaaauaucuucauuuuuaugaacaaagcagaauuugauuucugcuagaaucgaaugugaucgugguaacuacaguuugcuaagguaaugauuuaaggaaaugugguaucaucuagaagucuuugugguuuaaccuaucuuaguuaggaaaaugggcauuugggagcugaaagcaucuucauuuucuuucagagguacagacaaagaaaguucgaaaaguuccuccagguuugccaucuucaguaaguacugcuuguuucugcuuuguauauugcuuauuuuguucuguuuuguauugaugggaaggagauagaaguaaaugaguuuccaugcgcccagagcagcacguuuaucuagaagguggaugagguagaaaugaccugcacauccagccaccugacccacauuggagugauuaauugcacauccuggaagacugggugguuauguugauauucagcagguuaagcucuaaagagagccuugaaaaggugccugaaguuugaggaguuuuaccuguacagggcuugcaagagaaugaguauuaguuucauguguugguuaaauucuuugucaguauuaugaugauuuauggauuugcaugcgaaaggagauuuguggagaggauuuaggaaaaauuuacauggguuucagcccagagugcaggaagaaugucucuauuuucuggagagguugcugaauaaaggcugcaaagguagcugcaucaguagccauuugugucuuuacuaccaggugacaacuagaaguagucagcuguaaccaagagcauucugggucuuuuuaacagcuggagcucuaugcagaaguugcugauaucccccacccacccccaggucccuaguacagcaaaaguugguugugaucacaacucaauacaugauaucauauuuugaauucuuacguuccuagauaauuguauuuaauuuuauuuaggacuaguccauuucuaguaauuuucuccucauauaaaaugaaaacauaguuuccucucuucuuucuuuguuucuuuauccuuccuccuuuuuuucauucuuccuugcugugauauaaaguuuugauuuaauucuguagaguacuaguauucuuugaaaagaaugcugagacuuauuguuuuuauacuuuaauauaaaaucauauuuagauuucuuaaaguauauuaccaaucaaugcuugcauauuaguuucauuucauuuuuaauguauuagaagaauaauaggucuugcaaaugugcuaagauuagauuaacccaaacaccuguguauuugacuugauuucaguucagcucauccaaacaauuauuaaaugaauauaucagaauaagucuuaucaggaaaaagaguaaauuuuguaugcugauuaucauagaguuggugauguugaagaagcaucacaaaauuauucauaaauauagaaaaauauuguguaaauaagauugccaaugguguauagucacuuucaacuagcaauaagucacuuaaaauuguacucaguuguuuauuguuugaauuucuguguuguauugaaauugacuaauaugcccaaaggauuuuauaagcauauuuuaagcuugaaguuagggguggauuuaauguugaugaaacuuuagcuuuuaauagguuuuaugacaacuucaaaugauacaguccuaacagcuguuuacauuuuaaacaugccugaacuuaauauggacaauauuaaaugcauuugguggaccuuugaauguucugaaacaauggaauaacuguccuauaaaagccauaaaaaacuuaaagcuaucauacccuccuuaugcuucauauucaaauuaacuuguuuuauccaaugcuaagauuaggcagaaaucuagacaauuucuaaggagugcauugguguggcauuggaugguauguaucugcuuaaucacugucaacaacaauuuucauaauucguuguaaauguuuaaguauuucccuauagcuaacuggccccuuuagaaaauuuuacugguacaguguuuucuuugcuguuaagacaauuuagguguugcugcuaugucgugauacauucagaaauauaaaaauaauuuuccuuucuuucccaauaaacaaaacuugggaauuaggaauuuaguuuuauucuauuuaauuuucuguuuuuaguggucaguuuaggauuuacucuucuuagaagauuuaucuugacuaaauguuuucaugguccuuaugaaacauuuugaugaauagccuuuuuucugaaauauaaggaggaagaaaauacaauucaaaaugaaauuuuuauugcaauuuuuugagcaagaagaacaaguuuagguaauuuuauaauuuaaucauccauuuacucauuaccuaaaaaaaucccagcucuauuuucauagcaauuuaacuuaguuuauguaagcuuuguuguaaauaucaauugcuuauuacuuacaacaagauccacauggcuuaccaccacacaaaauauuuauuuuaacuugauuccaaaaaaggucugcaguagacauggucacacuuuucuaguagcagaucuguauuucuauauuuuuagaccucugccaugcuuuuuuuaaagcucaaauaaaauuaugacuauuugauaagagauacuucuuaaauuguuucaguauguaugaguauuuguauaacagauacuaaaagauuggagauaauaaaagguuuccuuuggagugauuaugacuacauaagacacuuauauguuuucuuugauacauauuuaccaugacaaauaguaauaaaucugucacaaucuguuguggcaacucacuuuaccccccauuuugaagugggcccucucuuucccuuauaauaaaaggaagaaaacuuaaacggugacacugcaucaucagguauuauuugugacacgccugugguacagagacuggacuucugccgccauuaggcugggucuuccucccaggcaaucaggagagagaggggauugccuagcccuguuuugaaaacacugcagcaucugugggagagagaaaacguaggccuggccagacaucaugccauggaucuggcaggauccacgaauguguguuuguacugugugcugcaccuagagaccucacgucacuguggaaguaugacacgauggugggauaacagaagacccaccaggcagggucuacaggacaagcacagcgugucggggggaagccugucccucuagugcacauagaccaguacuugcuaaggugauuuuuuuuuuaaaggaaagccugugugaaagacagcuaucuaauugcccacgagagcucugcuuauuacugcaguacauuuuuaucuucucgguucguauuuuaguauguugcucuuuuuagucacgucccaauuucucguagcccucguuuuuugcgaagaccuuaguaauaaaguguugucuuuuguugaugucagaauuuauuuugcaugucuaagcucuugaaucuacaugagaacaucuuguuuugcuagauuucuacauuuugguuuuccauuucaaaccauauuucaucuuaaacucaauauuuugcaacuuuacugcucauuucaacaaauuuguuuuauauaaccuaauaaucauacacauugaaucaugaauucauacacagaaaaauguacuauaguaaauuaaaguuggaaaaaaaugauuuaugauucuuaacagaaauuaacaugaaaguacuaaaaucuagaaaguagcaaaaaauuuuauauugugcuguuuuaagauacuuucaucaaacacagaaacaaagcaaaggcauuaucuuuuggaaacuuuauucugcccaucaacauguaaacauguaaaacuuuuaucuuagaauuugaaauauuucaaaauuauauacguuuuaucagaaacuguuaacaacuacaaacuuucuacuucagacuuugguggaauuugucuccacuuguaauccgauuugcaucuuuaaugauggucucaccaugaccccaguuggaaucucuugaacaucagauuuuucuggaaauaggauauuuuauccuuagaaauaguuuaugaccucucaucuccagugaucuuuccuaaagcuguacuucucaguaaagucuuuuuucuacguuaaaguacagagggguuuugugugucuguuuuguuuuaaaacucaggaggaccuggcaaacuuuaaguggucagagauaauuugggacacauggaucccaagauaaacaauuucuacuacuauaaagauucuaaaauaagguuuggacgcuucaagaauauuugugacauuaguuaaucaguagguagguuugaaaaauaaaaacaauguguauuagauauuagguucaccaauuuucauaaggaaagaauucuuaaauaaaaugaaauauuuaaguauggauuagaguuuccuuuacagaagcaauuauuagggguaucaagaaaaaugaguaaugcuaauggccuuaaauguccuauguauuuuguguuauauaaaaacuuuccuauuugaagauuucaaacaugauguugaauccauaucuugagcuauuuagggaaaaccccuuuuaucccaggugcuugaagaaaucacaaacaauuuaaaagagauauugguaaacuguuuuuuccuuauuagugggcuggaaauuauguaugauuuaaaaaaucaguacugaacucagaaauauauaauuuccuacaucacuuuugaaauugaucauagggaaaucagaacgaugcuuuuucaugucaacaaauuuuaacaaguaauaauacaauuuucuuuaagaugaaaguuuuauugaaauaugauaucgaucacaagugaacgaaauaucagccaucugggcucuauccuuuuuaggaaagucuggaaguagccgauugugugguaagacguaaaaggaggaaacucuucaagguucaucccugcagggauagauacuuugugaagaaguauaauuguuaaguguuuaaaauauuaagauagcucucaguauucacuuuuaaacuuagugugcccauuuucuaauuaaagauauuggaauaugagguuuggauauuaaaauugugcuuauuaauguuuaggcaagaaggagguuaagaguggcacaauuaagucaucucaaauaggacaaaacuauucacacaauuuacacggcauauauaacaugacaauggggaacagugaaagcugagaaaauauucaugacagagaaaguauuuuugugugugugcaguuaaugcugaauuugcuaaaccagacuucuaguucagcaugugcguuuuuuuuuuuuugugaaaaccaaucuuaucuucucuauuacacauugagacuauagaguuuaugauuuuuaugaauugcugauauaugaaaaaauauaggagaaucuuuauauuuguuuugauuggaggcuuuuguuccauuaaaaauuuuucagaaagcacacaagaggcuugcacauacucaacauacauacuauuaggcauucuaauaucccagaaguuugcucaaggauuucugaauuuuuguuuggaauuuuggaauaaugagcuccuucauccacuauccuccucuucucugccuugaagcccaauccugcacccuuuaagaaagaaggcuucuggugugcauauuuuagauagaaagagagaagaaauauaaaggaaaagacaagcaugaagguuaacuguggaugaaagguuuguguauuuuugagcuauuccugcuuuaucuuuacaaacaaaaagguuguaugccccaaacacucaaacaaaacaccaccaguucauuccuucccccagaaagaagccuuccuggccagcagcaccccauuuuucuacucagugaucucuucuaaggaguggugccugauguaucuuccuacucuccaauguguuuuuauuuuuaaucaaguauucaaaauaguauuuugcaugcuaagauuuaucaggacuuucguuaagauguuagcagcugcuaacauaaacaauaauagcauuuaguguaaaacuggacuuguugagaaaagagaaauacauuucugggaacugcuauuuugaacuuuaucauuuucacugaagaguauauuuuggugugaaguuuuggacucgagagugguuuaaauuacugagaaguguaggaaaccacugcagggcugcuuuacccagagagaauuauaacagggcuugcauguauuuugaaaauaaaaccuuuuucuauggcauccagcuuaacugugaauuuauauuuacgaaauaauguagauaaaugccuugauaauuugauugaauaccauuuuuuaacuuuuaaaauuuaauugauugaaauaguuuuauuugcuaacauagcaaaauguucuccuuuuuuccagaucacugacaauuucugcauuuucuauguuuucuugguuuugaauaauucuaaagguuuucauugaaaguaaugaaucaggaauuggagggcuaaauaagauucucuuagaagauguggcaguaauccuaaaagaauaaggagucucuucaagaauugucaaaguuguauuuucuuaaggcagaauccauacuugucaggcuguugacagacacuugcuuugucuuggcuuuuguuugauuuuuuacauaacugcacuggauuauuaaacugaacauaaaauugcaccucaaagcaauagcacaggauuuucagccuugaucaauuucuacuauccccggaugugugugugcacgcgugugugugugcacccauguguaugagugugcuucuuuuaaaggaauaggagcuuuuauacaauguggugcaaaacuuauaguuuuaaauacuuaauuauuuuaucuggaaacagcagcaugugagugauucuuuuuuaaguugcagcugcugcauagguguagagcuauuugaggaguuugaugcuuuacuugagcauauacucccucuucagagaaguuaagguagugcagaaguuucugcauuuuguaaaauuucaggguugaaaauaaagaugcuuuaugauuuggugagauggauagauuucacuucugaaagaaugugcaaguuguauuuugaaaggaacauuuuaagaauucuacuuaagugguuuagugacacccacucuugucucuugucugacuuugucaucugaggaauuaaucauaaauaagccacuagggaugaaacuugauauauaagugcuuacuuccagaguaauaagaagaggaacuguguguguguuaaauuucacuaaauuuauuuugauuauuccguagagcaggaaauaggaacauuucguagugaagcucucuucauagcaaacuguaaagaaaauuucucaguguguugccauauguuggcagugauuaaagggcauuuccuuugugaaacauggagccauauuagaaagacuuauauuuucucauaaaaaugaccuuugcaaguacauuuaaucaugaaaacuggugucauucgucacauacacauacaaaaagugucacuguuaccauuagggauuuuaggaaaaugcuacuuuggaacaauuauuuugauggcaucugagaaagaauaccuaagugucuacaggagccuccucccuccauggcccauaucauucuaaauaugccuccugaauuacgcuuauaauaauauuguaaugucuuucauucuaccgauuggcacaguauaucauuauaucauuagcugcuaugagaaagcaguuucaaguagguggcagauucuuagcauuaauguuuucaaguaacccuguuuggagaauuggguuguuucacaggugcucagguacauuaacacaguacaauaauauuuucuggcuugcuuuuuaugaaacgaacuugaaguacaaaauaauuuaauaacaaguggaguauaaaaacuggagcucuagcuuaagaaaguuuaauaacucaagacguuaaaggauaagaaaaaaauugucuaaggaggcagcaguguuuagcucauuuugcguuacuacuaaagcugaaauuuauuaggagaauguuuauggccugauuauuuagacuuguugaguuaguuuaaauuuuuuaaacgauuuggucaaguagaaaagcacaguucuguaucuauuguacuauuugaaaguauuguuacauaaaauaaauucgaaauucugccauuuaauacucaggcauaugauucaggagugaaauugcauugccagaaccuuggggucccucauguaucuuaauaugaauuuuauuuuuagagguguauaagacauuggcacauauaaucuguggcuuaauugauaacagcaaagaaaauggaauuaaaaauauuuauuauuaacagauacaguugggauuacaaaauucaaacugcagucaguaauuauuuuacaaauaaaugcuauuucauuuucccuuuaguaaauauaucaguaacuucacccaauauugauguaagugaaacccgacaguaacaagcugggagugcccagguagaaggggaaaaaagcauguucauuuauucauucauuccuuucuccguuuauacuuauucaaagaguauuuuucauugcagcuaaaaacuagacacaccauguaacauggaacaugucuuuuucuucuauguauucuuauuuaaaucguggagcuuuucaacugagauucuucacguuuaaugaaauuugcagucuugugucacuugcgucacaauuuguaggaauaaccuuagcauuuuaaagaguauaccguguagccuuuugagaaagucaugcauuugaaaaauaaaauaacccacaaaguguaacacauggacuuuugucccuuaagcugauugcccuuacucacuugucaccaccuuuacgagagugagggauauguuuuagauacauuuuuuuuuguccuauagaaaccagacucacugcuuuacuuaugcguauuacucugaaauauauuuccagugaaugaauauaguaguaaaagugguguagcaagguagaaaaaacacugcacuagacauaaaaagaccuuucaaguauaacgucugacagccucuacuuacacacccaguggccuugguuaggucacaaaccugcuucucugucuacaaagcagguauaaaauagugccugcauaauaagguggugucaauauacugauaacaaaccuuuaucaaaguacuuauuccaugccagaguacuuauuccauguucuaagugguacacuauuacaucauuugcaucuauugaaucauuuauuccuauaaaaauccugugagauggguacuacuguuuauucaagagacuuaaaaaugagacacagagaggugaagaaacaugucugcggucacacauaguaaguggcagagcugggagugagaccugggcagccugucucuaaaguuucuguguucuuaaccauagugcugucuaugcugccuagcguuucagacacucuguagaccaaaaagcucucuacagcaagguugucauuaaguuagcaaguauuugacuaucuacaauaaauuaauauucagaaauuucauuucacuguagagugaucaucaguaucucuguauagucauguccuauaacuuuugcccaagcaaaucaguaugccaggcaguccaggggagcaucuguguaaacaaagacaguauaauauagugguuagaguaugaaaucugaucaacuggguuuuuagggggcuaugucacuuccuagcuacacaguuauuuguaaaauaaguacucauugggguuugaaugcauuuauguaauauccuugaauguuacauacuauuguuacacauaauaaaaagcacugucaugcuauuaucaguaacaagguaacuaccuuucauuuggcauuugagaaacaaaucuaacauggcagccuacuuaggaguaguuagcaguagaauagaaacuaagaccagggucucagcuauguucaaaagaauuuuaccuaacagaggucacuugcuuuuucugaaauuauguaauauugcuuuuuuuuuuuuuuuuuuuugagauggggucuugcucugucaccuagguuggaguacaguggugcaaucauaguucacugcagucucaaacucccaggcucaagcgguccucccaccucaggcuccugaguagcuggguacacagguucacaaccaccacaccuggcuaauuuuuuucuuuuuuuuugguagagacagggucucccuguguuucccaggcucugcaaacccaucucuaucaaaccaagacacguagucagcccuuuuaaucauuagaccuaguggucugcaaaguuuguguuggaaauacuuuaucuucucucuuuugaacugguacaucggcugugaugcccggagcugcuuauacugugguucccuuggccaauaauuuguuuaugccuaaaucagccuugccucuaagugauaaggagauacgugcuuuuucuuuuguuuugugucagugguauucucuaauaggccgggaacgggucugcccaagugaugcacagccccuugguggggcuggcuauagauccccccgcaaaacugaagguuaggccuaagauauuagcuuugccuggcaagaugaagauguguggacuagguagaccuguguggcagucuguuucuuuuauaaaguaaacagaguucaguuuguuuaggacugcuuagguagauuucuuacacugagcaggaauauuuguacagauguuuuaagguaaagucaaagaauggcuagauuguagccuuugacgcauuauaauguaucuuuucucagugccccuguugaauucacaaaagaaaagguauuuuugaucaucggcuaugagaaacuuaaaacacuuuuuuuuauauauaaaggcugauuuaguuaacucuucuugcauuuaaagaaaaaaacaucugcugaaaguagggaggggggaggugugagcggaagcguggucuccacauuccacaaugaaugucuuuucccagccaauuuuaauuugcagaaaaaccaggcacugaguuagauuccucgggaaaagucccuguuggcugaugagcccugaacuucuuccguguacacccugaacagggacugaugcuucaguucacagagauaauuuuucucuggaaagccgauagauccgauuuagccaccccucauuuguagucauugccaccuuguggauuacaaaggauauugguuuucaucaaacuuccauuucgauuuggcuuuuuauggcaaguacacguuggcaguggauugccguguuccucaccaaaaggauccugguuuguucagcaacaccucacuucuccacucacaguucauuuaugauucugaugagaguguuuuuucaggaaacacacauuucacuuuuugaccuaggagcaucuguuagaauuuuuuuuuaauacuacuuuggcauucugaaaguguuaaugucuuucauaucuguuuaaugcuauuuagggauauuuaugaucaccucuugguuacucaggguaaagugugucgcaauuuuuuuuaaacagacaggaaagcauucacaugaggaaacagauugcuuuaaacaugugcuuccugugacaguaaaaagaacaaauuagauuuaacacuguguaaugaaugcauaaauguguacauuuaagcuuuuaaaagcuuuauguucaguucuggucacaacaaaaauugagucaccuguaaaaauuaaagaugcccaggguacucucagacuuuugaaaugcccagcaauugcaguccucaccugacgaugccucguuggaauuauaaaaagcaugaucuauuagugcuggagagaacuagaacauuacaaggcacauucagagguuaaaccagguuacagucagauuccguacauuuagcaaauaaaucagaauuuguugugggggggagaauacuucacucucaucuuccucccuaagaaucaaugaaaaaaucaauuuucgggaaccccauauauuccucugucuuucaugaaagaaaaagaaggaaaccugauguuuacuuacuagcauuuacuacaauuuaauuauauaagaaaaugacucuuuuucuuauguaauucaguuuguguuuuguaugcuggcagggagugaauagaaucugaguuaauauuuccaguuagacuagaguguggaauuggagggccugaauccucuccccggaagaagaggcacucauggccauuucugucugagccugcggauagugccucuccguccccugugcuuucaaagcuaaggauuuguggcacgcuugccaucucucuggccaaggagggccaggagagagucccucgggggagggcacauaguuugaggacaucugacucucuucuaucacauacugagguacuaauaucaaaacagacugcuugucgucgcacgguggggcagugcuuuuuuuggcugccguggucgaaaugaaaugggcaagcuguaguccgcuuggcaucagaaugggcuaagggaagcagggaaaucagagucagacugugaaugcaagucacagccaaugguuaacuuccuuuuugugugucacuuggcagcagcgagacugauggugauuuuuuuuuuuaacaugggugagaguucagugcccuaggaagagccguagaugcuguuauugugcuuccucauacaguugacuuguguugauuucuugaggccaguacagcuguuccaagagccagcuccaggagcuuuguguguauguacauggccaucggacgucggaugaaaaagguaaacagaugagaggugauccauacaaaaucucacugcugaucacuaggcagucuuaggggaaucagguucuggcauaaggcaauaauaccaaagaauaauauauagugcacuugaagggauacucccuuguauacagacacccaaagauauuuuuaaauuaucaccacuccgcaccccucaucucacauacaggauucaaaucaauuuuggacugucuggaaaauguaggacuaaaauagccagauugaauucagauaaaauuaccuucugcuuuuuugggagguuguugcuuuuugguuagccacauuauuuucuuugaagauucauuuggaagagaguuugguagaauuucuagccucucucaagauuuuccucccauuucucuguuugcaaagagcuguuccccaaaggcaaaaagagcgaguugccaucuugagcgaauuguauguuuagugaacaccaaauggucucagaguuacccuaaauuuucauuauaucugguugcuuucaaauacuauuuauuccccucaaaacuccuaaccauuuauauaagauaucaguaagaugaccaacuucugacaacccaaaagcagggaaggaagcuuagaaauagaauaccauuugucugguaauuagaguguaucucuuaagaguucgagagaauucugauuaaccuuucuguucccacauucucacguaaaauuagcacaccuuuuaaauuauuaucuaguauuuaaacacauauuuuugagucuucuuaaugcaacagguucuggggacacuaaaaguguguuauaguuuucuaaaaaacuucauuuuucuuacauuuuaaauguucuguuugugcaaaauuucgagaaucaccauaagggcuucuuugcauuuuuaauuuaguaacuaacauaugaauaaauuugcauauuaauuaguugcagauuaaaucaugcauacauaauugccuccuuacuguguuuaauguuugucaaaaucuccagccugguuugauggaugucguaugaaagauuacaauuugauguacccuuggaaguauuuacaccaauaaugcaagauucuuaauagcagaauuuucuaguuauauacaguuacuaauaaacauguaagauagguacaugucccuuugacuaaaauuuuuuucuuugcaccaaaucauuuacuauucauaaucauuaaugcaucuccuaauuauacagcauaugucuguuaacccuuucauugcuggccuucaaaugguagcuucuuucuuuuucuugcccccuaaagaaagcaaaauuguuugauaauacucugaaauuacucgauugccuuuuauuuauuucucuccuaguauauggacaaaccucauuugccauuuauuuuaacauacaauagauaauuauaugaucauuuuguauuuucuaguuaaagaucauaaaaugacccacgugcacaugguuaguagcugaugggcuuuugccuuucuuuuaccaaugcugaaaaaaauugaaauauuucagauacuucauauaguaguaaaaaaaaauguauacacagacauacucucuauuuaggaggguaauuguagaauaaguaaaaguauuaaaauuauauuuaaauucauuuugaauauugaaaugcauuuaauguaucaugaucaaacauaggauggaaaugugauuuuuuuuauuagaauugagaucucugaaguagaaacugacaagagaauagaugcucuugauuugacauaauuuuaaaaugccaauaaauguuuucucaaauuucuucagguauuuaauuuuuuaaguuuuaucuuacucauauaaaaaguagaccaacuggcuuuuuuuuuuccuuuuuacuauuuugaugucuaagcugcuuaucacacuguauuacccugcauuaaugaguauuccuacugugcaaaauucuaucaaaaaugauggugugaaugucauuuuuaauuggaaguuuauacagucaaauuuauaguacacaacaaaaaauauguauguaguucugcuccaagccuuuuuuuaggcuuuugaucuuuuuaguuuaaguauacauuuuuauuaaucuaagugucauuugaaaaucuacacaaauaugacuacauuuuuuauuaauaccauuguauuauggaagagagggaaacuaaggcauagaguaauuauaaugucuguaaacuguaagaagaacaaauacaagaaugaccaagaauagauuuucaggggucuuuuuuagacaugaaaacuugcugaccgguucuguauguuucacauaagucagacuguaugauuucugucuucuuuauuuuugaaugccugcauuuauaugccuaguaaaaaggcaaagguuaaaaugaguugaaagcauaaacagcugauuucccuucuuugauucuuucauaggagaaauaaugucuccuggucaccuaccucaggagcauuuauuugcuuaucacaggacacaaugaacuauuuauugauuuaacacaacauucuuuuacaacacgcaauauuacauuaaauuauuuagcaaugugaaaaaugaaaugaaagcugcaaaacuuauaaaaggaagcaaacagucagaccugaaacauauuuauccacagccauugugccuagguaauucagggcauaugguauguaaaugauauuuggagauccuugccaaaucuacacacgacgggauaaauuaaggacagguuucccugggugugagucccaugauuguggccggcacacuuccugcuugaauguguguguucuguucuugucuuucagcaagagcgucacagagcauucaguggccaaaucugguccucagcugacuucuaagacauuauuugcaauucccaagaauugauuuuaugauuaaauuuaaaacauaguaccaauuugccaaacuuucccuuugcucucacauuugaaaaguaagaucugaauaauuugucaggauauguuuagauauuaagccauuuaaauggguaucuuugacauuagaaauugagugccucugagcuucuuagucacugaagaaagguguuccugagcagugacuuuucucuaagcuaggauuaagauguuuccuagaacagacuaugaauuauuuugaacgauugauaauuuugguuccagguuggcccaguaauaauuuauuaauucaacuugacaacccaaauuacugguaucacuuauuuuauuuuugaauuauuauuuugaagcauauacucucauuucuagaaaggugaaggcacugacuccuauuuagaauaaauuuuaaguagguaagagguuaugcuguuuucuuuuuuuuugaaaggaaugucuuuucuaagcugggggucuuagcucagaguuuuuaaugcuuuaaauuaagguucauuuuuaucuuggaauuaugcaauuggagauuuugauuagaaacuauggcagaauuuuuucuccuauaauuuauuggacuauaccuaaagagugcauuuacugugcacacuuaauuauaaauacaagacuuauauguuauuuauaaaaguuauuucgggguauuuuaagacauguagaguauggcuuaggauguuuuauuguuuuuacuauuaagaauaaugcuuuuacuaaauaaaacuguguuucuuuuauaaaagauaaugcucuuaauauuaugguuuuauuugaauuagcaguuuagucuguguccccacauuccauuucauuuauggaaugcaaauaacacuaguuacugcauagaaaaugaaauuaggcugaguccuuguucauugcuguguaaauuggguaaaaaucagagaaaaaaaaauacccuugagaucaauguaaaucaauacuacuugagacagauccagcuaaaaauucaugaaaggggucacaguucuggaggaguuuauauaauuaucauguagccuauaguuugugaacucagggcaaaguucugagcugguuguucugggaccauuccuugguucauugaaacuacuuugcacagcugugcuucaaacucaacaacagagagcaaaaacaauauucacuauaaaauaaaccucguccugccuuucaacuucacugugaacuugcagucuugaaaacaacaaaagggauaaucgcaauugagauuacagaauccagauuagauguaauacacaguagggugguauggcccaauuuuacuuacauggggcaaguggaagugcugugaaugccaacauguuaagcaucauagccacuuauuaagauguuagcuuuaaaugucagucuuuggaccccauuugaaaugaagcaccugcauuuuauucaaagaaauuaagauauauuggggaaugcggaggugaguugaggguuuuuuuuguuuguuuuucuguuuuguuuuguuuuuuuuuucuggugggagaaagugccauagacaauagagauaaaauaucucaaguauuaaaagucuauuuuuauacacuguaugauucaaaaugacugagcaguuuugaaauuuuguagaaagaaaggaauauaaggagaauaagaaaugauauuugcaucuuuacagacaacucuguauagcacauuuaagauucuggcaauuuccuuacaaguaucugaaaauuaggaauuaugaaggaaacccagacagauacuuaacuauagcauugcuaccaggugucucuuugauaucaaugaguuaggaaaccuuaagaaaaaaagguuaaaacauccagaaugauaacuuauuuuagaauaugcuuucagacaaaauauuucuuuguuaagaauguugaaagguuuuauuuaauuguucacauauauuuaguaaauuuuuugguagacuugaccgauuaggcuuguuucauaaaagaugugggcuucuguguauuuagaucuuaaguuuauuucaaauuggccuuuauaaaacuuuagugccuuucucuuagaauucuagucaacaaaauuauauucaucaaguguauacaucacagaaguaacuggugauacagaguauaauuccuaccauauugucaaauggagucuauaucuccucaaagggaaagaaacacugacgugagucagaaguuuucacucacuuggcacugaaucagcuuaaaguucgagguugaaaaauucacaaauauuuauagcacaccuacuaagugccacgccuccuggaagguggacagcaauggccaauguuucugccauuggaaagauuugcaccgaaguguguauggccacauguaguuguacaaaucagaguucauuuuguaaugcuuuauaagggucugguaccacugauucuccuugcagacuaauaaacacagagcuuauaugacucuuaaaaauacagugauagcaagugcauccuaaauuauguaaucaugugguccaugauaacaguguaauauaugauauacagauggaaucagccaccuggcuuacuguaauuguuguugagguccuuuguuaugaacauauauuucuguuaacaaugcaacaaaauaauuuuuuaagcuguuuuuuuuuuucuguacugccucaaaucuagauaaacggaauguguuggaaaggacaacaaauaagaaguuaaauauguggaaaugacauggaaagcaccuguuucuucccuuuguuuucuucuacgucaucaggaaauaauauuuaaccauagaauauggugucccucuaagaaaauguuuauaauugaauguucaaaguagaauauagauuaaauaaguaaagaugacuugccaaaaaaaauuaaagaacauuugaaacaaacagaagucugcaucacacauaauaaguggcauaacaguaucaccucucaaaagugacaauagauguguccaucuuuaugccuuuagcauguuguuggcauuauuaguuauuguauugagagaguagccacgcuauacaagagaaaggaagguaaauuagaucccucacgcccccuucuucugugaauuguauauguuuuugaauacacucucugccaggacagcaaauaaaauuugguucaucccugauccucagcagauuauaaucuagguaaaggacagaccagguucaugaaaucaaaaauaauaauuagaacauuuggaaacuaggggaacagguccucauauugugugcauguuuuaucagucuaaaguagauauagcucuauugaaaauuguuggcuaguaauaugcucauuuucccauuucaugaagacuuauucucaaauggaaguuacagcuggcuaucguguuuuuccgacaaacucucuucucuguggacaugaugauuucuguuguuguggaaaggaaggaaauaaaucucuuuuuguuccucauucacucaaugagcaaagugugauugagcuccuauugugugcagauuauauuguuggagcacaggacaaagaaagcuaaauuaucaucuuuguuuagaaauuuaagauauuugggagcagcaagguagaugccuaugccuaguuuauuuaacaaggcacugaacuuugcuggagaauccuauauucuagaauauaguccuuaucuggaagugacuacagaaccugauucuggaucacagagagcugcagaucuggugugauuaagacaguggccacagauacuccacugagcuucugucuugcagcuucugucugucucuucccugaaaaucacagggaccacagauacuccacugagcuucugucuagcagcuucugucugucucuucccugaaaaucucagggaccguguggaguuuugcuuggucaacuggagaaacaacuuuugauuguuuuuauguuuuucagagauuuauuugccagagauauuacauuauaauaaaaacauaaacacagaaguuagggauuggaacaaagguuauauggucacaauuuaacucauaguuauuugaaaauuauugguuuauaaggaaacagauuuagacaaagcuagaacuuaugcagguaaguuacaaagcuagaacuuacucaggcaguugcucacgucuguaauucuagcacuuugggaggccggggcgggcggaucacgaggucaggaguucaagaccauccuggccaacauggugaaacccugucucuacuaaaaauacaaaaauuagccaggcgugguaguggugcaugcugguaaucccagccacucaggaggcugaggcaagagaauugcuugaaccugggaggcagagguggcagugagccaagaucacaccacugcacuccagccuggugacagagcgagacuccgucucaaaaaaaaagaaaauguaguggacacaauacauuuagauuuuuaauaaaguagacauauguuuauugcagaacauaugagcaguugauuaguuaaagauauccaacaugccaggcgugguggcuaacacuuguaaucccagcacuuugggaggccgaggcaggcggaucacgaggucaagagaucgagaccauccuggccaacguagcgaaaccccaucucuacuaaaaauacaaaaacuaucugggcaugguggcacacaccuguacuccuagcuacucaggagcugaggcaggauaauugcuugaacccgggagguagagguugcagugagccgagaucgugccacugcacuccagccuggcaacagagugagacuacaucucaaaaaaaaaaaaaaaaaaaaaaauccaacauugcuggcaaguuugaaggucacagcccauguacaaaauugguauaucuugaggaacucuugucuuuaucauauguucuguaccauuuccuugcacacaacacaguuacuauaugaugguacuaaguagauacagguccagaccccauaaagaauguggcauucaguucuugaacagauguuagagaacacaacccacucggcaguaagggauaucuucaacuagagggaagggugagaguugaccuguuuguccuuuugacucauauuuagaaaugcuaaaguuguuuuauguucaaaaugcauuugauaaucaugccugaagaggucaaagugcugacauuguugaaaacaaauaccccugucaaacaaauagagacaauuuucaugucuuugguugguaagcaccauaauuuggccuuuggcauugcugucaguaaagcuaguugaugacuuuuacaucaauuuuuggcccaaccauaaaugaaggaaauaagaccaauacugccacaguacuuuuucucacucaucacccauaccugauucagcuggguuaauguuaaaagccaaaauuuaucaauaucaauuuuuuucccaaaucauucuuauuuuaguacuguuuaugcucaauaaaaguuuaugaauuucuuucacuguuauuuaaugaaaacccagaauuuuuuaaaauugcacauuaucucuuuaaaaaaagucuuuuagauuacucgugggauuuacucuaaguuguugucuuuuaauagaagaugaugcaaaacuugucucaccuguuccuuccuggucgugucuguguuuaugugugggguggguauauaagugcuuuugauuaacagaaugaagagagugcuuauuuugaaaacucagucguuaaaauucaaguuuauuuugaguuaaagaacaccauauuuagauuaggaauggaccaaugaccugcuuaagcuuuaggcuaucgauuggccuugagggaacuuagaucugcuaaacacgaacuugaaaaggcacuucagugauggauguacguuggaugcucucacuguauggucauucacuugcauuuuaaaauuuauguuuuguuuuuccuuuauaccuacucuuuucauuccguuugucagagguggccauuuaaaguauuugacaauuguuuguucucugccuagcaaguuguccuauugcuccaugaugugaaagaacaaagguaaucaacaguuagaaaccucaggaaauugcuagaaucuucacccccaaagaggguuaauaaacccuagauaauuaguucauuuagaaugaaaaccauuuucauuguaauaaucacauuuccccucugauuaucgagcaaugcauugggaagccugauauuuauucacaaauuuuuuaaaauugagaacauccugugcugagauuccagucagcuucauccauccauuuuuuguuaaaaguuucucaacuaucauccuucauccagacaaauaaacauaaccaggauuuccccucuaacuuuuugggaauucauuuacacguguaccauuuugagggaaaaaaacaauuguccucgaauuucauuugacucaggugauugugguaagcucgcuaaccagcuucaucuaggaagugcagcaaucugagucaacuuccuccaucucuguuuuuacauuguccagugugaugcuuccucauuguaccaaaauagaaaugguuuguuuuuguaucaaacuuggagacuggcuauggauuacacuggguuaggauaaggguuuguuauuuuuuuuuuuuuaagaacauuccacuuaucccaagggaaaaagauugacggccuggggaaaaauaagaggcauaaugaagucuuuucuccuuaaauaaaaaucacaucuagucuucagaugugucaauugcacuauguuugccuaauuucauuuaauauuugagagauuuaguaguaaauuuaugacuuuugcaguuacuuugcaaaaaauugaggaaggaagaagugaauuucacuuugagucaaauguguagguuccaguguaauuaaaccuaaaaaucuauauauucuggucuugcuacuugguauuacacuuugccauaucacauaaugcuauuagcuacauuuuaccuuguuugcagggugaugccauuuuguaucucugguuuguugaauuuccuagaagauguuauguucauguagauaauggcauacucauugaauucuuuaccucagacaugaaaauauguggaaaaguggggaaaugaaucugaucagauuucacuguauacugaaauuugagaaucugguuuuugcaucuauuuugcaugcugcugucucuccaaaccauauaugucugugugaguuuuuauaaugccacauaaagcaaaaugagaagucucuucuuucuucuaaagggaaauagugccacagaaagguagaagucaaauauuuacuuauggaucaaaaaucuaguuaaaaaacaacccauugcuuaccuuaguaaucaaugugaauuacuuuauaaucaauaugaauacaagcuaucugaccagucacucagaaaauaaauauuugaucaugugauaaaccauuugaaugucuacauaugaacccaggccauauaaaaauaaccaauucaagauaacauaggaagucacuaaaaaagacacaaauaaaauuagauuucacaguuuacgcugauauuuugauacuuuucugugauaaaagcaucuuccaaacuaaauguguccauauuugaaccauguaaauaguuaaaaguauuuuaccugagaauaucuaaaugaugccaagaaaauaaguucaugccacuaaaaagauugagaugauuugugcuuuaucugacuucuugguguaauauggauuuacuucagauaaguauauuuucuacuuauccgauaaguguguuuaucugagauaaauauuuucuccagauacguguguauauugaaaaaaaauuuaaaauaauuaggaucccaauugaaaaaguaaaaaucuuaauugcuuaauaagaaaacaguuauuucauagucuuaagauuucaauacaaagaaauaugggaauauacacguaagagguuuguugguguucauuauuaaauugcaaggcugucucaaguuauugucaucagaauaaauucugugugugugugucugucugucugcguccuccuguuaguaauuagaucuuuuaugaaguuguacucauaccuauuagggauuuuugucauugcaguuuuaaguugaauaugacacauggauccuuuguugggucuaagcuaucaccauuuauuacaauuuuuuauaacauuccauauauaugcaucuacuaacuaaacaucagccuuaauuuagcuuaugaauuaaauuuuuuguuaggagugacuccugcuggagagcaaaaaauaccaauuaguuuagcuucuaaauaaacuauacuccuuuuuucaauggacaaggguaaccuccuauuccuuggcuuggcaacauuuacuauuccucuaaguuuaaagaugagaacauagauuugaguacuaacacaucagcagaaauuauauuuuuaaguacauacauaauucucaggccagucguguuuggugcuccaaaaagauuugugauugaauaucuuugcuccauugggaagaguuuagcauggugcuguauuuuuauaauucuuuuuuccauuuuagcagacuucaccuaagucuauuuuagguggagauuuuuuuuuuuuuuuuuuuuuuuuuuuuuugcugcugcucuuuaaggcacucuugcauagaggaaacagcagaggagacacaaggaaaugcacucuccuuuauaacaugcugcugauucucugaacuagguguccucucauuuaagccucaaaagaagcuguguauuaacuagaugaaggaacuaacacucaaaccugugauacagcuuggccagagucacacugcuggggagcagcaagguuacucaucaagaugugucugacccucaaguuuaagugcucugauuuaauaacuuugcucacacccugauuccagugucuuaguagcuuuugaucuauaaaaugucaucuaaggaucuuugagccuuaauucuuugucuuuaaagugggaaugauaauaccugccacagaguacuaguuauggagauuaaauaagugaaggcaauuauuauauguucuuuaaauugugugucacuguacugugcauguauuaagugucguuuuauuagcaaauaucuuuuugauggguagauguuuaccugaggugguuauuuaauuuauaggcuggcuuguucacacuauguuauguaaucauuguauauuaaugaauaucacuauuuuccuuaggauaugauguuuagcuaauucagccaugcuaggcaaaagaggucagcauuguagaaauaagcaaugucuuauacugaaaaaaagaaagacaacaacaacaaaacaacaacaacaaaaaacaacuuuccguguucagugacuuaaacagaaacauggaguuguucaaauucuaccaaguuauauucgggaggagaaaaaugggaauuccuuccauaugaccauucuucauucauucauuuauucagcuucuauuuguugaguugccugccuuacacugcaauaugcagggcaguuuguguguguguagauguucauuagguuuauuugcacuuugcaguaaccauguaauauuaucauuauucagaaauaaagguagaaucuacucuaaugagcucuguggucgaguggauaguucagcucuuuacccuguaauaguuuguuaucuaauuguuuaauguaugugcgauugccuucacaauuaaagcauuauucuuuagucauauuuucucucuuuucucaauuuucucaggaagaaaauugacaugucugugaacccugugcauguccccaaauggagcuuaacccaaaguugggaaucacuaaauaauuguucaugaaaugguugaauauagcucuucauucaagugauguagauucugaauauuuacuuauucuuuaaugcaguuauucauucauucggcaaguuuuuauugaacaucuaccuuguagguaauacuaugccaaugcauuggggguuuuaggucaaauauuucccaguuucuuauaacaaauguauguguguguugucaguucugcuucaccucaaauauaucugucaaagacuuuuuggaaaauuacaaaagaacuguaaacuuuagauucuagaagaaaauaagaaucguguggguuucauuuaaguggucaacacuucuagacaguuugcugguaagaauuuuuuuccccaaaaguggcagaaaaagacaacuggguucauugccuacccccaguguccucaauagugcuuugucuaagcaccagagagggaugguggcuuucuguauaguguggcuaaccaucauuccccaucauuucagcgauaacaaggcugggcauggggggugggggugguaccaaguagguaaccaaguuaccuacugcuggcaagguaacuuguccaguuauacacuacugugaaaacugugucugugaaacaagcaguagacuaguucaggguccuguaaaaauuggcugcuuaagauuaagacuucuuuaaaauuauucugaaacacauggauuuaugcauauagcuucaguuguucuuauacuucuguucuaacuccccacgcaucacacuaaaaauuuaucauggaugauauuucugucacaaagaaaacuucaaaggcugagaucgcagaaaugucucaguugacaagccacugacuugaguucugugauugaaauguacuccaaggucagcaaaccaaaaccaaacaucacuggaugauaauacguucagugucucacuggcuauaauucguagaucaccuuucaaagcauuauaucuuuauuaaucauuguaaauuugugcuuuugaaaucuuagacucguuuccauuaggcaaugaagcccagaagcuuaauguucuagucucauuuuaauuuuuucagucuuaugugcugaauugucaggguuuaaaaaucgauuucaccucaucagauuaaaaauauuuauuuaugcacauguuaacaauauauuaaaagaaaugagagcuucaauuuuaaaaauaggaauuguagcucauuaagccaugacaauuugguuuauauuuacauaauuaauaggaaggcauuuauauguuugcaaaauagguaagaaaagguauuuaacguagaugaagcagaaugauuguuuaucaaaagaguuuagagaucuuucuagcagucuacccauggaaaguuaggaucuagaaaagccuucucaauaagggaagaaacaacaaagaaacaacaaccaggaaacuccccaacuuaucucuuuaaauuccagccucuuuucuaaguggugguuuuuacauacuguccucugguagguggguacccuggccuuguguauuaagcagugagggugguuuaaagguuacaaaugugauccugucagauugacaacuaacuguucuaaugaggaaaaaauccucaaagcaugaaauuugaaugaaaugugugauuauaauucaaguacuguuuacacaaaccucuggggaccuuccgaauaaaugcagagcaagugaguuagacaaaccucugggccuucgauacguguguguggaugugcgguguguguguguuuauuuuagagaguggggaaacuuuccaccauuagcccgggcuuugcuccucggaaccaacaccacuauuccuccuuguuuauuaauacuguauguguuuuguuagcauauugaguuguaaggaaauaggugcuuugaauuauuaaaguugauucuugagaauagauguaugcucggguggcauuugcuucggcauaugcaaaugauuuaguuucauuugggaucaauucccagaggcccuccuuuccugugaugcucugaauuuggcaagcucaagucagcccaucuccucuccccacaucccucccuuucuuucuuuccuuuuuuuguaccuccccccgccuuuuuguugauugguauaauauuuuuaaaagacaauaaauaaauauaucaacuugcuugugagaaaccuugccaucuauaaggauucuauuguucaguugugaucaauaaaggugaacaaagguuuucacguucuuaaaguuuagcaaaaucgaaguuuaguaaaaaugugcaugagauguuugcuaaaauauuuauacagauacugggcugcggggaugcugcaaaacucugaaaauguggucucaggggugccuuuggggaaacugacagcuguaagauauucgucgguucgaagguaccaauaaacuugcuuuagagcccagcaaauagcgugaaguugcaguagauugucuaaagcuacagugaaagcacccaacuccagaguggagaacgugcgcccuuggggcgcccagcgccagcgaggggagcagcgccccagccccuccguaggcucugggcccaugcggcugucugcggcggggcgaggugaaguucaugggcggccgcgcuucccaccagcuccggggaggccggggcccgcggagcccggggcgggccgcacugcuacucuguuucauuccgcaaccccguuuuguagguuguugaccaagcagucagaaaacacugcccccucucuccuuuugagcgaggucagagacgugguguuuuuuuuuuuuuuuuuuuuuuuuucuucccuccccuuucccuccccuuucuccgagucgaguucucaggcagcugcguacaaugcugggagcuagccagcagcagagacagauggcagaguuauuagaugugcaucauacgauucccuuccugccacucgcuuuuuaaucaaauuaaaacaaaaaagaaagagagggagagagagagagggggagucaauuaacugcauuuguauucugcucaauaauggacccuguuccacuuuuacccuaaggcaguugaguggaaauuuuagagaagaaaagggugccuagaacaaaacaaaacaaaaaaaaaaaaaaaaaggaaaaaaaaaaagaaaagaaaaagaaaaaagugaagacugcagaaauuuguaagaaucggcauuauucgaggaacuaauaaaaaccccucggaaaaguugaaucgaucucgcguaugcauuaggauuucgagcuccaucagggccgggcugccuuccagcuccgcugcgcaaaguugagcgucugacagcagcgccgcggccucccccgcccgccaggaauggucucuuccugcuuugcauauucaccacgcuuggcccggccauaugggaaaaugcaacugaaggaauuguugugaaaaaagggacagcgaguuugaaauaaaaguuguuagagugguacugaggagaaaaaagaauccgagaccauguacugcgcauacacaaucccgggcaugggcggcaacucuuugauguacuacuauaaugggaaagcgguaagcgaaugcgggcugcgagggggauuuuugacaaguuuuauugucgcagggaugagcauccuagguggugaucauuguuugcaaaguugugcaggacugccgcaccuuccugggugccaugaaauauuuaucauuugccaauccuaagaucuucuucuugccuacuucuucuccuucgucuuuuuuuccccccacuccucccccagaguagaaaaauagaugcuuucagagcuuuagagaguggauccuagagcgaaaguuugcagucagguaaaguugagaggugguaugauuuuuuuuuuuuaaagaguuuuggaaaauucuuauuccuuccaaaugacuguuagaaaggaaaagcagauaugagaagcagaauugagaaagcccaaguuaggcugagaggaaauuugggguaaguuucucccuggauugagguuuugugauaucuaaagucuuacuaaguuggaagcuugagugcaguggauagaguggagagaaccugaaagguuaaaauagagcaaacacauaaaacugagagaucaaauuaaggaguagauuauauaagcuuagauauauauuuaaagccaaaauggggaaggaaaaacaaacggguucauucaugcauauaacaguauugucauaaguuauuugugcuguguggcuucuucccucaauuucccccccuuccaacagaaacgcuuuauuuaagaaaaaaaugugucugguauuuugugcauaaccccagcagaagguuuauacuugccaucuggagguuuauuuuuuuuuuccuucgucugggcccacugaaggaaaaggauuucaauauuuucaaaucgguauguggggcucucgggaagaguuguugggugauagaggagcaaaaauuuauuguuuuaaaauagaaaagaagaaugagagaaaagugaaaagcagccauuuauaaacuguucucuuuguguacuuugaacuuccauuuggauugaucuuaaucagggauaguugggccaaaggggacagaucagagcuuucaggaaggcccaguucagcuguagcaauuggcgcaaacgaauuaaacauguguaugugcugcuauaugccugugaguguauauacauacagaugcaugcauaacgguuauuucuagaugagcauauucuguaauacauacauauacacaacuguuugaaggugcaguuucagaagauuaauaauuucauuuaagaagccaguuuuaugaaugggcaacuugaaauaauaucguuuacuuuuauuuugaaaaguacgaguaaaucaucaaaaguucauagcgcuauccuauuuuuaucuuuuuuaaaaaagagcacgguguaauuaaaauaguuaagugugguaagggaaauauaauuuuaaaacaaaugguuuucguugugauuugaucaaaguguuuaaaucuguaaacauaaauauugggauuauguaacaucuuuuuuuuuuuuuaacaaguacaugauuugcaauugguaguuacucauauauagauaagacuuuugccuauuaucuuuuagauguucucauacauaacuuauucagcaccuuucauuuuaaagcacuuuuaaugaaaauuuugugaaugaugccaucguagucaguaagcaaaagugucucugaagcagauucagggauuagauagcccuuauccguaaugaaagacuuacauuauaaaagaauauaaguuuccaugguuuuuaucuuucaggauuaccaaugaugugacuuuuacauguuaauuguuaauuuugcaucuuaaauaucugaacugacaaaauuuuaauuuaaguuuuguaccuuuuaacucccuuuuggccaaaaggaauuuucaaaaauauguauuccauucccacagcuugccaguugccuccaccguaagaaaaugcugaauaugacaucauaucacuaauaugcccucucaguugccaaauauuuugguuguuagauuuuuuuuuuuuuugagaggaugguacucauaaaaucaagaucgcucugucacaggaaauguauuuauaggaacuguuuuaaggcguuuauuaaaaacaaaucuggugauguguaucucuauugauucaaacacuagaaagaggcaaauuguacacacauuauaguuagaaaaaaaauagccauuuggaacaccagcagaaagcuuuugaaacugcggauggcuaccaguuguccaucuuagcuuuaugaaacagacagcaaaguccaguugugugugucccaaggaaggggccaauucuauaccauuuuuuaaaaugcccucaugcauacacugaggaagcagauuuuuguuuauucuacaguguguauucugcuggcucuaauucugcauugaguggcuuuugauuuggugccagacauguuguggagauuguauauaccaugcguuaauuguucaaaaugccuaucgaagagacuuuacauuucuugaguuuuacuuaucguuuggagguugaauaucuaugcuuuuuuguguguaugugcaugucuaaccaauguguguuugaaccugaauuguugaaguuaaguguggucagcuauuuguugcacaaguuuuccucugaagagaacacagcacugaauuccuucuuuuuucccagugacaagucaauuacuuguuuaaauucaguuugaacucccugaacugagagaggccagaggaagcagguuuucccugugaauaaacaaaagaagaaaaauggaaaaucauuccaaaacacagugauuuuagcuugugggaagaauauaauuaagcauuacaagaauuaugguuucuucuuuuaugaacuggcaacuauaggguuuguaaaaucaguuguccucuaacuuucuagcagaaauauaaucaaugauauuuuaggacaaacgaaaaaaacgugaauuuuuuuacuaccuuaaguuaugaaguguuuccauguccauaucccacaaaaaaauuuuuccuuguuucugugaacaacuguaccuguccagaaguguggacucugaaaaaaauacuuaacaaaaaaucguaacacaagagcuaucaaagaauaaauuuuggauauaaaccagaauguauuuuuaaaaaucaguuucuccucaggugagaguuucaugaacuugauaaaauaauuuuugugauuuuuuuuuccucuaugcauuagagguuuaaauacuaacggauccaaaucuaagcuuaaaaaaaauuaaagcaccacuucugaacuacgaaacagauuuuuuuuugcagagaaaaucaguagcuuauuuuguguuggaaauacaagcuuguaucaaagugugccaaugugucuguccuuauuaaggcuauaagaaguauuaggcauuaccugcucuccaauaaguguaguucuagcucuaaauuuugaucuuuauggcuucuugcauguucauugaagaagaauuuuaauaagugauuauuuggucaaauuucacauaucuaauauuauagcauauccacgaagauaaaauuauggcaaauaaaacugaaaacaaaaguggcgaaauguccucguaaugguaauugaagaucacaucaucagcucucgccagcaugugcauguguuaaaccguagagagaaaccuguaauuauuguaauugcucuuuuugcuuuauacuaacaagcuucaaaccauguuucaaaguaguuguuuugaaauaguuauuugucaaaucaucaaaucucggaaaguaaaugguaaugagcuuuuuauguuuauauucugacuguuggucauauuaugcagcuuuucaaguccauaaaguucagagaugaaacuggauguuaauuauuucugauaucaaggccaaagaauaaaauaauguuacgaguccugcuuaaggugaaaaauuaggaauauuugaauaucagaaucucucaauugggaaacucucuauucuuagaagaaaguuuuccuguaaauaagugacaauaucagucagcaaccuaaauuuuuuaaagcugaaaauugggguaugaagaguguagcuuuuucucauuuaucacaggaagugcuaagauaaaaagaucaauauuuaaaugacgccacuaauaacauuuuucaguacauuuuacauauggcucuuuuuuuuccccccaaaccucacaguugguuggaacagccacacauaggacauagguagccacuggguuuuaaaguuuccaguagagugucaacuaugcaaauuacauuuggcauuuuaaaaauauauuucuuauacuuacuauuuucagaaccaugauuauaaaugaaagcagccaguauaaaugcuuuuauuuuuuuuaauugcuguuuacuugcuauuacacagcaaaaauuugcuuaggccacaaaguaaucaaauuuuuaaauuccccacugguucaauaaaauaaaacauaucaaagagaaagcauguaggaaaaacugcuuuuuugugagcuuauuuuuuaaauauaguuggcacuuuaauuuacccauuuaaaaauaacaaugaaauuuuuuuuuaugcuucauuacuuuaaaacaaaauuauguugauuuuguucuuuauguuuaagcugauaaaaauucaccagacacuuaaucuugacauuguggcuacaucuugccuuccugccucugauuaaauuuucaaaaucccugcaugagauucacagauaccaguuugaacguuucugugaggcuaauuucucagggaaaaaauauggaucaguuacaucuuugguuaauuuuaucuaguuccuaauuucugcuaggucuaagcauuuuaaauauaguguugguaaagcauccuucugucgcugggugauggcauuauugcaggcagaauuaggagaaaggacauuggcauaggagaaagaggguuggggagaaaaguggucaggaaaaaagaucuaauaguugaugcagucuuuuaaauaccuuuccaacugaucuacaggaaauugugcugaagaaucauuuguuuccuguuccacuauaaaugugguuugcauuacauccccuguucggcuuuuuuuguuguuguuuuguuucuacuaaauuguaguaccacgauggaggcuugagaauaagugaugucuuccuuuauaacuuaucuuuuaauggcuugaucauaguuggauuuuagacacugucauauuucauuauaugaauuuuguauguguguguuuccaagccuacuugaaacuucuauuacugcucugccacuaagaaaaacaaugcugcagucuaaguucuuuagaaucacuauuguaggucaaauacauggucuacaugcugccaucagggaucuauuaaaugaaucucuuguuuacucauucagaaaauuuagagauuuuagaugugguucuggcaauuguaaaaguuguuagaauucagauuuacuuuugccuuaagaagaaaauacaguggagacauauauuugcucugcacagcugaccuaaaugcaugccuuguaccugugagaauuucaguaugcggacacauaaaagauuacugggccuuuuuucccccuccaauauuaucagaguuacaaaauaaauaaucuuucacagucaacauaguuuaaaaguaauuuuaguuuuaagcuuuuucaaguuuuuauauguuuaauugcacuuuauuagcccuuaauacuucaaacauaacucuaagaugacacaggcuaaaguuguauaugauaaacauuauugauuacuuaaaaaaaagggauaucuguauauucauaaaacauuuauaaucuauuuaggaaaucaucauaguccuaaaaaaaaagcaguuguuuguauaccaggaaaaagagaucaguagugacaaaaguggaaaagauacuuguauaaaauugucuccuuuagugugaagugaucuacugaaaguuauacuuggaauuuucagaaaauguccauaguuguaggcuuuauaacauuucaaauucuguaauaaacuauuuggcacauuaucauaucauuuuagguauauagauaccauggcauuuuauuaagcaaaacaauuuuuuucuucugaagaauacuuaaggugaaauuuacugguuuugagcuugaaagugguuugagaauuauacaugaacuccacuuaaacuuuggagacuuuccuuuuugcagugcuaaagauccaugacuugguuccaaacuacaaccuuuuauuugcagauguauuuauggcacaguaccacauucugauuagaauuuaagaguucacauuucugauauuucugucucuaaaugcuguguugcuucuguuuaccuaguuuucuuccuauucuuccuaauuucuuaaagaaaucugcacauauucauugagguauuuaauccaaaaagauuuaaaagagacacuacgccucuaacauucuguuuaggagaguauacuacuuuaaacuccguucuccccaccuaaaaaaggggggcuaaagaguggguuugaacaccugagaagucagaggugggaacaguguagaugauggucuaauuucaggcucaaccaaaaaaaaugcaggcuuuggcuggcauccuccagggaccuagcucugugcuuuccuagagaccaaauuacacucaucuugagagagggcauguugagguaauuggugggagagaguggggagaguugaauuccagcugcuuccauuguagcuguccugaaaaugaauaggggauguuaacaauggaggcuaacauuugacuuggcuuuuucaccuccacaaaccuaagggugagaauuauagaguacugaaugacugcaccaauaaugauccuguuuaagugggaauugcuauguugggaaaaacucacaccauuuuaaaaauaguugaugcauuuaccaaccacaguccuauuacuguagcccaauaaaguuuauccacaguauggaaacacuccuuuuuuuuauugucagccaucuaguguguguauuggaucuucaccucuuugguuaccauuuuaaaaugcuccuacugaaagacauuuggaaggcaccagaaucccaucuccaagaagggaagcaagauacaagugcccuguacucccuuucuccuagaauguguggucuuuuuuuuuuuuuaaggagaauaaauacuguaugacucaauagcuuuucuaacgaauaaaacaaauuaaauugauguuacaugcguauuuaaacccuauccaguuaaguacugaugugauuaaaauaaucaaauguauuacuuaaaaaauuaaaaaggauaaauucugcaccccauuauuuuauugacuuuuaaauauaaauugcagaaauguuuacauuccuaauggcauuauuaagcuaaacugacaaaucagaggaaaaaguugauuggccagcacauuauuauuucugcaccuguuauuacagaaguggaggcucagcauuaaaggagcuggauggaugcuguuuucuuaggcuuccuuugugugauguggggguugggauaaauguguaacaaguguaguuucacuuuguagugccuuuuuguguguugaugugauuaaaagacuacaguguuuuucaugucgcuuugaaauuaauaugcaaauaauaugggauauuagggcuucccucuaccugcugcacuaagcuucccuaagccaaaugggguggggauuggugucaacuuuuuucauacaaguuguuuaguugcaaauaucgccaacguuuuaucucuacucugugaauuuguaagggggggagggaaaugucaaacucauugaaguaggauugaagaucugggaugaaaauacuuuaaauuuuuauuuucuacuuauauaucagccaggauguuaggagaccuugaaaacauuuugaaaaaguuguguaacauuaccaaggcuuugguauaagauuauacuuuucuucugguugaguucuuccuuguauuaaucaugcaauaucauuucucagacacuugagcccggcucuccccuggagcauagguggcaauaauuguuuguuauuauaauucuagaauuucuuggguguucauuguccguaauucauuucacacagagaaaucuaaacuuucuucagccaguagaauaaauaaugccuucccuguccuuuccuuuucuuuuuuaaauuuugaguucuuuaggaaugucauuauagucuuugaaacguaaugacauuaaauuuggauugaaggggaagggagaggaacuuuuauuucaugccauccaguggcuaguuugaguuugcaaagaaauagauacaaugccauuauuuucugcaagauacuaguuaacacuauucucauaucaguuuagacuuuguccuguguaauaauuuaaauuccuagauuuuaauaacacuuaauauguagcauggaucccacuuaaucuccccccggcuucacaacaaaauguuuacauaaaugaacucucaauuuugauaucaacuauuuaacucacucuuuccugaguuaauacuuccauaauuaaacauguuccacaguugccauaggaguguaucuuaaaaaugauguucuucucuguucuuuugagccaucuguuugcuaggucaguaaagaaaugggagccugauuuuauuuuaaagccaauaaguuauuacucuacuauuguauuagacauucagcuucagagggaguaaaagauaaaauuccaucacauuuccacuuucuuacauuugcagcagaaacuuguaugcucaaauugguuauuuucaacucaugacagcugugauauuuaaaaugaucacagcuguugugacuuaaaauugauuuuucuauuaacaccugagaaaaagaccugugccguauuaaaaacuuaaauaagguaacuguaaaauuagauguguugaugugaaucugguaauccuacuucccagagguugcaaagugcagcacaccucuugcaugcuuccagggaaugagcuaaaacugcuagaaauagaugcaugauuguuaaaagcguuuacauuuuaaaggauuccuguaauagcagauccucuuggcccaacuuuacagugucacuuuugcugauaaaaucauuuaggauucaguuuccuuaauuaaccccaagaaagaugacuuacaugaaucauuaugauauccuaaccucuagacuagagaagcugcuuuaccuuucagauaugacauugaaaaaugcaaaaccauacggaauuguuucuuaugaaggaaguuuugguuuuauggugcuuuuccuccauuaucuuuagaugacgaaaaaggaaaaacagaugagaaaggacaaauagaucauggcuaaguagcuuuaggcuagcacuuguuuuuggaaucuuuaauacauuuuuaaucuucauguugaagauccauuuaaccuguuuuaaaguuagauggugauuccuggguucaguuggucuguuuaaauguuuaccuuuucaggauaauccguauuagaaucuugcaucucucaauagauuaccuauuuaacaaaguaaccaauuuaagaaaaccuaaacacauuuauacauuaagauauuuuccuguuucgaguuagaugauguaguauauaaaauauauggcuggccugauguggaauuauguauagacaacagugucuucacagaugcauugccaauagggagcuauguagauuaaacucuuuggccaguccuaggcuuuuuaccuguguaacucaaucagaauugaaagcaugacagguuuuaugaugaugaauguauggcuggauuggagaaaguaugguuggguggguagauagauggauagauuucauaacuagacaguaauagauaaugccaauuauuuauuacucaaacuuguuuauuccucagaaauuuuucugcagaguauuauuuugauuauugcauguaguucagaacauuuaguugaaaaugauaaaauauuugcugucacauaaucaagacugcuauagaguugguucuaaaaguuccagagugaacauacauuaccugugucaaaguuagaggcuaagacuauggagggccauaagaucacaaagucagacuaucacauacuaagugaucaugggugucaauggcuauuuccuuguuuaguugaaagaagauacuccucgagauggacauuguuuauaugaagauuuaagaaaaucaaaguggauauuuguugcugacagacuaagauuacaaacauauaucuuuagaacaggguguuccccaggggacauacggcaauaucuggaaacgcuuuugauugucacaacugugggggucaggcaggagcuugcuacuggcaucuagggcuggaggccagggaugcuacuaaacaucuuaacagcgugcaagacagacccucagaagugcugagguugggaaguccugcuugcaaagugauauaucuggaccuuaagaauuaaauaaugucauaauaaguuccauaauuaaaucuuggcauugugaggcauuuauagaggauaacauuuuuuuguuuuuuuucuuucccuuucuauuucccuuuuccuuuucuuuucuuuccuuuuuucuuuuguuuccaaaacauuguuuuuuguuuguuuguuuuggcauagcacacuauagcauugcccagguauuucuacguuuuaccaugaaaacgugagauuuuauaguguauuaaauauuguacauuauuugugaaccaacuggaauggcuucaaagcagcuguuagaauauguugagucaguaacacaacaugucugcauacccuaaacauauauuugucuuaccuuuuaaaauguuuagaacccucuaucaguguaacuauugguuugucuugaaucauccuaaaugaggaaguguauuaccauuuuuucccuacaggacauaaaguggaaagaagaaauuagcauaaagaaacuaauuaauaauuauguuuuaaguuuuuuggcauuacggacauuguuuacaucaucauuaacaucauaacaucauaucgucuguuaucaagaaaagauuaaaauuuaaagccaacauugaagauguucuuuccagcuuucccaauaaugcaacuccuuuaccuccucacaacuggggaccucucucccugccacugcugcgcuucuccucaauguggauaauucuuggccaugauacggaagugauuuugaaaccucaguugccuucuguagcacccuguggaggaagguggcaggaucugguggcugagucuuacaucugccaacuucuagaccucacuccuuaggugccacauuuuggagcuaguugccaagccucacaguaacuugagccacucuucaauuuccuccccaugauauacaaaguucuccaagguuuaaugagaguagauauggaggcugggcacgggaauggcagcucugauuugcaguauaucuuugguguacagauaugcuuucauuuauugcuuagcccauuagcuaauggaauuucaauuccuucccacaggcauucucagacccugcacuucacucuuccuguuucccuguccagcuugguacaacacauucuaguaaaaucacacugauguguuuagguuuacuuuguacaucacaucuguaaccaucuauaaguuugcccuaaacuggcauuuauuuugaacugucuuccaccuuuuauuguacagcguugucuguacucaaagugagcaacugaaaagaaaauuuuaacauucuuuuugugugccagacaaguaauaaagauuacuauuuuuaugguaauuuuuuuauuugaauauuucuguuucuggaagaugguaauuuuuuuaaaucaugaauuuccuguaagugaaacuauuugagggaguauugaccuuuuuuugaucaaucauugauuaucuguguugcacucucaguauuucucuuauaguccauaugucccucugaauaauuguagaacaauaacuugcuuacacaguguuuuuagaauaugcuucaggaagcuugccugugugguauuuaacucagacauuuauggaguauaaaaccaaucuuacugugacuuuuaauuauuaggaaaguggcuuacaguuaaaauaaagcuuacagaaaauauuguagcaauaauuaauauccaguaaaauacaguuguaagcuucgguucuuucagacauuuucucaacccaguucuaauuugaucguuacugcaccucaguaagauaggugaugcaggagucaucaucccauuucacaggcaaagccuggccuguucagugagguagccacuggccccauguggcuauuaacauucaaaugaaggccaggcacaguggcuuaugccuguaaucccagcacuuugggaagcugaagcgggaggauugccuaagcccaggaguucaagaucaacaugaucaacauugggacacccugucucuagaaaaaguuaaaaaaaaaaaaaaaauuagccaggcaugguagcgcucaucuauagucccagcuacuuaggagauugaggcaggaggaucauugagcccaggaagcugaggcugcagcaagcugugaucaugccacugugcuccagccugggcagcagagcaagacccugucucuaaaauuaaaaauaaugauaauaauaauaauaauaaauaaaugaugucagucaaugagaauuaaauaaaacuuuaaaaagaucacuuccuugguugcacuagccaaguuucaauuacugaguuuucauauaugaucaguggcuacuguauuagcacagauacagaauauuuguaucauuguagaaaguuccauggggaggugcuggccugggaaauggaagcauugagggauuaaaacuugcugaagaucaugugggucaugacagaauagagucauugcugcuauauauuccaauaggauauuuuuacauuuuucuuagcuuuauugucaaauaucugauguaagaauugacauuuuaaugcuaccuuguagcacuuuacugaaugcuuaucucaacugaauuuaaauuuagagcuugaguuacacaaacuuuucaaaggauacagcccuuugccugucugcacacaauggggaccuugaauuuccagccagugauacccuccagaagggaccaugucuuaaugcaucuuuguagaccuuuuggcauauuguagacaaccaagaaauguuuaugcagccuaaugaaugugucacauccaccauacgggcauauguccauacauacaguuagacaagaccuuuggguagaaugcucccgagagagcuggugucugccaaauuuuacagagcucaugccucugcucuugcuguuuuaguaaaaaguaguauuuuaucaaaaguuaaauuggguucaauauucaccauuuggguaauggguacauuagaagcccaguccccagcagcaugcaauauuccauguaacaacaagcacguauaccccuuggaucuaaaauuuuuuaaaaauauguauuuacucacauaauccaaauauuuuucauaguaaaugaaaacgucuguccaucuuguccuuagcagucauuuagucccuaaccugacuuuguguuguuauaaaguugugucacuuaaguaguacuuaaguaaguacauaccuacauccauacuaucuuuccauuuccugcaucacugaguuggacaaaugugcccaguuagcguugguagugcugaagaccauguucauucauacaugcacucaaaaucauauuaauuacuuuucagugauaaccauagguggcaacagaugaaugggcuagcccuaggcuauuauuaagcacugggaaugagauuguuggugccuuguaccugugcuacuuuaacaggugagacaauuccagagcuuuccccaucauccucucguugcuacagucuagacauugggagcacuggaagccuauggugacacagacuggcagaugccuugggcuucuaaugguguauauguaagccaucauuuuguuuguaauaauuaugguguugagaagcauuugugugcugugcacucuuucagcuugugccacguuuaguuccuguuaugcaaauaccacuuuaaacuuagaaauuccaauuugcauuaauauuuugguuucauagagcuaacuauugcauuucacaaacaagugcauuuuaaugaguaccggcagaaugauuuaaaaauguuauuuauuaaauacuauuguagaaaaugcagucuuugguugccagaaacuauuaagacgaaauauaauguguguugaggccacagaguacaccucuucaagaguauuugacccuuauggcuuucagugauacaacagccaaugcucuucaugcaggcuuggagggcagagguaauuaauauaaaauagaagccagcguaccauugacguuuggguuuacuuuuaaaauguaaacauauuuuuacuauuugacauuugucauaagaccauaggucauuuaccucugaguuaaggugaaggacuuuaccagucauaaacacccaaguuuuaaagcaguguuuucuuauaucuuacaucuugauguuaaauccugaaauggaguuuguugcugcuuuauaauuuuuuucccucuuccuaaaagccuuuuuuuaaaucagaauuguggauaaaaaaauuuugauguacaaugugugggaaaauaaaaauuuugcaacuggauuuucagaaaugaacuauuuuaacacauggacuuugaaugcugcugucaugguugucauagcuugugguuccuaauuauaaugagcuuuuuuggugguguuauugcaguuguuuuauucccccugcccccacccagucuucaacucacuuuucccagaaggagaguuccaagccuuugaaaauucucaugauuuugcaaauccacucuauuuuugucuagaauacaggaaaguuaaaacuguggcugguaugaugccauguuuugaauccaauuuuaaagcaacccuuugcaacccagggaguaaagcugacaucuuuguaucuguaaugaagauaauuauaccugcaaggugacaucacuagcaaaguaacaaauacccuugaaaacggaguuccuggucuucucugaauucuguagaccacauuuggcauuuaacaccagacaccucuuucaugccugucguuugagaaguugcuuucagaugaauuuacuaaagcugacugacacaggguuaaauuaauucuuuucuuuauuacucaaagugauacagaccuuucuuggacuaauguagcuuaauuaguggucaauuaaaacugaacauugcugaauugaaguucuuugaucaaacucccuggcaugggcuugcuuucuuuaacuagccaccaucuugaauucauuuggaaucaguaguauaaacaaguuaaaaacugguucuuuuauaagaaagucagcaggcuuguauagcugugguuucuuuuuuuacuucuguaggcggcaauucaaaggcaugcuaaaugaaaacaguacuacacccugaaaaaauuacauuuuuaaaaguaacacuaagcagucagaaaacagucaacacccuuaccuguuuauucuagauacauuuaucuucuauguagaacaaauaauuaauaauucacuucccaauuucagugguugauuuuguuguuacauggaaggugaaaacuccccacccucccuugcaaagucuauaguuauaacaaaaagugaagcaaacaaaauccaaccugguuguugggaguagagucggaaggggcacgguaaaugaaggugugcccaguugcuccuaaauucauucuuugucacucuugggaaaauaguucaccucuguaucuuuggagugggagugacacacuacuucauuuacuuauugauuucaucauuuauuuugaagggcauuauccuaucaguauggaaacugauaauagcauauauuucauaugaaucacuugauuaaaaauacacauugcuuuuguuagaauuugggugaaguuacaaaaaaagagaauuaggggagcugaaaacuggggcagaggaaaucguaagcauugguaauaagaucacccaccuccauuuauccaguuacaugucuuaauauuuaaaguguauauaccauucuugucuaaacauaaauugauaccauuccguaauccuaguuuuugaaagcuuaacaaccaaaaacauacauccuagcuggcauucaguuagugcugugcauucuggaguauuaauugaaacugguacuuuuguacuggaaauaaaaguaauagauuagguuuaaauagauaauuugcuuaguucauagugauuucuucugguuuuuggaaauuuucacagagaaagaguuaaaggaaauuuggaagugaccauguacaguguucccccuguaagugacagaauuuuugugguuuucauuacuuagaucgaaaaauuguaguuauaaucaauaauuaaaauuaaaaauuuuaccaguugacagaaagagaaauuguuuauagucaaugugccuuucagccuucucucuugccuucucccuaaaaggcugauuaggauguaauaauuggggaugauagcgggaggaagacgacaauuccauuuaauuaaagauaauuuauuuuacuucaaauuggugaugucccacaugaauaagaguagcuuuagcagauagauuuauuaauggguacugacaucucaguugacagaaaaagcaaacauuuucuuuccucauuguuuuuauugugucccgucaccugaaacugcugucaccaugcuuccuuugcugcuugacagagcuguagacuuuuccaccaaauaugcaauuauugguuuaucauugaaacaaaguugauccucuucugaguuaaaaacuaggccaggagcuugaaaggcgguucaggcuuucagagcuaaugcuacaaaugcucucuucuuaaaucacauuuucucaacugauccuucccauaucuaguucaugaguagauugaaccuuuugaauaaggaccaaagauuuccuuuggucuugggugaggugcuugcaugaauauuccuuuaauaccuugaaugucuuggauaaugaaaugugccccaaaaaacuaccauuugcauuacuuagguucauuccugacaaggaauucugcccucgugugauauguucguuguugucucaugcaaucguaaauggaucuuggaaguugggacaguuuuuuuuaauuaggaaguagauucaagaaaugcaugauauuguuuuucauauaaucuccucagucuauagugguuguaaaggugugcuguuuagcauaccuuuagcaaaacuguauuuauaauucuauguaucuuaaggcacuuuuuaaaugcuucugacaaacugcauucuguuuuuccaaugucuauuugaucucuguuacauuaggcuuauuugucuuacucucacaucgaauuccuauauuuuuguuuauguuuucugguguucagucauuucuguaugcuugccuaguauguuucuuucauaccgucuucuucacugaaugaaaugcagaccaccuuggccacuuccuuccuucugggcuucuuuuccuauucacaacuuccgccauucacacugacccucuagcuuuacuuauaucuauugcuccugcugcuuuguugcucuaauuuucauauauauuuccuuuaugcuaauauccuuuccuuaacucuuuggauuucacugguuugucuuuccagcuuuauuuagaaaauuaggccauauaacuaauguuuacaccguagaaaggaaaaugagauucuuucuuucuuuuuuggaagugaagaggugagaagguugugguagagguuuucuuuuauuuuaaaccagauggauuuauuuuguccugcuuugcuauuucacuauuucaaauugauuuuaaaucagugaugguguuuucaaggauuaauuuuuauuaaaucuugauuuucaugucguguuaaccuuuuccuuccccucagccaaagggucuucuuccuuuuuucuguccauuucacuuguuuguuuuaauaaccugaucucuccagccauuauuuuauccucaaauccugccacuuuuauccaucuuuuuuuauugcacuguuguccuuacuucaccuuauaucuuuucuucuucuguaauuauuacagaauccaugauaccuucuccaaaauucuaacaaagaauucuggaaaaggagaaauugggaaagagaaaaauugcaaguaauguucuuugcugagcccuaggaagucugcuuggauuuuuauauucgacugauauuccucccuagaguugcagucaugauucuauguaguagggacacgaaggcaaaaguuuaaauagacuaacacugacccuuaauuggaggugauaauccuacauauaaacuuucaggagggaaagcgauccugcauuuuacaucagguaaacucaguugcacccauugccaguagcugggucagguguguagggguguguguguguguguguguguguguguguguguguguguguacguacugggagccagguuggaaguaggaagagaaggagguucuucuuuccucucccacuugcaagcuauuuucuuucuuuucugucuguuuucauuauuucuauggcaaguuuacuugccacgucuuaaacaccuucaaccuuuuugucucuuccuuuacuuuuuugcuuuacugcuaucaaagaguuaaggaaguccauuaaauuggaggccauuccucaccauaagagaaaucuggaugggaugcuuuugacaacugggcucucuuuaguagcuucucucuacuugggaaaaugucagauauuuugagaaauaaaugcauugccccaaacugaaaacaccacuuuuauucuguaaaagaggcauucagggaaggagaccuccucuauucccaggaggucacaggaacugggaguggcaagaaggaagcugcuaaacgggcuccagaugcagcuuuauccaggggacgccucaugccuggucauuuggguggcugggcuugucccaccuccccuucuucaugcccuccucccggucucauccuaggcccucccaccccuaggccagccacaggccucacagcggacaucugcgggucugaguuucauauauccagcaugaaguucccucucucccucccauuaugaauucugggcugugguccugcuugcuccuugugugucagauugaaguucugaugcugucagccaugucugaccaaucagcaaacaacaccacaggaugaaauuuaaacaaugcagaugcucagauacagggcuauguugccuggaccacgaagggaaagcagagguaaggucagagucuccccaaaguggucuauccugagccugccugacuugacaccucuugggcugcacugugcugcuuugacuuguauguuacccauuugcuuugcacuacuucugucuucccuggcauucaccagaacuuucauuuuaauucgcucugcccggguuacuuuaccaccuucaucugcucacguccuuuucuuuuggauuggugcugacugucauuacgaauguuccuggauugccucguggccgaggguccuuggcaagugccaccuuguucaggucuuuuguggccagacuuuuaggaauagaggacugcugaggaucagggcaaacggacggaguuaauaggccuuauuaauuuucccucugcaggacaguggaauuuaucauucgguuacaaccacgguuuuguuucuuaccauugugauguauugaauuguaaauugagcuuaaaucaucuuuuuuucucagaaacgguuuacuuagaaaagauauaaauagauacaaccuaaacgaggaugaaucagcucaucuuccaagaguuuuggagggggagaaagggaauugauaacucucccccacccgaauccccccccacuuuuuuuuuuuuuuuuuuuuuuuuacaguuuuugguguuagcucacuagauuacuguuugcaaaagaagaaucucaucaucauccucuucuguuuuaaguguuuacuuggcccuuuuauaauuuaaaguguuuacacgguucugugcucccuaggcccaucuggaaaauauuuaaacuucauaagaucuauaagacuagaauaucacauauaaugggauagggggaaggaagaaaaauuagagccguugcguguguuuagaauaaguuaguuguuuguucagaagcggcugcuggaggaauuggaacaaauagcugugugcggugaacgauuggguccagagcuguacauuucaccacagaaugagccuugguuugugaaacugacauucuguugugacuucuaaauccaaacaaaucucugcaaauuucugcccgaucgaguuaauaagaaaauauauacaugcagaggcgagagccguaugcuacuuguacuucugucaguguugguggaaauaagagacggauuuuaccuacuguauuacauucaaccagcaauuggcagaacccccagcucagcggguuuucuugacuuuuuuuucugcugugagaacaaugggaugcaaaagggcuucagaaaaggagagcagcagauacgggauuggggucacuuuucuucuaauugccuuguaauuggggagugguuuccacuuucccacuaucucacuggugggaggggaggaagacagauguggcuuagcgguaacgagcuuucuccaggccggaugugcugagggaccaggggggucauucccugcucugggccugugaucugcuucacaccugugcucauuuucccccaugaucgaugaccuuguauuaacccagagugaccuuuugccuucgccuguucucugggacgagcucuuggcuaguggacccuccuuucucucugauuuacaggugguuacuggagccacauacacuuguuuuucauggugcacugugcacuuagcagcccggcaagaccugcaauuucaucccucucaaggggccaagcaggggauuggaaggugggagggaggagggugccgcgagagugguugcuguuugcaugugcuuuucuauuuuguggcucauaugguaucaauuaccauuugauggcaacgccaggccugaggcccuucgcauguuuguccugugagaaagaucuggaagaaccgacauaugguuuugauugcagcaauugcagguugauagaaugaacgcaggggugagguggguggguuuuccuuccggcccuuuccacucuggguugcuaaugugcuucgcuuguggaacuggucuuuucaucauccagccccucccccacuuaccccucccccacccccaacucccugccacuuugcauucccugccccugccuuccaaaugaccgccaggaacauguggcccacauuaaggaccuucaauuaaaacaaacaaaaaauuguccacucuucuguucagucccagagcaggucaguccaucaagaugguuggaaguguaccacaguuaagaaacaaaugguuggcauagggggcagauucccuccagaagcuugggacauguuuuaaaauggcuguuaguucagauuguuaaacaucgaaaugaugcugaaaaauagcagcaauagagauuaaugugggguguguguguguguguguguguguguauaucuguauguguguguauuucauuuaagacaccucuuggaaucugugcaucugcugcauagggacaggaagaugaugauaauggauaggaguucuuugggguuccaucuuucuguacaucccaggccauaagaugauggaaaagcaagugaggcaugugugucucuaugagcauuucccuucagaaggaagauguuggagacucaucucccaugcacagugacuucucucuuacuaaauuugugaugguaggggguacuccucauuacuguggcucagcagggauugcaucugugaauaugccaagggagggucuacuauuggggaauggugagaggcaaagaggagaaaagaacauuauaggcacuuugaauguuacccagcaacauuuuuuuuguuguuucaaaguaacaucuuucuauaaugcuuucaaauuuaccugucugguaaucuguucuaagaugggcagcccaugagguuuugacuuuuuucacuuuggcuauugcauuucaaaauauuacucacaauuaggaauuuauaccauuugaaacaauaaugugguaucucaugaguaaaugcugccauuaacaucuuccuucuuuuaaacugaaaacaagcaaaccagacccaaaaaaaaaaaaaaaaaagcagaaacaugcucccccaagaaagcuuguuuuuuucuuugagauggagucucgcucuguugcccagguuggagugcaauggugcgaucucgacucacugcaaccuccaccucccagguucaagcgauucuccugucucagccucccaaguagcuaggauuacagguguccaccaccacaccuggcuaauuuuuuguauuuuuaguagagaugagguuucaccauguuggccaggcugguuucaaacuccugaccucaagugauccgcccaccucggccucccaaagugcugggauuauaggcgugagccaccacaccuggccaagaaaguuuuuuaaaugugagaugaauuuuuaguuuugaaggccagcuauugaaaccuaaucacacugcuugacauacuucuucauauuuaucuuuauauuagagcugaucuuuaucaaaagguaguagaaacuaaaaaacuuaaguuauugaccuaaauuguagggaaaugucugucugaucgacucuagagagaaaauuggccguaucuuuauaaugguuacugaauguauaucuucaugaggcuacaguuuuuuuuucuuugcuccaacuuucuccuuaugauguagagauugguguauuaaauaaucacuuuuucaacagucuugaugacaauuuuauuuugcuauuucauaaucuucauacaaugggauaaguguuuucagagauacguuugaauucagagcaacuggcaauuaagugauuugcucuagucacauguuuuaguaguagcuauuugguuauuugccugauauuuaaugcacacauauguacccuuaaaucaucauucagugugauagcuuaagacaacauuucuguuugcugcucaugccacuauuagcuacguuugaagagugauauacugagaaguuuaauuugcugggguuuuuuucuaaaaacauugcuuuccugaaauauauaguauugggggcucauagcaaaaaaaccguaguauauggguugugagccugucuucgaacauggugggucacuuaacagcagcugugcuggagagauauuugauuugagaagacuguuuugaaucuucucagcccuaacaccauucugguuuugaaaugggaaaauggaaaagaguuuuagggaauagagauaucucagccuugaaaggaagcauagguagaaaucuuucaguucucacucagaugaaccagcauuccuaaucuggcuacccucacagaggacaaagagucugcugggaaauguggguuuauauuuguagagacacacuucagaggcaugagauaguguuagauaccgacuggaugcuucgugcccaacaucaauuugguuugcagauugaaauuuaggaaagcuugcagaggagccaaucuuuuuuauauacagcaccuuuaaaaaaaagacuguccacuacuauuaaaaucugauucagucuucuaaaauauuacuacauucaagacaacuuuuaaaaugaucaaauuuagauagacaucaaugauguuaaaagauaaaagcccuccuacauguaauauauagugucuuaaaccuuauuuuuuaaaaaagggauaccacuuuugccaaaaguuucaauguagggauacucaaacuguccuuggaaguccuaaaaauugcuaguuuuuuuuuuguuugcuucuuuuuuuguuguuuuuguuuuuuguuuguaguuauucacaaauggagaaauauuuauaaaauuauauuauaauuuguaaugcacgcaaacaaccaucagaccacacuugaaucagagaguuacaguuauaaauugaggaaagaggaugccagcacaaugccuaauggagugaaaaauugugcuuauuuucacaggacucucuuggagaggagcuaacuacuuuccucucucuuaauacccagacccucucccucagcccugacagcacguuacagaaugcauucacuuagugugugaagagcuagcucaccaccucccuuuaagaucuauucuuguuauucauacauugcaaauuuguacuuuuguauccacaaggaagacauuacuaacuucaagaaaggcagugucaaugaggagcaggaaaauacaguaugauacaagccugccaaugaaagaauuauacucagacucuaugcgcucuguuaaacaaaauuugaaccuuugaggaaaaaauauuggggauucugaugaguguuuuuacucuuucuuuccuuuuuuuuuuuuuuucuauuuggaaaucauggcuuccugauccuaagggauaaaaaaaaaaaaaaaaaaaaaaaccucaaagaaaagacucaacaggcuuucuggacaucaaauaguuccuacaaaacaacauucugaugacuugcauguaaagaaaucagaaacauaugaauuaagcuucucucgaaauacauauggguugaaaaauagagagaagugcugagaaaauguguuuuggguuuugcugagcccaugacguuugaaaaauaguaugagacauugaacaaacacaaagcauggcuuggcucacccauuccuaauauuagccuucuaguucaacggcaaaucaguuuaccaugugccuaaaugugagccaccuuggugcacucccccacacuuaauuauaugcaguuuaaauuuuuucaauuaggagcucaaaaauaacauugcauuucaaggaaaugcaaaucuuagcauuuucuuaccugguuuguucaccucagaccauuuuagaaaacaccacagauuauuucaccuuaggagcagucacacugauguggcccucuuugauguggcuggcauauaacagaagaaacguaucauuuuuaagaaacuggcuccaaagacaauauugcuauuaaauugaagccaaaaaccacugcagguaaaacaugaugaagaugaaggacgcccucucuuagccauauaguagaagcccgaucauagacucucacccuuacaccaugacuugaguuccugcucauuuuuaucccugagcucugcagacuucuaagcaguggaaguuuucauucucuuucccacauugcacucaagagagcuaacaugagagauucuaaauccugggauuccucugcaucuggcuuuaaguacaggagcagaacacagggaauuuaaggaacaaaaauagccagagcuucaggcuucuuccacugaugguaagucauugacaugcacuuggaugaaauccuguaucuguucuuuggacuagcacuaucgccugagauuaucaguuucagagaguuacagagaggcaguagauuucaucuuuccuauuucaggaggaguuauuuugguuguuuaaaaaaaaaaaaaacacuuuaauguacuuuuccuaacuccuucacucagaugguggcaagaaguuugacagaauaaaguaauucagcuaauauuuaucaaaugccuacuaugagugagcuguuagaauauaacccugaacaagacaagcaugagauaggcaaacagacuauuaaaaccuagacugauaaugcauugauugggguguacaggcuccuuaagguagauauacaaaggacaacuaguccacauuuggccuuagaggaagugaagugcaaggaugaaugggaauuaagcuggcaaaaugcaaggguuauaacuggaagcaggggugagcauggcauauccggugacccagaaguaguucagaaugccagaagcuuaugguacaaaaggauaacauaaaagaugagacugaaaagguaaacaguggccugaucaaaaagcgacuugugagcccuauuaaggaguugagauuuuaucaugaaugugacgaggagccuuucaaauggguaugccugagaaguaauugaauuuaaaagucaagacggauaggaggaccuggaaaacuuagagucagagaagccaagggaggcagaucugaccagaaggaggaaauugucaacagugucagauguugcugaaagauagaagugacauuuggcugcagcauccaggaggucuugagcaguuucauugaaguagugaguguggaaggaagguaaagaaguggagaacaggcauugcaagauaauuuuccaucaucgucaucaucaucguccucaucaccggaaaaugagcaucaauuaucuuaucuaccagacauagagagugaccagguaaggaaugacacaccugcagccugggagauuucagaaaacagaucauaaauauaaaacagaagacagcaacacaugguacaacacaugcaaagggcaaaaugagcaguguaggccaacgggaugaagaacagaaagaauuagggggcaggugaaaugggagaguuuuucaagcagucagugcgcuugagguuugcauucuggauugugccuccuuauaagucaguccaaccuguuuuugauucuccauccaguggaaauaggaaacaccaucaaagaugaugcauagucuuaacuugccugugacuucugauuauguuuccgaauuuugggaggaagauuaaagucauaaacugacucuugguuuguuauaauuucuugcaacuguuauuuuaaaaauccggacacaggccaaggcaggaggauucucugaggccaggaguuugagaccagccugggcaacauagugagacccugucccuacaauaauaaaaguaaaauaaaaagaaaaucuggaugcagaaacugagguguagauaaauauagcaagucagagauauucguaaauucuacaucgaugaguuucuugagaaauucugcacacccagugcuggacaacuguggaauugcagcgugauaccuuucacaucugggucaucuccauaugauaucuucuuccugguacaaggccagaaguucaccccacgcacaacaccuauggaagccacuuacgauucaaaggacaguuuuucugaaaaagggugcaugauguauacuucccuucaacacuaaaauucugcugcuuaaacuuuguaagugaaggaaaggacugguucucuucuacuuuggcugucuuccuuguuuccuauuuauugggugcuugcuuugggcaacccauuguauuggaugugcucuaaaccacaaucuuugcuccuaaggaguccguaguauuuaucgggggauacgaccuggauaauucauauaagauaugaauuucuuucuuuuucuuuuuuuucuuuuuuuuugagacagauucucacucugucgcccaggcuggagugcaguggcgcgaucacggcucacugcaaccuccgucuccuggguucaagcaauucucaugccucagccccccaaguagcugggauuacaggcacccaccaccauacucagcuaauuuuuguauuuuuaguagagauggaguuucaccguguuggccaggcuggucuugaauuccugaccucaagugauccgcccaccucggccucccaaaguccugggauuacaggcgugaaccacaaugccuggccaagauaugaauucuaaaaaaaaaaaaaaaaaaaaaaaaaaaaaaaaguccuuggaaaguuuagaagaugaaauacauuuaaugaaaauugagcucauucuuccccaauauuuguuccauauuccucuccauauuauacuauuaguacacaauccuguuuggacuuacuggaaaaaagagcugaauagcuuauccacaugucaagaaacuuucuguuuaagaacacugagguucaucaacaucaaaaaauauuuucagcaucauucaggcacuggacaugcucuacaaauuaaauaccuuagggccccuacuauuucaguguuuucucagugucuuguugcaguggcaaaugcuaugaacuacauuuuucaaaugaauauugaagauugagaaagagguuaagaaccucuaucuauuaacgauagaaccaaaucuagaaagaugucuccugcucuguagagcacauuagggaucauuauuuauagccauuuggcucucuuaagacauuuuggcaaugagggaaaaaucauagguugauuuucuugguggaaugaagaacauugaguuugcuaacaaagagagcaugagugacuuugguaagagagcaguuuuuauuucaguggaaaggcagccuccucuccuaauaauagcuacauuauuuaccuaaauguuccauguagcaacugauaacaaggcuuacugcuuaagaaauuuggccaucaucuuguccucucuacuagaauuccaucugccuacagaugggcccuugcuaauauuuuuuuucugaaggacaacauguaacuuaagggcccacuacuguguguuauuuuguuuuuuuaauugaggugaaagucacauaauguaaaauuaaccauuuugaaguaaaccauucaguaauauuuaguacauucacaauguugagcagucaccacaucugucuaguucuaaaacauuuuccccagcccagaaggaaacucuguauccauuaagcaguuccuuccuaucccccuacuucuaggcuuuauaaaccuuuaauuuuaauguuauauacacacacaggcauacacauacauauaugcuauacacacauauguauguauauauguauaauguguguaaauaauguguaaauauagacguauaaagauguauaauguggguaaauaaauggauguguguauguguauauacauauauguacauguauacauauauacguauauauguauacauauauguaucuacgcacauguauauacguguauacacacacacacacacauucaugucuauuuauagauuaggaaguuccaaacagaggaccuaauauuuccuaauuauguaaacaaagaacuaucuacuuuaaugaauguuucuccaccaggaaaaagaaaaauaggaaacauuccuugcuucuuuuaaccugucuguauauuucucuuaaauucucacuagaugcuaauuuaucaaggaagacaaaaaagacagaaauaauccugagccuuuuguuguguaaaacugcugcucuucuuguaaagacauuuucucauuaauuucaucaacacugagaauuuuaaacugcuucucaauuuuaagcaauuguauggguuuuacauuucuauuuuugaaaauccaaaauuauugaacaaaguaauuuaguuagcaaaguuuacauuucuuggaaagaaauaugaaagggucauucuuacuauaauuuuuauuguuaaagaaauugcuguuguucacauguauuuaugcccuccucauuccggaagaauauuugagguagccaguagcacauuuuuuugaauuaagaaaaaauuagaucaaaugaaaaaauaccuaaaauuuaaauauuuagagaaagccaacucaauuauauuuuaaauaugccugaagucgugaacuaacuaauguugaucauuuagucuucugguccuaucucaggaauauuauugcccuucuuaauucaucuuucaccuccuuuaagaaguauuucugaauaacccuauaggauaacuuccuuuacauuucuuuagcucauaugguuuauacaaaaggcuacucacuuuaucacauuuucuaguugcuuauuguacuucauaaaucucccaacuaguuccuagugaaaauucugcccuucuaauuuuuuguauguaauuuaccaaagcaccuagcuuugugcuagcuaaaagcucugcucugaguuaaauuagugaaauauugcugguugauuucaccuaaaaguuugccccgggcaggagggaagagggugggcauuugaauggguaacagacagagaagcagcugauuggacauagauguugacaacuugcauacuuauuuuuuucauuucaaucugugccacagagucauacauuugguaauuauuucaugcuuuuguuuucaguugaaaguaguuagggccauauguuuugacagaaaaaagauaauucguacuuuuuuucagcuuuaugaaagggaagaugggguaacaauuuuacaguguaccauggcagugauuccuguucaaaacuuuaccagauuggaaacucacuguucauaacaauucucuugguaagcagaagaugaaggcaucuguuuaaagcacccagaguuaaguuugaugcuucaaagcacagcagaguucauuuauaacucuacuuagcacuauuagauaucuuuaacaaauaugaaaaguuguccaccagauuccuuagacuguaggugauuuggaaggauauucuggucaagugcuaacuucugacugaggauuucaaaugaaaagaccuagguuauaaccccauuccugcccuuacucugucuugugacucauggaaaaggaaggcacuuaacccgcuccaagcuuauguuccugaauguauaagauggguagcaugguugaccacuuagacagauaauccaucucaaaaugaugauuaaagaagauaauggaugagaaaaguccuuuugauuuaaaauacuaugaagaugugaacuuuuaauaaugacuaaugauagaauuuugucaaauuugcuuuacguaauuaaguucaagaucaaagaauauaucuagagaaguaccuauguauuuugugaaauguuucuuugaguauuauuauuaucauuuuaugucuguuagaaucuuggccucacugucuuuucauucuugcuugaaugucgacucuucaaagugugacuuucugcuugugucugaugcaacuuucuuccugaucgcucuugcuuccugagaaggaauagguacuuaggaaugauggcuuuuuggcugucugugcuuauuagguacaaacacagcacuaaagacauuugggacuggagaaauaagaagagcgccuuuaggguuguaugcaaaaggucaaacuauaauguaguuagcauuuuucuuuguacugcuuucccuucuuguaacaaccucucaauacccucauaccuucucugcuuuccagaaaugcuuucuaaaaauugauuauugggaaaagaucugagaccucauugcccugaaguguaauuacugcugacaaacugugacagcauuucccaaagacagggagugauuggagaugugaugaaaaguggguuugugacuguggaaacucuuucagggauguaggcuuuuaccccucuugguaauguaccuugacaaaagucugcagcaaugaaauuaacuuguucacuccaaucgcaucuaaaguuauuugagcuuaaguccuuucuuaaggaugucagcuuuaggcuucaggcaucaaccuguggacuagaauucaaagggaaaaggguagggaauggugcucuuaaaaucuuuaggaccauuauagguaauuccauauccuaaagaaagcucagcccuaaacacauuagagaaguggaaugcacuaaaauauauuuuggcagaaccaaugaauguuuaucuuucucuguguuaugauguuauucuuaguuugacguguaucccaugugugguguguuuauucauucaugcaugcaugcacuuaguaaaguuuugagccuauucugugcccggcauuacaugcacacacacauauguccaagcacaccugcacauuuuuuuuuuuuugguaaugccuuuuuuaccuuauuguuucugcaacuggcuauccuuagcaggccuucuuaauguacaauaggguauagaagaaauaacaaucaacauuggaguaaaccuaaaauuaauuucugucuuuauuguagagucauagaauuuguuuuccucuggaagaugugcugcccucauuuaauugauaaaacagugcuuucagaggucacaaagcuauuuuuuggcagauauaaccaaaccuauuuugauguuccagcaccuccuaaugaagcaguagucgucaucuaaaacaaaaagcagucgguugcuaaaggaggagaaaguguugagaugugagaugaucuguuagacauaauugacaaucaugaauuugauaugauagguguaaacagagauagaaauaauuuaguuacaucuguuuaagauuuaagauaaccagaagcaauaauguuuaauugaaauaauauaucagguucuccuuaacauuaccuugaauuucuucacaugcacaucaaugcauuugguaaauaaaaguuuggaaacaacuuaguuaaguguuuagaacauauuagaguugugaugugcuuagcauccgcagucuuuuaucugugccaacccugagccugguaaugaagccaacucccacaugaauaaguaacauaaggaguguaaccaggaagaagucaggguuucaccuggaccaaauuuuaggcaauuaaguguuucaagagaucuuuagccagguguaacuuaaucaguuuaaggcacucucagcuagggccaagguacucauaauguuggcagugggcauucgucugauacaccacguugaaaguaauaggaaacauagagugucugcucaguuauugccaagagcaagagaaaugcagguguaaaaauauaaagaaguauuuggagccagaggcuaguacacauagacaagacuguauuuacacuuggcuuuaauaguucagauaauaacauggugguuuuuaaucaguuuagugugcugauauuuagucgugggucugguuucaccacuaaacccuaguguaacucucagccgguuacuuagccucucucugucucuaguaauauuaaacaaguguauuaauaccugcugcaucuuagcucaacuucaugucuggaagacagaugaaugguccugcuucuugcaguaacacacaagaaccuccuuugugcugcccugacugagaugaucuuguguucuucucuacgggcaaaacagcccuaggcugcuaaauggccaggcaguauaggggacuuaggacucuacaaagcuggguuuugguaggaguccaugagcaccgcggagagaauucuuaguuaucaggagauacgguuguaguacuuaaaaacucaaacuccaaaacaagacuacgugguuuugaaucucaguuuugccaguuuauuagcugugugacuuuaagcaaguugcuuaaccucucugugccucagaucccuuagccauaaaauugggaugaucaugcaacaauaggauuaguauguaagcaaaaugaguauauguacaguuuggcugcaauagagcugauagguguaaacagauauaaauaaugacuucuuuucugaaaaugacuucuuuucuguuuuucucguuggugaucccugcuuaugucacugggauggcugcgggaauucaguaggauaauauuggaaaauagcuuaaaucucaaauguucuauagcuaugauaacaucacuaugacgucauagcagagugaguccacucacaucucuccuggcaguuuugcugccucagaguuggaauaauaacucacugaaaauacuuccaaaauagugagccacucugcagauuuaauuuguaauauuauucuuucuaauuauuaguggcucugucuuaaguuccuuuguuuuaauugaagcaggguuuuuuuucccccuuguaaauuucuauacaugucaaaggcuaccaacucauuuuuauuuagaguuugaaauuugauuugaaaaauauacugcagccagcuauaugaaaaacauaagaggauauuguugacuuuugaugaagggaagaaagaacaagguagagcugccuagccaugaagaacgccaggguuuuuguaaccccuggugugcuuugcacgcagaaggcacacacuuaaauuggcauggcucacuuuuuuuacugugccuuugcugagcuugcugcaggcugagugcacugguagaggagugcagggcuguguucuggccaucccugccugcucaggccucuccugcuccuuuguggaucgcccaggucucugcugcuuccuggugccgucuccuggauccucuugacauuuuuccguucuguaauuugauugacaguuacagacaaggaaggggacugaaauucuuaccguuuugugacuuccuaaaacgggaaaggaaauuuggugaaugagaaggggaaaacgccucuuggcugaaauuauuuacaggauuuagccccagguuuaauguacucaugaaugaauaaugacucagcugauauuuagaagccgggaaaauuaugcgauuuuugugaugggguguauagauauggauguauacuugaagugguuuguguucuaaauauauuaacaugcucagggaauuucuuuuuggggaaauacauauauucuuuuucauagauuuuuguggugcauucugguagacggaagaugggucauugcucaguuaguaaaaaugaaauaugaauaucauacacauaagugguacauuuuacacuuuuugauaguugugaaauacucuuuuuuuuucagacuaccaauaaagagaauuugaggaguaaaacucuucuuaccaugaauuguuuuggggcacuuagaacuauuuaguuaauucuuuuaaauacuccaacugauuuagauagaauaaaagugucacaauuuuaacagcuuacaccagugaaauguuuccacuuauaagaaauacccucuuauuugucagcauacugaagacauauauguguuauuucuaagcacauuuccuauuuaugugauaauggagaucgcccuuuaaccaucacuuggacgugaaggaggauucuucuuccuccauuaguaaauauuccuugacuugauaauacugaaaauaugugaggugaaugagcuuuaauccugugguuugguuugguuuuugguuguuugcagucuuggacuguucaccugcacugucuugugccuuugaguaugauuaacugccuugacgccuuacagugcauuacacaacucuacuucuuccauuucuugacuaaucucucaugcuguuugacugcccauuggaaucuuuaaguuagcuacuuaggaaagacuuuaggaaggagaaugcuaagagaacuggcagagaagucaggagccugggcucuguccaggcccuggcguaaguccuuucaccucuuccuuugacuccuuuacaaaaugaaguugaacucauucgagcuuuaaaaagaugacgccaagaggcaagacagagggcaguagaugugaaaguaacaugaaagagaaaggaacaucugaaaaaaaaaaaaagguagaaaaagauuuugacaaauaguacuaaaaacaaagaauauagaauagagagacccaauuauacugauaauuacaauuaucaguauuguaaaaacuacagcaaaaaagcuaaaaacauauucagcuuuuauuguccauaaaaagugaucacaccaugucuaacuguaauucguuugucaaaaacacuagaggccaaggacuaaauugcggauuaagaguuucuuccuuuuauuuccugcauauccagaaaccuggggucauagauacucuuccaugguguguuguuuggcacaacuugcaaguauuuuggcagaugguuagaaaaaaagacuuuaagaaauaugcaauaguacucaggacucuaaauauaauaaauaaagcuaagauaccaguauccugccauucauuacaaucaacauuuauugaacagcaguuauaugccagguagcagggauaccuagaacuugccccucccacuagcacuccagaagaguuccugcuuucccagccuaaagcaacagcaagucuuacaugagcuaggcuuacugugauagcuguccugacggcgaguggcaaacauggcccagugccuuccucauggaugaacaugacucuacacugggacuccccgguagaccuuuuugugaugaugagaaaguccuguguuggugauguucaguaugguaacuagugacuguaugugcuguugagaacuugaaauauggcuacugugacugagggacagaacauuuaauuuuauuuaacuuugguugaguuuaauucaaauaacuacauauuacuaauggcuacugauuggacagcagcuuucuagacccauuguuaaaaauaauuauaagcaaugaguaccucuuaugagauagaauuaauaaucccauuuauugagggcccaugacagauuaagaauuauguuugacauauauuaucccuaauccucacaagaaugguucauuugacaaauaagauaacugaaguucugagagauaaauugcuuuguuauguccucgcaaggaauugugagagcuggaauuugaaccuaauuggucagacuccagagcugggugauuucuaguaaucugccaaaucuguguauguacuguccggaugcugugucuucugaguacaucuucuccuugcuuuauggauuaguuagcaaugucuuuaucuuggucacauaggacaguuacaggguccaucuuaucucuucugaauauggacguaucacugcacuggaaccauucauuuuucuuacugaggccuauguccuucaaaaaauauuaagaguugaggguccaacccagcuucuugaguaguaagcuaaucaccuacaaguauauuuccccaguagaugcugagagaagcaucaaaguacauggguaguucuguggacaucaguggcacucaguaaacucuuggcauuugaguguuuaacugucacaguugaggauaucugugaacucucccaaggccugagucacugaaugagcccagccaguacuugggcgucuguggcuccauucugcuuugcuguuuucugcuuuccauggaacauacaguaacucucuugaagggucugaaagccucaauuacaacguuucagugauucugaacugauuuuucuuuggaaaguauauaugcagaugguacuugcagaaucaccaggggguaguaacguggaggagugguaaaggucuacuggacaaucagguggcuaccacccaaccacacauggugaugugauaugaagccacuuuucuuuauuccuucagauuuaagguuuccccuucaggaagcagguuacuuaacaaguacuugauuucaccauaacaugcauuaugacauuaucuuuuuuucuuuuuucuuuuuuuuuuuugagacggaaucuugcccugucgcccaggcuggagugcaauggcacgaucucggcucacugcaaccuccuucucccagguucaagcaauucuccugccucagccuccugaguagcugggauuacaggugcaugccgccacaccuggcuaauuuuuuguaucuuugguggagaugggguuucaccauguuggccaggcuggucucgaacuccugacuucguuauccacccaccucaaccucccaaagugcugggauuacacgcaugagccaccguuccuggccgauauuuuauuuucuuaaaaggucauuaucagaugccacaagaguauuucuauaaacuaugacccaaguauagccuaauguuaauagcuuaaaauagguuuuauuuaccuuuuuugcccuuuaaaagcaaggaauuauuuuuuaauggaaagaacauagacuuugaugaucaguucacauccuugcuuuaccccuugaaaaaugugcaaccuggaaagacagcuuaacauuccugagucacauuuguccaaauaauacaaacaauggcaacaagacuucagcacuaaugucugauguuuuuuguaugauuaaucugugccagguuccauucuaguuucuuuacacacauuauaccaucuaauucucacaacaacuuugcauagcaggcauugucauuuccacuuuacaagcaggaaucugaggaccagaguuaaaaguaacugguccaagauugccuaguuaauaaaugguggaauuugcagucagacccaagcugguuugggccaauacacuugaccuucuuaugauacgucagccuugugaaauagggcagauacuauuaauaauauccaccuugugugaucauuaugaagguuagauauaauguauguggaacucuugccaccaaagugguuccacaagaggcccuaaacaaaugaguaaucauuauuauuuuaaaauguccguaagugaaaccgauaugccaagaccaguaaaaaugagagcuucuuaaggaaaagaguaggaggcauaccuuuguuucauuuuguuuguugguuucugugcuugcuuuuuguucuuuucuguuaggcacagguuuuauuuagaauaaauuaaauuuuuuuuucuuugaugagugcagaaauaauaguuggaaacauugaauggaacagcuaauguaccauaguaauacuucuuggauuaccaaaaaaaaaaaaaauuaaaucuguaaaaugaaaacauuuuuguuuacuuuggucaguucaagguucaguguuaucuagagauuuuuguuaaacucaggauuucuauauguaugauugucugcuaaauucagaauuagaagagaagagauaauggcgcuaacuuugcauguuaaauauacuguguuacuaguuuuccaugaaguuuuuacucaacaaauagguuacuaaaagagcugugaccuaugaguuucaccaagucuuuccauuuccaauucggcaacaaaaguuucacacuucucaauuacucuugugggaggaaucagaaugccaacagucaccuugaucuaagcguauuauuggagaaaaauucaaggauagauauuuguuucucauuagauuuuccucauauuuuaucauuggggucacucuaguacaugguacuagaauuugggauuuuuauuucauuuuagauuggacugauuuucugguguuagucauuaaaaauaauuccaacucuuugaagagaucugggauguuuguuauuauucuauugauuaaauaaagcuauuuuauuuaacaauuguguuguuaaacuuucuauauacuuagaauaauaauacuaaaaacugaauggguaugagcuuuucuuauugaauuuaaugucaguauuaaauaccuuauugaaacccauacuuugaaagcuugauugagaaauuggcaaaagaguugacugaaguaaaaguaaugaagcaguucacuggucauccagguuaugaaaaauuaaaccauuagagauaaacugaacugugaaaauuaugaucaugguguuuucauaaauaccaucuaugucuccgccaccauucuaaaaaaaaguacccuaucaaauggugaaaaauaagagugauguuucugugaccauuucauuauucaguuuucuuauauuugaaaugugggagguugaacuaaaauuuguugguucccuucuuuaaaaaaguauaguuauaugugauauuuauuuauuuauauaaacaaaaauauagagaucuuaccuugaaaauaacuuuugagguaagaaugauaaaguaucuaaauggaagaugaauaacauuguaucugauuuguaaauuaugauauaaagaaaauguauaaaauauguagaaauugucuguauaaaaaacuauaaacagugguccguugccuauuaacaaagaguuucauguuaucuaaaaagucuucaauuggcuaaaacagcagaaaaauagaaauuacauacuauaauauauccuaaaaacauuucaauuccauagauacucuucuccaugcagccaauauuuaugaauuuggaguaagugaccuacucuuagauauuugagcuugauuauaauucauagucaaaguagccuccuuguaaauaaccaaaauuaaccaaagauuuuuccuuaucuuccaaaagcaaugccaaguaauucuauccaaauuggaaaaaaaaaaagaaaaaggauaaaccuuauuaggugucaucaaaugguguugacauaaugauauauauguuuaaggauaauguaauagaauauguaauuaaaauuaaaguauauaugaaaagaauugauuuuaauuguuuuaaaacauaagaugauuuaauaauaugggucggagauucuuuuuaguuuuauaauaaauauauugauuucugaaauuuggguauauuccauaguacacuuagcuuauguuaauacugaggccagauugcugucaggcuaauagcguguagauauauuauagucacacuacaaucauuccgucaguuuucaguuucccuuuuuccugugauguuucuuucaucuuguuagauuauucucaagaccuucucuaaauaccuucaguaguaauucacaaacucuuuguuaguuaauaguucucaagaaaauucugagaugugguugacagaacuuagaucauugguuuguuuuuggauuccuagccaaaguuuuauucuuuguuucuuaaaaauacucaaaaaaguuuuuuuuccuuauuguaagcccucuggaaauagaagcaaaucacuguuuauacauuuaaaaugugaugaaaauuacaaaauaaaguccagugaaauauagggcuuguauccauuagugccuuaagaaaaaucccuguuuucugaagugcgagugggcuuuucugguuuguuuuuguuuuguuaaagcuccaggaccucccaauuuucaagggcacuuuggggcauguguagcauuuauuugauguauggauguagaugcauauuuucccacaucugucucuguggaccuauccuuugugaaauccuaaaccuuguauuaaugcuuaguuuaugauucaugguguucugagagcaauuauauaauuuuucugggguguuuauucgaugugcacuguaaaaaaaaaugagaguuauuuuuugguaacccugcacuugccuuuuuauuggugaauuucuuuuccuuuuacugugaccugugaauaucacuguaggcucacugccaauuuugugagccgcugccugcuucaaaauggaggcaggaagguauccauuuucaucaagaggaugacaguguuucagucuuucugaccaucuggagagaggaacuuugagagcaaaagaaaauggggauuaaaaaaaauuauauuuagcagaaaaggcaagggggaaaaccaauuaaaguuaaacuauaccuuaugaauuugugcuuuucuacuaugcuguccuguuuaaaaaaaacauaaacaagaaaauacacaggcuauuuguauaaagaauugguuucccaagucucaugaguauuaguaaaugaauguaaguaaauuagguuuuuggcacacuuuuuaaguuuauuguacacacaaauauaauaagcaugaaaaaggagggcucccuccucccgcuuccuaugcacacacugauuguugguggucuuauguagauccaggcuuuuaauggccuuuuucaugcaucucugcaaaaagcugacacuaugggaauuuaauauucuaagauauauuuaucacuuucugugguuuggauaguucauuuguguucucucugucuccccccucccuaccuccucucuguaaaagugaaaauuuuaauugaaagguagaguuuuuacucuaccauuugaaagagguuugaugcaugucuuucuguuuuuaccauuuucacaugcuuaugggccaucuguguuuagaagaaaaagaaagaagugcuuagacucacaggauuacccuaugggcauuauacaguguauuuacaacuagacaugguuuacaucaacuggaauauaacacaccugguuauuuucuguucgcacaaauacaccgagcuuuuguuucguuuuguuguguuuguuuuaguguguucggaaagggcacuguuucuaggguuuguucagauuuaaacuggaaaggguagaaauguagcacuuucugccuacuucuuauauaagaauggagcuugggcugcuguggucaaugcaaaaagcaaaacucaguugguucuuucuccucaggucuaugcuccaucagcaagcacugccgacuacaauagggacucgccaggcuauccuuccuccaaaccagcaaccagcacuuucccuagcuccuucuucaugcaagguaagaugcugcugcuucugagggaaaggccacuggauagcauuuuccugggucacuuaaugucacagauggggcagaagaaauggaauaguaggcaaguguagaauuuuugaagucaugcucuucuuaggaauugaauuccuuaaaaauugauguauuaauuaaaacuguacuaagucuuucuuuacaauuaaaccccuuuaagcaguaauggguuaagauuagauugaucugcuucacuuagagccgaugcuuaugauggucuuccacucaugaccaaccauuucagcaucuucaccauccccaagacgauguagcuguuuguuuagaagugguucagcuccauguauguuuugaacauccuggauuuagccaacugggaacaaguuggccuaauguauaaccuuauguaaaauuuucacccacuuacuaauuuguagguaagaacaaggguccaagaugaaguaaccuaccacagacuggaauauuacauggugaaagcucugucccaacauaguaacugguuuaggauaaaaggcccaacuuuugggggagaagacaaauauaggaaauuauggaauuguccaguauguuuaaauacauggaugugugcccccacccugagcuuguagucuugcuacugauagcguauaccuuucugcugcucaaaaaagaccaagauguggccgagugcgguggcucacgccuguaaucccaacacuugggaggccaaggcaggcaaaucacaaggucaggauaucaagaccauccuggccaauauggugaaacccugucuguacuaaaaauacaaaaaauuagccaggcgugguggugggcaccuguagucccagcuacucgggaggcugaggcagaagaauggcaugaaccugggaggcagagcuuacagugagcugagauugcaccacugcacuccagccugggcaacagagcgagacuccaucucaaaauaaauaaauaaauaaauaaacaaacaaauaaauaaaugaauuuuuuaaaaagaccaagauguuugaaaugauagcagcuacuucaagaaugaaccacuuggaggaugccccuaagggcuccauccugauauguguguggcacuuauuuucuaauguaauuaucuuguuaccaaguuaaugcccugaauuuagauguggaauuuaccaagaaccccugugugcaaaauguuaacucuuuuugcccaggugugaaaaccuuauuuguauaagccuugucuacgggccaugggguuuccuucuuuaugcaucucuaggaagggccaugucacaggaaggggagcacauuuggggcaaagaguaccagggaagcagccugauauaguggacacacucaaaaucauucucauuaaaagauacuaaucuuccuucccuucaguguguuagcucuuuuaguuuguuaguucacgugugaaauuccauggaaaucuauaaaauuggauggaauggcucuguuaggaauagagagaauuuguuccacgcauaauagagcccgugugucagaaguccuuuaacuuugugacccguccuagguguaacucaaagggacacagcaggcuaugucaccugggugcguuuugugccgugacaaaaagcuaaucaccuucaguuauaaacaguagcuaccucagcaucaguccccuguuuugugagcagugggagauauuguccuacaggagcuuacagagauuggcaacucaaggauccaucacucaaaacagauuucgauugaaaacauugacggaaggauauauuuuuucuaucugcccaggaaaguggcuuucuggaagggugcacauugcaggagaggccagguagauuauaucaguaggcuccuuucccuagcagaccacacaaaauauggggaacaaauuuguuuaucugcauaugcauacccgaaaagcaaaaaaaaaaaaaaaaaauugaguugacauuuuugaugagcacaauuaauuugcacacaucuaauucuauucuuucuuucaaaagaacauuaugccaagaucaugggaugugauaaauauuaauuuacugugaaaagcauaauuuauguaaaauauguauuuuuauaagucugcaucaagcagaguacucuguguuaacaguccuaaacgcauugccacccaggguaucacauugucaggagacucuuguuuagugauauauguuuucaauuuauuugucauaugugccaucuauuuaaaauguuagugaucuugaacuucauauuugaauuuaaggugacauuuaaaccucuguaaucuaaggacuaaagcucaaguacaugaaugauaacuuuaaaaaaaaucauguguuuucacaugauggccacagaaacaguugcaucaugguccugucccacaucagcuuccuuucaguagagggguacuuggugcccugagaauucaagacuugaaggaauaugcaauuaaggugaaagauguucagaaacugucuggggcauauuguaaacucacuacuguggccucuuauuuguaacuucaauuuccaucuucuaguuaaaacucugaaguugucaaaaucacagacaugauuuugcuugcaugguucuuaaagagaggaaucugcaaacuauuccucccaauaugaaaugaguccaguuacaaaauucuaacuuccggauuuaagaacucaaugaaaaagagcuucacgaaauacagugucagauuuaacuuuucuauugccuaacuuuuuaauaggccuuuacuauauaaaauguuauggugaaaauaaucuuauuuucaaggaagcaauaucugcuauacauuuaacagccagcugauggccuaguguauaccuaguacucaauacuuuuuguuaaacuauugaaacaaagaaaaaaugaaugaauuuagcaguaauguagaucaucuuuucccuuaggcuugggaaaccaaaccuaaacauuagcaaucauuaauaauaaccuguaggccaauaggcccagagaaugaaaaaauccguagggauguuuuuaauaagaauguuaacaaaagguuaaccuuauguugaaagauacuuuauauaauuuuaaaccucuauaauucauaaaucguuuuauaaaauccagagacucucaaaaauaucuguaauauaauagcuaccuagggcauguuuguacccuuuggauugcuacugaagguuuaagauagcuauauaccuauacaccaaaaaauaaaaauaaaauauccuaagaacuauauauuugagauucaucuucucugcaugccguaauauaauuauaauuccaacuuuaauucuauuuauuguauauguuaaaaaugaaauuaaacauuuucaaucugagauuuuuuaaaauuaauacuucuuuacaugcuuuuaaaacuugucaacuuuguaauuucucaaguacuuuucaccccaaaguuuaggaacaauuuaacuuuuuaguugguuuucauagaaaaaacaguuagaagacuucuaagaaauguuuccuuuagcaguaauuaccuugcgacuugacauaauucaugguagaaauauacucuguuguucuuuuacaguucaauuuuuaccaagaacacuuuaacuuuuuuaaguguuuauauuuguuugacaauauagagccacuugggaagaaaugaugacugucuucugauguaaucagcuaaccaacacaaagaugaauaacacaacaggcagucauuuucaaguauaugaaaaaacccuauucuauaaggcaaggcugaaugccucagaaagucaugguugucuuuguccuuuacagauggccaucacagcagugacccuuggagcuccuccagugggaugaaucagccuggcuaugcaggaauguugggcaacucuucucauauuccacaguccagcagcuacuguagccugcauccacaugaacguuugguaaggcagacauacacgguaacgggaaugucacagcuaguugauuaaaccucguccucugucuuuccaugcauauacacaaggacucugcaaauaagugcaaaaauggcacacacccauuauucuuaaguuguauuguuucugugaucaaagacauaacagguucaaaucaccuuuguaaauucuuccagauucucucuggcauuguucuuuuguuuauuguguuuugcucugugccuucuuuaucacaaugucagcuuccuuggguacauaaauagauaccuauuuaaguuguagaaucuuaacauggugguuccugguuuuuuuuuuuuuuuuuuuuuuucuaucuguaguuucaaaagauguacugcagagggcagagugacagucgguagauuauaugcaucacccaggagcauuucauuucccauugacuggccuaugucagcuuuggccuguugugauguauccaaaagaaggaguuuguauuuucuguagacuuccaucaguaagagaaaccaugagguuucuacauagaucagauucccauuuuucaguauuuuaacuuuaauucccaucccagccugccacucauacuguguuuugcgucacuccaggugaaaacuggugggcucuagaauguuaggucuuucauuacuaaacauuuccacucuguccaucaccuacauucaucuaucauaguaugucucuuuauccuggaggaaacaacucagcugacuuucuucuagccuuaaauaucaccacagcccagaauccacuguugaacuuaagucugucauuaaagagaggaaagagccuagaucuugagugagauuugggaugcagauaagaugaaacuugaaucccuugugcaagaacauagcuuaaacaauauguggaccucacauccuacaaaugcgaaagcauaugggaaauccagugaucccaggugauacuuacaucacuacuauucaucuugcauuugccccuuuuucuucuucucauaucuacacuuagguuucuuucucuguucugauaaaggaaaucauucuggauucauguggucuuugcucucuuuugcucaaccaguacagauaagaaacaggaucugaucuccuacuccaauaaucaaaaaaauuccagaaguuaagauuucugauauccuugaaaauccguauuuaguugguccuagugguagagaugcuaaguagucaauuagccuauacauuccugagaggcagacaguggaaaugguauuggccuuuuuguaucaccucccaagauugaauguguaaaucacaaacuaucucacauuucagcacauuuccaguaaauagcagaugacuuauuuucaaauuuucucuuuucccaccuccuauuuggagauauuagagugaaagcuuagagaaauaucaacuauaucaacuauuauuaugcuagaauccguuuuggcuaaaauuuucauuucugcaccaucauuuuccacuucugugggaacucauggucaaaacuguauguguccuaugagcaaggaaaguuuugauuacaaauaaaaguuuuaggcacuauaccgcauguuggaauuucaguucuuuuaagaguugcccauuugacauuaauuuuucuucccuucuguguuucuuucuuucuucuccuaucaugcucaagaguuuugaguuaggcgauuugauuuuauccuaguccaguucacugcaugggaaguagcuuuaaaaugugcuuccaugcacaaaaaguauaauuucaaaauggaaaccaacuauauuccuuuuagaaaaaauuuuacagaaccaaaacaauauuaugaacuagagagaaaauaucauuuugaaguaguaacccaguaggcuauaucagaagccauauuugcaaugccauuuaccuaucacgaaacacaggauuuucauuuuucaucugaacaguuaacagauuucagagaguagaguuuuuguuuuaaaggagacaugaauaagcuaucuugcaauguauacuaaugaauuuucccacuguuagugaaacuauugaauuauuauaucuaguugucauuguacuuucaguauuuaaccaugugaaaaucuuuuacugaagugacuuagaagaaucugacacugacaauacuuugaauauauaguagcaguugguguccuuucaguugaaaauaaugguaguuccuuauaauuuuauucuuagcaucuggcuagccccauacugaacaaagggauaguuuaagaaaaagcuaagcgcuguuccuggauuauuugggguauaauuuggccaaguugauauuaucuguaaagauaaaauauuuuaaaaacaucauugccuucaucacuuuaugccauguuauaacagaauguguaauuauaaagcuuaagauccacauauuucaguagcgacugucaaguuacugauguuuagucuuuaaauccccuuuacaguuuuagccuguccaacagaaucccacagcuaaucauuacuguguuacacauacccacacaaaaucacucagaugaauggaguuugcgguuaaaguuuggaauggguuguuguagaugauuuuauguuuggaaugacuuggcagaguucuuuuuaagaacaggauagaguccucacugucuggcaugauuuaggcauggucuuugcacuacagggcgaaacaguccuaggagucuggaauuuuccuuuaaaggaaguucuguuuucuuuuauuuuuuuguaacauaaacccuuacuucaguaauucucaacugauggcaguuuuucccuucagggaacguuuggugaugucuggggacauuuucauuguuacaacuaggggcuagaugcuacuggaauccagugcguagaggcuaggggugcugguaaacaugacgucauguaugggagagccuccacagcaaagaauugucuggcacaaaagaucaguagugcuaagguugugaaauccugcccaaacccaaagcaugauuuuauucuuauuuaugugcaccaguuauuauauuuuucuaauguuugaauuaucaaccaguauaucaguaauggaaacauuuccaacaauuacucuguuaauagacacgaaauacaggacucuugggcaucauaaguuaaaaugaacgaauagugggcauguaaagccucgcacuuugucacacuccucauguccuuuguagcaagcaggaaagacaguaauagcuggaguaagagacuaagaggaccucuuauaguuuaucccuaaauccucuaaaagagacauuauucucugugguguauuuauuacaucucugaaugacaguaguuuucaagauaguuuuuaauguaaaauaaucuaguuauaaaucucguuaguuuauuucaacaacuaauuuucuaugagucucuaaaaauaacugauuuacauggauuccauugguucacuccuuuauaaucuauggggauuaauuuuucuuuuuauucugugaacucagcguuaacccuuugucaaaucccaaauuacugcccauuuuacauaaaguuaaaagggcccaaagauucucaccgaugugauuaucuguuuuguuucaucuucugauuauuauaguuaguuaaauauuuauaauucuucuccucuuuuuuugauuuuugcacauuucaggcagauuuguaguucgucuguucuucagaaauuccacauggaauaggacuguguagaagugagguuaaaguuagucaucucuuuuuuuguucuuuuuuccacauucuguuucuuuuccuccauuuuguuauagugcuuaccucuauagcagaaauaccucuaucccugcuaagcuuucagaauagcuguacuauggaaugggcccacuauauuuuucauuggagaaaauuccauggacuaccuuggguguucauuagguggcaaguagaaaugaguuuaacagguggccuaaggaauuuuggggucaaggaaagaaagagguccauggaauuuaaaaauuugaaaggcauucucaggaacuuggaaagauuuaaaggcaucaucucaacuuuuuuacggaagucuuuuaaguugggcuauuuuggucauacagagguaauauuuucaaaaacauucaugcgucuuugaaaauccuaccucuaauacguagauucauuuccuuagacuaguuggcucucaaauaaguuauacuucaauccacuguuuauuaaauucugacugauaaccaauuguucauugagcguauaguauaauuauguguucaguaguuagccacaaguugugggaugcagaacuauaagcucuauuccuuuaaagaguuuacaauacaggugaaaauacauuagaaaaagcaagaaaugaaaggccaaauauaauuaaguguuaaagacaauagugcagaauguaagugcauuagggaccuagagagaagagaugguggaagaguuggagguagucagggacucuucaagaaagagguagaauucaagacggaucucacagaguaaacagggcaacacucaagagacuaugguuucauuccucgugagcaaaugcuuggguuuuaaauacccgugacuaucagcaucauauucaaucucuuauuuugaaauaaacaauuuuuaacagcauuuccaauaaugauauaauaaagacucauaauccauuaauauauugcauaugaagaaaaaguguauuuuagcuuuaauauauugccuuuacauaacacauucagaugccuaugagaauaacuuuugaagcugcuuuuuaucuugaaaauagcucagcacuuuuuuguaaauuacuauguccauuuuagugagcuguucauucccaagcagauggguggauugcaacuaauuugccaccuuacaggcacuguggcauacccaagaaacacagcuuauuuggaaaacuaauauaauaauuaaacucaaagcagagucuuaaaccaagugauucuguaaagauguuguucuuucauugccagcuaugugaggauugcuuguagguggggcauggaaagaaaguacucaaaccaaaauaagucaugugguccuaauuuaauucaguauagucaauaguuacauauugaugaguaagagagauauuuaaccauuagugcuuuuuaaauuuuuuauuuacuaaauuuuauuguugcugggguucaaaaaaauuuaauuugggaggaagaagauuugagacugguuagucuuugccauuuaguuucaagaagaucaggaugaaauguaauauaagcccuguggaucauaauguuguuuuauucauuauauaguggaaucuuuuucacuugaucaauaggccacacaaaaaaauuaauaguagaguggucuuuuauguugccgaaacccuggagaugauuuuaagcaguaaucuguagauuucgagauugugaucauuucucaaugucccucauugccauuauaucccuccacaguugaugcaaacccaagcuauguuucuguauaacuuauuauuugaaaaaugaaagcugucagaucuaaacaagauauauucuuggcuauuuugaaauucuaaaagcugucuccauuguaaaauagagaguugugagaaaaguauuugaaaauaacucacuaaauaccuuaugauuaaauauggccaccuuuuucugcuucuugcuauagagcuauccaucacacuccucagcagacaucaauuccagucuuccuccgauguccacuuuccaucguagugguacaaaccauuacagcaccucuuccuguacgccuccugccaacgggacagacaguauaaugggugagucacagaaaugccaauucugauaccaacaauuggugucagaguuuaaucaucaaggaccucuuuuucccuuucauaacugaauagcaauuaggcacuaaauauuagucacaugacagaaugaacacacaaauguaccaaacagaaguaaaaucacuggcuugagcauaaccauauuuuucgucacaagacacugaaauuuagcuacguucuacguugcaagucauuagauugaacaaggguucaaacagaccaaaacuaucuuguuccucacauucaaaaagagugaacaaagucauaagaugagccaucagugacuagugagcuacaaagcagaauagcucuuaaugguaguuauugaccacuucccaaaauuccagucauugugcuaggcucuuauccaugaugugccacugucuuccgaggacugguuaaugugaaauucucaggugacugcuaauaacuacaugagguuaaucuccuggagaaugugacacuguggagucccucagaggggaagaaguauuuguucacuuaugagagaggagaugcgugggcaucaguuggccagaaauuauuugcugcuuuuuuaaauuaauuaauuaauuaauuuuuaccaaggacauuuacuaaugaguuaagguccaagaagaaugcuguucccaugaacugagccaucauccucucauuucuugugauguucacuguagucuuuuccauaggugguuccccagucaguauucccacuuugaggaaugaacugggcuggauguccagcugccccuggagggaagagguggaguugguggggagauagcuaccugcuucugaaccagcuuugacaccuuguuguucagaugagcagcacagcuuagugccccagggucuuauuaaaaccucagacuucucagguagucacuuucugcgguuauagcucaaacuaacuccuugcuuggccugaaugucacugucagagcgucgguggggagaauacucaguguaugucuuugagagaagauggcgcaacagaauaaugcugcuguugaguccucuuagcucuuugcacuuguuuucuuuagagaguguguagaauuuggggaaguggcgugaaucacuuauguaggaaaguuuuugauguuggaggagagauguguuuugaaauguuggaaauauaauuucugccucaauaaugcccucccugcguauucaauaauauaucucacacuugagaugagcuaucucgcagccucuccacuccgcuauccugucuaagaagcaaauugaggagagaguuuccauuuuuuuuaacuuuuccuaaccaagcuucuacaaauauguugcaucaguuugaccuuggagagcuacagacagaggucacauggggaaguuuguuagcuaucaaugcaguuuuggcagauuugaaaaacaagaagaaagaaagcagugcagaacugaaagagugagaaaagcauauuucacuucagugugguuugacaaauggaaagccccuuucugcagucaugaggucugguuauaaagaaggaugaccggucauucauccuuuuacaagacagauuuccugucuacuugugguuugaguaauuuucuuuuuuaggaagguaugaagguggagcagaaccuugaguugaggaaaacauacuuaggcucuguuugaaaaaaaacuuuuucugauugauuugcaaaacaguccucuugagagagaggcacuaugacuuggaagggacauaucaggaaauagggugguuaucuccaugagcuguagacagcuuagccacagcucucagugggaaugaguuuugcuugguuuuagcuggucaucuucauuaguuuguggaugaacaggagaaucuacuuguuggucuagccagaguggagcaauaggugacuucuauaugcugagaauagacuuaacuuguuaaaaaccauagggccuuauuuaagggucuugacaauaauaaaggagcuauaauuuaaaaacaaaaguaugagauuuuuagaacccagaaaagggcuuuuuagaaauuuauuucauacauuauuuuacaauaauggaugcacuugucaaaauccacuagcggaaugagaaaaagaugcauaaucuuuaaggaaauagguagacaugguaauucagcauuuuggaggagcaaaccuuuauuauuaugcauagauacagauauuacuuuaagguuacuuuaagggagaacauucuagaauguuuuucuuuaaaauaauauguucaccaauugcguacgugaaaaugcagaggaaaauuuaagcauaauaagccuuaguauugcgugaugucugaguggcccauguuuuuucacacuuaaguucucuuaggcuuugguuugauuuuuugagugugguagaagucagugauggcagcgugucuguauaacaagaagagaagcuuucucuucugauguuagugauacuacccuaacaaacaguauggauuaauaggauacaucugcagacuuuugaaaauauuuggcauauacucacucauucugaaacgcaggaaguaaagaaauauuacguugccuguaucucaaagaacaaacagagcuaauuaaauaauuggcaaauagggaacacauagccugacacauguuugagauuacacacgauucuguagaaaaugacuguaagcaauacuaaugccuuaagaaugggguucgagcacuaacacauggacaucacauuuuucacguuuuccugguaaaaaguugcaagacagugcagucuuuucauacaugguguugaugucuuaggaagcugcuuuuucaguucagaagagggcugcugcccuucgucucagugucauguuauaauaugucuuucugguggucagcaguuguccugaacugacacuagaacaacgcagugcauguggggugagauacaagcucuagaacucucggaagggaaccucucuguaaccacauucccuuucuucuucuguucucugcaucucaaagguggaagaugcccacugagguuugcuguuuguuuggcuugggggagugaccagguguuucuuguuuuguuuucuuuugcccuauaauacccaauaucauuuuuugagaaauccauaagaaggauaaagcuuacuuggauuacauuaaugagagauuuuuuuuuuuucaugacacauucauccauggauuuucaagagaauuguagaacaagguauuuuacucauugcauacaguccacuacuuuucucaagccuugcuggcaaacucuggagaucauauuagaccuuucugaauugaaaaggucaucuaauuagcccuccaauuagaggaauauaauguaugggacacagcauggauucacaguaguucagcugguggcgcacccaguuaaggaaagaagcugucaggggucuuugggaguuaccagcaucagcaccuucuacucaguucuucaaacuuuuucaauguuaugccacuggguauucucagaagcagugcaguucagugccucugcaucugagcauacauacggaggaggaaguguaguaaguuauuagauaccagcuauagagaauaggaaugucugcaggauauuaaccauacacauuugguuagccacauacuuccuuccuauuugcaauaauauccaguagcccuuccugauggaaagaaguaagaggaccuccuaccauagcacagaccacugagacugcucaagggugagaaugcgucgucuccccauugggacauaccaucuguauacauucacagggugugacccuuugugguuugaggcuacacacacucccuugcccucagagagaacuggucauauaacuaacauaaugguuauaauaacuauuauuguuuuauuagucuuuaacuggccugcauucuaauacguggucuuuuccacguuuuuaaaccucaaaccaaacaggguugaaggaacagacuaccaagauugauuuaauacaccauaugcuaaagauuacccuggaauaucuaucugguucaugaauuaaucuggcuuagaacuuuaacuucgaaugacauguuaguauguggcuugucuaguagaaacauuauguccuuuucucuuugaggacuugguuucacaguaauuuuauuauuagaguagucacauaauguucacuuuauauuuuacaagaauauugagccuugaaguagucaggcgaugaacaagcacagagcauaagaguaauaagaauuguauccagcaaugugaaggcaucuuaguuaccaagaccaccagcagagaacaauaaacuaguuugauuuaaaucuccuccauuuccugugcacgaucaggaagcccaacuucccccugaauuccuaggaaucccuccuguuaaaaaauagugcauuguagucuauauacuugcguuuguauuuuaaaaugguuguaguaggagugcuggaaauguuccuucuuuuugucaucuuuauagauaagcacauggcauuguuaugcuguuucuaaugguuuaauaacacgagggucacucggacacaguuuagaaaaaccuacuuugaaagcagucaucuucucucaggcaaacacagugugaauugugcugcuuauucuuuugaugccuucaugauguucccagccuuagaugaugggugugcauuaaaggggcaacacauuuuccaaauucugauuuuuaguaguugaucccaaggcaccacucaucccaguguuuuguugaggguguguucuaaugggaaugaacauuuccccaaagcugaggcugagacagaggguggucuagcauguaacccaagauacaaaaccuuucuuucugcuucaucuucuagccagcaacaccaccuguguucaagccaucugaacaauacuuggguggcaggcagugucgaagccuccuacaaaaauuacaguuccucuuaauaacugcucaucuuccauucauauuuguauguuacagcucuacuuagggacugauuauauuucucuugggcaagauaaauugauuagagccaaaauuagaaaucgauaaagucuuuaccaagcaaaugcauuaguuuucaucuuucuguuacauggacauuuugaucaucucuaauaugaauugacaaaaaucuugggccucaaagaguaaucaaguccuguuacaucaaacccacauuuucagcuuuaauguaucuugcuaaacauggcccacuucucaaugcaaaaaaaaaaaaaaaauucugccacuugagaauuaaaauauauuucuuuuccaguuauacccuuuguuauaucugucacacaaauaaaaagagaaaucuguaagagaaagacucauguagcuuaacauguucaggcaaucuagaaaauguagcuucuccaguguuuccuggaccagaacaaaaggcauuccaagugaaagggcaaacuggccccaguaaacugcuuugaaauuuaagcccuuggguuuggcacuccagcuguugcaagguaaaaucgcuucauguuaaaaaauagucuguucuuaucagugguuuccauggguagccuuuguaguuuucugaaauauuuucaugacgcgaugagguaagaaguugauucuauuuuuaauucuauuuccugagucauaauaucucccugcauaaaacaggcacugauagaauguuuaguuagaaagguguaguucuaaagaaaucagauuggucauaauaucuugccucuucuaacgugugauuuuuggggcguauauauuuaguuuuuaaaugcuccuaaaauauuuguauugguuuucaauacuuuguuuaguuucauaaaaauauauauauuauuuguaaucuucauuuuaaaguuguuuaaaggaagaauuaaucuuuugaaagccacuacuguagcagauauuaucuguagugaagcaauaucuuguucuuuuuuggcuuagguucuuuguuagauaaugugauuuuuccaauguagcucugaacuuuuugugaaaaucuauauucaaaucaagcagauaucacagauuauuuugacugauagaucuaauuuuuagguauauaauaaugaaaagaaauaucgcuucuaggaaaaaaaaaaagauaaguacccccaaauaccaugguaauacauacugaaaaaagguuaguaucaucuauauuucacaucauuauuauuuucucuuuagaaugguuuuuagguuuguuuguuguucuuguuguuugaggcagaguuuugauccuguugcccaggcuagagugcaauggcgcaaucucaaucucggcucacugcaaccuccgccucccagguucaagcgauucuccugccuuagccaggcauaguggugcaugccugcaauccauguuuuuaguuuuuaaaggacuccuuaaugcagaaauucuucucauuuucacacuagauauaauuuguuguauuuuaucuuauauuaaauauuuuuaauacucuugauaucugagcugcucccagugguccaauuguaugaugucagacccucauuucaaagaacuugcuuauacaauaccuaucaugaguacuaaugacucauguauuuuaauaucauaacuuugugauauggaaguuuauuuugucacgagauaauuguguucuucuuaucaugugccagauuucuuucaguauuuuagcaauuaacaaauaaauauggguguggguuuuguaaaccaaauaaaguauauaucaaaacauuaucggcugggcaccgugacucaguccuguaaucccagcacuuugggaggccaaggugggugguucaugaagucaggaguucgagaccagccugaccaacauggugaaacccugucucuacuaaaaauacgaaaauuacuuggcgugguggcgugugccuguaauccuagcuacucaggaggcugaggcaggagaauugcuugaacccggaaggcagagguugcagugagccgagauugugccacugcacuccagccugggcaacagaacaagacuccaucucaaaacaaaaaagaaaacucaucugacaaacucaacauauaaauauaugaaaauaacaagcauaaauuagcuaugcuaagcagaggucaggagaauuaaauuaugaccuggaaaagccauagaauuggaccacugaagauccgaccccacuacugcauuuuacaaguguggaaggugaugacaacacauuuguaagaaagaaggcucucuuaguucaagaauggggcuggaaagucuuugaaauuauauaccuguuuaaugaaguuuugcuuggauucauugggugauuuaaccuuuccuuuucuuauuucacaaaauagugaaaaacaaucuucccucagaacuuuaauagguuuuauuuagauacuaugucuauuugcuaauguugaggcuuuaguaaauacaacauaccccaagugcuaggcauucuguuaauacugaagaccacaagaauccuggaaaucccauuuuaucacuuaguucuaaaggcaagauaccuuccaaugauacauguuaaagaaagcuggcuuugaauuguauacuguaauauaugucuuuuauuauucacaauacucuuuguucuucucuuuuguagauaaaaauaccaguguuuaaggcaguagagauaagcuucaugaauauguagacuuacuuuaucucuggaauucgaggccauauugacuuuuaguagcauaccaguucacuuuuuuuagugugaacacagacuuuuaaauauguggagaauauauguuauuuaaaacauuaaaaauauuuucucuccuuguuagccagaccuguuguggaaauuuuuguuuguuuguuugguguacuguaggacugugagacgaauaccccguuuugcuauguaucaaauuucuauuuauuugaaaacagauggaaguuauuugugaagauaauuccauuuacuauaaaauaauauaaagaaaagccagacucugaggacuccagagaccugaaaguagucuauacuugucagcaaugaccgucacauagcuugcuacauucaccagcucaucaacagcaaggggaaagucauagcaaggaaaccacuuuaucuuuaaaccaaggugucagguuuauauuuuaucuguaaaaaaguaacaugaauauauuugacaucuaccucagcaaacaaauuaaugcuaauuaaagauuaauguguuguaauuagcauuaaaaaugcaauuaaauugugaguaaauggaccaggaauagaaaauuguuagacgucucacugccugguuuucauauucugccuuuuguuuuugcagcaaauagaggaagcggggcagccggcagcucccagacuggagaugcucuggggaaagcacuugcuucggugaggaaauauugacuuuggacuccauauguaccauuguaaagggugaacuuuaaucagaaguggacauuuggaauuuuagaaaaugaauggcaaauagcuuugauuuuuggaaaaugcuagcuuucuugcauaacagucacuggaaaauuugagaaggcucugaagcuuccaguauauagucucuuucucucauccucaaaaugguacuaagcugcacucaauuauggaugugggaauauucuccuggucuuuggguuuauagguuuuuuauacugaugucuuauuuuucucuaaaguaauaugggugcacauugaccagcuaagacugucuuagcaaggaauaguucuaaaacacuuugaaagaggcauuugaaaaaaaaaaaaaaaaaaaaagacaauaacugagguccaugaagaacugucacauaauuggcaccugggggacucagcuucucugcuuugcccaccuacugccagaaagcuaaaauugaacauuucuugcauguucccugaugacaaaauggcauaccuucauugucucagagaguauaucugguauuuuagucaaaagcuaaacauggucauuuagaaauguaaguggagggccagguaguguggcucacacugguaaucucagcacuuugggaggccgaggugggaggaucacuugaggucaggaguucaagacuagccuggccaacacggugaagcccugucacuacuaaaaacaugaaaauuaacuaggcauggguggcacaugccuguaaucccagcuacuccggagacugaggcaggagaaucgcuugaaccugggagguagagguugcagugagcugagaucaugccacugcacuccaacuugggugacagagcaagacuccaucaaauaaauaaauaaauguaaguggagauuucuuucucuaagauuuugucucuucaguuggcuuuuaccauugagagcauuaaaaaaguucacacuguauuagcauugugcccuaaguaaaaguuuuuguuucaucugggccuucugaugcuaugcaaucaaacgccuagaucuggcaaaagaguggcaaaauaucuuaggaaugauccuguucaaccucucauuguguagaugaggaaaggaaaguucaaaguaucugcuuggcuugcccauagccacacagccaguaggaacgaagaguugguuugaagucugcugaccccagccuggcucuuuucccaccaucccauaccacaucaguaauucuuguuuugaaaaauuaaaauaauuguuaaguucuucauuugacaauuuugguacuguaguugauuauuacauguaugcuguaacuuguaaguucuaaaugaauugcguugacaacuucguaguuuagaaaagugugaauuauuuuaaugaaugaggguguuuuuuuuuucuccuuauuguuuuaagaucuauucuccagaucacacuaacaacagcuuuucaucaaacccuucaacuccuguuggcucuccuccaucucucucagguaguguauuucaaaucccauuucaucauauaacaguuuauaagaaugauuccccccuuguacuuccugauuuuguagguggaaacucacuuccccccaaaucccaaagcuuuaacauuccuauaacagacaaauacaaagggugggagagacaaauuaccagauaacaguauagucguuuacauccaaaccuuuucuuaaaaauuagauuaucuuuuuaaaauauacaggcauauggaaaauguauuucuuacacuuuucuuagcucugcagaagacacccaacggcagaauaauguauuccaauaaaacgucucagaugaaaaaaacucaguuaauauagucaugaauaugaauauagacuagauagucaucaaauauagacuauuuaaauggaucauuuccugcaggaauuucaggcuuuccaaauucccucuuuaaaguacaugccauugggauguuuagagaaaacuauaauuuuguaaauaaauugugaaauaauugugugggguagaagggauguuugacuucaaaguauaauacauucguaugaccuguggcuucaaauugaauaacuauaauuuguagaauuaugucaguaaauaauuucacuuuucagggguccguuuaagagacucauugucuuuccaauauaaaugcuuccagaaagccuuccuugguucaugucucugcucuuugguaaggagacagguggcuuauuaaaaaaacaaaacaacagcaacaaaaccuaaaucacaucuguaccugauggaaaccuuaccuuacuguaauuuauaguggaguuacuugcguuuguuauuuccugcaugcagcucucauggcccaguguaaacucagcuccuuggucgaggacaggagguuucacauugccacaaaacuuucagaaaugauggccauggcuuagcugggauuuaaugucaaccucuuccaagccuccgugguaugagaagaucacagaauagagagggcagugggauucugaagucucuauguccagagagaccgcguugaaacugggaagcgauugaggugauuuuaagaggauaaucaaacguucccccugguggaaauagaaacuagaguucaguauuguuguacuccucggguucuguaccagauucuuacacucugaaaaaugauuucaauugucaguaacccccuuucgagacaacaagagauacaacaagggauagaggaaucugagcagguggaacuccaguuuccacauuucaaacaaaguagcuuucauuuuauucauuuucuaauuuagaaaaagaaauguucuaugguaucauaauguuugagaacgacuaauguagucugauacccugauuuuacagaugagaauacugagucccaaaaagggaguugaguuguugaguuuauuaccagugguaauagcagagcuuggacaaaaaucuggugcucacaguucugccauccauuucuagauuaauggugggaaagaaaaauuaggaugcacagucauucuagaaaacaucacaaauucccucgaccugaguagcaugaucucagugaaaggcacagaaacaaggcuagagaugccacuuuuugggucuugguaaugcaucauggaagaccacauguuaggaagaaagaacuuuuaugaagaugcaaauauggggacagauugcuauuuucacaccgacggcucuguccaaauucugucaagaaaaguaauugaacaaaauauucuauuuuuauuuagcauaaaaauauacaugcacacccagaaaagacaggaagaguggauuuuaaaagugcuaacagugucggggcaugagauuucagugagaucauagcuauuauuuuuuccuuuuuugaauuauguauuuuccaaguuuucuacacugaauguguauuauuuuacauuuaaaguguuuuuuauuuuguagguuagacauguaauauguauucuaacagcaaucuuuuuuuaccuucaaguuuaaugaaucauaaaaaaauuauuuucuucagaagaaacuuuuagucauugcuguauauugacuuuaaauuucuggcuuaguggaucacugauaacuaaucuuauucccuuaaaaaguuuuucaagauuuaucuuuuucuaaagauuguuuuaaaaacaaguggcaaagcuguuuuccacuggugcgagaauuuugguuuaacauaaacuagccuugcaugaaggucuaacaaaaucccauuuuuguacccuuaaaaguaccuugauuccauggugauaguuuuucuuccacaggaacccuucuuaccaaaauucagaaucaauuaaauguucucuuuuaggagacagccagccugggggaauugugagucuauguaaagucuacauauuuuacauuuaaaauguuuuccuugucccaaaauucuuauaugggaaguuuacauguauuuacguuguuguuuaaaugaaaaucaucauugccauugccauuuccaaaaggacuguuuaaaauauuggcaagcgucuuuuuacaugugucuagaucugauuguaauucccacuuuaauaucagcaggcacagcuguuuggucuagaaauggaggacaggccucaucgucuccuaauuaugaaggacccuuacacucuuugguaugucucauuugcuaaucucugucccacccauuuucaggucauguucuuucuuguucagucuccuuuacucuccaagauuuugauuuucccuguuaguaacuuuaagucagcauuaagcacacagguuugcgggagccagagucauuagccuaugcuugcuccuauuuggagaugggaacccagauacuacuguaauggcagccccagggcucuaaauaucuaguagcagauaaaauccuggaagggcaauggccuucuccccaucucuaggaaagaucccugucaaugauuaaaucacuuuccugcuaucagagugcuggaacuccagccagguccuauaccuggaacauuugauucccucuaccucugcuuuacuuuccagaauaacagguuuacaggagcuuuccuucucguagaaacccagugguauccuucgugguagagaaaugccuacucuuccaggagugaauugcugaaaauuuccauggauguaguuaauuauuauaaauacucacaugaugauucagugucugacacuucagucuuucucuccucaugauggugggggccagaaauaugcaggaaacaaugcugguugugcagcauuuaggcuguacaugaauuuagcgggaaggaauagcaguaagggagaggagccuuuuaguuccucgggguugagguuuucuuuucucccuccuaucuugagaugacacauggaagaagacauagauuuaucuaucugcuuuaguguugucuuauauucuucccuuucagcuuaaucuuaaggaaaaucugaaaagaaaagcaaagguggauuucccuccuuugcuguguucuuccuugcuauaguguaugaaucauucagcuaugcauuuuaaccaguaaaggaaaccagacagugaaacauauaugcacuacccagcccaauuaaucugcggaccacauccacauaauuaguuguuuuaguguuuaccuucaucaguuauucucuggggccuauucaucaaaaccaggcuucguccaacuauagaacuguaaagacgggguguauaguuaugggccacagcuuccauucuguuugaauucugaacacugaagaagagauuuacaagcagaaacugcugucucuaccaggaagcugugagccagaaacugugauaggcacauguaugauuucuuuuccugcauacauuuacacucagaaguaaguauguauuaucauucccauauuuauaaauuagaaagcaugcacuccaagagguuuaguaacuuuuccaaggccaaauacguagcaaagcuagcagucuaggggagguaguuuaacucccaaacccaccaaaucagaauguucuguaccauagacuacuauauuagacacacauucuuccugucaguauaaaauagaaauguuuuuucucaugcaauagagcugguacacuuguuugcacagccgauucaaaaucaaagucaauuguagcaugaucuagugcaaagagucacuagauuuaaaauaaaaagaccuagauuccaacucugacuuuaccauuuccuagcagugugacacuacguaacuaauucacuuugugucuuugagccucauuuucaugucuguacggaaggaaucauaaugucuucccugccugcccauacacacgugaaacaaggaucaaugagaugguauauuuuaaaguguacacuggagagugguauuugauaucauuauugaucaguuuuuaaaaugaauacauaccuuuaaaaugaauacauacauuuucuucacuaaaaacuauacgcauugucuaguugugaaaaacuagaauccuaauggcaaggaugaacaaagguugguugguuuuuaaugguuuaaaguugcgaauucuaugcuauaguuggggcuuugaacucaguuagaugcccccagugaacaguugauucaaguguuugugauucuucagucuuaaaaucuuauacuacuuuaguugacagaauuuauauaauuuuuuucuguaaccauuuugaggcccuuacacgcauaccaccacacacccacugguuuugaugacaggaagccagaaacaccgguaaaaacucaacaagaaauuaucauccauuugcuuuucccugucucugauuugguacuuagcacugggucauauaccacagggaagaccaaagaaauauaccuucaggaaaagaauuuaauuaagaaacuauaaauaggucaucuuuccagugguaauuguuuaaaacucuuuaacuuaauaccugccagaaaguuccuuaaauucagugaauguuuuucucuucuaaaauaaauuuaaauugccuuucaaaaggcaguaccguauauagcacauguauguuauaauguccuggaauaauuauugaauuuaguuuguucaugaaaaauaacacuauaauuuuaacauuaacacguucuaccaguuuucuggaaacaacacuauuuguauuauuguuuuaaggaaauacauuuuauuggaaacauguauuuagaaacacaguguguuuuuugucgacuaaaauuuuacuuguauaauuuaggcaccccuuuugaacuaaaucaaauuuuacaucauuuguuaaccaacagcaaagccgaauugaagaucguuuagaaagacuggaugaugcuauucauguucuccggaaccaugcagugggcccauccacagcuaugccugguggucauggggacaugcauggaaucauuggaccuucucauaauggagccauggguggucugggcucaggguauggaaccggccuucuuucagccaacagacauucacucaugguaagugaugaaauuuauagacucuauaguuaucauauagaguuagaauuucagauauagauacuauuguugcuguuuuuuaaaaaaucagcuuuauugagauauaauucacuuaacauacgaugagcccauuucagguguacaauucaaguguuuuaguguauuuacaagguugugcaaccaucaccauagucuagguuuugaauauuuuugcccccugcaaaaagaaaagaauccccguugcccauuaagcagucauuccccaucccuccacuuccagcccuuggcaaccacuugucuacuuccuaugucuauagauuuaccuauucuggauauuuugaauauauggaaucauacaacaugugguggucuuuuuugacuggcaucuuuuacuuagcaugacuguugcaguuuuucuacaguuugccacguauuagagcuuuauucauuuuuauugucaaauaguauuucacuguauggacauaccacauuacacaguuggguuguuccaacuccuuggcuaugaugaauaaugcuucuauaaauauucauguuuaaguuuuugugcagacacauguuucccuugaggaugaauugcugggucauuguugguguuugaaauuauucauuuuggugacccuggccaaaguguacaauuugaguucauauuauaauaugacauugcuaguaauucaaauauuaguguuuuuuuuuuaauuaaagaagccaaaauagugucugucaauucugagucugggagauagaaauauaugguauguuuauuuguauaaauacauugcaugugacuguguaauuuaauagaguagcuuuacuacuaccuauuuagaauaagucuuuauuugaauuauauuuaagcagauuuguccauauuacaauugugauuuuuuuccucauuacuuuugaaaggauuuuggagauaauucuuuuugaggaugauuaugaagauucagagacucuucuuaauagaauauuaagugaugacaauuaaugaggugaccagagugguggagaauguaacuugaccagugauucucuguaguucugauccucacaagcucuaccucgucucuaagcaccuuaguguccuauuuugccccuuacaggcucgcuaaaaguugcuuggaugaagguauauuuuccauuaucacuguagcauuucucguuuaagcauggucccaaaaggaaaugcaaaauacauacaaauuauuaugagguucuuuuaaguucuugcucaguaguauucuccuguccaucuuucaguuucucuuaauaaaagucuaagauuaagaguaccauucugaacgguguaguauugaaaucugcaaccaauuugaaaccaaaaauacugguuuauaaauagaagcaacgaacucacaucuaaaauguggaaagauauuuuugaaugccaaagagaaaucuuuuuuucuuucccuugaccucugcccuaaaaauucaucauugaauaaaaauuguuuauauguucauggcaguugcuuagaguuuacaaaagaaaagucuagauuuuaauuuagcuuggccucagguaauguguuaaauacacuugggaugcauauaauaugagauuuucguuuguacagcucuuuuuuuucuaacuacaauguuuaaacauacugcuuuuaauuaagaaaucuggcuuuauuaaaagccagaucugugacuuauaaccauuucuguauaucugcucucaaucaacagaaaaauaguuuaauuucuguagcuguguucauuuugcauauguuaaacggauguaacaugcacccagggcauugcuucagagacuauuuuuuccauaaauauguaaaguuuuucuuaaauaccauauguagguuaagugguucuuuuaaauauuaaacuauacauaaauacuuuuggggacuauuugaccuuugaauugacuccuuuuugagucagauucagaggugggaugggaggaaaagacuagaauuauuuuuggagaugggaaguuggacugaccucaguagaaccgaaagugagacgacugaauagaacgguagaaaaaaggaaauaauuagccaauauuacauagaaaccccuuuaauuugaucuugauauacacacacacacacacacacacaaaagcaauaaagccgccaguuuugcugauaaggauaaguuccuguuuucuccucugaagacauuuaauauucaaucaaggacagccacagagccaagcagaucauagcguaacuccaaagauauggcaugucaucacccugcugcccuuugaaccaaaugggguuuugcagucucucuccuuucuuccugaaaaccauucaacguguccccagaaucugagcuccucagccugaaacacuaaugugugugaaaaggauugguuuggccuaucuuucccgugcaaacugguaugaauuuuaaaacaaaaacauaagaacaaaggaaauaguuuuugaauuuaaucagucugaaguuagccuuugaccauuugauacauuccacaauaaaaaggaaguuuaaggggaaggcaaaaaaaaaaaaaaaaaaaccucaucccccuuccccacaacaacaaaaaaauucaaggaggauacugguaauguuuuccacauuugaauuuuaauacaugaaacaggcuauaaaacuuuggccagcugcaguaaauaaaguagccgugggagguaugcaccggaaacuucagcagagagcacuggugagagucucauucccaacuacacaccuucguuuguuguucugggcggaagcgaguugcaguaacuugauacucaucccagucccgguuuuguauugagcacaucgccuuucuaacucuccucaguaauuccuucugauuaaagaguagacagcucugaauccucucgaccuccguacgcuucucauuuccuuucucccugccuuccaaaaaucaaaacaaaauggcuugauaacuuggaaggugauauaagcauuucuuucugcagcagcuugaaguugugguggggaaaacugugguucugccucggcuguuauguuaucucauuuaauugcuaacauauuguccuuagcuuuugauucauaaaauguuuuccuuggaguucugaaguaggucuucagugauuuacuaaguauuaguauaaugaaagggauuuuuuuuuuucacagcggcauggcucauaacacaagagcgaauguuuguauacuugcaagcucucuggaugauauuauugagcuaugcuuauuuccugcucaaaaaccuucccugccuuuccauuuucuacaagauaaagaccaauuccuuagcucagcauuugaagccuauuaccauuuaccgaaagccuuauguugagcucuuccaaucugcaacaagucuuccagcaagacaaggcugggcauauuaccagaauucacccuguauguucuccuucggaacuuuuguaucucuuugucuuguccagcccuaucugcuuaucucuguacaccuaauacccacccauucucaaagcacugacucaaaucauucuucuuccaggaagccuucccuugcuaccccacucaugcuagccauuuuuuucucuauucuuacagcccuaugaaucauaccauuucuagauauuuaucuuaaccagcuccgcauagcugugcaucuuuuauagauaugacucugccuuaccaacuguuguaaauuccucgagucucacauauuauauuuugucucucuccccccgaccccuguaaauagaucauccauagaaacgggagaaaagaaacgaggaaacuuaacauucugugagugugaguuggcagccccucugcuaggcgcucugcauguguugucuuaggcagucuucacaacagcccagugaggaugauaauaguggucauuucaggugucgguaaagugagccuuagaaguuugagcaguuagucucaaguccugcagcgggauuuaaacucaagcacaucaacuccaaauucaaugcucuuuuuuacuaccaggcauacucuccagagauuaucuaugagaacaccuuuucagaacuuauuuuaaaugcuaggagcuugugauuuucaaaacuugauaaguguugguuggcaaaagaaguuuccagguauuccauggcuggguucccagagcagcucucuucccaaauguauagacagagaacuuucccuccaaagugguggcaugcuuggauuaaaacccacauuaucuaugcacuuauucuuaaaccaacauguuugcgcugagugccuaagaggugugaacucucccuaccaggguccuugagguagcaaauuuuaaguuaucaaguuauuuuucuuacuauaaccacccacuuuucuuccaaaauuaaagcagaaaucucugaaugugggagaauaaggaaauagccaggucuucacuacccuaguuagaaacucuuaccaaguaugauucccucucugccucagagaccuccaugauuaauccugauauuaaaugauuagauuucuuauaaauuauggaaagggcaauuuuccagauagaauucucucuguuacucauucaguauucacauccacagaugaggccugaaaagaagcguuucaaaugaccuaaccgcuuuuuuaacugacuaagaacaaaacccacaucaaacuugucuuuaugugacucuauguguucccguuuauuuguugguagagucagcaacuacgugaucauugagcuaaaaauccccucuacuauucauauaucgcauuaguguagcucucagauccuucuuguuuaaagucuauuuauucauuucaauaacauuuauccgugguuaccaaguguagguucugugcucucaaggaauucacaggcuaguaggaaaagauguguacuuaagcagauugcucccugccagucugcuaugcccucuaaaagaccaggggccugacccuuauccaguagugaaagaucacaugguuguuuaguagaggaguggucaucuccaguugacuuagggaugggggagucaugugcaacucaccccacacaccuguccuccacagcaucccuucagaguccugcaggugggggauguggaacccauuucagaaaucaccaauaaaaguggaucuuugcccaguuuuccucuuuucaguaacaauuuuuguuuuacuuuggauuaaaugcagucuaucaaaagagcauuccuuaggaaaagugguaucuuuuuauuuaacugacauuauauacaugagaacuuuuaccucuuagggcuucauaggacaaacaacuucaguuaguuuuccuuguauaguuaagagcucagaccacugaauuuuagauucuaaaaguacccuggaaaucagcccauugcccuucuuugaagacuaaggccuaggaaggggaagugaccaaaccauggguacucacuaguagaauuagaaaccagacaaaagaggcuggacacgguggcucaccccuguaaucccagcaauuuaggaggccgaggcggguggaucacucgaggucaggaguucgaggccagccuggccaacauggugaaacccugucucuaccaaaaauacaaaaauuagccgggcaugguggugcacaccuguaaucccagcuacucaggaggcugaggcaggagaauugcuugaacucuggaggcacagguugcagugagccaagauugugccacugcacuccagccugggugacagagagacccugccacacacacaaaaaaggaaaccagacaaaacagcaagcagaccagcacuccuugugcuauauccuacacugcucagccgacuuccucuuuacccuaauaccauaaccauuucaaaacugugagugguagaaauuagaaaccauucuguuacucugacuuaacuaaugaaauccaagaaaacucuguaguuggcccuaggcugccugcaaugaguugcuauuuagcucuaccaguaauauuuggcaaaaagagaggguagugggcauugaugugauguggcaguuauugguacauagucaugggagcagcaggagucagaagauucuguuucuaugugggccucuucaacaaagauaugaucaacagaggcaucagcaucuucaguugauaaaguugauaaaauagaaaacuauuuucuaaauagccuguuacagaauuucagcgaagcuauugguggucagcaucaucuuuuaauagcuacuaucuuguuuuucuuuaaauuaggauauuugccuucucuaguguucugucaucucuccuaaucuccacaacuaucagguauuucggagagcagauuaguaaccucaacugaaaguuuugaucuuuaucaauuuaucaguugcuccucuugggcuuucacagguuuugauuccauaaaguucugugucuauuugagugcauacuucauuucuaagcaguuauucccauggacucucagggaauuuaagagauuaucucuacugaaaucucccuacagauuuccugccaagcagucaacaagucuugaucagccuccuuccuucaagggugacuagcuccaaaugcccacaaaguccauuuucaucaaauauuugaaaguucuuccuagguccagcccaaauuugcuuuuuucuacaguccuuauguuucugcccaauagaauugcccacaaaucaaguccaacaagcacuugagaaacucaguuauuugaagacagucugcugaguguuuuuucccucuagacgaaacaucacuaucuucaaauauuuaaccugaaaaaaaguuuggacucccugucaugaacuccauugcuucccagugcauucucccuaguuuagcaaggaugccuuuuucuccacaagaaccuuuuaguguguggaaccgcaaacugaacacagugcuuaagaaaggaucaaguggacuaggguggaucuaucuccucccccauucaguaccuuguaucuucauuaaggccaccuaacaauauccuguuuugcuauguuugaugcuuucauuguccugcugacauauauucaauuuguaaucaacugaaauccauaagccaccuaucuccccagucucauuguguacuuuuuguugugucuguacaaaacuucaugaaaccccauugaauguuauguuguagccucagucugauuccuguuuaaugguuucccugaagcccucauucagucacauacucugccaucucuguugcuggcaaaugugaugggugugacuaaugcccacaucaaagccaccaauacaauauuuucaggggaggggauugaccagaaggccaugaggcucaguguuacagacauucuuucuacacgagugcugucuucuauccuuugaguuuaaucucagcugguucugucucccuccuuauacaccguauggcccaccuuugcucauuuuguccguagcguugucacagaagccgggcaugcagcacucacugugaagcaggaaaugaggcuuguccagaaugccuugcucugguggaaccaaacugaguuugagaggccauuccuguguuucagagcacuuucaaaacuauuuucuaaauacccuguuacagaauuucacccaagcuauugguggucaacaucaucuuucaauagcuacuaucuuguuuuucuuuaaauuaggauauuugccuucucuaguguucugucaucucuccuaaucuccacaacuaucaaguauuucggagagcagauuagcaaccucaaccgaaaguuuugaacuuuaucaauaucauacuuuauuuuuuuaaaacugaaaaaaaaaaggacagaaagguaaaagaacuugaagaaauucuuuuagccauggaugagugauaacagcugagaauccuugagcuuaccauuugauauuucuauauuaauuuaaagaaaagucaaaagauuuugaaaacagcaauagaaguaagauccuuuaagcucuauucagcagccccuaagaaaagugaugaggacacugugcaugcccauaugugaacaugguuggccaccuuagguauuuccccuucucuccacaugaauacauauuuuacucaaauucagacucuaugauguugaaacagucuggcauuggauguuuaccucaaaacccugcucucucugcaccuaggacaaacaaauccuaguucucugguguuuagcaucuuggagccaugaauuuuaaauaaaucaaagacaaaaaccuugucuuucccaguuuuaaaauauaaaagauacacacacacacacacacacacacacacacguguauuuaaaauagacccuauaaccucaucauauucuuacauccuuacaugguuuucuucuuaaauuguggaggaaaaggcaggcagacacauuuaauagcacagugaucaucauuuuuuaaaugaacuguuacagggacauaaucuuaaacuauccauaauuuggaauaggcacaacugugcauuuaaaaaaaugcaauauuacccuuauuuucucaggaaagcagauuuucuggagggaaaaguauauauuguauauauuagaaaauauacauauguucauucacucuuucugcaucugcugugcuucagaugcuuuuggggaugcauaaacguguaaaagaaaguaucugaucuuacaggccuuuuauccugguagagugauaauacaaauaugggucuaacuauaaugcaagguagaauuaugaaaugaccuaaggagcaauucagaccgcuaggaaaagcuucccggagaagaugccauugagcucauauucgaguccacauagaauuucaacaauuagagacaggauagaaaaggcguuucagagccauauaauaaacaugauuuaaaaccaaaaacagaaaauaaaggcucaugcaccuaaauggaaguaagaaaacugccugaugauaccaguccuugcagcuugccagccagggcugcauugggugaaaagccccuccacagcacggcagcuccagcaguuggcucgaauauuucacaugagaguccacaggaagagcgagcuuucauguauauuuuuuacauccaaauuaaguuaacucauggaauuuuccacccuuaggaauuaaaguagcaacucaugaaguaauucaguuaugucauucauaccaaaacagaaaauacuggagcaacuuggcacuguuuaaaagccaagauuaggccuuggccauuuuauauuuuuucacauuccauggccguuguguuauuuuaacuuuuauuauggcuguaaauuuuucaaaucaaaaguaucuuaauugcuuagaaaacagaaguugaaaauggguucauaguaagaagaggguuuaggcaaagcagcuuuaggagugagaacugaaaaaaagcuguagcauuacauuuucuguaaugcgaggguucuaccuauuugguugacauucacaguugugcauaauuauagcuuccucuauauccauaaaucaucuuagaacuauaaaguugaguuuaaccaaaagaucuguccaauauuagugaaaugacaucuuuagggaagcauuguccugauacaauagccacauucauuuuaaagcaguuaauuggacacauugucaaaaaccacgguauugaguuuccacauuuuaauuucacauuugccuucucccuggcuucugcacacggacgggucucuuuuggagcugaaagugugugaaaguuauuggagaaugguagucucuggguaauguuucuguaagcugcccaaaauuuucccccuguagucuagaugggaaacagcugguauuuguuuaaaaagcuguuuugcaaaaugucuaaaccuugagauauagaacugaggucaccauuaaagcaggugcuuaagagcaagugagaaagacuucagaggccgacuggcucuggaaucuucugcagggcacuuccuauuagaagaaaaaguguugaaguuugcuccuuuauuuaggacacggcuauaaguauuaauaaguaagugcacuagcaauacuacuagaaauugaguauuuuugaacauagccagcccucaagugaauaauuagcucaguaugaaaggaacuaaaauggucauuuuucucacagggcuucaagauacaagagcccaaggcgcucuagucuccuuuggguguuugaauuuccucuuuaaacacaccaacaguaaaagaacuacuauuucaaauaagcaguaccauaacugacuauaucuuccaagguuuuggaugcaaucuaagggaaagggggaaaagagacccgacuuggcaagacccguaccgaagcagucuggaaaaaaagcaaagcaaaaaacauguggaaccacuaaaggccagugcacgucagguauccaccagucugaagaugaaaggaaguaagccuccuccccugggagcuggagguuauuagcagcuguuuauccagucgggaauagagauuaacauuguacuuuuuuuuuaagaacuagaagaaaauuuguuugggaaguuggcuuuucauaucaagucacugugcuuugccaaaaaaaacuuccuuucucagaacucauguacuagcauugagcaauguuaugauucucugagaaacucugaauuaccaaaaagucuuucuccauuaaauagaacagaaaaggacagagaaaugggugaacguuugccauugacacauugcaguuguacucuuuaccaugugaaauuugccguuuggucuauuaccuguucuccaaccugacucuaaaugggacacucugcccucuaccccucacacguacccucacaacuuaaucauugccacucuaaggugcacacaauggguucugcagauaccuacugcuugcaaaaagaccuuucaugagauauuggggaaacugccuaguacucugggugcuuuauucucaaaaaacaaacaaacaaacaaacaaaaaacgaguuggauauagguauuuuuccccugauuuaaugcuacucuuaaugucauuuucuuuuauuaaauccuuucuucugcuuuugaucuuauuuauagcagagccacuggucauauggaaacuauuacuguauagcugcgagaugaaagacuucauggcaauuaaauaagagugaaucauuugggccaauaauacacacauacagugagguaccauuuguguccaaaaugcccuguguuguucacuuuguagcaaagccauugagcuuuacaaagggcuuuacaaaaaucugcuuuuugucagaaauauguagucugacaauaugaaaacacauguuaacacacaguccuuagcugcuugcuucuucacacauacacaguaucuaaaucaugccacuuauugauauaaaaugaaauuuucacuuaaauuugggauauuauuuaguuguguuaagcgucagcucuuuaaaaauauauuuggauaaucuauaucaaaauucgacccaucacucaaaaccugccuaaaaugucauguucuucuuaaaguagucccugguuuccuaaacggguaugacuucaucauuuuuuaaaacccuacaugaccuuguacuccuuuaugacauucaucguauuuugccuuguauaguaauauuaucccaucauuaaaauaucagugccugggcuaggcgcggugguucaggccuguaaucccagcacuuugggaagccaaggcgggaggaucacaaguucaggaguucgagaccagccuagccaacauggugaaaccccgucucuacuaaaaauacaaaaauuagcugggcguaaaggugcacgccuguaaucccagcuacuggggaggcugaggcaggagaaucgcuugaacccgggaggcggagguugcagugagccaagaucaugccacugcacuccuuucugggcaacaaagcaacacuccaucuuaaaaaaaaaaaaaaaaaucagugccugcaaagucauagacguguuuauuuuuccuugcaaaugcccauguagugccuugcauauaguacacuuucauaaggcgcuugucaaauuaagugaaauguuuauuugauagaaacaugcuaaauguauauuuggcaauaucaaacaauuaaauuucagacauagucucacagauccauagcauuugugucaucauuugcuaagcaucuaacugcacauuguacuauuacacucccgugcagugaccugugcaguuccuguccuugggaugggaugcccacaaauggagacaaguauaggcuuuacgaauggcagcaaaacaaacuuauugaaguuuaugcccugcaccauucaacaaugaccuugaauguguuuuaaggguggugucuguaaugcauagugagcucgugaggugacaagaaaguggagauuucuggagauccacucagcccugaagggucagagagugaggggaucugugaggcuaauaaaagagaagcaguuggugaguuaggaggaaaaaacuagcccagcagacagagcagggagggcuuugcucaagccuuagugaugugggcguuaacccagcagaugagaggccaugcguagguaauugaacauugauagugaggaauuuaaaaauaggagggaacugcauugguccugggagucuaggugaaggaugcaucagcacaagguggaccucuuagacuggauccauacagcaagcaagagccaggcugaagccuuaauauugcaucaacugauggagagagaauauugcauuuaaaagaugaguauuuggaaagugauggggaagaaaugguucauucguuuaggugagcuucuuuauacuucuacucucuuuucaaauauauuacaguaagcauguguuacuugaauaacaagaaaagcauuuaagaaauaaaggccaauggguaaugguaaaucccuagggauccuuagggaugggccaccuggacuggcuaaaaacuguguggaggucagcagcaugacugugcacucucacagguaugcuugcacuucaggcauucagaauuccaaguguaaaucaaguguccaguugucuuuuccuuuaaacaaaagcuguuuacacauaauugcuagacuucaccauauucucugugcuagauauguuugguucacuaggauggauuaacuuuaguuccauaccaucuacuuacuagccugcuauguggagcaaggaagagauagaggaaugggcucuguuaaucugccaguguccccgcuaggugagcucucuccaguuaugguuuccacuguauaggaaaaugaugucgagaauugagggugugggacacagaagagagaaaugaaacaguuuuaauagauggaacguaugaguuaguacaagaaagaugaacugaggucggcucacauccguuugcauuucuugaacuauaucauagaaucauucauuuaaccauuuuggugaacauccaggggaguuucagcccagcugaucauaugauagacaagcacugccaaggucaggaucauuuagaucauguuuaaauccucuugaaaauuacuuuauuaucuggagaaucaauauuaaauaaaucuccaagaauugcacaauaaggaauuaccuuacauuucauacagaacauaagagaagcugugauguuucuggaaaacaauguagguguucucaagacaguuaugaaaucuucucccgacauacauguuaagaaucaaguaaaaauccaaacaaaagaauugaauccagaucugauguuaaugaaaagucucuuaaagguuuaaucacauguacuaaagaaaaaucaucugauaauuuuuuaaacugagaaauauggaaauuauguuugugguuggagugucccagauguuagcucuuucucccacaacaggugguuauuagagguaggucuuguuuucugcagagccucugugccucuaguguuguuccucacaguaucuaucuacugcugccauuccaugaacuuccuaauucccaucugugagccauuaaaaaaguuugcaugaccgcuucccaccucuuuaaaagaugcacuuuuguacuaaaugguguuuugcacauuugagaaaauaaguuugcuuuccucuaauaugacagaggucuggcaagauaauugaaacugaaaucuaguacucuacaacugucauguauaauugauauuucauggggagauuacaguucagacaccaaaacuguuuucuguaucaauggguuucuaauuacagugaaaacccaucagcuuuucuuuuguguuaauggaaaaacaacagagaaaaguaacaguaaguugcaguuaccaggacuucugucuuugucccauuuuguuguuguucuucuuucuaaaaaccaaaaaaaucuauguccaaaauuggaaaccagaugccauuaauagcaaacuuuaauuuugauguaccaaaauguuuauaauaguauauccaguuuugugucauuaucacuuggucuagaaacugaugacaaguuuccuaaaguucccauuguauacucuuuuagaaggauuaugguagaauagaagugacugaggucugaaagccuguuuugaagcaguuaucucuggagauaacauuaacuaggauugaauaacugccaaaugaaauuuaauacauuuucccauccaugaaauaggccucuuaaauacaacagaauaauuacuuucacaauacucccuggaaacaaagagagcaaaaauauugaaugucuuuuuuguuugugguguuuguuguuagcuagaggauaaggacaaggauauuuaccacaaugcugaaugcaucuccauauaaaaacagccuugccaacagccaccuaauuugaaucugcaugucuuuuaaaucuguuuauguuggagggaucguggcaaauauuaaauuuuauaauuuaguuagacaucuuggccuuggccugaguuaaugaacuaugauuuucccccugcaauaaagaaaaaggaaaugauuuuccucuaucuauauauguacguauauauauguauguuauaugcuuguaccuagguguguguauacauguauggacacacacacacacuguuuuaaaacaaaagcucugggaaauaaacgcaucuugcccccuaacucuccuccccucuccuauauaauuguucaguguuguaaguuuucugaguucaaaaucuguuuuagaucuccaacuaagcaucgaaaguuggaucuuaagucacuucaccauucuuggccuuagcuuucuuuguaaaaugaagaguuugaccuaacugauauauaaccaagguccuccaagcccucgacgucuaaguucugugauuuaaaaguguuucuaucaguuugucaagcccuuucuuggaaacuaagguuauuuaaaauuauauggugcuuacgugauucaaaauaauuauugcauaucuaaugacauuuaauuauuuccauugacaaauucacacaggagaauucaaauagcuguguuggaauuugaauauaauuugaccuaagauacaauguaacucagacauuuacaccuacauguaccagucaauauguggacgggacaggccaagccgccuguguuuggacuacaugaucuuauccccccuuccucguuuguagcucucuggaccgggaaaaugccugucauuaagguggcccauucauaguaugaccuaugucugcuucaaaaugagcugggccauccagugaucuuggcauucugagcuuagaaauacaaagacaaagaggaaauuagcaggagguacagaaccagaaagaaugcaccaagagguaucaugaagaaagaguccaaucugucaucaugagagggcagaagccagagagaagcagagguccccccagagagaggagagaggcugaauagcccagcagaggcgaggaguggcauucgguucccaagagcucucugaguccaaaaccuaagcuacagaaaacuauuuaugauaaaucuuuuauuugaacaaacucaaauagguuucucuuccuuacuauuaaaacuaccccacuaaauugaucagcauacaaaaauccccccaagaaucauuaugaguuccacaaaaaccaggaccacaucugaguuauuucucauucuauccccagugucucccaaagugacaggcaugagcuagauuagaaaauguuuguuaaauuaguaaaugcauucucugaucaaucaaugaauaaucauugaauaauuuuuaaauuucacuucuaucuucuauuuuuagcauagauaucacuaaaacugcauuauacgugacuaugggaagauucacauuuacaaugaguauuaauaaaauuuucauaagcuggcuuuuaacuuuagacuauuguuaucucuaugaaaagguuaucaaaauagagcuuuaacgaaguauggauuuucuaaaaauagggacgaaaugucaugcuuagaauugacuugugggaaucuccuuucuccuagucacauuaugacguauuuaaguucagaaugccaagaucauuggaugccccagcucauuuugaagcagacaugggucauucuaugaaugggccgccuuaaugccagugggcaaaucccugacccuuguauauacagagaacagugugaguuucuccaucuauuucuguguuauucuagcgauggauuugugccgacaguccacuguguuucuucccuugucucuuaugugaccagaaauaauguuucugaaagagaagaaaacaggguuagaauaugccaucuguggccaaggaaacaagcaaagccaagccaauuauucaaauuggaauacucuuccacagccacaggcaauggaguugauccuauccuggagaaucaagcucauuauuacauggcucuggaccuaucagagggcauucacaugaccuggaauagacacaaggggagucuuaaaacaucacgacaaauuagccggcgugguggugggcgccuguaauuccaguuacuugggaggcugaaacaggagaauugcuugaaccugggaggcagagguugcagugaacggagauugcaccccugcacuccagccugggugacagagcaagacucugucuccaaaaaaaaaaaaaaaaaaagucagaacaacuuugucucuaacauucuuuauggaaaaugauugauauuauuuaagaugaucuauagaaaauagauggaguuagguaacauaugggccuaaaauccaaacaaaaauguaguuggaacaacuauauccucagauauauuuauaauauuuaagaguuuacagucauuguauaggggaaagauuuaaaauuaaauggauuuuaacaaaauagagacaaagaucaccguaacugaagauagcuugaguuuugaggggguucuugaacuacacaggcuauuauuucuauauaacaugcaaguauuuucagucaaaacacaugauucugucugcaguuauuauguaccuauuacauaccaguugucauguacgauugcauggguucucuuuuucucuuuugagaacuuaccucaaugugaucuagagggaaaaaauuucaggagcaguaacugaauauauuuuaaguaaaaagcaaaacauuacucuuaaguuaugucacagaugcuugcaaagaaaucuugagaguguuaaugauucugaaauaggaguacacuucuccucuaugcucaaaucugugguuaccuucagugauuuugacuuagagucauccuuuguagaaauucaagaaauuagauccauugggaauacaaauaaauaugaaucagcacgaagaauuauuuagguuuauauugauugacagacauaaagagccaccauuugaucaaggccuguaaaaauucaugcuuacaaguugacaucuuagauugaaaggauaaucauugauugaauccguuuucuaaugcaugaauauaaaaauagcaaaucaaaaccucaauggaaaauagcuaucaugcuucugaauaaaaauuaaaauauauaagagagugaguuacaaaugguugcuggagcaggugggcguggucugccuauaagagagcagacuucagucacagaggaaaggagugguguggcaggcaacaggguugaauauguuuaaaaaaaaaaaaagguuuguacuuaacgccacagagcucuagaagcugaaacuagaaucagugagugaaaucuacaaagaggccaauuugugguaaaaauggaaugggcuucuuugggagauaucagucucaguacauuugaagcaccccacagaggccaaauaaccaccauucagaaaguucuguguugcgacacaggcaccggggagcagugcuggacuuccuacaucucucugcugaaacauucauuuauacuuccugaggcucauaagccucaaguguugucuuauucuugcuguauuuugaauccaaacaauuaauaugauuuaugugaucaucuccacccaaaauuuaaaaaaaaguuggagugcauacacacacacacacacacacacacaugcacacaugaauauaaaaauggcauacuucaggaucaauuacuuaaauauauuuucaguaaaaagcaaaauauuauaggugauacuuaauacauggcugccuuuaaauagcaugugcuuauuagguccugugaauuuguuguugguucagauacuuauuguugaugcauucuuuggaaauacccuuuuaaaauauauugguaacacaagagugaugauucuccuuucugguuucauauuuuugacuggaaaaaaaaauaaaccugauucauagcaguauaaauguaugguuaauuuuuuguguuuuagacccaccguccuguguaaaugcucacuuaaccauaggcuaagaaaauacuuggaaauagaaaagaaaaugugaacuacugauuguccucuuaguugacaaaugcuucauguuuucgcuugaaggcaugugcuaugaaguaggcaguugcugucucagugccacaaguucaaugucucuggaccccagagucgauaguaguaguuaauaaaaagcucagcaguauuuuuuuaaugaaguaaucaugcuguacucuauaauuuuauucuuggaagcauaaagaguauuuacaauauggugucuuucuagggucagaauagugaggaaaaaaauggaaaaauguccaaacauccuuccuugcauggcaaugauggcauuacugguguguuuaauaaaaccuuuauugguacauuuuccggugugguggcauuggcagaaaccaucccccuuuggauuuggaacucagcagcugaugaaauacaguaaacauuaauuuggaaugggcugccaguuuuggaaagccaggugacauuuuauuauauuuguaccaagcagaggcugugucccauacugcuguagcuuccgcugucagaggcuuagcuggcauuauggaaaaaaaaaaauggcaggccugagaaucuuauccccugaaaugaaagucgaaugccaaauugaaauuccuguaggauuuccgauagcaaugggggaauugagaagcucacaauuaagcauaugggcauuaagauaauugucagaucuguuggcggacaugauagaagacagauggguacgaaucagugcgcuccacugcagcacccugggaggcaauuugacguuuuaccugccugagcuacucugccauauuugucacugaauguacagcacggcaucuuacugaguguuaaguguuuucgccgggaacuauaggugcaugugcgguccuucagcgcccucuagugaaacgcguuugggaguaugguuuuugaaaagccagccuucaucagguccucuuggccucuggaaauagcugucgcaccuccgguuccugcucaccucucugguuccucucgcccuuucagguggggacccaucgugaagauggcguggcccugagaggcagccauucucuucugccaaaccagguuccgguuccacagcuuccuguccagucugcgacuuccccugaccugaacccaccccaggacccuuacagagguagguuggccucaccagggcacuucugaccucacuuucacaauaggaccaguguugauacccagccucuugguguucaucccucaagaagcacuggcagaaacccaggaaucaaauugggcacaaaaaugguaaggaaauggcaaaguauuuagaacuucgcccgcuaauuguguuucuccagggacuguuuuccucaaacauccucugaaauccugguccuauaucagcagggaaugaggccacagacugaugagaggaaauuuuauuuuagcuauuuccacauuuuucucauucagguccucuaaugugguuaguuguggccugaaaaugauauuuccaaaugaauaggaaggaaggaaauuguuuuuguuguuuaagauggaaggaaauauaggugcauuuaaaaaauggagcuugguugcaugauuuucgcucuugagucaucuagcccucuaaugauugccucauaccggugauuacgagcggcuuuucaugaccccaggaaguugggcuauugcuggccagcugacuaggagucgcuuagauaacaucuucucagucccuucacauuuaauauaaaaaugauaacauugccacaggaauacaugugggcauuuuuucagcuguucaacauuguacagaucugagugucaauuauauguauggguaugucugcccauuuuuuaugaauaauaaucauuuuauggacuuuuuuuuuuuuuuuuuuugacagagccucacucugucgcccaggcuggaguacaguggugcgaucucagcucacugcaaccuccaccucccagguucaagcgauucuccugccucagccucccaggggguagcuaggauuacagacaugcaucaccaugccuggcuauuuuucguauuuuuaguagagacaggguuucaccacauuagccaggcuggucuugaauuccugaccucaagugaugcacccgccucagccucccgaagugcugggauuacaggugugaaccaccacaacuggccaggaccuuucuuaucaggaggcuuuggauuuugcccucuuuguccuaaaccugugcuucucaaacugcacauaagcacaaccugagcaucuuguuaaaaugcagauuccacuucuguaggucugggauuguccauuucuaaugggcucacagaugaugaggccgcauggaccaaaguuugaguggcaagguucuagaauacacagauuacaaauaaagaggaauacuugacagauaugcuucuaccuuuaaaaaaauuacuacauuagggucguguuuuaaaaugcagugugacuuggaaaguugagcaaugauaaagcuagaaauuucuaaaaugaguagcaaacugccuuccauauguaccauuuuaaaaugcugauuacuucuugagaauaagagaagccuaauuucagaauaucauuaggguaccuauugaagucuugacugcacauauuuagcauacucccugggaauuauauuuuaaggacauuuuucuauuaaaucauugcauauggaagaaacucaauauaauagcugauauuuacuuggguucuuaaucagaacauuggcugugugauuuucaugauuaugauuuucauugcaauuaaguugauguuuuguagacagugaaauuaccaucuacuccaaaagauugcaaaauagaauuuaaccuuagagccaaugcagggaaaacuuguuucugcaggugcauuuuuugaaacuucaacagauagcagggggaaaaaaaagugacagaaggaucacaguucagcaguaugaauugucugcuggcagccuugcaaucuggugugcaggcagugagauugugguguacaugucaccugauuucucuuuuucggcaggcaugccaccaggacuacaggggcagagugucuccucuggcagcucugagaucaaauccgaugacgagggugaugagaaccugcaagacacgaaaucuucggaggacaagaaauuagaugacgacaagaaggauaucaaaucaauuacuaggucaagaucuagguaacaguauauaauacugucgcuucauuuaauuccuuuauuggacuuugaugaagugaacagaacgggaagaaacuauucaguuuuuuccuggcagguaaauuuacagcugaaaagaaaauuaaaggccuacucuagaaguacuaaaaguaucguuucagauaccuguacucuauuggagccuaaacuguuuuggcauuuaugaaucuggacccaaugcuaaugacacacagugaaaaaauuugucucugauucaaguacaguuuauuuguaaaacuauacuuauucuacaaauuuggucagaaauguugugucuauaauauuucuaaaaagagauuguagccauguuaaaaacucaacugauguaugugccaacuauaacucuuuucuuaccucuaaaguaagaaaauaauuuccuagauuuauccuaaacaugcugauguauauaagaguaauaccuuaauuguuuaugguuuuucuuccuggacacucuuuucuacagaaaacacaacugcaggaaaauagcuucugucugguuuucuuaaauaucugcuaucuuuaaauucaaaucuauaucuccuugaacuuuaaucugguaaucagaugguuuuugaauaccaacacccguguacuuugccucaauucccugagguuguuuuuauucacaaauucaaccaauuguccuaagacuacagcuuuccuucuaaaggcugugguucucaagguucuaucuggaaucuuuugugaauuaagaacaugcugccucuuuauguugcuguuguaauuauugagauaaauuccgugucuugccacaaguuuaaaaaugccgaauacuucuagauaaccccuuuccuuccuuguugucuuuuucugauucuuggccacuuuggcaagaaaucccaaggaggggauuucauaccuuuagcagcuucuguguuagaccagucaguucuugguaauuuaacuuauuguggccaaacuuaugcauguuaauggauucuuugaaguuuuggaacaacauuuucauucgcuguugagaaccuucuuauuuaaaaaggucacucuuaugacauuuacuuauguaugccuccaaaacuguauuauaaggcagugcuuuuucaaaucuaggcaguuuuauuugcauaacuaguuuauuuguaagugaauaaccaauucuaauuggucguuagccugaaaaucuuuggaagaaaaguuccuauuuuccagucuccuuuguguaagguguagcauuuguuggauguauaaaaauaucacccaaaugcucagcuuccggacaggccuggcagagacuguuuucauuugcuuuuuacagccuauuugcauaguagaauauaggagugaauuaaucauuacugauuuccuuggcacuggcagcaguugggggugagggcagaggagggauccgcagaaggcagagaaagagggccuuuuccaguggacucaguugacuuccauguuuaccauacacaccuguggcagacagugccaucuggaaaggcgcuuacgcuauggagagagaggagccuggucuuacagcauccuucuguggugucauccuccuugccccuaacuuuucuccuucacccaaguguucuugacuuacgugcauuaucuuuauguguaacguauacuugcaaccgaagaauaccacucccacuuuugauugauuggagcuucucaaguguaauugguccuuauugccacuuggaaguuacccagagauucuccaaaauggaacaucagagucauauauuuuaaaccagcauucauuaaauauacauuuaauugaguagauaauuucccacaucuuccaacuccgaaauguugugauuaaucaucuuuauucugugaacauuuccaaugugugaaauuacccuuuagguuaauuguuagucacuuccauggaguuucuugugauggggagucuacugauguucagugaaguuuguuucauuuucugugucucucauaagccccccaaaaguccucacucauguuuauucacaauagucauucagagcuuuauagcacgugcugcucugccuucuugagacaagacgucgugcacacuucucuuuuuuacaugacagcccuuggaauauuugaacccugcugcugugacgacuuccucauaugauaugcuuuccagguggcucaucauccucuuugccuuccauucaaaaguuucuaauuugucacuguaacacucagaaauggacagaaccgaucuuaucuuuucagacuauucugggcccggccaugcauuuguuaugaaucauggaauauuuugguuuucacaauuagaaauuaccuuuuggcuuuuuuuuuuuuuuuuuuuuguaagagacagagucuggcuguguugcccaggcuggagugcaguggccugaucacaucucacuguagccuccaccuccuagauucaagugagccucccaccucagccuccugaguagcugagaccgcaggugugcaucacugugcccagcuaauuuuuuuuuauuuuuuguagagacgaggucucacuauaucguccaggcugggguuauaggcaugagccacugcacccagcuuucuggcuucauuuuugacucacaaugaggucauggucauucauaagcugcagguguuugguuuguugaaucguuuugcaugacugauaucaguucagguuucccaaacuuguucuguggaucauaaacaucuauaagauuaaagaccauggaagucauguuuuuguaacuuuuuguuuaauacauagagaaaaugagacucacauaguggguugaccaggccuucaaagcaagguaauggggacaccugaauaaaagccucacugucuucacucccauugcucuggugucuuacauauaggccuuucuucuuacuccuguuaagcugccuuguauuuuuuugaccuaucaaaaucauuuuucaauuacuuguuuccccuagauuucagaugucacgguaugaaagguuuuauauauauuuaaaaaauaaaguauaaacauaaagucuuuuugaagcgugguuaugcaacauaugcuaggcguaaguuggugaaugccugcuuugcagaguguaaccccauugaauaaaaaaagcuuuguuuucccuuucugccccccuguaucaguaugggcacacccugcacucuaacuuuaaucuacgucacccucaccuguuugguuuggguuuaaugucugcgagaaaaccaaauaucuuguguauugugaacugucaaagccaucuaaaccaaucccaaggucaaguggauauaaaaauucugccaaaaacauggcauaagauggaaaaguucccugaaaacucuggaagaaaacaaaguaauguagacaccuucuuuuuccccacaccauuagaaaauguugcaucccuuuugucccacagcaauaaugacgaugaggaccugacaccagagcagaaggcagagcgugagaaggagcggaggauggccaacaaugcccgagagcgucugcggguccgugacaucaacgaggcuuucaaagagcucggccgcauggugcagcuccaccucaagagugacaagccccagaccaagcuccugauccuccaccaggcgguggccgucauccucagucuggagcagcaaguccgaggucagugcaggccagccuccuugcagagcucgugaggagcuuguggcaggcacaagcugagaugggcacgccagucuugagcaguggcagacaguagacuuucaagcaucauuccaaagaauuguuuccauugcagacugugucuaaauccauaaggcagcaucccuuucuccuguaauuaaguugugggauucucuuauaacuaagauuauauugcaacuuucccuauauccuuucaguaauuugagcuuaguuuauuugcuuuaccaaccuuugcuuacuguaaaguggcuguacacacucacaugcaguucaccuuuuacuagugacugaccaaauggauugccacaguacuuaguaacuguuccuuuuguucuguaauauaaacacugagaaaaaggucagacacgcaagaagagugcauugcugcccucugccagaagccucagcauuaaacaaagguucugugcuuuaauccuccacagaaaggaaucugaauccgaaagcugcgugucugaaaagaagggaggaagagaagguguccucagagccucccccucucuccuuggccggcccacacccuggaaugggagacgcaucgaaucacaugggacagauguaaaagggcaaguuuguuuucagccauuucugagaucgaucauucaaaacucucaucaguguaucagccauaaaagugaauuucacccaaauugacagauauuuucuuucauggaaaaagaauuuuuuuuaaaaaaagcauacuuuuucuguuacaaauauauuaaugaauuuuuucucucuuuuuuccuuucucagguccaaguugccacauugcuucauuaaaacaagagaccacuuccuuaacagcuguauuaucuuaaacccacauaaacacuucuccuuaacccccauuuuuguaauauaagacaagucugaguaguuaugaaucgcagacgcaagagguuucagcauucccaauuaucaaaaaacagaaaaacaaaaaaaagaaagaaaaaagugcaacuugagggacgacuuucuuuaacauaucauucagaaugugcaaagcaguauguacaggcugagacacagcccagagacugaacggcaaucuuuccacacuguggaacaaugcauuugugccuaaacuucuuuuggaaaaaaaaaauauaauuaauuuguaagucugaaaaaaaaauauuuaauuuaaaaaaaauuguaaacuugcaauaaugaaaaaguguacuucugaagaaaacuacaugaacguuuuuguugguauucaagucagcuaguguuuauaauuacuggauauugaauuaggggaagcucggcugcccuaguaacaaaaccagcaaacguccugaugacaacgaagugaugacauuagccauuccuuaggguaggaggaacagauggaucuuauagaccuaugacaaauauauauauaaauauauauauaaauauauauuaaaaauuuagugacuaugguaagcuuuuguucauuuguuucagacuuuuuucuccuguaaaaaaauaguacugauuaacuuuuuuaaaagaaagauuuuacuguaaauauggauuuuuuuuuuuuuggucuuauuucugucccuuucccugguuuguuaucguaaccuguagugccaacucugcuuccagagggguagugcaggaugaaaugcugacccugauguugcuucucauucauaaauaaguagaaaguuguuucuccagucuuuugggaacacaggacuuaaaagucacaucauguguagauauuacaagcagcauuaccaagacauggcaaaaagaguuugucugaauuguaauguugcguuugugaaccuauucugggauuuucagagguacaagguuagaaugcuacaauguuaccacugugccuuccaauguuuauaucaucggaaacauaacauaaucaaaguggcugugauuuaacaaaaugauuaaaguguuaccuaccuguguagccgaaguagugugcagugaggcguuucugaauacauggucagauuuuuggaaaaaaacaaaaacaaaaaaaacaaguaaaguucaaaaaccgucaaaugagaaaauugcaaguagugugacagagcugauugauuuuguugcuuucuugauuuuuuuuuucaaaauggguuuacuaaaauguagaugacuuaacugccuccuccuucgucugaaaaaugccaauauucaaucaucaugcagcauuauaacaagccuuauaaguccuaaagcauuaaguugcacuuuuuugaggagggguagugcaguauuucucuggccaguaugaaugaaguuuauacuuaccauauuugauagaaacauagaucaagcuauggcacagcgacucaucagauagcuagcuuugacgucugggcacaauugaaccaacuuccaucgugaaucuuuauaaugauugacuuugguguauagugcaguaaacaaauagugcuccuaguuaaguauuugucagcauccuuuugucucuaacuuguuucuauuuuuacagccacacaauucuuggcauguauuaagaaaaaaaaaaaucccuguucaaguaguuuuuccaccuaucagcacugaguaaaugccauaaauccauugaaauggucuaaauguuccaucuguucuccuguuuugccaguuauauaguaaugaaauacauuuguaaauuuuaugcaacaaauggcaaacguaucauuauuuugaaauuguguauguaaaaguuauauuuuuacauguagacucuuguuauuauguguuuuaauacauuguaucaguuuuuguuuuuuuuuaaaaacugugguuuaaaaagaagucucauuuaaaugaaauagcuacaagaaucagaauuuuauguucauuucugaaaauguaagaacaaauaagauaguuaccacguggucaucuuuuacaaacccauaaacauuuugauuagcuguguguguguugaaaaacuguaaauauguucaguagcgauaaaacuaaaauaacuuugauuuguugauaaguuccuaaaauguggagguggauuaaaaccuuaggagaauagcagaaaucaaacuucaugaaaaguuauuuuggggcuuuccugugaaauguaugaacaaagaggcucagagaaggacauggaagacaauaauguauacucucuccuccucccugaauaaugaaaaccauguguauuuguucccuccguauguuaaagauuuccuuuuagugguacauucugcacucauuuuguauagucuaccaaggcggguaucccuaggaacaauauuauauaggaagcagguauacucugaucacauucaggauaaguguacagaagaaaauacgguguuuacucuuuagggaacuggaaacacucccugcauugauguacauuuuaagaauggcacuuuugauacauguuaucauaaaggugcuuaauagagcugaauuaaaguuuuucaaaucuguaaacaaagcaaaaaaguaaauuguagucauuugauuauuuuuuaaauuggugcuuuauauuuuguucucacucagaguaaaagcugcaauuuauuguucaccagcuuugauguauucauuacucaguaaugcaauaccucuauuguugaauucccuuuggaaauaagugaaaauucuaacggccacugaaagcugcucgcuagguuuugcuugguggagaaacauaaucugcaccuauccauauuaauuggguuguauccccauuaaaaaagaaaaaaagggaauguggccuuuuuaguguguuuuuuauuguuguuguuuuguaauuaucaaacccagguaagauauugguauccugcacuggauuuucaaaugaaguucagcagaagacaguuaagauuaaaguacuauacaaaaauuucaaaaggguccauacuacgcuaucuguaugacgacacuuaggcuggggaucucuuucagaaacucggacuuuaaaagcaacuuggagcaguugauccaccuccacauucaaguaauuuaugaauaugcagaauagggaucuguucaucuagaaauuuuuaccauuugucuucuguguagcugcaaggaacacuaauguuuauacaacugucaguccacccaguggugcaacugguucugauucagucuuccgauuccuuuuuauuuuucacuuuuuccuauuucugaauuuuuuuuuuuauuugugaucuugauuuugaugagggguuggggaguggggagggagucgaaccaagacuuggaguuaagaggauuuucaucuuuugcauccaacaggcagaauaugaucuguguccaaaagugaacuugagucaggaaugaaucaauuucagcauaaacaagcacaaaaauuuagucugcuggcugacuggaagcaaaaaagucaagauggaauaugaugaauuccaacacaauggggcaccaaggccuuuaggccucucuuuuuauuuugcuuugguuuuguuuguuuuucuuuagagacaugcucuuucucaugggacuugaaguggacucaucuuugugcagugcugguuuugccauacucauuucaaguauuauagacauauguaauggugaaaauauaugaacuguggccuuuuucauucuuguuacuugugaugcaauuaagugaagauaagaaaaaaaaaaaaaaagcagagauuuaccauguaucagugccuggcuuuuuguuauaaagcuuuguuugucuagugcucuuuugcuauaaaauagacuguaguacacccuaguaggaaaaaaaaaaaacuaaauuuaaaaauaaaaaauauauuuggcuuauuuuucgcaggagcaauccuuuuauaccaugaauauuacaaaaaaauugucagauucugaauauuucuucuuuguagauuuuuggaaucauuaugaguaaaaguuuguuacuuuauuuuacuauuuaaaagauguuauuuuaccauguguuaccaagaugaaacuguauggguagcuuuuuuguuuguuuuuuguuuuguuuuuguuuuuguuuuuguuuuuaguuguaggucgcagcggggaaauuuuuugcgacuguacacauagcugcagcauuaaaaacuuaaaaaaauuguuaaaaaaaaaaaaagggaaaacauuucaaaaaaaaaaaaaaagauaaacaguuacaccuuguuuucaauguguggcugagugccucgauuuuuucauguuuuugguguauuucugauuuguagaaguguccaaacagguugugugcuggaguuccuucaagacaaaaacaaacccagcuuggucaaggccauuaccuguuucccaucuguaguuauucgaugaagucauguacaugaccguucuguagcaauaaaugugccauuuuuauaaacuguuucugacacuuguuucauuucauuuugcauuguccauauagcuaugauucucuucuguaaguaaaacgcaucuauauuucauuuuccaaguguuggagguauugacagcuuaacaaacaaaacauacaaaaaaaaucacaaaaacaaauugaaaagcaaagcacaugauugaucaaggaagagaugcccuuaaugaaaauggaacgggaugcaugcaaaacaaaaagaaaacugucuagaggauuaacuaauugaaggaauauaauuaauguguguguaacacugaagcuaugcauuugaagagcucugaacugcaccaguguuuucgguugugcugcagguugcuaagucaagucagccuuaaccuuuugcaccaguuggucggcuguuuggcagaacauucucagaucuuuucagucaaaaaucuaagaugauuuauuuuguaucacuuuguuaaaagcugaauauuguuaacuacaguuaauauuaacacuguauuuauacuuucucaaacuacauccgccccaccacuucugguugccucuguugacuauuaauccagauguaaacaaccagauguuuuuuucuaacuuguacaaacugacgugugucaacuaucauggaaggaaaaaaauguacagauuaaaauuauucaguguuauguacuguaaguuaauauuuuuguagaauggacaucaaucuacuuugcaaaauuuggaggcuauuucaacauugcacuguagaaauguaaaguaauguaugcaauguaaaggaaagcccgcgguagcugagcgcuucauaacagaauguucuaaucaaguacgugguauuuggggaugucuccaauauugcucuuguauucuuucuaauuggguuuagugacuaguugaaggaaaauguuauaacgccauuugguucacaugugaagugcccuccauagccaaauguugggauuuuuuuuuuuuucguuuuugguuggacuguuugcagauauuuaaauuuuaugaaauuuccaaagauuuugguugauaacccccuuuuaccuucuaaaugauuugagauguucuuauguucuuacuguguguuuuaaauauauauaaaagagccacaagcauuu

SEQ ID NO: 6320 - RNA, 288439 nt, Homo sapiens
auuaacucauguucuguuuccauggagcacaggagaguaacaaggaaggccccuuaaaagaaaggccuuuuaaaguggaggucucaguucacaaacuuuaaaaguuuacgaaguaguauuuuagaauuuuaaucaccagauauauugggggaauuuauuacuuccuauucauauggaagaggacagcagagguaaauauuuauguaacuuguauuuuaaaagcuuacucuugauuaaaauguuugaucuaucgacuucuguauccuuagaaguuugaauugcuggacauauuugacugggguuuuuacaaaggcuucuagguugaaaugcaugguucaggauuuugguuucaaauuucugucagguuggacacauauaaaugagaaaguaauguggaauauuauaaacauuucugcuuuuuuaagcucuaacuuuuuuuugcuaucucuaccaaaaugccugaaaaugucaugacucuuuagacggagaaauagaggaauggaaaccauucuggauccucugcugugacucagucagucuaaggggcagacugagcgcuauaucuggaguuuuacuuuaugaaugugcaccuuuaaccuugagucagaaaaugugguuacugucagucuuacucaguaaguggugcugcauagaacaucagggggagacuuggccuugguuuaguagaaacuugaaggagacaaacaugaaaagcagugucagaaaauggaagaccaguguuaaaaaucuuugguuuugcuuucauuucucuugguuauuucuuaggauuauugcuuuagaucauuuucccaggcauuuucauggaugaagaauuccaaagaaaguuauuauuucaacucuugaaagcuacgcuucagggugaagguagggcuugauuaucaaaggaauuucccuggcugcaguccuaacaguuuaacuuccugugauuuccccccgccccuuucccuuuauuuuuggcucagaacuucaguaaugucuggauugauggaauuccucugggaggcagauuugagggucuaaaggugcuucucaauaaagauuuugaggaaugauauuaacuuauuagaggcaacccucuauuguuuuaguauaaaggggaugagauuugggggaaucauuuuggaugucacauuaagccacuagccauuuuacucuugaugaccuuaguugccuuuaaacuguauuuuuaguggggaucauucuuucaacaguccauucuuuuuuaaacgcaauuugguuuauaauucugggggcugccucuacaugcuguacugucaagagagacaucaaauauuuucugaguaguuuucaacacagugaauuaaagcugaaaaaacaaguagcgauacuaccagcaucuuaacugaguaugugguggugguguuugaguguuugugugugugugugugugugucugucugugugaguguuuuauguugcuguaccuacuugcuuuuagguagcuacaguuuuaccagagaagagaauaacuuagauuauaucaaaguuuuuuuuuauauaaugguuuaaaaaccugcccugugucuaguacuccuuuacgaaguccgcaagacuuggggauaacaguggacaauaauguuccuuaaggacuuacagaaauaagacacacacagauauauuuaaauuccaauuaaucugauuuuuaguguggauuauugaagggcuaggaacuuagacucagaaauggaguauuuuuccuguuuaaaauguaaagagauuuaauaacauacaggagucuugcuaugauuuuugagaggagauuuacucuaauguuucagauaaucuguuuaacaguuaauaaaaauacgauuuacauuuuguuuggauuuuuuaaagucagcacauaauuucuaaaaguaagcaaauuucuugcagggauggugaaaugaaaccuuguagcauuuagcguguauugcgguuuuguuauuugcaguuuguuauuaaguguuccuaggaauaaaaggaggugcacagcaacaauguuuacugugccgauuucugguauuuuauaauuaaagagcaagugugagcugggaagggugggcuggaaagcauggauucuggcucuaaaucucagcucgaccacuuacuaccuguaaccuggggcaacacaguuauuuaauuucucuguaaaaugaggauaauacaagucccugcuucauugggcuaugggaauuaaaugagugaaugcaucuaacauugagaacaguguucagcccauaguaacugcucagugaguauuuuuaagcuauuagcaugaucaaauuuagagaggagaaauauaauggagcaguuucucaguucuuguuagaaauaaucauuacauuugaaaauccaacaaaauauuaacauucaaaacccauuuucagaagugguggugguagaauugcuauaacggaggaaaauuuaggaauggcagccugguuaaaagaaagggcggguagaccuggaguagguuauagaucaauuuaaagcagcaaaguuuucuaaaggugcuucuaguuuuacuuuaaaugaguuugcaguugcacauaucaaauaauaagguguuauuugccagaggcauuuuguugguggggggugggagaaaguuuugggguauauuguguguguuggggguacauuuccccggcugccuuuuuccacugcugcugguccucuggucaggaagccucccugucccgcacugguucuguuauuuguucuuggauagcaucaacuugaggaugagacuuuauaggcaacacauuagccucagugucuccuccugguuguagucauuucccgguuacaugggucaguuucuccaccuuacuugagugaaugccuagaaaggcuauuucagccuagagaauuuuuaggggaauggagaagcugaggguaacuccucagcaccaacacuugaacccaaucaauacuugauagauuacucccagcacacacaauacacccagaaaucuucuccccaauccacacccaauuaaguuucagccaagguuagaauucagugguucccucuguguguguccccuuagcuguugcuguucaggugcaaagguguucauuucuuugucuacccauguguaguugccugauauccaacuaaacugcaucaaaauauggaaccccuagguaggcaaaaaagauaauuagaauacaguaguccccccgccccccuuaucuguaguuucauuuucucuaguuuuaguuacuguccaucagcugugguccaaaaauauuaaauggaaaauuccagaaauaacuccuaaguucuaaauugcucgccauuugaugaaaucugcacuguccuuugccaucucauccgggacaugaauccuuacuuuguccagcagauucacacuccagacacucccugccuauaagucaccucuagguuuucagauugacuguuacuauggcagugcucagguucuagucacccuuuuuugacuuaacuauggccccaaagcacaaaaguagugaaucuggcaauucagauaugccaaaagaaagccaugaagugcauccuauaaguuacaagggcaaaguuccccacuuaagaaaaggccaggccugguggcucaugccuguaaucccagcacuuugggaggccaaggcgggcggaucaccugaggucaagagaucgagaccagccuggccaacauggugaaaccccaucucuacuaaaaauacaaaaauuagccagacguggugguggacgccuguaaucccagcuacuugggaggcugaggcaggagaauugcuugagucugagaggcggagguugcagugagccaagauugugccacugcacuccagccucagugacagagcaagccuccaucucaaaaaaaaaaaaagaaaaaaaaaagaaagaucauaugcugagguugcaguauauuauaauuguucuauguuacucuuaguuauuguugucagucucucacugugccugauuuaugaacuaacuuuaucauagguauauaugcauaggaaaaaucauagcguauauagaauuuugugcuaucugagguuucaggcaucugcuggagaucuuaaaaccuaucccucucuuagagugaguacugugauuauguuuaaauaaaugaaugcaugcuugcuuguggaaauauuuuugugugugggguauguauauguguguguguguguguugcauguggacauuuuaauguguguguauuauccuagcugaugguuuuccuuuggacauuuggguucauuuuguagaaagaaaaugcaguuuuagaaucaggaagcugauuggaugauuccaucugaauauauguguguguauaaauaaaauauauuaucaaaagccugacuugacuugggaacugggaaguagcagccucagguccuccuagguuuauuggaguuacacuuauuaguaaguagccuaauccucucugcaaagagaggaaguacaguuuuaugauagaaucacgugggaugaggaucauugaaccagagagaaacugcugcuguuugauuuccacugcaggucaucaguauuucuugaucuagaacaaugauaaaaaguguucuggucuuuaagcaaaacucagauuuaggcuuuauccuuagaaucugaucuuuaaaacuggaagcacaagcuuuccagcuuugaauucacuccauuucagagaugaagaaaccauuucucaaagaggugucucuguugagguuucacagugaacaagucaggucagcugaauccaggucuaguguuauuuccugcaaauacauuuuauuuuucauuuuugcaguaaucuuuagauuaaacccacuccuauacuguuggauuaguuaggcacauggacuggguguauguuucccagauuugaagguugguucuccaugucauaguuauuuguucugguugcuuuuuuuuuuuuuuuuuuuugagacggagucucgcucuguggcccaggcuggagugcaguggcgggaucucggcucacugcaagcuccgccucccggguucacgccauucuccugccucagccccccaaguagcugggacuacaggcgcccgccacuacgcccggcuaauuuuuuguauuuuuaguagagacgggguuucaccguuuuagccgggauggucucgaucuccugaccucgugauccgcccgccucggccuuccaaagugcugggauuacaggcgugagccaccgcgcccggcccgguugcuauuuuuucucaguuuucuuaucuguacaguggcgguaguuauuucauagaaucauacugaggacuaaauaaguuauuucuuguaaauuacuuacaugaguacccagcauaaguguuagcuauaauaauuauuauguuauuaaugauuaugucauuauuauguauuguugauaguaauauaauaauauauugcuuuuuagacacuuuaguuagcuauccagcauaugacaauaaaaagguggcucuauugaagagaaggauuccauaauuuucuugugaaauuagcgccauaaaucauugaacaucuugcuucaguuuugugugaauuauuuggauugacuaaguacucuugguacugggcugaguuaccaucugcuguguuuugcuuccauaggucaggcuuauucuccuagggaauggugagguggaaaaaaaugccaauaaccuaaccccaaaauguauccuaacugucuuguucacauuuauaggacaguuuuauugcuguagguaagacggauaacugggcacuauuccagcaucuuggcaguuuuccuuuuuucaagguacuaauauuaggauuagcauguuguuuuaaagccauugccuuucugcaccuuauaauugcuuguucuugggggaggcuuggaacauuugaauuacgguuuuucugccaaauaugggagagguugucuguuuuguuuuaauacuucgauugguuuuuaaaguugguacuacaguccauuuugccaacagacaacacaaauuagaggcagugugggcacacuguguauggggcagaugcagagaggggcagcgaauaugcaugagcgagaauguuauagcucugucaguuuuuguaugugugccucaguuuauuuuugguauugauaccaauguucggcaauacagugauuugccuccucuauuuuguuucuaaaucaaagccuuggcagauuaaaaugacuaggaaaagauuaaauuguuaaugguauaaucauauuuuucucuaaagcauugaagaauuacagugucuauacuuauuagcaugugauaacuuuagugauugaaauguuuagcuaguuuuacucaaauauuaguaggauuucuaauuuucauaggagagccuagugccacaaaaguuacugguaacuagcacucuucaguuuucaucuucauguaacuguugugagcauucaaggaaggagcugggaaaugguuuagucuucauagaugcucaacagaugugaguucucuuuucucccauguauacguuucuuaucuuuuuguagaguucaugggagcagcauuuauggauucagacuuauauuguugacaauguccuugcuaccugauagaugaucaguaaguguugcagaacgaauacauaugagagcagcagagauaggaguacauuagggcaauuagaauagauuccuuuuuuuguuuguuuuuugagacagagucuguugcccaggcuggagugagguggaucggucucacugcaacuucugccuccuggguucaagcgauucuugugccucagccuccucaguagcgggacuacaggcaugugccaccacaccuggcuaauuuuuauauuuuuaguagagauggaguuucaucacguuggccaggcuggucucgaauuccuggccucaagugauccguccaccucggccucccaaagugcugggauuacagguaugagccacagugcccggccauuagaauagauuucaaagaaaaguugacugugccaaucucugcucccuccuguauguuguuaagucuacagggccauauugccuaaagaaacggaguuccccaagaauguguuaggaauaacaaaaauucuguacuuugaccugaaaauugcgguucuugagcugguuauuuuucuagguauuguuggaaguuaugagucagaguuagguacuuauucguggauaacacaaggacuucugucagagaucuggaugcugucaguagaaucucuguuuacccucuugggcucaguuuauucaucuauucuaugaggaggaguaugccuguuuggccuuccucuuagguugcuuuugagaaugaaugaaauaauaugugaaaauucuguucauaaguguagaagauggcuagugaugaugaugaugaugaugaugaaauugaugaugcccaaaauauggagaaucuagacugaauuuauggcuuucuaacuucgaauuuucggcuuucuaacuucgaauuuucaggaaugcaugaugauagaauguuuuuauuucugauauccacugcauuguuucuauagaccuucaaaguuugacacaaauaacuaaauuauuuuguuuuguuggugaggaucacuuuuauuuuagcgguguauccuguuaaaauaaccuugcaugaggauucucaaaguuauacuaauguugcacuaguaacuaaggcaguuccaaaaagagacauuuagaaugaauaaggauaaaucaaaaguaauucauauccauugguaaggagguggcacauaccaagugucaacuguagauauuuuagaaauugaaguguuaccauggaaucaaaguauuccacuguaagguugaauaucucaggauaccuacuuuaagucgucgauuaagaugaaguuaauauucauuuuacauauccugcuugaaaccucuuaugcugugaaauuuuccugucuauuaagaauaguuuuagaaaaaugaauuagcuaauuccuuaacuuguauguaacuugaauauaaguuccuuuccuuaacuugugugaaaaucaguucuccuuugugaagagcaugagagauaccucaauaaaauaguaauuuuauauugacaucgguugcaguuucaaagucagaguuuuacacuuaugugccccuauauugucuagcuuuguaauccccacuuuaaaaggcaucccaaaauagcaacagaagaauaaauugugacuuggguguauuagauuuguaugaucuuguuuauugagcugcuuuguuauguaguuaccaaggaugauguaagcuucucauccaaguuuuccuuuacuaugcugcauuguccuuuaaaugucaugagaauacaaauauuuucaagguagcagugaggaacaaucuagaugagaugaccaaaaggaccucucauaugaaacugcagugagcaaagguuuauuggucuuuggaucucuaaauagagugacuuuagauaucuaaauuuagugaaaaccagaauucagugacuuuagauuucagaccauaagggguuguaacaccuacuccuuuucucuguaaugaagaaaaaugaccacaacaaugugguggauaucagaaauagaaacuuuucaucgucaugcauuccuggaaauuccagguuagaaaggcauaaaagagagagaaaaccugucauaguuaguauaucuaccuugguuaguguuuuucacuuaggggauugcaaauucauaugagaauugcugagagaaacaauuaauuuagaacaaauauucuccuuccauuguuacagccuguaaaauguuacuucugaguugcuacuuaucuaucaccauuucucuuucuccacuucauuguuaguguuuguaugauuagggugggcgggggucuucuggaugggguugcucacacuccacaaagccuuuucccucuucuguugaaagaagacacagcugaaaucagucucuuugccuuuucaugauauggggaugcgguggaaucaaagcaggcaggaugaaagcccaaaagcuuccuguuuccagcuguuuucuucagcgaagguuuuuuuuuuuucucccaaagaugaugcuuccuuucaagggguuuuuaaucugcuaacuguuuccucaguuuauuucacuacaguaaaauguguucccuuuaggucauaucugucucuuuuaaaacccaaccuguccuuuucagccguguuaguugcuacucaaaagaacaaacgugauuuauaaaaguccuuuuaaugagguacaaagaccaauaaaccuuugccacuagaguuucaucuuuucaguugcuuuauuuucauuuaugaaaaauuugagaugucaaaaagccauugagaacacuauugauuugaccauuuaauauuuguaaacaaagccguuaaaaauaaaauauauuguuauggccuuaagguugguugugguuuuuuuuucccuuccgaaugcaguauaaucauauguaauuuguuuaauguaaauucuuuaaaauuaaggcacuggaaacugcauaaaugcuaaaaugaauacuaagaguggcuugauuuauuaagugauaaugugcaugaaaauauggcuuuuuugcacugauguuuauugcuucacuuuuugcauugauguuguuuuggaauuuacauuucuaaauucugcauccucuagggauaaaugaaauauaaaaaugaauucuuuuaaucacucauuaaacauuaacuagaccuuucacccauuuccuagaucuuccaggguucucaguaauaaucaucaucauuauacauugauuuauaaaggaauaucagagugagucagaauuuuucuguuucuuuaucacuugucuuuccccaaauauccauacugaccuaaacguaggagaauuuaucagcaagaagguucacauugcugcccuguuauuugagcucauucuuugugauauaaugaagccaguggcauaugggggagaaccaccucauuucauuuucacuuuaaugcuaacucuaacauaugcuuuugaauugaaguggggucccaaaugccaauauauguuaaaagaauuaaacacuuugaaaaaagagaaaguuuucccuuauuuacuccuguugcccacucucuugagggugagaggcugauagcgcuuaaaaacaugagcaugccuauuuuaucuguacuguuuaauagagagcuaugaaaaaaauggcaauuaacauauucagacagaaaaucauccuggcugaaugacucauuaaauagucguauaaacaggaugugccgaaaugaacugguucagaauuuaguuccauuggucuuuucagcacacacugcucauuaucagcacuuuaagaagcagacuugugggugcuuagaggacacuuaaauuucuuuucucuuuauuuuuuucuuaaauacuucuccccuccuccacuccuuuccccugcuauuccuaauucuuugcaggcuaagauuacucgucuaaacaugaaacauucuguuggcaaucgaguuagggguaagagcuucugacuuucauccaggucggugguccuaaccccagaugacaaucaaaauguauuugaagauuuuuuuuuuuggagacaaagucucccucugucgcccaggcuggagugcaauggcacaaucuuggcucacuguagccucagccucccagguucaagcaauucuccugccucagccuccgaguagcugggauuacaggcguauaccaccaugccuggcuaauuuuuguauuuuuaguagagaugggguuucaccauguuggccaggcuggucucaaacuccugaccuugugugauccgccugccucagccucccaaagugcugggauuacaggcgugagccacugugccuggccauguuuuuaaaauaugcagacauugcugaaccucauuuuuuugggcuucccauucaguaggucuagaggcaaggccugguaguccguauuuuaauaaaagcucccaguaggauucagauagccagccgggcuuggaaacuauucacugauuuguguccccucacaguaaaaaugcucuuuccccagguacaggauauauggccaucuggccuggauaucagugguuugcagaccuggcugcaaauuagaaucacuuggggagcuuggagaauaaauacugauguuugaccccacccccaauuaaauuguugguggggggaguaguuaaaaccuccccaguugauucuaauguacagucaaguuagaguacuucuguccuacauaaacagauggagcuagguuuagcugaaaaagucuaguuuucuuuuagaauaugcuuuacccugugcuaaaacuccucuguuacugugccucccuagccacacacacagagcuuaaacguauugccucuacuaaggcuuucacauuuauugguacccuguucucaggugggaguagaaugcuaggcucucacguuguaucagauuccuguuucuuccuaccugaguaucacaucugugaugugcagauguguugguauagcaugagcaccccacaaaggcuaaguaauaaggaugaagaacaaaauugcaguuuagcaaaggaaggagcauccaucuuuugagucccuguauacuccaagaaaaauucugaguaaacaaguuucuucuuuagcaaguugugauauuaaaugggugccuuucauuacauuggcuaacauuugcauuucuuggaccuguucuggaaaagggucugagaugaacccaucguugaagaucuaaaaaacaaaaacuuucaccaugucaagggaaagaggaaagauuuccauaaguguaaucuuguauucuggaugguacaugaaaacucuacuuccuaacugcccacagggauuuaagggguauuuuaagggguacuuacaaauaaaaggaagaagauacauuacaucacauucucauuaccaaggagaaacucauccucucuaggaaagguuucucuccugucuuacgugugacuuuccaccugcuaaguccccuugaaguuacugagcaaagacacucuuacaacacuaagccauuggugcuagaaguggaaguagacggagccccugagguucaggugccagguccuuguaucucugauggcgugggaaacaaaagucagcagccauuucucuucacuagagacucagaggagguaaaaaggggggauucacgaagucaucuugauuuuuccguaucuuauggcgaagucuugugguagaccccagaacccugaugguuggucucacgcucguaaguuuacauaaggcuuucucaagaaacugacauccagagcgcuugccuuagagaagacagcugaccauggucaugacacuggcagguguuaggacuggcuggucuacucugguauggcagaaacccugggccccugaauaagggaggugauuaugcuuuaaagucuaggcuuaccauguguagggcugugggacucacugucaggguuguguaaggcgagggccaucgcuugcagaagucugagugugugagcacccccuuaaauauugcccccaggugcuguacuugcuuaaccccggacccagcccuggcagggagcaacagcaggagggaaaaccauugguaauuuaggucuucacaucuuaugcuucauuuaaugugguugauaaagagccuccuuguaaaaauaucuugguguagacucccagggaaggaaacacuugugugacugacaagcuggcagugcccauggccacgugugucacccugguggaggauaaucguccuauuauuuuuugucaguagguauaacaaguggguagugcuuuguguauuccacugugaugaauuaauuuuguguucauuguaguagcacugaucauaaugaauuaauuugguauucauguggaugucagagguuuuuuuuuccccuuccaauuucauguagcuuuaguuaauggauacuuuaaaguacaguacaucugaucugauuucuguucucucauucacuucucauaauuuuccccccgcuggauauugugaggucuucuguuuuuaaaacauuuaacuugaucuuuaaauaauuaauguuuuaauagcuuuacaugaacucaaacauuccuccugcuuuuaauuuauaaaauaaggaaaauaagguaaauaguuauaacaaauauaacugcuagguugaaugauauacuuaauaacuuguauauuuuaguuugguuuaaaaagaucugaacuaaucauuuguaauuuguagccuuauugaagacaaauauuguauccccuuaugcaaauaugaaauaaugaaaacugcaugccguauauaauaguuugcucuucuuuuaauuucuucucucuuucccucauagacaagauugauaaauguaugugcauauauuauuuaucuguucauauaaggacauguaauugacuauuagauaugguaauugcauaaauauaucuuauucaagcucauuuccuuuucuguuuauaaaauaaauguuuuuguuaaauuggaauauguacugaaauagaagugccuaauuuaggauucagaaacuagguacacaaacaaaaaucaaacaaaauucugggaaccuuugacaaacuuguucuuuaaccuauauguguuuaaaaaauuuguucaucauguuugcugauuauugaagauauuuauaauagaauaaggguuuccuucaucacuaacacaccugcucggcugauuugcucccaguggaaauaugguugaaccuuuagaaagaacgauguuuuuuugccuuacgaguaucaggaugccauuuuuggucuuucuuuaaauuuaaacuuggaaaugguauccuccauauauucucuuguggcuuuaaacuuuuuuuuuuuuuuuuuuuguaauuuuacagcucuuguucaguuugauucucagcagcagcuguauuccauuguagacugcuguguuucagcaauugauggauccuguauauauucuacuauuuagaguauauaaagaaguugggacucuugcaaguggcaaggacuauauaacuggguuacuauggcuuucauuauuuuuguuauuauugugacagauuguacaguaauaugcuaacaaagauuuauggcaucaugcagcaguaggaaauguugggauggaggagaaaacucauguuaaaacaaaugucuauaauaauaagaggaaaacaaaacuucaaaaaagcugagaauuguuucuaguauaaauauuuuuauuaacauuuguuaugguugaagaucuugagaggaacuguucaugcauuucugcaguuuagauuaugcuguaugccuauuugugcaucaucguucuuaggagauuguucuuucuucugguuuuuuuuuuuuuuaguuuuuuuguuuuacuggaacacauagguauugaauaugcaaugaacagaaaauuuauggagggcagaguuaugaguaucugaggaaaguuuaauuacuuuuauaauuuagauaagcuucauaauuuauuguaacacgcuguacuuuggcacaauuuguaacaauuauaaagcacuugaauuuagguucuuuacuuggcagcuaucaacagaguuagcuguaugaaaacuuuaagcauuuacuuuccuuccuccgccuugcauuacaggcuuacgcuguaguaguuuuguugcucccacuuucauuugccacaucucuggguuuuauguaucacaguauaguaggcuuguggcuauacacuaggaagcagacgaagagagaaccugaagauaccuccugaugcccaaaccuaggaaagggaaaaaugcagaagaacucagacgacucuuggaaaugauucuugccucaauuaaaaagaccucaccacucaccuccauguaaaggacaggucgugaauuauucaaaugauucagaaaucaacauuuaaaaaaaugaacauaaauuccuuuucauaauuaaagagcgguggaaaauggcucuuuucuuaggucuagauuauauugcuguuaaaggaauugcugccuaguauacaauuuuuugacauuguuuucuacaacaucaaucuuauuuguuguccuuuuuugucacgccuguuaaauguguauuuuucuguguugauauugaaacuaauguacaaagugugacaucuccaaaaacugauuugguuguuccuaaaaacauugguccuuaaaaguauauuuauuugcagcccaggaauuuuuagcuucacauuuuucuuuuaauaacuaaacuguagaacagaauuagcucucauaaaaccuuguacuugcugaacaacucucauaauuaaaugaauauaaugauuuuaugugacacuuugaacuucuaaaguucuuucacaucuauguauguuuaggacaagauuuaaaaguuaaauuauucuacaguuggaguagaaauaaguggccaaguauccaacuuuuguaucucaaauaccuucuuuuuuuuuuuuuuucccaaauaccuucuuauauucuccaccgacuuuuugggcuggcuaagugugacagaaaugggaacuuuaguucuggcuuuugauucucucauguuaauguagguuuuugauaagucacuuggugcaaaacacugaaacaacuuaucuauuggcuuaaaugagucaacagucugaaucaaacagguugugaauugguuaaaauaauaaaccaguaacccugugguugagcucuugaugauuaaagaaccagaccuaagaaugcauuuauagucuuuuaaaagagaguaaagacucccacuucuuugagcuguguuucuuuguguagauuucuuuuuuuuuuuuuuuaaagaaaggcuucauuaucuguuucagaucuuuauagauguugcaauaagguacuccuuucuauuaguauaggauugaaaggaucaaaguuaauaacuugaacugagaugcuuuaaaauaacaaaauaguuuauuaucucuuuccuuuucaagauuuauguucuuacaaggguacaauguucaugauugaaugugguccuacugguaaggcuuccauguaauagaagaguaauucccuugucuagcauucucuggguuguuuuaauguugcaggugaauguguucugcugugcaaauaaauguaguucucuuauucacauuccugaugacuugcauccuuaaacccuuuuggucaggguauuauuguccuuuauccugaaaaaugucugugauuguagugcccuaauacuauaaaucaauggggacugaauucagcgccugcuaaguagagugaggcaacccuuuaaaugcaaaugcaucagggcuaguuuuaauguaauuuuaauaaggcugaaaccauuuugaaguagacuuaaaucauaauacuaaucuuaaaagacucucuauuuagcugagaagucccuuuauucucacuggccauuuuuccucugugugcauccaaaccaccuuucaugugauuccacaguuuuucauuucuuuuuuuuuuuuucucaaauagaauauauguacaguuugugguuacuuuauuaguuggagaagagcuuguauugacuaaaauugcuucacuucuuuuucuuccugguuguacaugccugacuaaucuguguguguguguguguguguguguccauaauauuucaaucacauugcuguguuuuggucagagaaguaaaaaucuagcugucaaugccaacuggaguaguuauuuaagaauauaauauuuaaguaggggaguauaugcaaaguaauauaaaaaugaggaaaacauuuacaaaaucaaaugugaccucaaguccaauauuuuucaaucuucuaagucuguugguuucaccaccucacauuauuucaauguaugugaaauauaucuugcuguuuauauuuggguugaugggacaggugcaggaucuuugaccuggggaaauaaauuggauuaaggacuagcuuaacuagucuacagaaacuguagacuacaaaaacugaaggcaagaaccuacugucacaucuuuugcagagagacaaaggcauuuugguauuuggauauuuuacuugggauauguauuuuguguauuuguguaauuuuguauuaauuuacacaaacuuaaguaaacaauauauuaauaagauucaucaaguaauuuauaaauuaacuuucccacauuuuucuguguucaagaauuaucaaggagauguguaaauauugaagccuauacuauauuccauuauuugcuuuuaauguauuucauauaauucagaaaacaguaauuuaucauuuacauuacuucccuuuuccuauugagccuucugaaagaauaauguagaccagcauuuuaaaaaaaagcuuguuucaagacauguuaauagaaauuuuauuuucaguccauucugcauuaaauauuguaaaacaccccuagagagugauauuauuuguaaugauucccaaauugcuuugaccagagaacuccuuuuuucaugaaauaccucccauguggaacauucugcagaagaguuuugugaaaugcuaacucagcccaaaagguuuuuuaaauuaaggccuuucaaguugguaaugguauuuaguuucuuguuuuuuaaaauagacuuuguuuaggacaguuuucuagggucacugugccacucaugcugacuguccugucgucuugaaaaauacuacugguaacaugugaacagauauggagguccucuacccgaguauuuuaauaccaaauaauagcuauaucuucucagauauugguagcuaugucaauggagaugugaaauuggcucuaucgauggcuuuuguccauucuccaagagaggccugucuuuguggguggagguguugguggauauguguaugugucuccuucucuuacccucuuaacaguuuggucacaguggugaccagugaguauagagcagagccuugacaaugcaccugacuuugggcuuuagccagauaguaugaaugagugaagcagauguuaaggagaggugaguuuagggcaacuggggcauucgugcccccucauucauucaguuaacauuuccaagaauccugugcagggcaaauaagaucuaucucaggaccagcaauaucucauccuugguaugaagauaagaagucaggagacuugagcuguagguuugguugucuccuugccuggcaggcuugccuaauuuacagcaaguagaaaauaaucugugucuuguucaaaucuaaauaacaaugcuuuaaagguaguguagaauauuuguuaaaaagaacauauuaauuauguuuuuagaagcuucuguaaggaagaaagaaguuugaccccccaacuuuucucuuuucuagaacugcaaauuacugcuauuuuaaauagacuuuguuguuuaacuguacauccaggaaaaucuaggaaauuaaagaagcaugcauauaaaugauuguguagcagaacaugaacauuaaauucauacagugaagaaauuaaaguuagaaauacucucaaacauaagaagguucuagaaucaauccuuuaagcacagucugagacaugguauaucuuugcacuuacuuggaccuugguuucuauuccugugaugauuauuggauuugaugccaucugauguccuguuccucagauucuaugaagcugagucugagauuaacuuaggucugagauugacauaaaggggaaccggucccuagauuuccucagggcugagaaguuauugauuucucaaguauaauaggacugcacagacgcacaauuugcaccaaucggaacaaaauguuuaacaaguucugaguauagaaaacacuuugcaauuugaauuucuaugauuccaaaauucaaaaaagcuccuuuuugauuaaaugcacugcccucaaccacacaugcucauuuucucugucuacugcuuugucauucuguuuauuuaacuuuacuuggcauaccagaguuuuaacgcugagauuuuaaaguacauaugcaaaauuggaaugugucagagaaccuaggaacagauucaucaaaggagucaugaggcacauugcacaugcuuuaacaucaagguguaaacggagcccauuaaacuauuaguuaaguggugaucaggagcaagagccugauuagauuacaaaaucuucugugugugagcgcgguaugugaaaacauaacacuugauccucaccauagugccaggaagauucaauuagagaacugguaugugcccagauuuggggacauaaagggcaacuggauuuugaaggaaagaugguaaggaaacaccugcaaaaaucugcuucucugugcaacagacuggguaauugcauaugcagauggauaguuagggauauaauugcuugauuugugaacauaaaugcccuuucgauugugucaguguugaauuuugcagugacaggugccugcggauugcuguguguguauccuuugcaccccuguuuaaauauuuggccuggaguaugucuuccauucauugugaauggaaccaccgccgucccgcccccaugauggucuggggguauuguuauagcucuuaaugucucuccaacuuuuucucauaaauaauaaccuuaauuugaaaccuuaacuaaaagaaggacugcauagaggcauguggugaagggcuuacgaauuaugcacagaauucauuuuuuaaagcugcuggauguaacucauuaguuuucauuguuuucucaaaauaaggaaaacuauuaaccaacacugcagacuaauagccuggauuuuuuuucccccauaaucaacugaaguuuaauggaaaaucaucuuuugaaagacuuccuuuuuucuccuugcuuuuucuuaaccuuuccauuaauacuguuccaauaucuucucuaaucucucucaacuaaauagcauucucagucauuccuuuucuaugucaacauuucuauaccgcacugaagauguuuguaaaaauacuggugcaguccaaaugggauuuauuuuuaaauugaagaauuuguuaagcacuuacuuauguggaauggucaggucaucuccguauuccuuucucuggccuuauggagaaaguggaggaaauggugucugccuuuaaugagguugcuaacgugccugaacuacacaauaaguuauuaagucauauuuuaugugauuauucaguuucuuuuuuuuuuugcuccauucuaaaucaaacuaucuaaauuauuuuugucaaauaaagguuaauuucagcaguuguugauaauaaacacuugcauguacuauucauaucaacguguaugauacucugcuaaguauaguacaucaguaaucucauuuaaucugucaaacaguauauauuauucccauuucacagaugagcaaacugagcuauaagauuaaguauauuacuccugccauauaguuaauaaauagaaagggauuggaguucagaaauaugugccucucuagcccacguuuguugcuguuuuggcaucuaauuugcaaauauaaauaaauauaucuaaauaaauaaaaaauaucuugaaucugccuuuuuaaaggagccugccaaagagaggcaaaauaaccgcagaaaucccauuuugacuggcuuugauaugaagacuucacacaacucuuauuuuaauuucuugguauuuccuuaugcuuugcugcucuucugaggcacauuuucucaguaagauauucuuuaugcuuuuuaacuaaaaauguggggauuaaauuuuacccacaaaaagguuugaaaccguucuuucuaauucuucaugugucauuaaaaaaguauccgcauguauuuuggugcguguggagaaggagcuggcacugugugcucaaauaaugcucagaaccaccugcuuugaauguggucugauugaaucaaaugacgacugcuuuucaucaccgagccgggauugggaugugggggaaguguuuuguuuugauauuucacaugugcuuagguguucgugguuucagguuguuuaagaacagacucucauugaguguuggugaguccugugggggagauuugaaagcaacguugaggauuucuaggucuguuucaaaauuacauccucuuguguggugcauuuauuuguguucaggaugcagauugccuuguggaaaauggcaaaucauuuucccucauaaaagguuucuuuuguuuuuuuguuuguuuggucuucagcuauuuuuuuugguaguuuccccuccugaguucagauuaucaguacuuucaucauuuauaccacucgguucucuggaguucuuggugcacuguggguccacuuuucuuguuuggggugaugacuaacaucugcccugauacucgccugguacuugaggcucugaacuuuauuaucuucucuucaacugcagcucguggcacuuguaggcaacgugccucccaaagagccugaaagagauuacagcucacuuccugccaucagacaguauguggggaggucaaggggugggcagaggagaggcuuggugaaauucagacuuuugggccccaucuagaagaaucugcuucaguaucucuuggagcuacccaggaauauguauuuucaacagugcuccagaucugagggacaguuggaauuaggaaaacuguggcucuaacugaugccccaguacuucucaaagugggugcccccacauccugauaugcuggauguguuuuguaacugcagauuccugggcuccacugggagugguggcccuggaccagccucugucauguguccccaaccacacucuugggauucguauuuguaugaacuuuagagaaugaacugccacagagauucuaggugacaggaaauugugggguaaauuggaggauuacagaucaugcuucuaauaucagcacagguacacacaaucgucaaaauaggggacagguguguuuggaaagcuuguuuuguaaagaaagucuuuucucccuuugacuucucuucuuuacguggaagcuacacuucugaauuacaaagagacagagaaaaaagagaacaauaacaacaaaagguuccugaggcauaccuaagcugcaggagccaagggagugucccuuguuuuacuuggugauggcuguuugaacagccguuugcuuucuccuuccuguccucugaugugaggaugcaggauuggaaucauuagaaacccuagguuaguagcaucaggcucccugcccuguguagucucugggaggacagagcugcagcuuaaguugugcuuuugucuuggcaagcaccuuucaauuuuuauccuagcucaguugcuuuguuuggcauuuuacuggccaauacuccuuuuuuuuucccucucuucuccaucuccuaauucucaaccucuucuggggccaaaaacuuggaggaaagacuuuaaaaaaaccaauuucacuccuguuuauguaaucguuucuauauuacagaaggcuaugguauguuuuaaaauguauacaucucuuugcuuuucucccuugugacugaauuuuugaaaaaugcuugaaauacggacaccaaaacggaauguaugugugucacauuuaaacggaaaacccuguuuguuuuguauauuagacuauagccaaugaaaacccagggaguaaggauuuucaugaccacaacugaauauagaaccucauagguuucuguuauaaguauaaauauugagaauaguuuuguuuguuuaugccagugcaguuuuauagcaaauccuuucaaauggggugcaaagccauccauggauauuuguaaaggcuuugcaaaaucauacauaaaauaaauuguccauuugauuugaacaaguuuugcaauuauuuguggcuuuaacaggggcuuuugaagggcacuguauauaucuaccagcugguucuacuuuuuuuuuuuuaagaaaauggagagcuuuguauacaaucccuuggguaaaccaguaauaaacuauauaucagguagucaagucaugccauuucaaaucuguuuuacauuuuaaagggguaauaauuugugaauuucaucucauagaaauuuuuaugcuucaaaucaaguuguuaucccauccuugucuauuuuuuuuuuaucgauccccucacucaguguuuuagagaaauaaagcauacaauggaaucucuugcugggaaaaaauacuuucuuacuuauuauauuguaucuuguaauaauauauuucuaucaccauuuaaaaaacauucuuuuaguuauugaugauuauuuugucaaauuauaugaauuugguucuguuuucuuuuugugacaaagauucugaauuuucauguuuaauaaaugcacuucuucacaugacaaauguucauugagcccuuagccaggcauuggugucaacccugguucauaggugcccagaguuccuguccuucugaagcuugcauccugguggggaucaauaaacaaagauaccaaccaacaaauauaaauauauguauguauguaauugauugauugauaucugugugugaguguuuccucaauggcauuaugcauuuauuuauucauucuucaugcauuuguugugugggaaagaauguuuuccagguugaggaaagacacgagacucgacagccagggauauauuagguaacggugaggagucuggugugauugaggcacagaaggaagugccaguguaaaguaacaugagaagaaaguacacacagauccugagcaccuuaaaugcuagccuaaggaauuuuaaguuuauacccaaagcaauagggagccacugaagauuuuuguauggagaagugacaguugucaguggcucauaguagauuggagugggcaccuuugcugaaguuagggaaccuguuuucagguccuuauuaugagacgugcuaguuaaaagaggaaaggaggggaggggguuggcaaaggcugcaguuaguuacauugagugaggucaaguaaaauguuuugaagcauuucuauggagaagucccagaucuucuuaccuuucaugacuuuguuagacucacucuucagugaaauaagacuggucuugauuuuuccaugcgucuugaguuaaagcguuacccuuugcuaccugggcucuacgauuucaccuguucucuggccacaccuuggaauucacuucuuugugcucuccaauauuugauuuccuucuugucuucuuuucuuuguuguuguuuuuuguuuuugauacaagagucucacucugucacccacgcuggagugcaguggugugauguuggcucauugcaaccuucgccucccggguucaagcgauuuuccugccucagccuccugaguggcugggauuacaggugugcgccaccacgcccggcuaauuuuuguauuuuuaguagagauggaauuucaccauguuggccaggcaggucuccaacuucuggccccaagccaucugcccaccucagccucccaaagugcugggauuacaggcagcauggccaccaugcccggcuuuccuucuugccuuuucuuaagaguccugcuucaaggaaacuuccgucuccuuuucaaaaacuauuucaguaacaaucccuugguguuuauuuaccauuuguagcuuaaacuuaaaacuuuuucccuguauuaguuauuuuucaaauauacuuuuugucucuucaacuaaauuuugagcucaggauucauaauuuauuugaagagguacaaacagaaagguucugucccauauuucuaaguaguaggauuuauuuuuccuucuauugaaaugaaaauauaaauggccuuugaggcuccaggagagcccacaaaauuuuauuuaguccaaaauaccguaaaacuucaguauuauuaauacuuaaagaugguuugccucaagcaagaaauaugaagcucuggggaacacauucugugugugugacacauccagacagugugguuugccaaaugguagcugauccagagugagguucuuaaccuucaucaagucagggacugcuuugaaaauccaaugcaagcuguagacugucuucccagaaaaaugcguauagcuaaauacaugaggaaaauucugcaguccuuagucuguguauguagcauguguguagguaugauauugguaaauccaaaagaaaaaaugcuuuuuaguuaccuuuuguagccauuaacguuaccugugcuaagugcucauuaggcauuugcuggcugauucuauucaugugagggccacagggaccaggagaggugagagcaaagaugcaugcacagaucagagaaggguuaaauggggaauuaugcagcauguaacuuauacauuuccugaaaaugaugcuucuguggacuuagacaaaaaugaguggccaggagaggauugccguuggauagaugaagucuagauuuauccagaguugguauuucuuguuaaagaaccucagugagcaguaaguucauaaaccuacuggggugcugguggagggggagaucuacuguuuauuuuaggauguuuucagcugcaacaaaagaaaacccugacucaaauggacuuaaacauagggaaaugucuuacauuacguuaccuauuccaaaaucucuggugguuuccuuccuccguguacugccuucauccuaggaaugauaaggaaauuccugcuuugguucugggcaucacauccaaacagaaaaaucaucaaagaggauaaguggucgucuacugaugugucucuuuccuuggaguagggagauauuuccaagaacccaguagaggcugcaccuuugugucuuagugcucauuuugaaaccaguaucuggccuggggaaggcaaggggugugauuggcuguaggacuuggggguuucccucuggaacuggaaaugaggucaccuguuccugauccacuaggaggagugguggcuaugugaacaaauagcaauuauaccaaaaacugcugcacguucuacuaagaaggaagaagagaaaaauagauauuggaccaacagaacuaacagugucauuguaucuucugauaaacucacauucugaauaaaaaaggaagucauguuuguauuuuuaaaauuuaucuaaaucuguuguuauuuucucuaccacaacacaugggguacagucauaugcuuaaguccaugugagugagcuuuuauaauagauguucuguccacacaaggacugguuuccaaggcccgcacucaguuuacuuaugggccccacugccaugcacaauuaagaaaaagacgagauuuuagcaacuuggacugaacuauagacuuugccuaaacucauuauuuacagcagcacuuuucuucauaggugaauuguuaauagguuugauuacuuauucuugccuuggagaauuuucagguauggcuuacaaagugauaugaauugucaucucucaaaugcaucuuuaauuuaaacauauucucuauguuucuggguagaggaagaggaaaaaagucuaugaaaaugaauuuaaaaugcuucucagagucaguauuaauuuaaaccguugcgguuuucuguggggcauauuuaacccaaaagaaaagcccuuauaauuaggaaauugggauucugaauaauuaauuugaaagaggaaauauaacuuuuucuacagagaacaucuuucauccaaauuuggaguuccaguuucugcagaugucacuucucucucauaacauaagaaaauagguaagaggcaguuuggaaagagguugaaaggagaaauuauagguucuccucccagcuuuuccaauaacuugccuugaggacuuggaccaagcccugacuuucucugauguauaaaguuguaaaggaagaugaaauacugugcacgaaagugcuuugaaaaauugaaagcaguaaacugcucuaggauauuuauuguuaguguggugguucugguuauuauaaaugaagcagaacuuuaaauauuaaugguacucuuguucaucaauggggaaguuauaggggaaagguuuuccaaaaaaugcugagcuauaacugccauccaaguaagugacgcagaaugccuaacccaauuuguaucuugcuaucaccugaucacagaaagcuguuucacuguagagguaacaguuguuuucuccucuguccugaggccaaugauuauauaauauguaucaaaucacuagggugcauaucaaagugagcauaaagaggcaaauauuucccuuuacaaugaccauauaagagauuauuucugucaggggauaaggcauacaugaagucugacuguuucacugcauuuuuacuauagaaaucacugagcuugagacuuguacauuaacuccaucuggucaugugacuggcaagugaaguguuucaauguguuaagaggacugaucugcauauuucuugcugaaucuuaaucuguacuugcauauuugugaaacgaaugaguauuuaaauuauggagaaaagauguauugugccaaacuaaccuuuauagcauaccugugguuguaguuucucuagcuaacaguggacaagaugaaaacucauuauacauuuucaucauguuagguauucuucucaaagucacaggagcacugcagaaugguucguaacuuuaugaauucagcuggcauuuuggauauauggacggccccuuugaggggcuaaagacacagccauccauuucaccaagagucgccgagggugccuuauugccccuaccccgugcuggguacugagggugggauagaaggcaaaccagacacaucccuuguguuuaugcagcuuuuucuucagugggcaagacauuacuugagaauccuaaaaauauaaaauuacgucuaugacaaguccaaugaaggagaaggacaagacacuugauugaggaggacauuuauugcuagucaggggggacaaggaaagcugacccaaggaaaugaugauucagcugaguugauagaggagugaaauagucauaguaggaaaguggaguggugggaguugggaggaaaguacuguauuugaagaaccacguguucaaguucugcagcagaagggccaaugaaguacuugaguguugucaaaggcaaucaagguaacuggaagagagaacacgagggcgugaggguauguuaucaggaugaccuugauguucacaauuaagaaaguugcucuaauccugacaucaauaggaagacugaaguaucugaaggagggaguuugcaugucuguucacaaagaccucuuaagcaauacacuguacacuauuaauaugccagugguucuuggggcgcugucuccaaccugugguugucucacuacuguauacucuacuccuuccccagugugugcuaucugugugauuugugugggaucacuacaucccugguggacuacugugacuggacuaaaacaaucaagguaauccuaucccucucaucacggugauuaauucgggucauccaggccuaagcaaauccaugcaugguauuuuuuggcuuuagggauuguuccaugauggucccaaucaggacaaaguucagcaggaauuuugcucuuuuauagacugaacuugcugccauugaaagucaaugaggaagcaaguagaucuggaauccuaugaccaugagagaagccugcuuuagggugaaguugacauggaagugucagaggugagggguacaaagaaccauuuuguccuugcuaauauaguagauccacuguaucucagauugcaccugauaccuguugaaguuuucaggcuuuucucaccccuaggcccuucuccaauccugaugcuagcuguugacaacagucauuauuaaauaaauaucagaaaccucaucugaauucaaggaaucucccagcucuuucuaaacccauacuugcucauuguaacuguagcucaggccaagauggaauagacuaccuuggugaggacagguguaugaagaaucacugauuuaaagauuguucauaacguaucgcagucauuaggcauaagucuauuucuugagacauuguaagggauuauucuuggaaggacauagguccaaaauguugaauuggacgucuaggagucagggugguaaaaaugaaguauauauugauuaaguggagaguuacaugaguagagaagcaaaaugaagccgaguagaaaauuaaagguuuugggaggaguacugccugaauuuagauguuuuuaaaguacagcuuucugucuucaugggaauaucuuuucgauauacugagaaaaagaaauccagguguucuucacuuuuguaagcauccugguuuuucgugcagggagcacagacaacaggauuucuugccaaucaguuaccauugugaggccugauuuuucaucuguaaaaugaggauaauacagucuaccugaguaauggcugugaaaguuaaaugaagcaauuugaguacaaauaccucacaaugaaugauuguuuucauugauguggugguaaauguuuaauaaccucuuuuucaaagaauaaaagccguuauuggucauuuuugccaauuuccaugguguaaauacuuccaacauugugccaguuccgaguuaccaguguguuacaaaauugaaauggaguuagagaaauacacauauaaugccggagagcucaccaggaugccacugcuuucuuuccuucuuuccaaauuacauacaucccagauuuuuuuuuuuuuuuuuuuuuuuuuugagauggagucuugcucuguugcccagguuggagugcaguggcacagucuuggcucacugcagccuccgccuuccauguucaagugauucuccugccucagccucccaaguagcuaggauuacaggugccugccaccacgcccagcaauuuuuuguauuuuuaguagagacagaguuuuaccauauugccuaggcuggucucaaacuccuggccucaagugauacacccuccucagccucccgaaguguugggauuacaggcgugagccacugcacccggcccauaagccaccacgccuggccuaugccagauuuuguacaaaguaaaaucaauccuugucccccaccacugugauacuaggguuuguuugauuuuagugacaucuguauuaggguugacacagaauuaauaacugaaucaauaaagagaccgggaacagggccacgccuuacacaaggugacaugaaaaauguugagguguagcaguuuauucccuuagguuaaucaugaaccuuucuguuaggccccuuugaaauuuaguaucacucuguccuaaaucaccaguaccuugcaaguguugauucuagcccauauaacucaccuuucucaaaaauucugcuauguuuguuuuaguaaccaaauacuguauuuuauuuucguaagauuuucuucccaaucuagauuauauauuucagagagaaagcguccuauuuuauguacauuuuguauccuuuuggugucaaauaucaugcuaugaccauaacaguaaguguaauacacauaauauccuccccccgcccccccgcuuuuuuuuuuuuuuuuuuuuggaguuccuacuguguuccagguuccaugguaacauuuuccuuguuaucuguaaucaucacaacaguacuggaggguaaauacggucauucccauuuuacagaugaggauacauucaaugugagauguuaaagauguucuucagaauuucccagguagcaggcagcucaugguauucaaaagguaaugguuaagagaaagaauggauaaugaauaucuugugucuauuuucuugagacagacgagacugagcagccugagaacauuuggugcucagagggaggaaaugcuaagaggggaaaacaagucugaaagggaaagaaggauaguucaaagaccaguuuccccugcuucagaauucugacuggugccagcucuaacugcguauguuugcuuuacuuggaagauagaaucauagugccagaauucacggaagucuguuuuggaagaugcauuagucaggguaugcuaauugcuggaacaaacaauccccaaacuucaguagcuuaacacugcagaggguuauuacccuccggugucacagagcaacgugggugggcucugguccuagccuggcuucuuccauggcucaggucugcuauccccuaggaccuuggaguucacuagauauuggcaucaggcugaucaaagaggaaaaggagaguggugcauagacgauuacaugggaaauuuuaagggccaggucuggacaaggcaaguauuacuucugcucacauuuuauuggccaaauccuagucauaugaucccaugacugcaaaggaagauggggaauuucagauuccuagguggucacgggcagaaagagauggggauuggugaaaacauagccuggcuuuagccacagaggguuacaccagaggccugcaaguuuggugaccacuaguuuucagagguauuggguauuugauaaaauccagugucuuccagagguugagcaugagccacauauaaauaacuuucccagugacgggccaucagcaguccaaugaagacauugggucuucaugucuucauuggacugcugauggccugucauuggggaaguuauuuaccuucucugaggagaaaauaauaacuugcauuucagagugguuugggacacuaaaggaaaucagaagauggaacugauuuguuaacuagaaauggacauaaguauugguuacagguuuaaaaugaaacuugcaauguuugaggaagaaagggaaaauguuaaugcaaaaacaaaaaagguaaagaaauggugggaaguagauuauuggcacuuuuucuuuggaaacccauugccauauuucauguaauuaaacuucauuccuuuuaaugaaacaauucuucuaaauaauacagagauuucccaccaauauaauauuuaacauuuauaauuuucaccuuaaaguuugaacauuuuuaauuuuaaaacuguuuguugcaguuuaaaucuccuuaugccacagaacuguggacuuucucugguugcaaaauucuuuacagugucuugaauugaaaagggcuuaaguaaaaaaagcugggggaagugggggccuuuuacaaacaaauuacaacucauuugguacaauaaggauaauucauuuugucuuguuuugcauggcuguauauuguuuugaauucauucugcauuucggaagcuugcaguauuucuuuucuguagguuucuuacuuguaacugcagauuucgcgguuucuuuuguguaccacuugccucccagaauuuggcccaacaguuuugaguagcugaacaauuuaucggggacagaucagcugaaauguggcucaacuugaguaaagcagaaggaaugacauaagguuaggugacugaugugugaguuuuugaauuugauuugguuuuacauggaaagguugaagcaaugauccauguauucuaauaaaaaucaucaguacaaaucaaauaaaaucuggcuuaguggcuauuuucccacuguaucacucauggcuagccugugcuguuacagaccacauuuggcaggcacggcuuuuuccuacaacaaaucuuaaaguaacauugcaaucuuugcuguguuaaaaaggcaucuuuucuaaucaaacugucugcuaaucucaucagauaaaucauuauucucuacugacagcuccggcuuucccggaaccccuucccugcuucuuguuuucucucaagaugucugguuaucgucauucuucaggucuuugccucuaucuccuuucacacuaaugacauaucuuccauuccugaggaagaguuacagcuuuuuaccauuccacuuacugaauugguaagaccaguaccucagagcagcucaucucuuucugaccgguauuccacuaguuaucagaugggcaaaaggcaggaugcauccaaguugcagaccuacuagaaccaaaaaugccuauucccaggaauuugaugugauuaaaccuaagaaaucaucaguugaugcguucucaucucuuucagcuggacuaguaaaguaaggcagauguauuuucacuacuucaguagugaacauguuuuauagaaccugaaagugaaaguaagggaagcagcaugguuuagaggaaaccuugguccauuuuuccgucauagaccuguccugcuagcaaaguccugggcguuucuuaaacugauggcaacugcgugugcccugguggugaaaugguguugcaguaugccugggcacugcccugugaaaaaggacacacagaggggagacucacaguuuuguuuucauugcugacaugguuuaaaaauguacguugcuagcugugaaaacucagucauuauaacaccguacaccuuucuucuuucagcaaguauuccuugugaacauuagcaaguauucuauucucuguuagaauuaaacagguaaucguaauagcaugaaagggugaaaguaugucuuaugcaaaauagccucuuuuauauagggcaucuaccaauuuucuugugauuuuuguuuuuuccucuuuugaaaaaugauuuuagucugcucguguuuagguagguaacuucucuugaucccaauuuuauacuuuaaaugaucccagauauugcauuuuaaaugagaugaguauauaaaaaauaggaagcagaaagcauaauuaaaaauugugguuacauuaucgugagaccaaaugaccagucagacuccucugaccaauuucauagaaaauaaggagguaucauuugaacaaguuguaacauaugggaacuguuuuaaacaccaucauugauaucaagaaacuauuaggaaaugcaaguuuguguaucguguguguguguaugcugauuuuacacacacaggcacaugcacacacaugcacacacacauuuauaagcccaaguaagagaaaccuuugccaaugucugccaggcauuuggcugaaguggaauugugaggaacauuuucucagccuuuauaaaucacaguugaaauaugucagcacuguucaguuuauaaaaugacaagggcuguaggcugggcaugguggcucacgccuauaaucccagcauuuugggaggcugaggugggaggauugccugagcccaggagucggagaucaaccugagcaacauagugagacccugucucuacaaaaaauucacugggugugguggugugugccuguggucccagcuacucaggagggugaggugggaggauugcuugagucugggagguugagguugcagcgagcccugaucgcaccacugcacuacauauacccuagaugaagagcaggaccccaucucaaaaaaaaacaaaaacaaaaaacaaaaaacaaaaaaacaacgagggcuucaucuaaagguuaaagggacuguuucuaccuuauauugauuauaacaaguuaacucacucaauauuguaugguaugcuuaugcuguauugaauggcaaaguuccucucacagucuuuuuuggggucacccuucacucuucacuuugugagguggcuaguucauuuguauaccugcucucuaaaugugggaauauauucuuuuaaaaguggcaacucaacuuaucucccccuucuaaaauauuuuagauguuuccaauuuuuuuuuuuguacgucagcccauggaaaccacacuaaauuuuucugugucaugaguaugcuugucucugcauuugaauuuaauugggaagugccucugaaauggcaggucuccuuuuuacacagugguuuacagaauguggugggaggaggcaccaaauagccuguuaggauagcauggcuccaaaacugauucuuuaacuugccuuuauacauugcauuaauucacaaguggaucaguccaucuugucuucaucuuggccaaauuccuucaaaauuaauaguaaaauaugccuaaauauauucuuguuccugcccuccccacucccaccuaggucacagggcuacaacuaaucauugucuccauugaaaugucacuagaugaucaacgauugaagaauauuucuuaccaauucaaauagaacagaaacuucagucaaguuuagcauuuauugcccuacauuucugcggcugucaaaaccaguugaucagagacgugaagauauguaaggaaauaggaagcugugauggguuaucgcuugucuaagagugguacaagugagacuugagggcauuaucacuuuuuaccuuauacauuuuuguauuuuaauuuuuuucaauaagcacauacuuaaaaauuaguuugaauguucuuaacgaaucuuuccauagguuacugauuaguucaacagggacaaauuauaaucauacauugcagaauuugcaugccacuuugaccaggugaucaaaauuggcauagcacaugaggggcagaccaacaugccaucaaggggcucuggaagugauguccugggaaggacaccagaccacuauuguaguauuauauccacuggaauauaaucaugaggaagcaucugauccucccaaauugagaaacauuuccauaaaauaacuggccuguauucuuccaaaauucuaauaucacagaaggaaaaggcugaggaauuaugucugauucaaauggauaaaagagauagacaauucagugcagugcaugauccuggacuuugucuucuaccggagagggaggaaguucccuauuggaauauggauuauggauuggaucuaaguacccacaguauauuuucugauuuugauaauaguacuguuuuuguucuuaggaagugcacacagaaguacuaaggugcaaaaggauauaauugaugcaacuuacacaugguucagaagcaacauauuauauaauuauaacugcacuguaauugaaaacuuuuaaaauuagccugguguggcagucccagcuacuugggaggcugaauugggaggaucuccuaagccuaggagguugcggcuguggugagcuguguuugugccacuggacuccagccugugugacagaacgagacccugucucaaaaacaaacaaacaaaacaaacaaaaaccccaaaacuuaaaaaaaauaaaaauguaaaauaugggaagaaugaaaaaauuauacauuuuccuugacuucaacccuugaucuuuucuugaucaguucccaggugggguuaggauaucuguguuuuuuaugagguuccuuggaguauuuggguggucagccaccauuuggagaucaccauguagugccuagauuauaaauuauccuuuuagaaagaguugcuggaaucauuucaagauuggucagguaccaauaaauaaguaauagaaacacccucaaaauuggaauugaaagaguggaaauuuauuuuauuuaguuuggggauaugaacaugguauaauauugucgcauuuuuucuggaguuuagaugaauaagagcagccuacaguugaccggaugacuuaauauuuuuuucguaccacaaaaauuaaaugcuuuacuaaaacuuucauucucuuacaauucugaugaacaagguuguacuguaugguuaaguaucacacuguaaauuuaggcaauacauguccuauugagcccauggaguaaaauagauuuucccgugauccaagcuauuacaauuucagauguguaaaguauuucaaauucauuuuaauagacugcuucccuucaaauacauguggagguagauuuauacaacuguaaacaguuuaugcauuuuuacagauuuucauuauauguguuugauacuaauuuaccucuuuuuaauuguaggagagauaaagaauuaguaguuuaaaacaguaggaacugcguguucugcugugaucaaggaauuagauaaucuggcuuguuugcuuaaggggucuguaucuugagacuuuuauagggcaguauuaaagcucugagccuccuuauuaugccaguacccagaagauugcuuuaaugagaaguaaagggccuuuuuccaauuacaagggaauaacugcauuaaguuccuguguuaugucaaccugcuuugauuugauuacuaugaaagaaauggauuuaucugucaguguuacuuaauuaagccuucucauugauguuuugcagaguaauauagugugguuugcacauuugagccuaaguacagagaaaauuggccuaaaacuaagacaugaccccugaagauaacaugcaagauugaucauuugucauugccaggucauaggcugcaguguuaaacauagguggaaggauugccauguugaaaggguaaaaugaaaaucaguuuaugggagugaguauuuuaagcaaaagggguugugguggaaaacuggauuuuagggaggaguuuugaauauguaaaacuauugacuucaccaauauuagucaagcaucuggaauaggaaaugacaauaaaacaaacaggagaaguagauuuuguuaaaguauaaaaggaaauagaagaaaaaggagaaagcaagaggaaagaaugccguuugggagaaguagaccauugugguuaggcagagcaauuacagccuacagauauuucaauuaagccagccuccccuucucagaaccucacaaauggcacccucgggagaaaagagguaucaggaaagaaaagaagaaaagaggaaacaguuccauguuucauguuggcuaaccucucccaagaauaaauucaauaaauuauuuaccaaauaggcauuuuaaauaccaguuuguauaucugaagucauuacaauauuauggauuuugcacuauaaauauuacauguaugguuugaaaaauacacacguaauuacauguagacauuaucagagguauauauucaguuuuauuaggaaaugaagcauauucuuaaauguauuccuuaguuguuuaacacuuuguuuucuaaaguaucuaccuuuuauuucuugcacucugugauauaucuuuagaaggugauaugucuuuaggaggugccaaacaccuacuuaaaaacuuccuugcaauauuuucacauuuauuuaaguacuuugaaacuuaucuguguaauguugaaguuagaugguacuuugauuuuuuuuucaaagucuucagauaugguaacuuacuuccaauuguuauucucacgcaauucacaauguuuacucuccaagaaaacugucuuaguuaagacugauuuuuaagugcuuuuagauuggucacauuucgaaaagucaaagaagguauauauaguucacguuauacucuugcuugaguuauucauggcucuuauuuguaggauauugcuuuaaaagguaggauccccaaacgacuaacuucucuucaagaggaagaccccagcuagccagucccauacacuugaaagguugcuaaauggcacucaucucucagcauuucacauuauauauucaagcuaggguauaauucaaguuagaugaucguugacaccuccaaauauauaaauuaauauaaaggcuucaauguacguuugguucaguugcauaauguaacuguuuaccaccuugagcuucaaaaagauuucugaguuucaauauaaggaacaccacugacauauuuguaacauaacaguuacccacuucauuuuguuacuuucucauuaucugaauuuuauguuauaggaagaugcuuucccuguuuaugacagcacacaauggaauuaacuccauaucuuaagcagcagaaauguaguguucauuuuugaaaaacagguuauuuugaacuuaaggaaaauaauacuguuuuaaaggacuuauuaauggaaguuuaaguuggauguuaauuaaggcuaaaauauugcaguaauugucugcgaacacuuuuuuccuacuauacuuucucaccagcauaucuacccuuuaacuuuucuuaucauaugaaaaauacucuaagaugaucucaugcuugaccuuugaguuucagauuuauuugguuaggaaauccauuagcucugagaaagccaggguugacagcagucaucugaaaauggaaagcccaggucuguauucuuuauauuugacuuaucuuuuuuuuuuuuuuuugagacagagucuugcucagucaccgaggcuggagugcaguggcacaaucuuggaucacugcagccuccaucuucuggguucaugugauucuagugccucagccucuugaguagcugggacuacaagugugcaccaccaugcccagcuaauuuuuguguuuuuaguagagauggguuuuaccauguugcccaggcugaucucgaacucuuggccucacuuuuucuagucugauaguuuugauugcuguccacauaagcaaaguagagcuuugaguaaucaaaucauaauccaccugccucggcuucccaaagugcugggauuauaggcgugagccaucgcaccuggccugacacaucuuaacauuugugugggaagcauugacacaacccucauccuuugcuuagucagauuugggaagugcuggaagcuucuugucgaguuucuuguuagugcccagaucacucauucugaagcaccauuucuuaugucuaauagaaaacagaaacaaucaugcuuguguggacaucaucugucaauauuugaaucuccucaacucuuccuaugucuguaauaguacucaaauuugacuucaaauuacucuacuuagagcucuuauuauacugggugcuaaugaaaaugugcacauccuuaacacgcucuuugcugaugaaauauuuugaacucuaaauucaucuggcacugacggagagcauaugccaucucaguuugugugagggcucagccaaggguucuuccuggacuaggaaauuaguaggagccacagauguacgcagucugugagucuccauaaugguguagaggauauuuaauagugucuguuguugcaggaagaagguuuugaggcaguguagacuucauuguguuucagaaugauuaucuuuccuggaagaacuugacauccuaucucugaacgcauucugaauguguugaaauuuuuauuaagaaaucaauauauuuccacaagagcaggaaucuguagacuuagagcaaugcaaaauaccauuucaggcauuuuucuaauuucauaaaacucuaggguccugggugauuggcauguuguaggcucagaguauagaaaggacaacuacacagcucuacgucaaaucaaucuagguaacuuucauacuuguuuauuucaaaucaagcugaaaguuacaugguauuuagucuguguucuuagcuugggacucugaucagcauacauaacuucugacaacaugucauuuguguauuacacauagaaguacacugagauauaaagagaauacucuaaugguaaacuaagccacugaauaaaucuaaugcuuacugaauucuuacucugauaguguuauacagggucacggagaagguaggauuguuuaaccuaaacguuuuggguguuucuaagauccaggagaguauuuaaaaaucacugaccuguuuagcagaacaaggagucauaaaaauguaaggcucagauuuucuuagauauuggaggguauuauuaaauuaggcacucaugauaaauacuggugacuaugguagauauuuacuacggaucaaguacuuuccuaaguguuuaacaaauguuaguuaauucauuuacuuuaacaauaacuccuuaaucuugcaaauacuaucauccccuuaucuucuguuagaauacugacuuugggguaugucuuggguuuucacuucuguucuccuugacucaagaggccauuacauuuucaaggcugacagauguccccagggcaaaaaauguguuuucuucuucccuggguuccagccuucacuuugauuuuggcucccugauuccuuguuaucuugucugcucaguauuuuaaaauuuuucaaaaaacuguuauccaucauuuuuaguuuucugugggagaguuguccaaauauacuagccugcccuauuuccaagaauggaaaucaaacuugcuuauuucguaguucacaaaaaugaguacggagaggccagugacuugcucagaccagagaacuggucacugcagagucccugcugaaauccagcucuuuaucccaacucccagugcuguguuuucuaaaguuugucuagucugucugauaguuuugaucuugcugaccacaagagcaaaguggagcuuugaguaaucggauuacaaguguaaugaauguggaugggaaaucgcagaagguaagaauuaugucugaacaucuuuccccuaaauagaguguuuggucauaguucugcccaaacuguuguguuuuggcacugaucugucaaauacuuuauuuauuauuuuuuuuuuugagacagucucgcucugucacccaggcuggaguacaguggcucgaucuuggcucgcggcaaccuccaccuccuggguucaagcaguucuccugccucagccuccugaguagcugggauuacaggcguccaccaccaggcccagcuaauuuuuguauguucaguagagauggggucucaccauuuuggccaggcuggcuucaaacuccugaccucagcugaucugcccgccucggcaucucaaagugcugggauuacaggcaugagccauugcacccgaccaaugugucagacacuguagaggggacucaugcagaaugaaucaaauaagaugaaaauuuguggauuuucagauugccuccuaaagcagccagcaaucccauggaagaguuacuaaaucuaucuugguuuaggguaaaauaagaaauuagaaaaaucuugaacugagcccauuucagucuuuuggaacaggaauuucuaucaucuacuugcuuucuuccuuucuuuuugcccgggguaauaucuuucucuuuauucucccaucuuggaaaaaggguggcaauagaacaaggggggggggggcgagaacuaaauagauucagcagcuucaucccaggcaguuuuucauuugucacuauguugccuuaauggauuucacacaucuauuuccuguauauuguuuagucucaccucuagauguaaacacuucucauaccacaauauuaucuuacuuuucacuuucugcuguuuuaacucauuucaauaaagaacuaaugagcccaccauuguacaguaccacacaagauguuauuugugucaaguauguuucuuuccuauaauaaacguacaucacaguuggguaugauauaaguauauagcucuauagcuguauauauauucacaugguuauuuggauaauaaauucuguguacuugcugaacuaucguauugagccagccauacaaguuuuaucauugugccuacuguugauacuaugggcugcuaugggauauucuguccucuguguugggagcucacagauauuuucugucuggcuuaauaccaggauuagguaugcuucuccuggacacuuuguguguuuuuaucugaugguuauugucaaucuuguuucccucucugcuuugucuacuuaauagcuucuaaaguuuugacccacuucuagcaaauagccaguccuucacugugugcauuuugauaaacucaucauaccucuggccuuacuguucugcuacuuuuauuuugcagucacuuggguccuucaaauauugauuucguauauuuuguguuguauguguuucuguaaucuuuuguggacacaagaguuggguauaaacucccaaauaaauauauucacucugcguggggagaagugacaggagggaacguucagcugguuagacagagaugugacauucuuacuggggagucuuuacagcagugggcagagcuucagccuccuuuuguguccaagcucugccauuuccugaucccuugggcaaguuuucuaacccaucugagccucaguucagauauauaaaaccagaauacuaguaaggcauuugagaguuuagcgcagugucugacauacauucaagcucaccacaugugagcuguuacucuuucuuugagaggugaggaacaguuuaggcagaaggaauagcaguuacaaaaacauggugguauaaaagaccgugcaguguccugguacccuagcaggaguaaggaauggccagguguaggcccugugcaagguuuacaugaaaaugagucuggacaagaacuucuuggaugcucaugugauggagguguauagugaaugcugcugaaaccagcaacccagacagcaauuuuaagauauggagugagagaggcugcuguuggugguguggggcaugcauuugucuuguguuacaguggaguaguccugugguucucaaacuccugugugcauaaaaguuaccuggggaccuguuaaaaacaguuuucucagccccacccccagaguuucagacugaguagauaugagacggacccuaauaagccaauuuaaaaaugggcauacaggugauucagguggcggauacacuuugaaaugcacuugguggugcacuggaauaguuauugaggaaaugcuaacuaaggggcaggccugacaaaguucaaggagagggaagauggaagaaaaugacuucaaaguaacauguuuacauucauuaugaauuaccauugcgcaugcuauggaaacacuaguuuauagugucuucuauggauauggauaaaugagcaccgguccuauagauuuuuuucaaagguaaaauauaauuagaauucauaugauuauucuauuuauuagguuugggagagcuagugauuuguccucauccuugagauccagcaggagaccaagggaaggggaagccuguucaacagagagcaaucaaagaaagaaaggugcagcagcgugaggucaggaagugggaaagauggaaaugggaaaggguggaaaaagagcagucagauccgauuggucaggaaucuauuugugaaggaacccagccaguauuuaaccugcuuugaaaaagcuagacuuccagcauuuuuaauuaguggauugcucgcuuuugaaauugcccaguugggaauacucaaguguugauguguuuuaucugccugcuaauuagcaggcugcuugguugaccauuacuuuuccuuuuuucuguggacagaagauguauaugaaggucucuugguacauuccagcucaagucuagcuuaaagugcauaagaaaaacuguguauuuaauaagaguucuuacuaaauuauaaaucaaauuuuaauacaucuuuucuccaacuugauuccuuuugcucuagcacagggcuucucaaucucaacacaauuuuuauuuggggucagaacaccaaaaauauauauauauauuuuuagggacagggucucacucaguugccuagguuggagugcaguggcacaaucguaguucacuguaaccuugaacuccugggcucaagggaucuuccugccucggccccuccaauuagcuaggacuacaggcaaguuccaccacacuuggcuaauuuuaaaaauuuuuguagcgacagaaucuugccguguuucccaggcuggucucaaacuccuggccucaagcaauccuucugcuucagccucccaacgugcugguaucacaggugugagcugcugugcccugcacaggguauuucuuacuguggagagcuguuuugugcaauuaugagauauuuaauagcaacucuuggccucugugugaucaaugccacuagcaacacccaaauugugacaaccaaaacugucuccuggguggcuuugccaaauguccuuugggaugcaaaagccccacugaccuggcaguagcguccucuuuccuccaagucucugccuacuuuucauguuuaaaauccucuuuuaaaauugaaaagauaaaaugaguccaaacaauuugaaaucuuaugguacuuauagggauucaaaucuguuccuccauuacuuuuuggccaaauucaagaggagaaaucucucaaaugaauccaagcuggcuguuauaggugaaaagaaagucaagaugcgccagacuuuuaaaagcuugcagugguugagagauuuuguuauuuauacacuuuuuauuuuggcugaaaauauuugguuuuuguuuaagaauuaagagaaccguguaggcuacaaaauuuauuuaugugcgaaucccagaggguuguaaguagcuucuuugugugcuucaguucaacauauacaggauaggccagcauguuggauuguuaaacagcagaucuggggaagguuuuacaccuuuucucuaggcuuggugcagucccgagagcuuucuugacaugccuugaagcucacagugcacugauuuaaacuguccauaggggacaucuguuugcaguuuguguuaucugcugaagcaccaacuaaaaggaagugaaauaauauuugucauuaaaaaaaaaaagagaaguuaauuuaaugguaauaacuuaguuguuguugcuuuucuaucucuuaagauauucugaaacaccauguacucuacuguaucccaaaauaaauaaauuaauuauacuaugauuacuucugcugauaauaaaauagcaguaauaauaaaaggaaugacaguagagcauuaagagaauaaacaguaucacugaaaugugaggaaacacaauaaaugggauugugucuccugaaccuuaguuucacacuuccuccuccacuucugucagaggguguuugugauggccgucuguuaucagccgugaucaaaauaauauaacagugaaacuuuuuauacuuaugaaggcccuuucaucaaaaaucucacagccauuucuaaauauagagcaacugaucuuuaaaacacuuuuauguuuuaagcaauuaauaugguaacuuagcuguuagacuuuccauccugcguauuugccauuuggagcguggauggaacauuucguaaucuacucagcauuaaaacuuugcugguauugaguuuagaauuccaacuuuucgaugguucauguaggucuuuucacugucaucuaucaaaacaaaacauugcuuuauaauggaauaaccacauucauuuccacauaucaaaacccagauuaaggauuauagaccaaaugguaugucuaguuuaaaaaaaaaaggaaagacagagacaguauugucuuaaccuaaaaaaaaguuuuguuucaguccuaauaucccuguaaugugcugguggaaauagacuacugaauacuuucucagucucauuuucuguugcaugucuggugucuucugugauaagccugggcuauggaacaaaaaggauccaagagcauuauggcgaggaugcuaaagguguuaguguggauauuuaccuuaauuuaacuuuuuuugcauuaaaguuauguuagugcauuuuuaaacuuauuuuauccaaaagauuguaauaaaacuuuaaguacaguuucacaucuauaaagacugaggcuaucaaacacugugaaggauggaaguaauuuuuauguuuauaccucugguuccugaggguccaguucauuucuacugugaauuuaaaugaguuaauuuaaguagaugggucagaagccacuaucaucaugguagcccggugccugguucuuaauuaaaggcaacaggagauuaauuugaaacauuaauuugaaagugcauauacaaaaagaaaaaauuacugcaagaaagccuaaagaacuuuucucuugucccuagauguagaagacagaaguagcucaggguccugggggaauggaggacauccaagcccguccaggguaaguauaucuaaucuuuucucccacaaccagacaucccacauauguaaauugacaaacagaagguguguuucucucucucucucucucucucucucacacacacacacacacacacacacacacagaggcaugggcaugcacacgcacacaaacacacacgcauauaugugcauacuaaguuuaaugaggaucagcuugacuuuggaauuuuuuucccccauucucuuauuggaugcuguuauucaauuugacaccuguuccacuucugcuaaccagaagaaaauuccuucguuacauguuuggucuuucuuuugucaguuauugauccauauuacauaaugcuguuuguuguagauggaaaaacuuaaaaaaauuccuaauaucccuauaagguauuggugugaauagacuacugaauaaucccaaagauacacuaugaaguucuauccuaccaguauaaucuacguacugaaucugaguugauuucgcuauguagacauguuaucauuccaccaguagggacuuugaucacuagauggaucauucauuuauuugcccucaacuuuuugcuauucuucuccacaguuuuccuacaugcauugguuguuucuuggggaagacccaaggaauauaauguaauaggaauguaauaggaagaccauggaauaagaguugggugggugguuaagcaauacguguuucuuguauguauaugaucuugggcaugucauuucaccucuuggguccucauuuucuuauuuugcaaaaugaggaaguagauccagaggaucaucuguguuucuuccaguuuaaauauucaugauuuuguaugaaauuucuuuaacugaaucauugcuaggcccucuaaaauccaugucaguuuuuaugauguacauacaaugccccagauuaaaaguacacuucguguacaugguaaaaccagcaugucuuccuuucccaaccagcuauauauauauagaugaagcauucugcagggaggguaacauuuuacuguaaguguucacacaaauuuggguugggggaagguuccauuuuggcauaagaggcagggaagguaaucaagcugucaaaaugagggcauuucagcaagucagagcuagacauuuccaccuguccuuggcauugugauccuuagucuaguguucaggguacagcaggaucucuaagcuuaccaguaacuuugugagcccuuacaccagcugucgagcuugacauucuaaugcuuuauauggauggguugaggaaaucuuuccuccuccucauguuacagucugcacuugcagaaauaaauccauuccccuugacagcaaguggagaucauagaacuccccucaauuguuuaguucauccagauuuucacaauuucuuaugauuuauccauucaguacacaugguacuuuuaauuguguuucagaaaacaaggucuguuuagaaucaucuuaauuuaggauuaaaacuaacuagcuuuugguuuuuguuagcuguccugccauuuuucucaaggaauauauuggugaauaauuucaaaccaauuuuguguaauuuauauuuucuaaauccagaaguuugcaugagacaaaucauuuguggcagauuuauacccaggcguacuuucaaggucucucuuuuuucaucuuaacauggggauagugucuaccuuacagcacugugcugaggauuaaauuagauaauauauauuaagcuuuuaguacacuaucuaggaugaggacacuuaauaagugauaauuagcauuaugcaaugccugguauagagugagugaguguacuaugauggguauuuaaaauguagccucuuuuuauagauggacauguuggcagaauuagauuacaguaucaggcaaguuaauuguuauacacgaggaaaggugauugagaacgggguaguuuuccuuaagguugaggggaugugucuuuuccuuguucaugcagcagcccucucuuuugugugggcagauuuugcccuuuggcucacaugcaaccgauaccucugaguaaauuugacuuagacuuucaugggcaguuccaccagcugagcagaaugacuuuuuccccccuuuuuggucacuuuaugcacuuuaguagacugaaaguugaaccauguaguauagaugauuuuaacucuuuccuauugcguuaucaaauuuccccauuaaaauuaaguaacuggacagcuuaagaacauuguuuuaauuuuaaauuccccuuaaaacaauaagcugauuguaauaaugaaauauuucugucaaaauuugucugccuuacaacugguuguuuuuugugacaugcuuuguccaacuccagaaaugcuaauuuaugcuaauguuuugauguucauauccuaguuaaacccuaauauucuuaacuuucuuauguguuaauuacuuaugugacaaucuaguucucuuacaaccacaauaccacaauaguaacuauaauaaaacauugaaacuucaguauccuaacaccaaauguuauuguuugaauggcucuaucuuggucuuugaaaagcaauucauugcaugcuaugccuaauuuucccuuguggcacaauuuugcuuuaauguggccuuauuaaaauaauaauuuuuaacauaagcaauauacuuuguaugugucuggugucuuacauacacuauuuuauuuaaucaugucaacaacuccaugcaguugauaccauuauuauuauuccuaagauuucucagcuauuaugaggaaaauuuggacuucguagacucuagagcuuucuuuuagccacuauaccugugaaagugcagauuccuucuagugaaguuccagggagggaauaguggacuccaauuucuuuggaggggagaaguuuugguaguggagcuauguuuguuuaugugcuguuuauuaauauaaaauaauaacuuacacugucauuuuauuuacagaacuauggagaugggacucccuaugaccacaugaccagcagggaccuugggucacaugacaaucucucuccaccuuuugucaauuccagaauacaaaguaagacccauuuuaaauuaacuuacacuuuuugaaugcucaaguuuuacuauagaagguaaaaccauguccuagacagagguucugcuuuuagaaacuuggauauuuagucaguucacuuguaauaaucuuaaauugcagagaggauuggcagucuguguuugguaauagugcauuaaggauuaaguuuuacaagcauauggaaugaaaugcuuuuagugauacugaaucuauguggaaauuuuguuuuccuuagaccuaaagcacggaccacaguuucaauguuguaucaguaguuuccuaaguuaagguagaugaagucaaaguggugaauauuuagaauaaaaauaucacugggcuuguugguuggcagugauauauagucaguguuaacugugauuucugcuaaagggguuaugaaaauaaaugguguuaaugggcuuagugugcuuaaaucagaguagugcauucaaguugaauuguaaaaucugauuguauauuuaucaaggcaugaacuuuagugcuaauggccuaggcagaccccauccugcuuuauuaaagcaaguuaccuguuaguuugaggcugucugugaaucuccggcaugccauucauccuggcauccucagcauguuuuucugcuuuuggcuacccuguagggauguuuguuuaacagcaguaacuugagcaaugaaaagaugauuccuaauggcuuaaaaggucccaauagcuggcuacuuuaguuuugauugaaaaaaaaaaagaucuuuguucuaguaaacaugaguucuuaacaauauuaguaaaucucucaaccuggccaaauucucuugagaaucugucaauaagugaaguuaaauuucuugguacaaucuguuggacaacacuccaaggaaacacacacagcgaugauuauauuuuucugagaccauaacugcaaaugcuucuaaagaaugucaugauuuuaagcuuuggaagcuauaccaguuacuucagguccuugaaucucaggcauucuuugaaaaaucaccaucaaauccaucuaaauggauuucagauauuuaacacaaaauagucaaagcagauaaauacuagcaacuuauuuuuaauggguaacaucauauguucgugccuuugaguaucuuaccaacuuugagaaccacaaaguugguuuuggucauagaauguucuuauuuuugugcuauuuuugccuucaaaguaguaaauuucauauuuacguuuuaacauuguaacucaagcaggaaucccaguucuuuaucaguuguugauagaaaggugcauuguuucuuguucucaggauauguagauacaggugaccagauauauuuaucaacuuagauuuuaaaaggcagcuuuugacucuucagugucaauaguuaugauuuuauuucuaacacccuugcuucucuauucaucuccacacaaccacuuagaauaaaagauucacuugaaaauguagucuugagaaguagcaccuaaauaauauacuaacuuccuuggauccuaaaaugauccuccaaugagcuacaguaagaaaaauagaauaaauaaauacucauagggagacgcuuauguuaucuaugugaaaaaaguuuuaacucuaaagaacaacuugauaaauuaauauuacagaauacaccaagcaguacaaacagauuaaaugauuguucuguucauguuuccucaugggcaacugcuuuacaaaucaaauuaguuuuucaacccaaauaguauuuaaaauauaaguggccugacagucuagagcggagagagcugauucuuuucacuuaguuguuguuuaggcugcaaauccaugucagcuuugcucuuuuauccugucugcccuccuucccauuaaacucuuaaauauggagaccaagacagucuccugcauugugauaggaaaugcuacuauguccacgaggcccccacccacuguucccagugaaaggacuucucuguuagauaagcugucugguuugaaacauggcucuuuauuguuuacaaacugcuacauuuuccaccucgagcagauuuuugcacagaaaagaauugugcuugggcuaaaugguuuaucugacauuaacggcgcagugucagacuggggucagggaagucacccucagagcgagaggguauugcgcgguaugcaaaaaaaauggaaaagggagaaaaagacauugaaacaaguaugaaauaccuuacauuuuuaguuuagagaagaauaauuuuuuuaagagaauugacucuuaugcugcauuaaaaacuucccaucgcuauaauuucucacacacccgaugccuucuugauuggcuugcguaucugaaggcuagauucggggaacaaagauucucauugauuuugcccaagcugcuguuuauuuaaaaugaaaccacuuuucagaugagccauauuugguguuauguuacagcuuuacaaagaaaagauagaucauuuucaagaaauuaacgacaauuaauuuacaaaugauaauaaaaacaaaguaagaucuauugguguaggggacaguuugaacucauagcauauaugcuguguucuaaaccgcacuuuguguccagacccagagcccauguugugaccuuuguggauauuuuccuucuaccaaaagaagguaguagacuuuagcauaaguguuugacaacacuccagucuccacuuucagaauguuuaacugguuuuuguuaaaacuacaaaguauuuguuucugucucaaaggcuuaauucugcugugaugucgcaucaggguaaaagcuauagcaucagaaauaaaucagccacuuuauuggagcagauucucuauugucaaaucaaucaagccugugacugaauuaggcgucugcuacagaaauaagugacacuaauuuuauaggaaagaguuauuaacugcagaugaccugauuuuuuuuuuuccuuuuuuuggugaacuguucauuuaguaagguuuuauuuuauugcaaagaaagaaaaaaguacuggacuacucuuuccuuuugagaguggauuaucauuaauuauguauuuuguucuuuauggcaguauacaauuuuagggaaaugauaacaggcauugcuaguauauuuguuuauaaccucuaugguaaugaaacccauuauuacaacucugaacuucuugauuucacaugaaugguuuugcauuuuacagauuuuuaaacauaauacuucuauuuggcacugaaauuccaaaacuuaguucauuugugucucuauuucacauuuaugcaaagugggauauaaauuauaagaguaauaaaguguuuuagccuaggcaacauggugaaaccucaucucuaccaaaaauacaaaaacuuagccaggcgugguggcacacuucuguggucccaacuacuugggaggccaaggagggaggaucucuugagcucagggggcggagguugcagugggcugacaucaugccauugcaccccaaccugggcaauaagugagaucccaucucaaaaaaaaguaauaaaauguuuguuuuaauuuauucuuuuagaaauaaucuuguguguguggaaaaaugcacuauuugauaguuugugaaucccuaaaguaaauaaaacacccaugugugguuauacaugcaugcacacacauguacacccauacacacaauguauguaucaugcuagaagacuuaaugacguuucuugguuuauaagauuguucuguauuccugucugugguuauaguugucauacaggguuuuagugguugauacuuguaaguguuuuaaagaagaaccuaacuaacagaaacaaaaagcaagcuccuaaauuuuuuuuaaauaggugugaauagccuuuguguuuguuuugauguuggcaggguugagagaugucaguacugacugccuacauugaccaauucauauacuuuuaccugacauuuacuaagaacucacucguugcuuucauuguguagauacaugccagguugcauuuugccuuaguugaaauuccaugcauuguuuuauaucuggagaaaauaaaucauuucuuccuugugacugccuaucauuauuaaugauuauaauguacacuggaccuauuggagacuucuucauugcaguuuuuaaacaauuugaugaaaccuuccuaggugguccauuggauaccuuucagaguaugcuaaugguagaaagggucgaugagucuaauuccucuguuuuuuuaagaggguuauuuauaugcuauggaauaguuugagaauccuggcaagaaguguauggaaagaauauggacauuaaaaaaaacuuuuuuuuccuuugucaagcacuaaacuuuugcagguaauuguccagauauuuuuacaaugguagacaauauauuuucuagcuaaaacuguuugcuccaaggaaggagcuaagcauuccauuuuccuuuuauuauuccagagcaucgauugaaagcuagauugaggauaagugagcaaguugccccauaaaauuacauacaugcauuugugacugaagggugugaaaagcgauacuuuuguacauuuggcuacagcuuaguucagcaucggggcuaugcuuucacauggcccauuuugaaugguucaguuuccuuacugugguauuugguucuaguccuacucaugguacucucccagagcauuaaauaauuuaccgccauaggguagcuggguucuaaccuagcucagcagaacauuuuucugcuggauuagauugagguuucaggcagaacugaagaaagcugcuggcuuacaggaugaccuuugaaucucaucuggguuagcgguugauauuuugauuugguuacuguggucauauugugacagcugcuagcucauuauaauucgguuccaccgcuccguuugccuagcaggaauauuuagguuuguauuacuucagaguguuuauggcuacccugaguuuagcccagcauaaaggugaaguguugugaguguuuucaaaucccaguggcagaagcaggugccacagucuucuuguaaaacagcaaaugugaguacaugcuaauacagggaguuuuacucuucauuguaaaacagagaauaaccaaugaaucagcuuuuacuaggaaaaguguuuuuggaagccuuaauguacaaaggaaaagcaugacuacaaagaaacauaauuuuucaaagcacgaaugagauguuaccugacuucaugguuagauauuuuguucuuugcagaagugugaguauuagaaaauaguaaaaccuguacaauaauggcaaucauuugauguuugaaaguuccaaaggucaaauaaucuuuaguaacuucauaagaacggaacugugaauauagaugucagcucuagaaauuuuaguucacuuuuuaaaugcagcgaaauuagguagugauacaagcaggccccuuugcuaguucauuaguuagggacaucuuggugugcuucuuuuuuuuuuuuuuuuuuccaauaacaccuuucagcuugauguuaucucgacaucaacucuuaaguguuggacuuauaauguggcacaaguaauuucugagaaaggaaauuauuaauuguggucuuauuugauuuuacuuugggaauuuucauuucuuuaauguuaaauuuaaaaugcccuccugaaauauuaacaaguaugacucguuugagccucaucgcugguguuuuuagcaaucuugauuguugagcuaaggcugguagucaggagucaggagaacucaguuuuucuuucuucuacuucuuccuuucuucuucuacuucuccuucuucuuuuucuuuucuuuuuuuuuuuuuuuuuuuuuuuugagacagagucucucucuguugcccagacuggaguucaguaggaugaucucugaagccucaacuuccugggcucaggugagccucccaccuuagccugcugagcagcugggacgacagguguacaccaccacaucuggcuaauuuuuauauuuuuaguagagaugggguuuuaccauguuagccaggcuggucuugaacuccugaccugaagugaucugccugcuucagucucccaaagcccugggauuacaggcgugagccaccacgcccagccaagaauugaguuuucuauucuguuuugcuacagcugccuguggguccucuggucaggucguuuucacaucuuuagguugagggaggaacagcucuuuaggugaucucugagauaauuuuauuaucuaaugguccauugaucuuucugauaugucauuuuauccuuauacuauauuuucucuuuggagauguuuuauuguucuuucuaauccauucaucucuauuuuaugaauaccuucaagugacuuugccagugauguguuuuccaaauguaauucuuuaaagccuaacuaaaauagauauuccuuuuauaucucagcugauuccagaucuauagcuaaggaauuggauugguuggggauaaauaaaauaauaacucauuaaguugagucaccaggagaaaaguucugugcauagaucaguauuuagcauagagguuguaggaccucaauaaaugacugucgagugaaucagggaauuagauagauaggguuuaaacguugaaugaaaagcccauacauuaaaguuaggccuauaccuuacuguaccaagaagaagacccuaaaccagagccagucauauagaaauucacauuuuguucuauaggacuauauccuugacugggcaaaauauucugccaagauaggaaacgggccauauuacaguguggccuguuucaguuuucaguacaccacagauuauuuuauauauaagcggaaauaaguaaaaucaauaauauuuugggucgggcauagugccucaugccuguaauccuagcacuuugggaggccaagguggaaggauugcucgagcccaaguguuugagaccagccugggcaacauagcgagauccuguuucuacagauaauaaaaaaauuagcugggugugguuuuaugcacuaguggucccagacauucaggaggcugagguggaaggacuacuggaggcugggagguugaggucacuacagugagcugugauugugccacugcacuugcacuccagccugggugacagagagagaccccauugcuaauaauaauaauacuuauuacuauauuuauauuuuuguaauuauauaauaauaauaauuacuauuauuauuauaaauaauuugaaaggccauugaaaaaaguugcguuucugguauugagcuaagauaacugauuuccuuuuguccagucagaggacauuuccauucuucucucauuggucuuguuuccuuuccggccuacucugugauauagcacagcuaaugcugugguccucaaacacuuuuagaguccaacuagguuuacuaauccaagucguauaacauuuagaagaauuucuaaacagaaaaauguuacuugaaaacuauggccaacagagauguauagaccuucuaaauaccaggggaagauuucucacauagaaaguuauugacccaaagagaagauaaaucauuuaagcuucacauaaaaguaaaaagcaauuuguaucagguaggaaugcuuuugcuucgaaguaauggaaaaugugacuaaugauggcuuaagaauaauuuuucucauucuagaaaucuggugguaggucccugcuggaagugguuugcagcucagugaugucagggcugguggcucugugauucuuuuguccuuccccucauugucuaaagaugggggucacagcuucuugugucaaguucagguuugaugcagaaagaaggggaagggugaguugaguggugucuccccaccacacugcuuccccauaacccaggccaucuccagcugcagagguuggggcagggcugggaaugcagccugggaaauagacaggagagaagcaaguuugggacucauacugggcuuacuaacuugcaguguucaauucacacuuuaauuuuuuaaagagaaaaauauauaauuuucuauuuaauaauuuugaaaauuaagaacaaggccuuaacuuucauguaauaaaaauauauaaaaagaugucucagcucuaauuucuggucagcaaauuagagaggaagauggaguaggaaaaaagauacuguaaagaggaagauggagaaaguacaggcaugagcgucuugcaugggaaggagcgugaggucugcuguuugcaucucaccuucaaggccugugucuucauuguccuaagcccuugagcaaggcagcaaccagccaaagccagcucuccuuaccuuugcuuuccccaggaccuucucuuuuaggucucuggcuugacuuucugccagccuguccagggcacccuugucacgcaacaggccuguagcuccagccaccaaccacucuuuucuccaguccccuggguggucuuuggcagagccaaaggccaggcuuuacucccagugucuccugcugcacccauccagagcaggccuggcacccuggagcacgucccugggacaugcugcuacaagugacagacaaagaucuuucuccuggaccauugcccaaacaguuuccagggaacuuaccuccagcaaccugccaugucaccaugaaacagucagacaagaaugccuacugccuaggggagaaaacccucuauuuucuuuuaauauguacacaauugcaguuguugauuuuuaauguggaggauuaggugcagccaaaagacauuuaguuuuagacaacaugccaagacuggaugaaauggugagagcuggauccaacuuuuguccagaaguuucccaacccuauugaacagucucaugucaugaaucagacccauuggaacagaggcagggggaaggaccaucuaucauuaaagguaaccaggaugugaaauaaacagugcugcuuuuauuuaguagaaaaaguuuuucucuagguuuuuacauuuuuauuuauuuucauguuuuuauuuacuuacuuucuuuuuagacacagaaucucacucugucacccaggcuggaguacagugacaugauuauagcucacugcaucuucaaacaccuaggcucaagugauccucccgcuuuagccucccaaaguucugggauuacaggugugagccacugugcccagccaauucucuaagucuuuccuugggaagaugguuucucugaauuuugcauaagcccuauacuuaaaaugugucugugacaguauuaaccaguacccuacuucuggacuggaucuuggguggcgggguugcgauuaaacacuuuguguuucucaaaccucucauuacuccauggcuucaggagaauaacaucaguauaguuagggaauccugaaccucacauccuugaaacuucuguguccaccuuaagugcuguauucauccucaauaaaaauaagacugcuuucuuuguucacauuauauauucuuagaaccaaagaagcaaaggagcuguuuugagcagugcacaucuuacagggugucaugggacaguggauucuaggucuucaggggucacuucagcauaauucuuggcuuuucacuuccuagugaugggugaugggacauugggcaaauuuccucagagcccccguuuucugguuucccaggugaggacagggaugccagccuggcccaccccucccaggcucacugagaaagauguggugaugugauacacuuuguaaucacugugcucugcuguguaacuguuagggcauugcaaggcuaaccacuggucaucugucauuuucgucuggguaaugaauggaaaaaucuauagacuuugggguuuugggugguagcaauuuuaaaauaccuauaccuucuaaagagauuggaacagaaggcaggagcagguggagguaguauagaauguucacuucuguaaacaucaagaccaaaaugaaaaggcuucuuuuuuagccaguccacaaaacaguaauccuauaaaauaaguaccucuuuggggacagcuguguuggauucagaugcucccuuuugugaaauauuugccuacagccauguuucucuccauuuuaaauguucucaaguuucaucuuuaaacacaaggccaagaacacccuggugugguguuugaguggugagacuagggagaacccacugacaaaugcagauuucuuugccuguguuguaggucaucugaauaauggagucacuacaagguaccaugguuuucaucaaggagauaguuuuacaaauaccuuccauauucuugggaauguuuuggagacaguccuauuccacuucauuucuuucuucuccacagaugcuugguauagaauguugccucuguauaugggauuauucucucauucccuuuacuccacagacgcuugguauagaauguugccucuguauuggauuauucucucauuccccuuacucuuaagaguuuuugaauccgaaggaaacauguuuuguuuugaguaaaaggagguguucaguggaucucauuuucuuuucuuuugcggaauaugaggccuaggaacuaacaauugcaaaauauauggagcauagguugagauuaaauuaaauuuauuucuaagugguuaauagacacagcucgaacauuuuucaucuucuugaugauugcuuauuaaucacuccuuaauuccuugacacauuuauuaauaggaaaaauugcaaggaagcaucauuugaaaguaguauaaaauacagcugguuauauuguuuauguuuaagauaaaacauuuaaagcuuucacguagguugaaaaugccacaagagaacuaacaugggggaagugguggaugguggaccuagcagagcacuguggucagcugggcauugcugugagcaccagcucaccacucuccaguucugugaccuugggcaaguuucuuuagcacugugaugaaauuucucaucuaaguaguugcccuguguuuaaaagaaauaacguaaagccaccuggcccuaaaauucaguuaaugcaaauuauuauuacaccuacuauuauguuaucuagucuguuuuucuguucauuggguccgaucagcuuggcaaaagugauaugcuaacuugagcaucauguagugaauucuggcagaacguggaagugauuaauuaaaugccacccccucgugggccauauuaaagcugaaugaaaauagaaaguguguaauaucugauaacauuugguggagaagggggagacagaaaaauugaaggauaagagaaaaggagacacauauaaagcuaauuuuagagcgauagaucacaaaguaagauuuucuagcuuuguauuaucagcauuggcuuggcuuucugagucucgaaauuacuagguuacugacuggccgugccuuuuccucaccuuggcuauucagaccaagcuguacucuuaacagcucaguagccaaaucugaaugcuucaaauauaagcauaaacucuuuauguguaacugauugcacuuaauugggcaauaccaaaucauggaagaaaauuuauuagugacccugucuccuucagaacuuucagaguaauuggaaaugagccuaauauccguguuuuugaaagcuuuaacaauuggucuacugacaggauuaaauucauacuuuauaugguguguauguuuuuucaugcuuaaguuuuuuuccuuauuuauugauggucuuacaaauauuauuuggaaauugagaugcagugagcacagaucuuaaauaucuuggcagaccgccucaguagcuguggaugaucccuguuagcuagagaaaaaccaggaaaaaaaaacccaaccugguacacaauaguuuacgaaaugaucuuugugugauuuugaacaagcuguuuuucauuuuaaucucaguuuccuugcuucuguuacugaccuaacucauggagauguggccaggagagggugggagagcucucugaauuuuuuuguuucuccugaaauaaaacaguucuaaauagacauacuuuugugugauuacauuuuccauuuuucgcaaagucguagguauaguuugaacaccaauugagaauaaaagaagcugccuucucccagucuuuucaagacauuuuaauaguuaaugagauuuugccccuuacccucaugaguuucauuugguucugaaauaaaaauuuacggcuguucucucagcugagcugauacuaguuuaagaguggaauugaguucacaccugcucuggcauaaaaagccucuaugugacuucuuugaaauauucacagagcagaauaagagagaguacucacuaucucuacaacuguaguaacuacacgguaauguugcuugcaagcacuuuagagaagcugcucuauaaacugacucuaaucugcugauauuguccacagauagaugccuccccuaagucaccuguguuccucaagguggaaugugguuguggaaaugcaguugguuuguguaggcagugggucuacauuaacacuguaaaguguacauaugggaaaaucuuugcauuugcuaggccauuuagccguucaagacaugguccguuagucaggcaacguacaauggauuuucugaguguucuaguuaaagagcaggauguguaaaguaguauacauuuaggcggauaauuaauaauugguguaggcuuguaaggcuguaauagaauauauaaauuucagcaccuguuaaaguuuuaucagagcagaucaccuuuccuuacugugagggaauauucccgccuguagaaaaauaaagugcucccacuacacgugaaaaaccuuuaugaugaaaggaggacugguuuuuauaacaaauauuauuuuccauggucacugugauuaggugacauuuuagcagucacauuuagagagcguuccuagacaauaguauuuuguauggguuugacuguagguggcaaaacacugcauagaaacaauauuuuagugcauucuaauauucagauacaguuuacuugucaaagaagccaccuccccccccauaucauccccccacaaaacaauaggguuguucauuuuauaaguucaucacaaguaaauauucagagcgaaagccuuuucuaguggcuacguuggaagggguagagaagaugaaacauagaucccaaguucaguuuuuggcuuugguuguaucauaagcaguuuuuacacuucauaucuuagcugucuucauuuucagacauagaggaagugcucccuuacagcagugagggaaagggcaaaugauauauuugugaaagcaaagcagacuaucuuacugcuuuaaaaguuucauuggcugcuugauaaauaaaauuaacauguuaucgauaugucugcaaucauaugguccucaguauauguauuuuuuaaagccauuuauauaaauuccauuuauucuagaagcugcccaaaaugauaaacuucaauacucaaaugagucuuugguucguacagucauucacccagcaaguacuuuugggaagcuggugaucugcaagcccuauguuagguacuagauaguggcaugcuacuuuucuugcuuucaacuuggcccacauccuaauaaaagaaucagguagauaucagauaauuacaauucagagaguuggggaaauaauccauguguucccaggguguuguugcauacauaucagggauacuccaccaucagcuuccucauaauaaugucuaauuuuuuuuuuuuuuuugagacggucucaccccguccuucaggcuggagugcaggggugcuuacugcagcuucaaacuucugggcuuaagaucuucccuccuuggccuccugguggcagggacugugggcacgugccaccacaccuggcuaauuuuuucuauuuuuauuuuuuguagagacaaggucucgcucuguugcacaggcuacucuggaaccucuagccucaagcagucauccugccuuagccucccaaagauuacaagugugagccacuguguccagcuuggcuaagauuuuuuuuucuuuuuuuccuuuuuuuuuuuuuuuugagacagagucucgcucuguccccaggcuagcaugcaguggcgcgaucuccgcucacugcuagcuccaccuccuggguucacgccauucuccugccuuagccuccugaguaucugggacuacaggcaucuaccaccacgcccagcuaauuuuuuguguguuuuuaguagagacaggguuucaccguguuagccaggauggucuccaucuccugaccuagugauccgccugccucggccucccaaaguacugggauuacaggcgugagucaccgcgccuggccuggcuaagauuuuuggguacucacuguguaccaggcacuugcuaaguacuuuacacauauuauccugcuugcuccuuauaauaaacuucuuuguuagacauugucauuaccauuuuacaaaggaggcaauugagaaucagagagauuagguuauuugcccaguguuguguagcugguaaguggcagaauccagauuugaagcaagaucugcugaacucuaaagccuuguccuuacccaccacugcauugccuccuuuguagagaauuuagaaagaauucccagagguggaauagcagcuaaacauggguucagcugcaacuaauagaauaccugauaacaaugguagguuaguaaaacaaagggguuuuuccccuucauuuuaggaggugucuggaggcaggagguugccugugugaguucagcaaaucaauguuucuuucuucccauucugcccuccuuagcaugcugauuuucauucuucagcuuuuuccucuccucuugcauuucuuucuugcaagcuggcucuugagccucacacagcacauuagaguccccuaaaggaggcaggggaggcagagguuaggguaacauuuauccuuacauauauccuauuccauccaggaagggggaaaaacauuaccagaaucugguggccuugagcaggauucugcuaacaacuuauuggcuaaaccucuagcagacaucuacucauagcugcaagggaagcuuggaaugugaacucuuagagccaugguugggucucugacucaagagacaggcaagggaggagggaguuaggaauggcuauuguauggaucaacaugaauuuucuuaauaauauacgugguaaugccugagcuucaucuuaaaggugaguugguuagaacuauccugauggaaagaaaauuaccaguugguagagaugcuugagcagagccuugggagcuggaagacguaauaggaauacuggaacugaagucauucugugagaugacuaugagauguaguaccacagaggaagggaugacagguugauauggcuuggcugugucccacccaaaucucaucuugaauuguagcucucauaauccccacauauugugggaaggaccuggugggaggcaauugaaucaugggggguggguuuuucccaugcuguucuugugauagugaauacaucucacgagaucugaugguuuuauaaaggccaguucgccugcacaugcuaucuugccucccaccauguaggacgugcuuuugcuucuucuucgccuuccaccaugauugugaggcuuccccagccaugugaaacuaugaguucauuaaacccccuuuucuuuauaaauuauaauuauuuauaaauuauaauuaaaaucuauaaauuguaccaucuccgguauuucuucauagcaguauaaaaaugcucuaauacacaggugaagcuggaauacaauccuggccccagagaaaugaagggucucuuguguuuaggaguggaagaugucagauuuucaaugaagcgugugguaaacuacucaaggauugauuuuaaauagugagauaccaugauaugauuuaugauuuaggacacucaagcaacugugaauaggaggcaacuugagggcaaggagauuacucaggaggugauuaaggcaauuccaagaggaaaugaugagauugagcugaacugggaacaaugaagaugaagaggaggauggauuugagugauauuaaaaugauggaaaugguuggacuugguaacugaugggcaaggcaggggucguccuuggcuucuuggugucuggcuugggccacuuggugguuggcagugccauuuguuaagauguagaauauaugaggagaaguaggucaugggggauuaagguggucaguucaguuuuggaaauaaugaauuuuugacaugucuguggguggacagauuugugauucuggguuugggauugcagauuuggcacacaauauuaauauuucauaguugaagucaugggaguagauaaguuccccagagagagacaugaaccaccaccaacaaggcaauuuguugcauugugacagcucuaacuuuuagaaaguucucaauucuguagcugucagccugaaauacucauuuuucccucugaagcuaacuaguauuguguauugucucucuuuccacauguuuugaaggaugcuaaucuuggcuuccuucaaaagcgcaacuggaaaacuuucaacacauuguagaacaugguuuaaucacaccuuguauucccggucaccauccucugcuguguucuaguucaucucuuuuucccuccaaguggugaauccaagucuuacccuaguauuccagaucugguuugaucaauaguggaucugcucucauuuuuaguguuaaugcagucuaagauuccauguauacauucauauuuuaacauugacugaaaauggagcuugugguccacuaaaaucauuaaguguuuuuaacauuaauugcuuuacauccagggcuuccacaucuuuguguagaaugggacuuaauacguauccucgucugauuucuucauguugguuuuggucugcaaaugugcaauaauucuguccuuucacucuguugauauaggaagugagauggugugaugcuuaggaaugcaaacucuuggauuuauauccuggcucugcccacccuuuacuaccugggugacaucuaaguugcuuucucugagucacaguuuccucaucucuguguugaagauauuauaaaauccaucuguugggauuguugggugaaguaaaugagguaaugcauguauaaugcauagaggaauccccagaacaucaucaacacucaguaauuuuucccuguuacuauuguagggcauauaaggaguuaauggcgcuauuuuugugauuguggauccuuucucucaguauucuuucuggaauacuuucaguaucucuuucuggagagaaaguuuaaggcaagugguucaucugugacgaauggaagaaggaaaugugguucuugauuuugaguugugugaugaacccaaauuuaccaggcaauagauaggauaugaugauuacuaaauuugccauugacugauaguuaacuggcuaccuuguugggucucuugagaaaagaacuaaaacaagaacaacaacaacaaaagcuuaaaauuaccugaaaauaugucucuuuaccuacaccuaauuuuaaggcagaaaauuccaaagugagccagcuacucaauacaggugcugaagguuaugugaaaauucggguuaacacuaaugauagauugagagguaacuguuugcuuuacaaaccgcuugccaaggaaugcccauauuagacuaugaaaauuagacucauggcaaauuuucaggaacaugauucuugugauaaacaagcuaucuggagggugaugugugagcucacaggggaguuuuaagaacagguuuccauuguuggacaguaaccugacagcuaggcauacucagaggaagggcauagauuaguauccaacaaccuguuuuaaaaccaagcaaugggaccccauacaagguccagguugacccgaaccaagguuagaugaaccugacuuguuuuuauaguaaacgucacaauggugacaagccagcagggucaucagcacacuuugcagcuacagacuucccacuggacaaaccauuuucagcuuccucuguuuggucacacccacaagaaguacgaaugguauauuuaaaaagcuaguccaucuugguucauuuauaccaguguguaggauuucuguagacucugggcugguuacaaccuagagcugcagaagggugcagagcuucauguguucauucuguacugugauaaaguucuuugcacguuuguggaaaugcaaaaguucuucuaugcaccuggcuucuguuccggucauuuccuuguauauggguuuugauccggugugacggaagagggaagcuaugcauucugagaucucagauuucauuguauccaauuauuuauaagaccugagaggugcuuuauuaguuaggaagcacugcagauuuucucuguagcuuuuaaaaaucauccugacuuccuauguguuauuuuuugcauuggcacccauugccaaugcuaugucucagaagagccgagacuuguggccaauaauccuuagaaacugauggggcuguagaauuuauuucucugucacccuuuuugaaaauaaaauaaaguuauauuuuucauuuacauggauggacaaauuggggucuuuaaaauaaaaccuacuuccccuuuucauucuuuuucugaucauuuguagcaaaagcuuagugguuuucuguagaacugcuuuguuuuaaaaaucaaauugaagaccaacuugauucugccugcagagcaaagcuaucugccuuuuuagaaaaucuggaugguuaaauuggaagcacauucugcacaugguuuagcaguuaguagccuggaaaaugacccaauagccaagauaguuuuuuuguuuguuuguuuuuuguuuuuuuaaucuucauuguaagugcuuguuuaaaguguaagcuuguaauggacuauuuugcacauuguucauuguuaauucuuuucaggcuauuauaguucuguaaauacauugccugcuaaguugugucaguggagaaacauuagugcuauaagaaaauccagugaaaugugcuuaaaagcauuaccaauuagcgcaugggacuggaucaccgcgauuucuuagugauccuagagaagucaguuucaguugacuucccauuuauuuaaaauggguaugacaacguucuuuuuggagaauagggcagcacacaaaugcacacuaugcuguggccugcugaagaguuuccacugauuugugacuauauuacucaauauugcuuuguagcacccuuagucuaauccacauugaaggagcaaaauccuucuguaucuuacuuauuauacgauuauguaauacauauguuacuuuauauauaauauguaguaguacuuauuuuacuauuuuuauucauuauaaugaaaauaacaaauuuacugggugguaucuaccaucuagcucaagcuguucuauuuuguauuguuuaaauuugagaaaagcuaauauugguuaauaauuaaagguuacaaaaauuguagugggaaaggaguuaaauucugucucucagauaguaaagacugccagaacauggacauaaucaugggaaauaauaggguggauagaaugugauuuaucugcguauguuaaagaaagaaaaauagugaucgugaauguacugaauauagcuuaaacuauuuaucauuauguacaaauggaaacuuacauaaaaccccuguugauuaaguuuuaucugaaacaaaggauaugauuggaaguggagaaugggagaguauuuuaagagcaugugauaauccagcuagaagcuucagcaagucuguggucaaacaagagaagagaaagaaagagcaaggaagcuugauuugguuaugcaaauuuggagcacacauaugaguugggaccuaauggauuguugcacuggauuuggucaucaaaugaugcuuuucauagcaaauauuaucugagccauuaauucaaacacugagaaaugcaggccauguguaggcagaaccacagccuuuuuaucccucaaaacaaaauguaaaaguuggccuugaugguuagaccuuauaaagaagaauaaggggggaagggggaaaggagcaaguagugaaggaaaaagcacccagaauggaaacaggcaugcguauucagacauaaauccaauaaacagacaccccaaaguuaugcuguguaagaauagacacacaguaagaaauuuccagcuaucaggcuaacaggauggaaaacuggagagcacagagcaauuacuuacgaagaaagaggcacaguugacaucaaguguuauagaggagacuggcaugauuacaggaagauguugagaauaucagaaaacauccccaaauuaagagugccaaaaagaagaaagauuaccgaugagaucaugauaaauaauaaugagcuguuucucaaaguaccugaagaaggggccugaaaagugguuugucaagccuggaagacagagaaaggguaauguauugacggacgauggagacacugcuaaaaaauaaaugaaauuuucaccccaguguucacaaaggaggaggugguuggggacagaugucagacacagacacaaauuucccaggggagaaugaagaaauacaaaagaaaucaggauccugcuaaaacaggugaucaaggggugagaagaagaaaaugaauaaaaccccaaaaaccccaaagcuuagcgguagucaccuaaaaaucuucaagaagugagaacaaagaagcuaacaagaagaggaaaaacauacccgcaucacuuagaaaggcuggaaauauuuucauguguguguguuuuuaucuaguuaauuuguuagacuagcccuuuugaaacuuguccuuaaaggaaguaagauagaauacuuaaagaaaaaugauuguggcugggcgugguggcucaccacccagaguggaaacaggcaugcguauucagacauaaauccaauaaacagacaccccaaaguuaugcuguguaagaauagacacacaguaagaaauuuccagcuaucaggcuaacaggccuguaaucucagcucuuugggaggccgaggagggcagaucauuugaagccaggaguucgagaccaaccuggccaacauggugaaaccccgugucuacuaaaaauacaaaaaauuagccaggcgugguggcacgugccuguagucccagcuagucgggaggcugaggcaggagaacugauugaacccaggaggcggcgguugcagugagcugagaucaugccguuauacucuugccucggugacagagugagacuccgucucaaaaaagaaaaaagaaaaaugaucguuuaaguggccuugaauaaccaagacaucuuuccugcuaaguucuuuucgaguuacccauuaugcccagcguugaauguuuacugugcuuauuaaggaugauuuuuguguccuaggugaucacugaguccuugauugggccaguauuuacuggauggaugcuucuuagugccagggagugcgcuagauccuggacuacugggauggaaaagcuagauacuuucugaggguuuuugaagucacuucuuccucacucauauaagcaaccccaccucuuuccaggcauugauuucaguguguucaucaucccuggucuugcuuuuaaccagcuacuugaugggcaaaggucuggagaggggcagccuccuuuguugcuggcucagugugcugugcuguccucagcguggugccugcuuuuugcccuuauccucagauguggaucccucucuucccaagcucuccuccauccccugugcugcaaacaaaacuccuuguuuguugcuccccaccaguggccacgaaggaauuugcaaaccccucaaccuccuacuguuuuggaauucaugaaguuuuugcccugagcaagaggcuauacuuucaaaaguacuuuuuccuuucuucauuuucccacccccugccuuucaaccacugccccgcccuggugcacacaccuccaucccaggcugauaacucccaucucuauuugaaccacccacucccuucucuuggccucugucaauuuuagggcucagcaaaacugggcuuacuaaaaacaccuuucaauuucuguucucagcauuaaucugucuuugcuuaguguucaaagaauacuuuaagauacucauuaaugcaaacacuguuaugaggagggagcuucacuucggucccuucuucucaccuucagauacuacuguaacagcugugugggacuggaguauggaauguuucagagaagcugcuucugaguguguaggagagggcugaagaaacuuucauccaguacacaguuuuguccuguaguccuuguucccauggccaaaagucuucugguaaaauuaaucuccagugcuaccuuuccuaccaggacugcagguggugucuuuuaguugaaacagacucccguggucccuugauucucauauguaauguuccauguucaggugucucugaaagcuguuagacuucauccaauggagaaggguccauugagcuacaucacuuucuuuuuucacauuugcguuucuuuauguagagugaguugcaguuugguuggcuuuuuuucugggaauagaucacucuucuggggacugucagacuuggucccugcccugggugaguuugccaucuuauugaggggguacuaacaugugcgagacaacuauaaucauagcaauaccaaccccaccucaauggcugagugacuaaugagaggagagagugaggggcugagcagaggccucuaggaagcagcuguggucaaucuuagccuacauuuacuuuuuuuuuuuuuuuuuuugagacgaagucucacuccgucacucaggcuggagugcagugguaugaucucugcucacugcaaccuccaccucccagguucaagcaauucuccugucucagccuccugaguagcugggauuacaggcaugcaccaccacacccaguuaauuuuuguauuuuuaguagagaugggguuucaccauguuggccaggcuggucucaaacuccugaccucaagugauccgcccaccuuggccuccgaaagugcugggauuagaggcgugagccgcugugccuggccuaaaccuauauuuacuuugaauuucacuauagucuaccauuuccugaugccuuauauaucugacauauaucugaugagugacauucuugagaugucugcccaggacuccugaaccccaugagaaauaagauugcacuuugcaguucuucaaccuugcugugcaucugaguaacauguggcccauucauacacugcagaugccugggcuccgucugugagauucuguguuuagaggccugggcugggaucuaggcuucuguuauuuaaacaggaauuucugaccuacacauugcuucaaaaaauugucaauuuuguuuucaaaauuguuauuuuuucuugaacucaauacuuauuuuuaaauccuuuuucacucaggaaaagugaaucaucaccuacuuagcaccuaauuauuuaccacuaagauauuugugugcaaaaaauuaauaauuuuuagaucaaagaaaauggauaacuucuaauauguuaaaaucgugcauauuuccauugagagagagaaugggcugaaauuaucccucuuuuauauuuuaauuguucaucaaauugauagauuuaaucuacuggcccuaaagauuugcuucuauaauaauguugugaaugaaaccuucauugcuguagauucacaauucaacaucauacguaugugguaggugugauuuuucuuguauuaaaggaaaaaggguuagcagauuuuuaccaauuuagaaaaaaggcaagccaaauuagagggaagucagcauuauaaauauuucgaaaagaacccccauucauuauuuuuuguaauguguagcuaagaccaagcaacagugaagugggaaucuuugccuuaugcaaaaugguuagggaaauagcuaaggaugcuaagaaauuagcuucaauauugguuguaggcaugaauguuuuucucagggacuugggugauuuuguuacacuuucuaauauuaucucugcuaucuucuaggacuuauuuugugcagucaaagacuuuuuaaggcugucuguucuguaaaagaaauacaaacuccaaguuguuugauuuuaugaguuuuguuguuguuguuguugcuguucagucuguaaaauagugacguggauaauaaagauauuuaguuguauguccagugaccuuuggaauaauaaaacuguuuuugucuguguggguuuuucacauacagguaauguuuuguucacauucuggauacagaccugaccucaggcugcucagcacugcaauuucauaggcuccuaugagguccccggcuaacauuuugacuguggugguagaccuucaccucuuagauuucauauaucuuucauuuugcuucuuuugugcuucuguugaauucuguauauuuaagaaaauuaagaugcagagagaaaauugguuaaugucuccucugugucuuguaauauguggcccaaacagaaagaaaauguauggaauuuagaaauuuuauuuacuuguuuucuuacaucauagaauaccauuuuaccauugaaauuauuaaaaccugcuuuuauugagaauuuuggggaaguugaaaauguaaccuuuacggggaauuaaagcuguuuuauuuuaaugaauaaaguaguuaaauuauuaaucauauaaaauuauuucucuggauguuaauaaccauuucuuuacccaggaacuuuuuucuaaucacagaaucuugauuggugguuuauuugaaggcauaucucacuauuaaugguucaagaauacccauaacuuuuggaaagacucaaaacauauugcauaauuggauuuuaaguuauguuguuuguaagcuuauuugacuuguaucauguagugauuacuaucaguuuuucuggauguagguaggugcuucuuaugauucuuucauagauaguauugagucauucauuaagucuauuccucagaugcuuauugagcaucagacuugugucacauacuugcacagcuugguguuggagauacacccuuuaucaccacauacuuggaguugcuuuuugucugcuguaagacacaggauguagugaacaggccaagagaaauauaggguccugugggagcuccuuacagggagggacauagcacagagaaacucaggguaguugacauuuaaguucagaucugagugaucaggaaaacagccagccagagggagcuggcaugggaauggauggaggcguguuugagucauggcagccagaucuaaagaaggcuacaaguagagagaggacugugcauuucuccuucccaucacuggaagaggaaggguaugaggaguaggcucuacaugaacaugagagccagcucaugaagggcuguacaagccauguuucaguguuuaucauucauucugcaaauacauacucagcacuaugugucagguacuuggcuucaggaaacaaggcagaaaauaaugccugcccuuguggagauuuuauucaaauggggaagagacaaacaguaaacauggcacuagugguuuugaaaaugggucagaaguauguguaguccaaaugguuacagacucagcauuugccaauaucauggagccaaaucuaagacuauuuaauaaaaauaaguuugcaaucauuuccaguccucagcugauaacuacagauagacuuauucuuaacucaacauauuuacagguaaaguugaagguuaccuaucauuuauauuuauugcucacucacauugcaucaggcauugggcuaagcaagcaagcaaaccacauuugagagaaggugcuacaguuuagugcaaucaguauuucaaguucaccagaguagaacuuaagaguagaagguuuauuuguuaaauaagaauacuugaccuuaauggcuaccaaaaaagaguuggaagaaugaauaagaucuaguauuugauggcacaacagggugauuauaaucaauaauaauuuaauaguacauuuaaaaauaacuggaagaguauaauuguauuguuuguaacauaaaggauaaaugcuugaguugauggguacuccauuuacccauauaugauuauuacacauuauaagccuauaugaaaauaucucauauaccucauauauacccacuauguaccuacaaaaauuaaaauacacacacacacacacacacacacacacacacacgaauacuugagaggugaucagaauguccuguauuccuggccgggcacgguggcucacgccuguaaucccagcacuuugggaggccaaggcgggcagaucaugaggucaggagacugagaccauccuggcuaacagggugaaaccccgucucuacuaaaaauacaaaaaaaaaaaaaauuagccgggcgugguggcgggugccuguagucccagcuacuugggaggcugaggcaggagaauggcgugaaccugggaggcggagcuugcagugagccgagaucgcgccacugcacucuagccucggcaacacagcgagacuccaucucaaaaaaaaaaaaaaaaaagaauguccuguauugcuguuugaaaacacauuaccagaaccagaauucuuccuugaaguuuugaacaauaucacaauaacagaaacaucucaagauuuuaucaugcagccagcaaacaaaaaaauucuacauagugauugaaguagacauuugcuugucacucaagaugaauuauuguaaauaaggaguuuuuauuacaaugaacacuuuuuuuggcagaauuaauaaagagcagaggauacuagaagucagugcauagaagcaaaaggagaaauguaguugagcauagugaauagagaagauuugcuuucguuuauuugcccuauacauuaagaccauugaaugagacuauuuuguguaugacaagcauuugaaaaaauuguuuuacucuggcaaucuuaggcugauuuguuuuauuuccuuuagaauaaaaguugcaaguggguaggaauuaugccuuaaaguguuagccuacaaaggacuggaaaacuacucaaggguaacagcugaagaggaaauggcucugucagugucgugcgcauggaugauugggcacauaagggacacaagcagggagaaaggugcagagagaagagcucauaaaaccaaggaggcuugcuuggaacuaaaauagaauagcaaaagugaaaagccuggggagccacuaaugugauauaguuucccucguaacauaaugcaaauauguaaaguugaaaacgugugccgccucuugcauagacauugcugucaucagcagcacacacaguuggguauauuuggcgaggcauuuaaucuccuggcucucuggucucucaguccauaucaccagaggcauguauuuucaaaacaguccagaucaaugucuggucuuuguaucugugguacaaauauaaagcuuacuuguccacauaacagcaaaguaaauccgugguccauuaacgcuaaauuguaaauagugauagucacuuuuguccaacagugucuguaauguuuauugcuaaagcccauacauguuuauugauauuauccuaaucugggaacaguagcugcuaguuaucuaugugccaaacacugugcugcuguuugcaaauuuuaucuaauagcaacuguuugugaggagcauuuguuaucugcauuuuacccauaaggaagguaggagggacagaaagguuaaaauaauccagauggaggacccacucuuggucacugguauguuuugggcuuagcacacaguucugccagacucugcaacauguguucuuaaccaucagacuuuauuucucuggugggcaacacagguagaugugacagguuagaaguauuagauauaaauauaaguuaucgagaugauaugacuaccgaauucacuacugcacuuuuuuuacuuuuuuaaaaacauguauuucagcacacugcuaaaccacagcaagaaucuuuuuaaaaagaccuuacaagaagcaugauuacaggucacaaaaucaagggaaaauauugucaucauuauuuuuuaauaagugauaagugaggcugaugaguguagaccuguugcuuuauuaauagaaauaugugcaucuggugaggacuuguauuugccaagcacacugcuggccuggaauuagacuccucuguggaauucaggucaguguuuacacccauaguaguuuacaaucuuucauaaauuugagcaaaauauuaggaaagcacuuagaagcaauuuagagaaucagaauuaaaguagaaucgguguagcauguauguucaguggagaggggcgaguagaggagugaguuucucugacagaugaugaaucuaguuuguuuacuuuuugggagacccuguuuccacacucacugacaugugaguuugcauccuggcucaagcacuuaaacuccccagucucccuuucugugugugugggauggagauaacaaggccaaccuuacaagguuguauaggguaaagugcccaguguaagauuugaagcacaguaagucuucaguggggcuagguuuucuccuuccucccugcuacuuacuucaugaagaggaugaauaaguacaaaucucuguucagcgcugcaaaggaagauuaucauauuuauuuauuuauuuauuuuugagacagagucucacucugucgcccaggcuggaaugcaguggcaugaucuuggcccacugcagccuccgccuccuggguucaagugauucugcugccucagccacccaaguggcugggacuacaggcgugugccaccaggcccagcuaauuuuuguauauuuuaguagagacaggguuucgccauguuuaccaggcuggucucgaacuccugacuucaagugauccauccaccuuggccucccaaagugcugggauuacaggcaugagccaccuugcccagcccagauuaucauuuuuaaaugcugaaaaccuaaauuucccauugcacugugcuauuacuuucacaguguugacuuucagagauauccgugcaccgccuuuugguagcucccuauguccucuugcuucucuaguugccauuucuuuggaagacccccccgacauuaguuaucucauuuuccaugagugauuuugaaacccaguuugugccacaguaaaauuuauugaaauagaagaaacacuggaucuugagagauaccaccagcaccugcagucuuaacgcuucaucuccucuccugaccuggguccaacucaucuuuuuuucucaucaccgccugcugccaucuuguuuacuccaagucuucaccguucagucagaaauacaaagcccugcaugggucagguaguccucagagaaggagagaaguaagaaagaaaguggaggccggccacggugguucacaacuguaaucccagcacuuuuggaggcugaggugggcggaucaccugaggucaggaguccaagaccagcuuggccaacguggugaaaccccgucucuacuaaaaauacaaaaauuagcugggcuugguggcaggugccuguaaucccagcuacucgggaggcugaggcgagagaauugcuugaacccggaaggcggagguugcagugagccgagaucgccccauugcacucuagccuggacaacaagagcaaaacuccgucugaaaaaacaaaaaacaagaaagaagguggaaucaaagggauguagggguuccacaaauuuagaugagaugucagguuucucagauguguuccuugauuugagguaggugaucuuagaagagcugcaacuaaacuccaacuggcuccuuuuucccccaugucuuagaagaaaaugugcuucguuuuuauucucuugacaacccucugcauuugcaucuuucagcuucuucuaacuugugucuccugggaccuuucuuuucauaacucuauuuucuuucaucaucugucuuuccccugacuccuuuucccuuugcuucaaaaugugcaaauggauccucucuucucuggcagugauuaucaaagugugguuucucggcgaaaugugaucacuuacuucaaaucuccugggaugaugugaaaguugggacccacuucaggccuaugugucaauaccucaguaugauauauuccagcaacuuucccaaaaaacuacuuaguuuccaaggcaguuuggcaucuccuagaguggcacagcaaauuccaugauuuuuuucuagcccuguucguuuugucuuuuaaaaccugucucccucaacauccacaauguuaaaaacgucuaacuugccuucuguuucgcucacuacucuuuuuuuuuuuccugcuuucugcuucugucuucauaagugcaggcaugggaagagcugggaauuuggagucccaguaggguuugauuccuuaaugucauugcucaguagcugcgugaucuugggucacccauguaucuucaguagggcaucugcuuuggagguuuguguggcuugcaagugucauuuuuaaauugggagcccaaaugcaauuguuugugcucuaaaaaucugccucuuccaguuugcuguuggaaaacuuggaaauuauuggcuuugccaggguuguggccucuggaugagagcuaaaaggugaacagccuuuuauccauucugcuuccccccacuuacucaggguccuuuccuguuacaaaucauaguuuguauggcauggcaaguacuggaagggagaaauucucuccagugagccagaaaaugcaacgggaucuguuugugauugauagagauaagagugccugaucuacuuuucccucugccagaaaaguauuuuucccugacagcuggagacaucaaaggucugaagcugugaauacagagagaugaauguucuaauauuaauauuauauuuaaaaauauaccacguaacauuuaacaucaacaugucuaguuuccucugucugguaacccccagucguccauaugcaaaaagaggaauuccaaucacagagguccucacuccaaggagacaggcaaccauuacgugucugugaauagcugaguaagccaaacugugauaguuucugauagaucaugucaagaccuaaauaguggaaucuucaggauuuggagguggggagcaagucaccuggauugaugaggacucacugaugaacugaccaaauuguuuuuuuuuuuuuuuuuuuuuuuuugagauggagucuugcucugucccccaagcuggagugagugcaguggugccaucuuggcucaucgcaagcuccgccucccggguucacgccauucuccugccucagccucccgaguagcugggaccacaggcgcccaccaccaugcccggcuaauuuuuuguauuuuuaguagagaugggguuucaccguguuagccagauggucuugaucuccugaccuugugauccgcuggucuuggccucccaaagugcugggauuacaggcgugagccaucgugcucggccccaaaugggcuuuuuaggaguucucauggaagagauggaaguuucuucuugagugagagcaaucccagagucugauauuucaccuaguacaugggaagggaacauguuuuguccuaagccaggugugaaguauagucauucauguugggcaaaaacguggcaggacuuggaacuucuguggggacccacaaaggagaauagaggagaagacuccaugaaauuucugguccugguguuguguggauggcccagggcccuggccagagagauucaacuacuaggugagguuuuuuucacuuuagacaacccugcuaaggcuucauuucacuuauaugccgucugugggccuuugaugguucuuuuuuccuauauuugcuauggauauauuuaugcauuuaaaaaauuugcaucauuguaacuuuucauugacaaaauauauuuaauaugcucgguuuuuacaguuuugcuuaauuaguuuuuuucccacuuauauuuauuuucuguaacuuuucucuuuuuuguugucuguuuugcucuauuaagauguuauauaucuucuccuccuucuccagaguagaccucucaucaguucaccaaaaucucucuccaguaagagucaggaagcuuaccgugugacaaccccuucaaggcaauaaggcuccaacuaagggauuaagauuguuuuuugacaccaaacauuguuuauccucuuaauuuugagcuauguagccugaaauccaugcucugugaugaaauggaggugguuuaucugagcuuuaauacucuuaaaaaugaagauaaugauagagcauaguaaugaaaauuaaauaagaugcaugcaucuagcagagaagcuaagaaauaggagauucuuaacaaauguaaccucauuucuucuuuaguuucuguaaaaccccaggaauguuagaaaauaucuaggucgaaaggagaagaucaugaguuugguguuaauuuugagguaccuuuaaccagucaagugaagacaugaaguagacaguugaauuuaagggugugcagaucagagaugucugaguggagagucugcaguugaagagcuguuuguagagaugccaguugaugguaugagauugcuuauggagucuugaguaacaggugggccuugagccuagcaguagaaggauuuucaagauuuaaagacauucaauugagaacaaaagagcaugccagggacugggagagaagggaaaugugauguuauagaagcuaugcuaagcauaguuuuuuaagaaggaggggaugggugugucuuuuuuggucaucaaggaagaugaguacucaacagugucucuuggcuuuaaccacuuuaguggucacuguugacauuuucagagaguuuucuugguggaaucauggaauaggaacugacuuuccaucccucagaguugaguugucuuucaucugacuuggcaaaguauuucuuuuauguacuucuaaugugauuuuucucuauuguuuauaguuguuugcacuuuucauucacguaauaaauuaucaguuuccugaagacagaggucaugcaaaaucccauguaaauuacaccuaguuaaguauuuagucuuagaaucauugguucucaugaugaacaaaacacauuucuuggucuguucauuuauucauucauucgcugaacaguuuuucauuuaccaauuccauacaaauagcagguacuauuuuagguuaugugaauauaguggugaacauaagauacucccuuuucuguaaacuuucauuguagguggagacagaugagaaggaaugaauacaaauguugagggcguucagugucuucacuuauuuguuccucacaacaauagcaugauguagauguuauuccuaguccuauuucauugaugagaagauggaggcaucaagauauuuaguaacuugccaggguucucaguucauuggaaacagggaugauguuuggagcuaggauucaaacccaggcgguuugacucucagauccacuuugcuaaucaucucacuacacugcaaaguguuuggcacggggaaaaucauuauucuuauuauuaauguaguuaauaguaacuauuucucaagggagcugaggaaucauuuacucuaauucagaugagaaaauggacacucauacagcuagcuauuggcagaacugaaauuuagaagccauauuuccaggcuccccuuccaauguuuuccccucauccaguaccucuucuuuaaggaauggaguauggaaaagggaaaagaagcuggaagaaugaaggaaugggcaaggagaaggaaggguguguagaagagauauaggaaauaauuaaaccuguuggauuugggguuuuugaugcuauugaacugucugguuuuuaaaguuuuuuucccccuuauauucucaagagguagauauccuugaaaugauaucuucaugcaaaauaguguuuuauuucaucuaugaccaaaaaauaauucaggagcuaggaaaccuuagcuccuuaaaaguaaaagacuguauuuugggaaagaacauuguuacuggaauuuauacugugaugacacugguugguagacacacuagaagcuuugaggagugugugugugugucuuugugugucuguguuugugucuuugugugucuguguuuguauauguuuguauauuaguaugauauauauagaaguacauauuuauuuuauaaaauacugguaguguuuaauuugugcauacucuuuaggggagaggguauugaaauauuuuucuggguuggaaaaguuuuuguacuuacaugcaaggcugcucuaaaaucaagcaccauauugaaacaucacaaauauacacuaagcaagggacagaugcacaaggaauuuaagcagaguuuuucuaaauggcaaauaauuagaggggaacagaugccuaugggcagcaaaggaugaaaugagguaccaggaauuuuaaaagggagauggaaauacaaauguagaaugcaguugcucucaaggauguuuaagccuagagggugugcuugcccaaaguucacucuuuuuguggguauugacuuaaauuugguucucucuucaccugucuuccccaaagaaguagaugaugcuaaucauucugaaguggaacagauuuucuguggaaccucaguuuuggaugaucuguggcugcaucucuuucuucugccucccuagggucuuguccuuuuauaggacugccaggauaugacauuucacaaccaugucaguucucacuuauuuauuauuuauaccccauauccuuccaaaaggguuuuuagguagccuaccaauaaaagacacguaugaaaauauauguguguguguguguguauauauauauauauauauaaaauuuuuugucuugguuuguguuuuaggauggacaugucccuucuuuagaaacaagucugcuguaaaauggguuguauccaucucagagcuauucugcguagucuugauguggaaaaggaaacaaaucuccaagaauaaaguagagcacuaggcauuucccaucuuccuguagagugguaguuuaaacagcaggggcacugagcagagcgauugagccacccagcaaagcugagcuguagcaccugaucauuaucccucagguuuaagauuuaccuguugugcucauuguaacaaaagaaaugaaaucucuguaauuauauuggaagggggaggagaucguguuuuaguuccuuugaucuugagcuagaauaggcucugcuuuuggaaauuuaauuugaaagagcccaacguacacaucugcuuuuuguacugcaauuucuauugagcuugaaaauagaaauuuauuaaugcaaauguguagagucuguuccuugaggaaaagauauacucauucaaaacacaaggugaucccuuccuacauagcuauggaagauguuaauauguuuucuguuuuuuuuuuuccuugacuucagauaugagguuccuugcuaacaaggacuaagcauaaaaauuauaggauccauuggggaauggaaagauucauucaauacuuaaaaguuuccaaaggacaaauucauuggugaagagcugggggaagcauacugaauccucaaaagaaaaaaaaaaagccaaaaacaagugcaucaucaaaccauucugaaaauauguuugaauugaugauagggcccaugcuaagagacaaagcuuucauuucaacgaauccaaucugccuaguguuguguaaaauugccuuugccuguaaauggaauggcaugcagauuuuagguaggacacuuucucacccaacuuagccuguacucuauuucauuuuuuccaccauuacaugaagcuucacauaaaugacaacuugacuuaauccuuaaaguggcuggauuguguggucuauuuugauuaaacuuuuucuuguucuuaguguaaauuuucaguaaugccuaaaaugucaugagcauuuugggacauaaauccuuuaagcuauuuugcagucauauaguuguucuuuggaggguuugagugcuuuccuaaacuccuucucaucucuaaauaggcaaaauaaauuauaaauugucgagaacauucaaucacucuucggaugagcaggcaucuccuaaagcuggggaaaguauccauuuucaauauuuugaguaaauauaguugauucuuuauaauauuuguacuguaucaaaagaucucaaaaacuguuauaaauuaccuagacuuaaggaagaagacaugauuaaauaauucauuggaucaauaaaaccaaucugcuuuuuucugauguggugugaugaaguuuuuuuucaaaugggguaggugggccucagugcuguguauuauccuuuugauucuauugguuacugucuuucucugcuccccccuuaguuguuguuugauauuuuugugcuuuuuguuuguuuuguuuuaaagaaaggaaagcugcaagccauagaaaguuaggcugugaguuaggaauucugaguuuaaagcagggagccugucccuaacuuuguguuuaaguugguguuucaguuauguugccaguguaagcuugugacccuuacaaauguacaauuucauuuggguucagugauuccuggaugaguuugugauauaggaugccaaaggcuguggaauuucuuuaagacacaaaaucuugagacagagcugauuccuuggaagcuuguggguaacuagagucucauguuaacuaaucuggagggggcuaagaaaagucuuccuacccacuuccaauuaauuaauuucuaacauuuccaucuaaucaugacuuugucgagugacacacaucuuuuuuccucacaggcaagaaacucacacacaaaauuucuauuucuaauggcagacaguuggggugccgcagccaagcagucacccuuaaaaauuaaugagcguaaugaugguuagaaaagcgauucugauggugguuggagagggaggggccauggggauggcagaaggaggaagaccggacuccucauaagugacaaugaugugagccccuguccucaucuccccucccauccccccuuccgcccagucaccaccccuuccauccuccucucuuuacaggagccaaagcagauagaaagacagggcgauuaugaagacgucaguuggaguguaggcaggcgagaggggcgcagcgccccagaugagguccggggggagcugaggagggucacucauggacgaccgugugugugugucugacagacugugaaauggugcguuguugcacggcugcgcugcaccugggcccuucaucugugauugauugguuuggucauguguaauggucccaucugcucuguguuguuuuucuuuuuuuacuuauaaacaccguucccagaggcugagagaggaugagcuauguuuugucaucuucacuuacacuuuagcucaaaaaaguggucaaguagguaagcucuaaagucuguccaaguaauguaguaggaaaguacgguuuuuccccuuugcuugauugugugugugugugugugugugugugugcgcgcgcgcgugugccucuccugcgcacgcgugugugcguggaguuuuaaugcugccuguuaauaucugaauaguucgugaaccacggaagaccaaaauaucgcagaaaugauuugcacaacucuguguauugugacucuuacugcagugaggauuuuuuuuuguaacggagccaauacuuaauuaaaaccgcugacaucaugguguuauaauuaagcguggcauuaauuaagcuggaauaacgauuuuuuuuuauuaagaacugcuucuauuguauaagaccauuaucgccuaaaaacaaaauaauuuuaaggcaaaaauaaauuugcuuuaaccuagcccuuuucaacuucccccaaaguccggccucaggacugucaucaucagggcuccgagucugugugugcgugugugugugagcaugugcguguguguguguguguuuggugguguuggguugggggagaguggaagugaaauuuguuuuuuuucacccaaaaaugcugaucggcuccuggcauucugauggcuaauuaugcaucggagagcuucgacagcugcauucaucaucauaaaauguaauaauuaaugacauuccaacaaagaaaaauaugcaaaugaggacucauuagcauuuucauauucagcuuugauaaugcuuuugcugacaagguuguaauuaaugaaaauucaugucgcagucaggagauuggaucgguuucauuccgcucacaauucccaaaugcuugcauuauggaaaaucggcggcucugccaacuuuucagggaagaaaaaaacacacacacacacuaaaagcaccagaugcaaauuaaugguagggagucuuuaacucuuuaaaccaccccccuaaauuuccaucauaggaaacaugugaugaguguuagccuaagaacuagauucucuuuuuuuuaauaauaggaaaguacuuuuauuugugacccaaguaugagaauuucuggcaaacuuuuuuuuuaauauuaaaaaaaaccccccaaacccuccaccuuuucccuucuuuccuuuucccuuucaagacuauuuaaauguacauaguaaaacauguuaggacagccaagccccagcauguuguguucuguccucuggcuggcagauucacgccacaacaguuuauucauccacaugcuuuuuggcgacucuucaucacguauuugggcuuagaucuucuggugccucccucggcgugcuacccauaaggucgaaagaaaagcaaguauucgauuucucuauucaggguggguuuuuuuuuuuuuuuuuuuuuuuggaugauagugguuuuuuuuuuuuugugcuuuuucuuuuuaaucuauucccuuugugguuuaguguaagaguuugagaaugugcccauaauucucucacucaacacuucugguuuaguguuguucuucaaauguaauuuuaggagacacucugcaaucaaaauggaaacccagaaaccccagagcagagauaucgacaaauauuuaacacagagagcuguuaauuuaugaaagccucuguguguugcuuucaaaauguggaacuuuagguuggcaaauguacacuugaugccaaccugguaccauguuugacagacaagccugaaguuaaacugaaaguucuaucuggcccucaagguuagaaagaaaaacuuaaacagagucugacuucauuuucuauuugaucuuuagguuaaaaaaugaugauuauuaaaacuggucuuuuugcugaggcagauguuuuaauaaaagguuuguauaaugauuaagaaaaagggaaaauagaaguguacuucuuuauaaauuauaacguuuauaagcauuuucacucucagaugaauaaaaugacuucugggaguuccuaagaugcaguuuccuguuuauuuaaaguuaaauuguaauucccaaaguugcuagcccagcauaaauaaagauuauaauacgccuuguuaagggaagagagaaacuuugauaugcggggccuuauuuuuuagaguauuucaguaaaacagaaagaaucaucaguuauuucacgaaaauuuuaaaauaaaucuuuuuucccuuguaugugauuaagaaugacuggguuucauuccuuguuaaacucuugggguuccaagaaacagaauuuuauuucaaucucuugcuucuuccaacuuuuauuuugucacaguuuguacaugaaccuguguguguguacacaggcauguguguaaauguguguguguccaugucuaaagauuaugguggcucuguccucucuccuguaaaaucuauugugguaaaauagcaggcaaaagaagguuuuacuuuuuuuuuuuccuuuuaguuuauuucuuuuuuugugugggcaaacugcccauccagaugguagaauuucaccuguaagcaaucugaaacgauagguuaauucugacauuuuauagagcuuuuuuuauuuucuuuucacacaguacaacuaagugcagaauaacugcucaagauaauguuucuuuuuuuuuuuuuuuucuuuuaaagcgcuuucugcugugauugguucuuuuuucccccaaaucugaauuuggggcucauuuaaaaaucuguggcuuuaggcacuuugcuguuauugucaaaaccacaucuaaugaaaucuuugaccagcuucuaauauguguaaaugaggaagugauggcagaagugaaaaagcagguuagucgccgagaagcagauccuuguaauuuuauaacgcugaacguuccacuggcuuugauaaauuuacuguuaguuuucuccucccaccaaauucacagauguauaccaacucauaacuucccaaguaaugccuagcaugguauuagcccccggaauccugggacuugcuuuuguugucagugugguuagccucugguggcuuaugugacugaguaaacuggagaaaaacuucagggugauucguugucccgugaucaaggaaucccauuauuuccaaaagcggguuagaagauguuuuuggaguagaguguggaagggaaagggaguauuggagauuguuuuuacacauaaucaugguaaucaugcuguguugacaaguuaguuuugaaugugccaccuucuuguuuuuauuucuagaaaaccuucauuuucaugaauuauuucuugagcugaugauaaagaugacuuuagagacaucuucuccccugguguauuccuuuagggaaacguuuuugaaaguguuucccuuuauuauaccuguaaggcuugggaccuuugucauggcauuguuuguuguuuuuuccguuuccuguuuugcacguguuaauuccugugggcauuuucuuuuuaaagugaugggauuuccacuguccagcagcaagccacauuuacuggaguuauugaacucuguaauaggaaaccugugggugaucaguuuuacccucccuagaagauacugcuucagucaaugagaauuacagccccaugacugagaauuuuaaagaagggguuccacuaagacacccagauguuuuguuucagguguugcaacaaaaucaacauuuguuugugggcagcgaagccaguguuccugccaguauucccguucagucgcuucucauauuucccuugcaaacuuucccauugguuggggucuguggagagauuucaguggcuggcugguggaaauguuugggagaacauuugcguaucaaagcaaccuaaauauuugcaaaaauguuugcuugagaaaaaagaauccacuuaggauuaggaaguaacugcuuaaacauuuuaaaagcauuugugauuucccuaaguauauuacucaugagccacugccuaaccugaauuucaggggucacucuggaaucuguauauuuaaaaacccuauaagauaauaaagguuuugcuuuaugauuaagaucugaauccauacauuaaaaugaaaaaacacuugacaagacaaaauauauuuuaagaauuguuuaucauuuagugaaccugcaaaacaaaagguguaaagaaagggccucaugaaaugguuggauguugaauaccucuaacgucauucuuucccucuacuguagauuuuuuguugguaaaacccaauuguauugcuaugauaugacauuccuucuguuggaguccauaagcuuucuuccagugguaaugauuugaaugucagaucuuuuucuugaguuuaauguaggcauuuucuguccacauuauuaaaguuucagcuacauuuuacugaugguuuggaaacaguauguguaaaacucaguguaggccaauuuuuccaauuuguuaacaagguaggaguugagcauugacaauuacuguacuuaaaagccccucggaucagguguuauuuuaccaucuggacauuuuaauuaguaauaaaaguguggaucuggauacacagaaauaggaucuacaguacacaauggcccaaugcacucuguuggugcugagguguauguggcuacauuuuauaaauauguauguaugugugugugugggcaaguguaauuaugugccagguguguccuuuuucaaacugggcacuaacacaacaccaaagaauuuggcuacuuuucuuagauaaaaaguaaaaauguauaaucuauaaacuugcacauaaguaaaacuguaucuuuuuaaugcuccuacuuccucaaguauggcaugacaaaauauaaugcugacauuuagguaggccugggcaaaagaugugacucuucucuuucauagcugugugcucuaaggcaaauaaauuaaccaccaaguaucccuuuuuucucauauucagaaugaaaguauaaaugauaauuguuaugguaucuaccuaacaggauuaugaggaagcucauuugagcauguauguugaaaagcacuuaaugaaauauaaggagucauaacaguucuuaacaauugauuguuaauacaggaugcagaugaccaauucauaccccacauaccaucuuuuauaauucaguaaaucaucucauauuuaaaaauaagggagaugcaaauauaauguuacauuagauuauuaacaaaugauaaguuuaagaccaccagaaaaaaauguguucauaaguuucaacauaaagcaaaaugacucauucuuauaaaguauauacaggcucauugacgcaauguuauccuuaauuaaggcaaaagcgaugcauuugagggaaauagugacccucuggagaaauagagaaugaaaauaguuuagggaaaugaaucuuaacaucuucucuuuuggaaaaauucaugcauguuucucuuaaucauuaugaauuucauguuugcaaaccagugugaauacuuaaacgauaaucauuauuguuuagaaucuaccuauuacuacacacacagauacacacacacacacacacacacacacacacacacacacacauuugcucaagaaaaucauccucaggaaguaaaggaguugauaaaauuaccauuggagcagaugaguuuggauacuucuacugaaagcuguuucaguuuuuauuauagguacaguucucccccgagaauucuuugggagaaauaaaaacauuuguuuuuaauuuaaaugagugguaacaugcuguagcauaauauuaacuauuucagugauuuuaucaauuuuaucuuccucugccuuaauguaauaaaugcauaucuugauuaaguacaaaucuuuacauuacguugucccuaaugacaaauauuauuuuaggcaacuuaguuuuaaucaucagagugucuuagggagcuuauaaaacuugucucugggacaugguauuagcaggauguacagaguuccuuuuuggugccaugcuaggaggagagacugacagagucaguccaguccauucauucauuugauagauaauaaguaaaccacagaagaaacgagaauaugucaguucugacuguacagguuuuaagauuuuuuagacuuaauauugaaaacuaguuuuacuuaauguucuaucaguuucauuuaaaugcccuaauccaaugaucacuuucauuuaaauauccuaaucuagugagcagauagggcuuacauagcauuugucuugaagacguuuuaaaaaugcagcugcagguccucaucuuugaaacuccauuugguaaaaauggccaugucuaccuuuaccuguagauuuaaguguccacagucgcgggaugagaaaagaaauugugacacuucuugaaaaauggucucaucaaagggauucaguugaaaaugugagggacugcauuuaaacuuugauaaaaaaaauaaguaauucuaaguaaagucuguagccaaacuccuuaauugugaugcauuugcugaguuccccucuuccgucgucgggccugcucugaugccauauggccuaccauggaacauuuaacuugucagauauaauggauuguccuggaagcagauuuuugcuuugagcacucggcuccuuucuugcauuucacucucagcuccaggcugcaggaugaaggauugugguagaagugcaaagaagagacacacaguugauuccccuuaagagagugaccuauaugccacaaaauuuuacccacguaaagaggcauuauccccgucacuggccuuagcaggcugcaugucaaagucauuuaaauuucccuggacuuaacagauuguguaaacauuucagaacugagagcuuaggaauaaugaaacaucgucauuuuaacuuaggcaaaaauggugcagccauauuggccaaaggaggcauauuauuuauugugaccuacauguaacguagaccaccugguuuuuagauucuauaaauuaaguucucucaaguuuaugaaggaugcuaaaaaauauauauauuaugauggaaauguuacuuggcuuuauuguuuuuguuucgugaauagagaggugagguugaaaugaucauuuaggaaucgcuucuuagccuuuuggcuaagaucaagugaaaugaucauuuagguggagggacaguggcagcuaauuauccuaccaggcuuucuagcuugaaacuuaggggcagaccuuccauucauucuaaccuauuugaaauuagagauuggauguguuauggacuauuuaauuuuuaucuguaaaaguaaauaauguagucuuuguucauuuuaauuuggugcuuuuaugaguuaauuuuuuuuucaauuugugcuauuguuucaacaagcuuggaaaacaguaggaacaauuugugacuuuugcaucuguaggaaaacuucuuuaaaagaauaaacagugcccuaccuauauguguguguacauacauagcugugagguacucuucugguauaaccuacuguaaaccccaaagcaaauauugugauauagagacacagaauagacaauuuacaaguaaucaaucaagcacaaaccagugggaaaauaaggaacuuauguaucucaauuuauucuuuaaaugcuacauauuugauugcuuuaggguugcaaaaguuaauuaauagauuuguauaagacacacagaaauauacauacacuaaaagagacuuugcuaaguguaauucaauauacucacaaaaauauguguuaauuauguuagaaauuuaauauuuaauuuaauuccauaaauccuugcauuacaaauaaguccucauacaggucagauagggcaauaaaaacuacuguggccuugaaaacugacagaagcucacuucuguacaaaucuuuuuaaugaacaacuuuccaucgagcagcuaagaaauaucuguuaaagucaguauuuaauacuaaaguguacuuauguauguuucuuacugauccuaaauugagcacguuaguuuuaucaaugccacucaucggcugacuguaccccuccucccccauacagauuuggugagacuuaguacuaaauaaguuuggggagugccuggccauagccggcucuuguuggggcaugugcgcccucugcuggcugcucacauaggaacugacuggugugugagguucuuucuuucuuuuacuuuucaagguuggguuuuuuuuguuuuuuguuuuguuucaauuuauuuuuauacaacugaucagauauuuaccaugauuauaaaguuguagcuuaauacugaguauggccguuaauuuguuuuuauuuggaaauaaaggugagguuuuguuuuggguguguuuuugguaaauagauaguccugauaguucaaauaacaugcaauguguguaauacucuugaguuuuuuaagugguugauuguauaucacgauuaaccauauuuucauugcuuucauauuccccuugccuugauuguauuugagaaguauucuuguuggacuaaguugggaauagaacuuaaaaggggauagauaagucauugaaauuuugaaauaugauuauuugucuguaauggaugugguagguaaucccuaguagaaaaauuccuguuaugguugguugauaguuuucacuugcuuugccaaggaaaaugaguauauuuacaucauaauacuuuauaaaagcauuuuugguuuccuugcaaaccaaauuaagcugugcucacuggcagacauugagaaugguaguuugaguaaaauauuuuuuguuuuguuuugcuuuugcaguugcuguuuauagaguaugagauguuaaaggaacaaaucacugauggucucuuuacucccaggacacaggacuaaacuauacaagggcaguuacagaggaagagugucagccucucuaccauugccuggguggagagcauccuuggguccugguagugaaggccagggcucuguguaaugagugugucuuuuaaaaauagcaacaauuuuuguugacaaggcuccaucaaagucuuuauaauaauuuaguuuguauaagugauuucuguguaucucugaaauuaaaugacuugauggagucaguuugguauuuguuguacagagaaggcaguuuagauuuuuauaguucuuuugucuuacauugcaaauuuuucuaauuuguaagcaaaagccauaaaaacuuccaaaccaaccguggagugaucaaagaacuuagagcuguggaagggcagaaaugucaucuacguuuuuuuuuucuuuucuuuucuuucaguuuuuccccuuugcaauuuuagguuccaguuaccuuaaaauuuguuuuggauaaaugauauaaauuuuuacuuaauagucuuuacuuacuuugauuuaacauugucaaauaacuaagaauugcauucuaacaaauauuaaguccuuauuaccucuguuagaaugucaucuugcaugaaaucucacauacaugucucuccuguuaccaccuugucuucaaugagguuguauugggugcucuuucuuggugcuucucuggguucccauuauaucccuuacugguggauagcauuguguuacuccugguauuuagucaucuaaacucuuaccuccuugagaauaaugugcauuguugacucucuugcauccagcacauguuacacagaaagcacccaacaaauauuaaauucccuauauuguguuuuuuaggccucauucaccacuauucagaugauaauuuuugcaaguuucaggauuaaaaauuguggucuguaaacauaguauauguaaugcauuuuauuuucuugcauacuuuuuauaggaugaggucauucuucuggcuacuccuugucugcuuucuuuuuucucuuuuuccucccucucauccuucccucugccucuccucuuccuuccugugcuccccaccuuccucucuugauugagucaugcuccuagauucagucauugagaggcuucucuuaaacacugcagcaugggaccauucaucuaccaaccuuccccuuccuugaacaauaacuagugcugcaggcugguuggacucuggggaguguggcccugcguaucuggcaguuugguuauuauuaugggcccauucucuugaaguugaucuugaagagcaggcuuggcuggaaaacaucauucuucuauaaauauaaugguuagcaaucuuccuacucuuugucuuccuuggaauguguuuucaauucugggcuguuccucccacuccccuccaguuucucucaguagugcauguuuaggggauauaggucaauuguauucagugcuaaggcuagagaaaugaucauuuaauauauuacagauacguauacaaauggcaguuggauuaucuucugucugggguuaaaaaugucacuuauauauguguguuuauguauguauuauacauaucuauauaccguauauaacauugucauguccccccccauucuuuugauguaguuuugaguaucauauccaauguguauaguuuaagagaugaacauuguuauauucuuguucacuguaaacuuagcuugaaaguuaaggccaucaccuguguaccauggugcuaaaauacauaauuuuucuauauagacaacuaagugccuauguagacuacucuauaacaaacaaaccuuuuccucucuuuuccaucucacuguggcuuauuuagaguuguaucauuuuuaucuuuuacauugacuguugcuaagacucugguggaacauucaguuaagugagcagcauauaauuuaugauuaaaagugauuuguguggugaaaugcggcugcugauuuccuucauauuuuccaauaaauuccaaaauauuuagccaggcaccaaagucuugcccagaugauguugucucuauuacauucagccagaaaugucacccaucuccuccaaugaaagggaaaggaccggauuuucucccucacuguggacuugucaugccuccacagaacguggacagagaagggguagaaggacccuuuuaaaugaacgaaccaggucagguucacuagaguuggauccuggauucuaaaggugacauccacucuugagauagaagagagaugcuuucagagcagcgggccagugggucugaucaaugaggagcaaccuuaacaaaacuccgggauucucauauuuugggauacuguuguuuauuaggggaaucgauuuggcaauguaaaaucgauuucuuaaaaaaaaaaaaaacagccuucauuauuggagaugagcacauuuaaaggccuagcacgcugccagagaaagguuucucuaacccaugaaauguaacugucugaaaugaccuuggggaucaacaaguccuugucuuuuaaaaaacucugcguaaauaggugagugcuaguaguaaucuacuuuuuguuaucuaccauguuaccaggucuauuggaguuuuagcuaauguaaccuauagagcugugccuaucacuuaaauugguugcuugucucccuagcuggucagaauaaccaguggaauuuuauuugcaagaaaaaaaaaucuguugggcaugguggcucaugccuguaauccuagcacuuugggaggcugaggcagguagaucacuugaggucgggaguucaagaccagccugaccaacauggugaaaccccaucucuacuaaaaauacaaaaauuagucggaugugguggcacaugcguguaaucccagcuacucgggaggcugaggcaggagaauugcuugaauccaagagauggagguugcagugagcugagacugcaugccacuguacuccagccugggcaacagagugagacucugucuuaaaaagaaaaaaauaaaaauaaaaagagagaaugccagacucuaccgaauucacguaccauggagaagagaacccaggaaucuguuuuuaggaaaagucuugcugauaauucuccugaucagcaagguuucuuagccaugaauugaauuugaggaaauugcuuuucuccacacucaccaucucaucacaagucuuccuucugccuaagaacauagugaaaauauuuuauuucugcgugcuuuugacaccuuuagcauguauugcaagaugagcuuuuuuucauuuuuauaugaaaaacuauuauguucuuuugaauaaaaaauaagcuuucaaaugcauaugcuguuuuuucuaagaccacacaaguccuuaauugccuugguuauauccaauuaucauagacucaaacugcaguaaaaauauaagauaggguaggcaucacugugaagauguuauucacauaaagccaaugguaaguuacucauuagaaguaaguugagugauuucaggguugcccuuaguccuucaggucucuaggggacccuuguacaaauugcugauucagaaaaucauuacuuuggugguucaagugguacuuuaguggccuuaaagaguuauuugacacaccuccccaaacagcuaaguuauccccaugauuauguugauuaauugcacacucuguggaauuaguguuauuuucaaugaaagauuuuccugcguucggaaaaucaagcauaaaacucaugugcuuuaauuugauaauguguguacuucuccuaagcaggaugccaagugaggggcugauuuugguuguuguugucugggccaugugaaaucaucuaggacaauauuuuuauucugcacugaaaagguaguuuuugauggacuguaggauguucacucaaaaugcuuaucgauucggacauuuucauccaucauggaacuugagaacucuuugacuuuaugaauugaguuuaaauuauuuggggagaggauuacgguagugagaaggcaaugguuguugcuacaguaggcacuaauaaugauacaucuagaaaacuccaaacggagguggcauauugugggaaagccuugguacuggaacuggaggucugugugcuaacuucaccacuucauaucugugcagccuuuuuaacuauaugagcugguuacccuuaauuuuagugacuucgucuauaaaaacauggacuaaaaugcccauuuaaugagcuuuuaggguguguugccuuaaauaauguaaguuaaauuugcaugcgagauagugcauuacaaauauaagugcucuauggagaauugaauauagaaucugaaauucuucacuuaggcagagcccugaagugaagacuuuugguggcaccuuaagauacuaucugggguuucaguacccacacuguguuaaaggcagcacaaugccuagaugagaugaggggaaucagugaugaaaugcagccaaaacuccccaauuuccagugggaucagagcuauaggccauuacugaguauucuauuuuuaggacuaaaagaacaucagcggaagagagaguuaaugccagucuuuuccagaaaaaaaugguuuacugcccauuuuucauuaucccuugauacauacaagcuaugugccuaguuaguuaccuuuucccccauuugucuuuauaggauuuccuagguuguuggaugacuaguuuauuugcuggaauggaguuguaauucuuuuagcacaaauuuauuuuacauuuagauuuuuaaaugacuguggaugaaggcagaguugucccuguaucguaagauucuguaggagagaaccaguacucuucucugaaauguuggaaauugaaagaauaaugucagcuucugcuuuuuuguaaacccagagucucaccuccaaacugggaucaggaguaaaguugacuagcuagucagaacaaugaagcuauaccugcauggccacagauuaccguaagacauauaagccaauagaaaccagcaaauuaaauagucaaaauguuuucauaucaauuuaaauaaaauaaaaauuuaauuuuugaaccuacaucauuuaucugauagaaaacuacaaauauauaguaaccugauauauucuuaguguuaaguuguaaauaauaguaguucugaaaggucaucagcucuuguauuaauagacacaaaaaagauggggacgggcauguaugcucaagucaguuuaggaaacauuguauaaaacuaaauugaaagccaaguacagugucucaugucugugaucccagcuccucuggagagcagugcagaagaauccuugagcauaggaguuagagagcaccuuggguaacauagugagaccccaucucauuaaaaaaaaagaaaacccugaauuaaaugucuuaacugcaguacuucucaagagucuuuaacaugcuagauacaauguaaaucuguuggggggcagggcaauagcuuguaacaguucguagauucuuuuaauuagucucccuuuugguuuuuggagcccguugugggaucacuauucuauagaugacacugagugaugcuggguuguccuguauuauaauuauauuuuuacuuuuacucuucuguacaucuuaauacaaagacauagucuucacauagagguguagaaaugcaguuuucugccauguuuuuguuaauuaguugcuuuguguuaaugugcggagaugguggcaguuuauuguaagaugucacagaauccauguguaucauuugugcagcuauaaaguaccuagagaccuuuuaggaauaaaacaccauguaaauguaaauuaucauugccuauaagacacuuucauuaauuucauaucaaauucaugaguguuuugagcucugggauuugagagucuucagugucgggccucuaguuuauuuauacuuuuuuuuuuuucccccagaguuuaaacaccagcagcauagcauagugcuaagagcacagucugggcaaacaaacugccaggguuugaauccuggcucugucacuuguaccuguguggcugugggcaauuuucuagaucucaguuuccucaucugcaaaaugguguuucuauuaccugccuuaugggguugugcagauugaaugaaucauuuuauguagagcuuugagcagugguuaauacaugauaaggacacagcuauucuuauuuggacagggaaggaaaaggcaggcauggaaacgaugaaggacuguaaauaauaaccucauguauguguucagaacuacuaaaaaguucaguuguuguuuaaugaacuaguccuuucuacauauauauagauucacaggguaaucagagauggaugggacuggggauggggacagaaauuuauucugagucaaacauguuuaugaugaguucccuagucugaugccagggaacaaaaggcucauucuucaguucccagaaugaggauuaacagugaaacagccuugcuugguguuguccugcagcaucagauaauuuuucaucaaggcguuucacgggaugauauauucucccauauagaugaaucuauuucagcggugggugaaacaccuaccauuuauauauaauuuuuaaaguggcauuuuacaaaugaaaggcuacacaaccaaacaugacccuguuauuauccuacuggucaaccacaagagggaucaucucuguuagagcuuaucucuagaaaucauuuuauugauaaguugcucgucugucucuagcucuuucuaggugguuuagaacugucauguguauccaggggcaguaaucuaccaaaggugauccuucuuagaaguaucccuaugaguggaauggauuuaugagaucauuuuuuucccuucauguaauauuuucauugucacccaguucccuuacaauaggauaccauggauguaucggaagaaaaauuggaagucaaauggcugauaauacaagaauauaaaaauauucaauuugaaauucuauagacauuuguuaaccauaucacccucaaauaaaaagcaaauuuuccugcuccuucuugggacagcaagauaaaagauuguugaauagaucagcaaaacauugacuuuuuuuuuuuuuuuuuuauauggaaguugcuugccuuuccugcucauauuaguuuuucugggccaggggaagcaagugaauccuuuauugauugccauuuggugccauuuuuaauaaucaaauuuaaauauaggcuuuagcagcggacggguucgauuuggacagaacacauguugacuuccuggacuguuugcucacuggagaugccgacuuguucuguagacggggcugcauguugaucuccuuugucuccagaaggauugauugacggauguugugucugcucauuuacagcguuuuccuuguuuaauuuaaaaaauugugacauaguauuacauguucccuuguauacaucauuuuugcagaagaaaguuguuuagccaauaugucgacuuaguuuaugaaauccucucuauagcuuucauucagcccuucguguacuccauuaggucauauucauuucaugcacggcaaaucgucaccagcagcaaaauuuaacauuugguccuuuuagguauaaaaaugaaucaaaugccugacaagauuuguuucugguauauauuucagaaucuccccccgccccccgcaccaaccccaucuuuaugggcauacaacaaauguuacuaacggguacuuuuaguuuuaaaaauauggacaacaguacuccaugcaguaaaagacuugagcgauuaaugcuacccuuaugccucuuuugaguaguuuuagccauggggcuuggcacugccaccauugucuuugugccaaaaaauauccgcagcggcugucgcauucuaguaccggaggguugucucgaaaauuccgcagugaacgcgccggguuuguucaucacugcuaucucuuuuaaauauuggaaaaauagaaucuuuagcucuuucaaagccccguugugguuguggggauggggggaggcggguggugaagaauggagaaaggaggaaagaggcuguccgcgccagccaguugguauaagugacaaaaauccaugccugacauagaguaaacacagauauuuaagagcuuuuguguucaugagcacagauaguuacuuaaggauccuacucaaacauguuaucagcgcucuugaaaauuuuauuaucugaaacaaauguuccaagugaauuuuaagcagaaaaucaacaucaagaccauagcuaauuuuuaauggauaauuuacacaaaagauaguuucuuuucuagaaacugagguguccuuuuaaaauggcugcuuuuagucuuuaaaaaaaaugauaggaaucgcgauuuuauguuugagaaggugcgugggcuuuauccacagugccugauuauuuugcucccaaacagggguucuggcucugagggcagauuuauaguugaauuggggaacaaaaagauguaauaaaguuaaaagcuuacacuaucagaaugaaauguguuuguucaugaucucuggaccgaucuauuugaugguaaaaguggaugcuacagaugaaaucuuuacaaggagcauaauccuuaaaaaaaaaaaaaaaaaaaaaaaguccaccucccagccuccugcuggcugugcugccucuuugguaccucgcagacuucgacagagcccuggacgggugcccauugaugucauggaaacacucaaauuacugagaaugauucaugucuaugcuggucucuuauccucccccacacaaacaggaguagauuuuuaacccugacaacuuguaauuugcaguggguuuauuuuuguaucuggauaaauauuuuuuaacaagcaaaauuaagauuaagcagucuguaucugauaugauaguaaagaaugcuggguuccauguagccaagaguacuuuggggacucugcagcgugaauucauauucuucuccuccuccucucccuccugccucuuucuuuuccuaccucuugcucuuugcauuccacucuuccucucuuuguuuuucuccuacuuauucucucucuccuuuuaaaauccugcccuuuuaucuuuaaaauaauggaaggaguagcccaacuuauaucuauaagugaggcaaauccuggcagaaagauuccucccuccuguucuguguguuggagucaaguugggaaauaaugcugaguggugaaauucuacaggggauagcuucaggaauuccuucuagagaaaaaaauagaugcuuuuucuuccuuaaacuguauuuuacaauuuggauuuuuagaaauuaccaaaacaggacacuagauguucaguuucuuaggaagucagagcagauucuacuuuauccaucuuucugucuuucugccugccuccuuaccugcccagcuuccugccugccuaucuaccuguuaaacaagugaauauuacaucaaaguaagugauguaauggugauauugaagcauucuuagaugcaagagcuuaaggaaggacacgcguccuuugauagcucaugaaggucgagccuuuucuguuaguaauauuuauagagagaaguuaaaggguauaaguagcuuaaauuugauguacacagaugaguaaauaugucuuugugaccauucacacugcugauacaaguauaaauuuaucuuuucuucagugcaaaauccucauacaauggaaguuauucuguuagaucuucuaagacugacagucugugcgauggugucuuguuucacugaaauugaaacugauauggggcauugauuuuauacuuugcgcugagcgcuagaccagaaauggggcggagguguuuucccaacuuuaagauucauuaaaaucaguagaaaaguuaauacugggaaacgggguuaauuuuaagacuuagguuuggcuuucuuugaaaaccaccauccauuuuauauauguaaugacuuggauacaggauacccuuuugaccacauagaaaaauuuauggauauaaauguaucaaagauacauucuuuguguggggucaggaaggcauacucuaauaacauugccauugccauugaccuaaaagauaaaaagacuacuguuacuuuuagcauucguguugaguugagaggggaaaacuuggggguuguaaacuucagaaggaaaucuauucagccucucaaaauacaaguuuagaguuuuccuguuggaaaaaggaauacuguaguccuauguaucaaguacaauuacuguaaagcuccagucuugacgaaagaaguauccuuuagacuugcgugggguggggucuuaggcaccugccugccucuuuuagccccuuuuaauguucugguauggacagauuucuacaaugauucuccacaugucacuaucuggacucuacugcuuagaucucuuguaaugugauuucauuauccucccuaaugauuauugggguuaaacuuuaaaaagaaacaaaugaacacccuugauuuuauucuuagauguggccgaauagcaucgaagggucuauagaucucuguagagcagucuacagauaaaaauuggguuguuagaauuggaacaagacauucacauuccaugaucccuuguccugcugggucuauugguggaaucugaacuuggguucagaguaggcaauuuuucaaaagcccuguuucccaaauguaaauuccaucaucaucuugaucaugaugggguucacuccugggaaagggaguuuuuaaaaaagagagagagagagagacucagaauuuugaauaguuucuuugcuaaauucaccaucuggagagccugugauugauuaguuuuggccucacuauuaagugucaauauaaucaaugggaauuacuaggcuagggucauuacauagauaauuugccugcuguguaaauaaaaaugaaauuguuuaaauuuugugcaagagaaagugaaaauaaggaguuacgauuuguuuguuagagaaaguggaggccauuggaaugacaguuuuuggaaguguggagcaguuuggcuaagaauaggaaugaaggauauuuuuuuccaguuuaucauagccagagugaggaaguguuauucccucucuugcuugcauacauugccaguagugccuacuuuacguauguaaacaucggggaagagcaguagaugucuguuaccuggaggagauuuuuuuuuaaggaaaaacacaauuuacacuuuuuugucguuucucuuggcagguaaaacagaaaggggcucauacucaucuuaugggagagaaucaaacuuacaggguugccaccagguaagugagaaucucuguugcggaaggguugagaggauuaaccugguaaaucaguuuguuuucuaaauuagaugaugcauuuuaaacugugacaccaaagaugcaccggcaagucagaugauggcucucucuuuaaguaaugaaauaacacagagcuuagaacuaauaaacaccucaucuuuagaucgcugcuguaucagaacuacauucaugggcuuguuuuuauuuuuuaauccaucagccgguaccaguggcacuguuugcaaaccagcaaugucggugaaagugguucuauuaaaagaguuuauuugcaauuaagaacuuaagaauuucuuacgcaggaaauacuucgcggagucaugugucagacccuggguuucggguggcuauugcccuaaauuauaguuuucauaggggcuguaugauguugugugaaaacaggguuguauugagggauaaaaaugucugugaaaauaugauuuguugucccuuuuuguuucugaauuguuuuuggcuggaagucaaggccagcaggcuaacagcaaagccgucucaagggaagcaugcgugagcuagaaaaauaagaguacuuuaauuaaauaauaaaaugccaguguaauacaaagguauagcauguguguguuugugucucugggcacuuugcauuuguauacuuuaaacucuccagagagagccuauuucuaaaaauacugucaauagcuaaaaguauaagcuuuguuucaagacaacugaguuuuuauagaugcuuucuuuuucaguucaguaucaguauuaaucauguauuuaaaaucuuuuuuaaaaauuuauacuuccuuuuuauaagugcauugguuucuuacuuuggaaaacucuugauggaauuuaauaauccucuuuaauauucagagcucucuacuguuuuuauuauucacgcaaacaaaauguacuuuuuuuuuuucaaaugcuggaaaggggaugcuuacucucuugaacucucucacccucugauguucuugaugggggaaaaaaaucuauuuuaauuuuauuuuaaacagcccauuuaauauaccccugaaaaauguaagcaaaguuuuguuuuuguaauuaaaucgagccuaugaggaaaguuuccuuuacguaccagacauaggaagguacgacuucugguggguugguguguuuguuuuuucccuguauauauuugcauuuuuaaaguuuacucccuuggcccagccaccaauucagucauauucggcaucugaaagauuuguugcauugaggugaacagugcuugguuaagagcuccugccggagugcaguucauggcaguuuguuuggaaagaauucugcaggaaagaaauuuacagccauuccagcgcaacggaaacaucuuuggaaugugagugcaaauguucgggcuagauagccugggcgacaagccucugagugcugugucucugguguaaagcucucaguuccugcagaagaccguguuccugugggucugguuucugagggucaaggcggaggucauuagaguuuuggggagaagaaaguugacaacauccuuccuuucugcagauggucauggcagaggucucuguuuucgcugggccccuuuuucuggucauugagagaauaggcuuccucaccccuguauccuuucuuacuaauaggaauuggcgugauuccucacagacacaaagauuuccucugcugaguaagcgugaggccccuuaacuugugaaagcaucauccagaccgugugagucugucuguguaugugcagaacacagacccuccuuucuccguuuguggggaauacuucccucgggugaaacugaaguuaauuuuuuuuuuuuuccaaacacaaggugagaaguggaaaggggcagaggguggaagagagguggauggauuggcaugugauggcugaauuucugggccuugggagguucguuuugaggcauuaauguccaggaaaauucuuuuguauauagcacuaugacugcauaugcuuuucuuaaaaagccuucguaauguagccguggaguguggagauuccuucauucuuaauuugugcuucaugguugugagucuugcaagagucuacuaucucugugcuuagcguggucgcagcaaucuccauaaacagugugauuacuuagggauaaauaaaagugaaauuuuggaaauuugcugacagagggaaaauagggacugaagaugaaaaauguacagaguaugaauuucugcuuucugugaaauuugagaauagaacagaccauagugugucuuccagugaaucaguuucucuugugccguauuguuauuugaaucccugucuacaacaucagcuaugcaaaccaaagagaaaggcaaaaucucaguaucuugggcuucaagucuaaauagcagaucacagcugaaaugauuccccacugugugacaaggugagugacucguggaggggaggcuuuuguuuucuucuguuuacuacaugauugagauacggaauaggaaaccuucagauggugugcccuaaggagcuccaaaagcugcuuuaucguauuauaacaguguauccuauggacuuaaaggggugagcagugcuauauggaaacaugcuucuuccagucucaauagccuuuuguuugguguagagacagaguggugguaagcaacagguagcaaagcgcuguccuggaggaauacauuauuauugugagacguguguuguuucagaaauauaucaaguuaaaaauagauauauauuuuagauuucuccuaaggauuuaacacuaauacugauggacauaugacgcuuuuuuaaauggauauauuuuagcagaagaaugaaagccggcagguucuuuauuagcaauuaaguuguuuucauuaaaaauaguaaugagauauuauuucauuaaugcauuuccaccugaaguuaucagaaauaaacauggugacuuuuugagacuuuuaaaauuguguugaaaaugaaucaauagauaagcaaaaguagccaaacgaacuuuuuugaguucuuacuaaauaugacaaaacuaauuuaaaucaaauugggguacagaaaucacacccagcuuaacauguucuugccaaaugguaaccucauacuccuuuuaacuggcagagaaaaugaaauuuauaauggaaagucugacagaaacgaaaaugagugggaauaaaguuuuuugcaagcuaguccaaccuuaauacuauaauagccaauaacuaaaacuuaaugggcaucauugcaaaugccagaagggaaaaaaugucauuuguuuugguuucuuuuugcugcuuugaauagaauguugggugauuugcaaacuuuuaaauuuugcuaaaaucuauuuuuuuaaugagaugaugauaucaaaacaaauacuuguuauuacuucuccccuuaaauggaaguuuagaguugauuaucaggaauuguuuguauuuucuuucugggauauagcccaggucuaaagccaugguuucauuuuuaguauugugugugugugugugugugugugugugugugugugugugugugugagagagagagagagagagagagagagauggggagagagagagagagagagaaagaaagcugccuaucugagaccaaucaaauuagaaucuugugagcugggccugugcuuuucugacaacuccccagguuauucuaaugugcagcuagguuuuaucauuuccuagaauguucuguagaaauauacccuguauuaaugacuuguguucaacauaugaccuugaaaaugcuuuuaggcuuuuugcauuaauuugauuauucaaggcauggaaauauauugcauaugaacuucauuuaaaaggcagugaaaauuagugauauagugaaaaucuucaaaucuuuauauagaauuccacaacugaaugucccagcccauaucuuguuuucucuagugaaguccaaggcuuuaaccucauccaaauucuuuuucuucuucagcaagugaucaaauaggacuuugcugauacaguuauuuaauguuuacaucuuaaaaugacuaauggaauuuaagaauuagaccuaaucuaggagguuguuguuaauuuccagaaacuuggagaccagggaggaaacauauuuucuuaguuugcccauaggcuugcucauuuuugguucaucgaaauuaagcauguaguugauuccaaaaugaauuucacauuucagaauugauuucuuugucuuguuauuuuuacuuuugauucaauagguauuacaaaugacuuaauucuaaacuuuuggccucuuuuaguuuuucuuaucuaaagucaaaauagaaaggauguaagugaaaaccguacaaaauuauuuuguuuauuacgaaauuggcaauugaggccaauuaggccuugcgcaagcagaaauacacaucgcuuuuuaauuuacuaagaugccuaaguguuuauccugaguguucagcacauccaucgaggucuuaugcauccuuccugggaagcucucccuugcagggccuuagcaccugucuucaucgugcuuuuuaaaauuugccaucauuuuuauguguuuguugcaugcugauuuccacaggauucuguaaacuccuggagggcagggaccaugucugcuuuauccugaauguguaccaugugccuagcagggcaaaaauugcaaugaccuaguguuucuuuccucagcaucacuuuuggaagccauuuugagggaguaaggucugaauagcaauguacaugaaccauauugugagcaucuuuuucaugccuacgaaaaccagaaaacugcacucucccaaaaaaguccuuuggaagcucuuccuucuaacaugcugugcaggcucuggaaggacaccaaagucauaccguggagagacacccacucugacuuuuugggggguugaaucgucucauucaccuggugacuucacuguucuaggccuguauaucuggaaaggccugaaugagggaauuauagaugaucugugguucuggcagagguguuguuggaaccaaaggucagcauccugguccgaacauugaaauguagcagugugaaugguaggacaggauauuuuaaauugugacaguuucagacaucacagggccugaguuugcaguauauaugucaucgcagcugugucccugagcgguauuuuucgggcagcggcuuauucauuuugggggauuguuauggguauauacccuucuuucaaaagucagccgguacuuaucaaaggggagaauggguccauucuuucauugcauugguuaagaaauacuuauugacccuguagugguguguuagauacucaggagaaaaaccaagggaucuuguauaccuucccuucuauccccaccagcagcuuccuggauguuaacggggaaaaucgagcucuauuuauuuauuuuuauuuuuaaccuuacauagcauaaauuuuugagcauccagaacaguugaaaaaauaauaaaaugaaugccacauaccugcuauuuagguuaaacaguuguuuguauuuguuauacaguauuuucuuguguguauguauaauauguauaagaauacauauuuuucagugaaccaaccauuuuaaguugcagauuuaauaagaaugcacccauagauuuuucaguacaugucucuuaaaaauaagacauuugccuaacuaacauacuguuauuaucccuaaagagauuaacaguaguuucuuaaucucaguccauauucagauuucuucaguuguccucaugcaaaugucuucaguagcuuucuuaaaaaaggcaacuaaaaugccauuuacgcgugucauuugauuucuaugucucuuuauaauuucuuuuaaacuagagcuguuccucuauuuguauucuuuuuuaaauuguguaauuuauuuuuuagggaugggguaucgcuauguugccaaggcuggacucaaacuucugggcuugggauuuucccaaguaauuuuuuuguugguuuguuugaaugauagugacuuuaaagagaccaggccaacuguccuauaaaacauuccccuuucuagaauuauuagauuucguuuccuuguggugcuguuuaauuuuguucaucacuuguuuugccuacaaauuuaaaauuaguucuaaagguuuaugcagguucagguuaaacauuuucggcuggaguacuucauugggggugcuguguauaucaaauuacauuccaacagaauauugagcuaugcugcuguugguaaugcuaacuuuaaucacuuggcaaaaguggugaccacuggauuguuccauuguaaaggaaucuuuccccaucugcaauuaacaaauagucuuuguauugauacuuuagcaauggacagauaccccuuuuucccaacaaccuuugaccuaauaguuuuagcacacauugaugacccuugccugaaucaguuauuucaacugaagacuucaaacuggugauucuuuuaaaauuccaucauuccuuccacauuuauagcuaguauucuucuauaaaagggcaguuucuuucaucauucauuuuaacacuaucaguuucauguuucauauuuuauauaagugucauaacaauuacuguuucuaauguuuccuuaccuggaggauguuggaagcauuaaaguauucuugaaaucucuuaagguauauugauaagaaaaguaguuauggcucaggcugauggucagagaggcuuuaauuguaagaggagggagguaauuguaggcauguuuccuuguaaacuaaacuucaguauucuuuuggugaaauuuggaaccuugcaacaaccucugugccccuagcuguguuucucugauucucauauugccacucuauaauugcuaguaaacaucucacaagguugaucaucaguaguugacuggccgacucgaggggguugcuguggugcucugugaagcugcgcuaucagggaucagcuaauaaucccugccucaguccuugcacaauccagacaugguugauagugaaugucaaaaugagugaauuucuaaaagauaguuugggcuuaaucuaaaggaagccugaguaacuaguauuaggugccaauauaaaucucugaguugguuaauauuauugucccuuaauaauuaagaaagggaugcucagagaaguaaagcaaguagaccucaaaucauuugcuucaaguaaguuucagagccagacucugaacucuaagauguuuuguuucaaagccagugcuuuccaacuuggguucccugcuacuuaagcccaugaaggaguuuuuaggcucagaaguccauauuaguucucaucuagaaaacccugucuggucgauuccaggcccacugggggaucugggccugacacaguaucuacaacagaguagcugcacucagcuccguucaggguuagcuagaacucugaacagucaguagggaaaggcauagcggagggcagaucgcaucguuccugacugcccagccuuaagggggggaaaaaaagauuauaugaauaaucuauucaguaacauccucagaauuagcaugugcaauuuccuuaaaaccaaugaggauuuccugugaaaaggcugggguggaauaugccaauucacauuuuagcaacagcgugaacacuuucuuaaaaauguauagauuauguuuuggcuuugcuuuuugugcaauguaggcagaauaugguuugcuauuauauaaauuuggauucauuauagaucacauuauuguuccaaaaacacaagagcuacauacagcgagauucugaaacaauaccuuuagcagguucuuaaauaugccccaauaauuuuucgauuauggcauuuagcccucaaguaaaauauaugaaacaacagaauaugugcuaggagcauaggcaaguuuuauacaacaacaguucaggcaguuagugcauaaaaagccauugaaauugcuuugagaugauuuaugagacaccgaagaaauggacuccuaguauccaaauugaaauuucaccagaaucaugggauuaacuucucuuuucuuaugaaaaccauuaagcguuuuuaaaauagcuucuagcaauuaggacuacaguucuucaucuuuauguuucugauagguguaaagacaaaggggaaaaaucaauuaaugacuaaagaaauaauugauuuaaugcugagguguaucugauauaauuuaauguugaaacguaucuacauaucauguagagaucaguguagcucuauagccuccuucuguaagaaaggcaguauacucaaaauucaacaucaggauaguguuucaaugugaaaugacagaaauauuuauugaacgucaugcuugauauuauuuuauuguugagagcuuuuuacugaaacucuuuaaaacugaacccccaaauuaaaauauuggcaacacugaaagauagcaacagaagccuguaaucugaaguaauggacuuauuaaggacuucagaaaaaaagacuuuagaaaagaagcauauaucguugagucugcugccgugccugauagugauaaccugcuuagaauugaagcaccccauucuuugaaaaauugugugcgcucuguggauauugacguggguuuguuuacaugugcuuucacucacagaucaacugagcuuccuaaagcauggaccuuucauguucagcguguuguuuucuaaucucauagaaguaguuucauagggaggagaaaacagaaaccgacaagaauauuucuuugcauuugccuuagcauuuccaacaugcaaauguugcuuuuuucauaguauggcacuuauuuuugucagacauuucuuguacuuaacaaagggcaaaguuacauuuuggcgggagagcgacuuucgcccggcacuucaccagaucucguugaauagaauauauuaucacuguuagcauucuuaggguucuuaaugaaagcuacauacccuuuaucuccauuuuccucuccuuuuagaagacaucuuccaaugaacaauuucuaugacuugaauaccagauauauguuauuuucaagcuaccucaaagccauguuuauaugcauuugcgacaauaacaauuccgugcuucggaauaauuauguaggaguaucauugagguuauuaggcaggacccacccucuagaguucuguacaugggggggucucuguguguugggguuuuacugugcaagcacacagaauauccugagcucauuuguaccaugauaaugaacagcagggcacugaaucuuuuuaguuuuauuggcauuguauacaguaaguuauuaaauuucaucucuguaauauaccugcaguaaaauaacaaaauauuggugcacuuaaagaacauguguguguggaacaaugcccuccccaucauuucagcccccugcaaacagcugcuuacagauuucaagauccauuguauguauucccucgagcccaccucuaauaaucgagacacaucugccauugcaguauuauaggcauauguaguuuuauugaaaacuauaccuguaaaaaaauuaaauaacuccugccucaauuaaauuggcaagcuaccuuuugcaaagaucauauugcagaccucuugagacccaagugaguucauuuuauucuuacauuacaaaucacuaaauauguuauuuuuauuuagcugaguagcuagcuuuccucguacuuugaugguaaguuacuuucauccauucucacuuuuguuuuccuucuccccucaucuuuacauauuaaaaaaauuaugcaaauugcaugaagcaaacauuuugagaaucugaacagaauaaaaucaaagggaaaggacccuaacaugcagcuuuaacucugaagugauuauuaaauaaauacaugcaaagguuacaaaauuggggucaaauuuauaacucacguuguggcuugugauuuuuacaaacuucuuugagauccauuugaucaucauaaugguagaauaggaaguaauaugaagaggaaaugaguuaguaggccauacaaagcauaugcagaugaauuccuauuggauuaaauaacuuaacacuuacucuuaagaaaauaauagauacgagaucucacucuaucacccaggcuggagugcaguggugcagucauagcucacugcaaccuugaacuccugggcucaagcaauccucccuccucagccuccugaguagcuaggacugcaggcauauaccaccauggcugguuaacuuuuuuauguuuuguagagccagggucucacguuguuguccaggcugucucaaauuccugacuucaagccauccuucuaccuagacuuuccaaaaugcugugauuauaggcaugagccacugcacccagccaacagucuuaauacuuguugaagauugagucaguaauagaugucugcaaaauaguuuuuuauccaaagaaggaauaagaguaaaauauuuaccgauauaaaaaugugagccuaaacuuauuuuaaguuauguaagguaucuguauaggucuucaugugaguuaaucaugccaauauauagugauuuaaccaagaagaauuuuuuugcuuuauauuuucauagaaaaaauccaaaaagacaaguugcccacuauaugggaaacauauauguguauauaucguauauaucugaauuauguaugucuauauauaugaaacacacacacacacuguuauaagacaguaagcagguuccuuaucuauaguuucuuaguuaaaaaaacaaaacaaaacaacauuuugugcuauucagaugaacuguguauaacuggaccgagggagugguuagaggugaauacugucccaaagugaacauagagucagaggaaagacucuguugaaagucagaaaguagaugauuucauaggaucaagucacggauaaauaugaggugaugacuguuauagagaagguagaaaaucgaaaaucaagcagugauauucuuuuuuuuuuuuuuuuuuugugggguuguuggggauugggucucuauguuguccaggugggacucaaaccccugggcugaaucagucuucccaccucagcccucugaguaguugggacuguagguacacaccaccaugccuggcuuguaguagcaguauugacaaccagucaggauagaaaauaguuacauguuuaaauaaagaauuuccuucuuugggccgggcaugauggcucaugccuguaaucccagcacuuugggaggccgagguggguggaucacuugaggacaggaguucgagaccagccugacgaacauggcgaaaugccaucucuacugaaaauacaaaaaguuagcuaggugugguggugcaugccuguaaucccagcuacucaggaggcugaggcacaagaauugcuugaaccugggaggcggagguugcagugagcccagaucacgccacugcacugcagccugggugacagagcgagacucugucucaaaaaaaaaaaaaaaaaaaaaaaaaagauuuuuuuuuuuucuuuuagaugaagucucacucugucgcccaggcugcagugcaguggcacaaucucugcucacugcaaccucugccuccuggguucaagcgaugcuccuguuucacccucccgaguaguugggauuacaggcgugugccaccugggcuggcuaaguuuuuuuuuaauauuuuuguagagacaggguuucaccauguuggccagacuggucucaaacuccugaccucaagugauccgcccaccucggccucccaaagugcugggauuacaggcaugaaccaccgcgccuggcagaauguucuucuuuuuugauaggaauguugauucaagucagugaguggucguuugguuccacuugggcuuaccugggcccaggagacucugcucacucuguguucucccaggguauuuugugccccacugcugguucacagagaugccagguuucacggaauggagggcugaguccuagagagggucaucacuuacaaguaagauaucaaacccuaagggaaucagaauuuaaagucuuagaaggguuucaguuuugucauauagaaaaauauugaaaauuaaaaaauauauauauuaugaauuguaaacaaacuuuuugaucaaaacucaugaaaguuggggaauacaccuuaacuugcacccugccacugcuuugaagucccaucccugggaugugguucacuccuguggaaauauauauuaucuauuacauuugaacugugaauuguguuugucacacugagcuaagcagcucagaacugucauguguagagugacugguacaauacaacaucaguggugguaaaagauuuguauggacaaugacauguggcaaagaagaaugucaacagcugccacugcuaugacaucgucccucaaggagucuuucugcaucucugccauguaacugucucagccaaagagaaggcacuaacaugaacuucuuccccagaaugcuacucccaacuagcgaccacguaagacucgcuugagucuuuuuugagggugcaaguccugggugccauuugucaccggaaagaacauuuaaguuuggaguuuuauguauagagggagggauuauucuuugauuuauuucgaaagaacauguucuuaauguccuuuugcagauaauacacacacccuaucaguuuuuggacuccagacugucuccauccauaugucauuaugaagcagguuuuuaucuuauuaugauuuagguaauuguacuagccucuaaaauuuuauaauguaccuuucagaagcucauagaugccaagaucagaggcuccuuuggaguuccaucuaauauaucuuccuuagccaacugguacagauaauuuuaucuuuccucuagauaguuacacauauagcucuagaaauaaaauguaguuauccuaaaucagcuguauagagccuuaaccagcaaucagaccauuuagaacauucaacaauaauacauucuaccaaacucugacuuucuguguucaguagauauuuauuaggaaacucacccugugucccacugaagauccucacaugcucucuagguagaugacuucagcuaauaguauaguaaccaugaggccuuaguauuuaugacuuuucuuuucuuucuuucuuuuuuuuuuuuuuuuuuuuuuuuaagagucaggguccugcuguguugcccaggcuggucuugaacucccggccagagugauccucccaccuuggccucccaaagugcugggauuauaggugugagccaccacaucuggaaguauuuaucacuuuccaaauucguauucuuacauguguuuggauuuauuuuucaagaagccagaguaaaauuuggcaauuaccaaauugugaguugagaaaaauagauaauucaccuuugguauugugcuuuugaauuugaauuccauugauuggauuucaguccgucgggauuaguucuuccaucugugucccuuggugugaugacugacucccagccaccaucugagacugcucggucucccucaucuccaaaaguccucaguuuccagaucucaucaauucugcuugcaagauaccaauaaaucugcugcugccuccuagacccccagucaccaccguggcugcccgugcugcucugaucccucuacccaccuucucccucacaugccuccuguccacugcugcuggagugacagucuccacaaaacauuguuccuuggcuuuggggccuguccuuagcauggugguauccuggccccuguuucugccugcagccucagccuucguacucaccauucacaucucauguuccagcccuacugagcugcuugcaguucccucaagaguucuuucacgguucucucugucuuuauaagaaccugaaauaccuuugccuugccuccccuucuucuugccuuacaucuguucuaccagcuaacucaccugcuuuguucaagauucagggacccuggauguuauaaccagggcagagcgagcugccucucuucugugcucaggaagccuuuggagcacuucuuuuuccucacagucaucacacugucuacagccagagaagggcaaaggcuaggggcaagggcuaggcuugccgucucuaucugcagugucuaacaggggcacccaggaagugcuuguuccagagucacaggauggaugagugaaugaaugaaugaacuagcaauaguaagaaauuguaugugagcauguaacuuacuauauuuaaauacuuccaugcaaauuucuugacuuaaauuaaccaugccaaugaccccugaggcuggauuuauuuauuuauuuauuuuuugagauggagucucgcucugucacccaggcugaagugcaguggugugaucucggcucacugcaaucccugccucccggguucaugccauucuucugccucagucucccgaguagcugggaccacaggcgcccaccaccaugcccggcuaauuuuuuuuuguauuuuuaguagagaugggguuucaccguguuagccaggauggucucaaucuccugaccucgugauccacccgccucggccucccaaagugcugagauuacagcugugagccacugugcccagccgaggcugggauuauuuuuaauccaguuuuauugauaaagaaacugagauuuagagagauuuguuuucacucugaaggcagagaugggacuggggaacaaacuccuuuggauccagauuuggcauuuucuuugucacuucuuuagcacuggauaaaguugguguagcuuugugucauagcaaguagcccacagagucuuuucauagaugguuccagcucucuauucauuauuaacuuagggaucauucauggaggcacuuaccuaguuaccaggcugagaccucugucugccaaugagaaaaaaugugcauuucuaaagaggauaugaagaaccuagcaaucuguauaucaggagcauugucuuuacauagacaaaaaagaauauuuugaauguuuccuguaaguaaguaccaguugcaauagcguggugcguaccgcccaugcuaucuauugcccaucagugguaccucuacucucugguuguggugaaaaggaccaugguccuccuggaaauuucuggcccugaagcucaggggagaagugcaacaccagccacaucucaucccccaaguuucauucuccuucacucucccugguacaacuuggcagaggauggggagaacugggaagaaguggaugcauugaguagaucaagcuuuuccucuucauguuuacuuuauaugauuuuaauuuuguaaccuuguuguaggacauaaaaaaugaaugacaguggacuuagcuuuuauuuauaacauugaaauccuuaaagauagaauguuagagucagaaaggaccuagacaucaucuggcauccagugccgcuuuguagcaaguggaaaacuaaagcucagagauguugagguuggucgucaucacacagcaagcagaccuugcucagacacagccacacaauacaaguaaaauuccuagccuguaacacggaaguuuuccuuugaugucuuuguacccgcuuucuuccaaagagcaaaaggucaccuagaccaugaaguaauagccagcagcagccggaaacacauccugaggaaauuucuagacgauugucccuuuguuaagcuaccauugaaucauacugucacagagccagagggugucguuugcuuguaaauacugaguuuuugaaaugucacuguaacacuggaaaaauguugucucugaagguugccaaagugacagaaucccgacauuguaaauaccagccaacacaagugcuuauaaaugacaggaauaaaauauacuugacuaaauccauaauaaucacugauaacacuguuuacccucagugaccaggagcugugaacuuggauaaaaagcacaugugugcagauaucauuaauaugucugagccucuagccauuccagaauauuuugauggaaaagcucccuaaauauguaaaagcuuugcaauaacuaagaagcuaguguguaagguagggugucagucgucccugaugaaacuagagagagccuugacuaucuucagcccccagaggacugauaaggccucccuuguucugguuagacccaaacucugagccaggcuacuagggcaggcaaugcuguauuuucaguagaugugauucucagaaggcccauuugccagaagcaugagcccacaccuauaucauguuccauggagaaaauguggaaugaacuuagagauuaaaaacuuuggagccauaagugggaggaucccaugaacuacccuuugacuuucaaaggguggauggguggucagaccuuuccacaguccuaauacucuauagcccaggcuuuuucuuaauaauaacuuccuccucucuagaaaugauucucucccucuuuuuucuguucuaguguaaaaauggugccuguguguauccgagucuuuaagaggaaauggacacauuggcaaaccagugccuccuuuggcucugugauguggcugcuguuacuacucaacuggagcaccccuuauauuccagucuccccagaaaugcucaggaacaguggagacucaaugacagaggguugagcccuccugguuuuucaacuggugaaagagaaauucagaugguuaaggagauagcagaguagccagcacuccgggagcugcucuuaucucugcuaugaggcugugcauggggaagaguagggcugcuuggaaugaccuccuuacuuuucauauauugaaacauauuucuuuuuccuugauaugcuccuguauuguuugaauuuuauuuuauuuuauuuuuugugguaagcauuguuuucuuaauuaacaaugaaagguuguagucaauaaacuaguacuugaugagauuugagaaaaacuacaaaacuguagauugcaaguuggcauuugaccaagaaauuaugauugugcuccuuggauuuuuaugcuuaggaaagagugcacaagagggaaaaagcuuucggucagaagauacccauucuaguacuagcuggaauggugguaaagaauacgaaauggucugaauguccauggcugugugauauuggcguauuuugcuguccaugggucuaaguggaugguauuauagcuuugaaagagucauggcaaaggagggaacaggugugucccaaacccuaaugaacucagcagauuggccuggcauucuggcaauguagucauucagcggagccguggggacucccuggguggggacccagcaugcuucuggagguaccugggaggcgcugggaguagggccugcuguacugguuugacuaaugugguguagguguugauguuggagaguugguggccagucucaggcucuguucuggcacuacuccagcuuguuggucaugaaugcagauugagauugaauggcuccuuacauuucccuugaagaaaggcagcuuugucuuccaggaaugagcugauggcaguggccguguggacauucugcagcuuuggcacccaguagcgauggccugauugccuugaaacugggagccucuagggcccugagaacuugagcagggcuggacaagccuuggagcagaacuuugcugugaauucuuucauugacucgcaaaagaugaaggacucuaaucccugauaucuaccuuuccacuugaccuuuuuagucuucaguggucuuuuagaaguaauuuuaccuggccgcgguggcucaugccuauaauccuagaacuuugggaggccuaggcgggcagaucaccugaggccaggaguucgagaccggccuggccagcauagugaaaccccaucucuacuaaaaauacaaaauuagcagggugugguggcucacgccuauaauccuaguuacucgggaugcugaggcaggagaaucacuugaaccugggaggcagaggcugaagugagccaagaucgugcauugcacuccagccugggugacaagagagaaaccaucuaacaaaaaaaguuauuuuaugaaaaacauuuggagguuuucuuuuggguauggcaggcagauuggccucuuauuuggcauaggugaagaagaagaguugaauaaaaguaguuggggcauagaauggccaugcaaguucccaacuaaaucagggucaaguuuaaauguauuuguauuuuguucaaauucaucuuuaucuaaaacaggcugaugcuguuuugucucugugcugcagguggauagccacaaauuugacucuauaguuaccaguuaucccccugccaccccuuguuuuucuuccugauuucucuacuuccaaucagcugcucuuuuagaaaccaauagagaagugagacggggugggggcagaggaagagagaaaggggguaagggggagggagaaagaggaaagagagguuguuuuuugucauuagugaguaaaaaucugucgggcucggguaguuucuuagugaauucagcauuuagugauuagauuagagggguauauuugagcugaagauuuugggaacucaccuuucugcucuacagaaucccuagguuucuccuuuagcucuacuuucugauucauuccauccccauccacugaccccaccgccaauauugagguacuugugaaagcucagaaucuccaguguccucaaggagcuagccccaaagugcccccugguggcuagaggagaaaaagacaagauggaggaugggaaaaaggucagguggauggauaacuuuggcucuucuuuuggcucuucuuuucugauaguauuuuuguuaacagcaucuaauggguugucuucuuucaguaucaaugugaaccagcucugaauagguuaguguaucaauguauuucccuuuuugggugauuuugcugcagggauuucuuucccuaugccaguuuuuguuggucugauuuuuguuucuaggcauauugcauugaccugagccuucucacaguacugaugacacuggggguagggagaacaggagcaguugaagacgacacaugcugucaccucaugugcuggugugaguggcgcagggaagggcugugauuuuuuauaggcacacugauuagccaagcacuugucaccuccacugccgcucauuggccuacugagugugagcgugccaucuaauugacagcugucuguugucagagggccaucuuuucuccuuuucaguuugagugaacacaacagagacaucugcagagcucucugcagcucugacaagguugcccugccugccaacccucagacuucuaggcagcauaauugaagagaucagaaaagaauauuaacccguugaccaucuugggcugagguguaaugaccaaaaagucacuuuuuaaggugacugugagucuuucuuaguagaggaagacaugagauucucugucagaagagucaggccaguaggaagugcuauuucuugguagugauuguucgugggguuucaguucaucugagcacuuggaagaggaugagaaguucauuuucaagguagacccaguguuucauggugggguuacacugaagccugaaugcugggucacaucauucaugucugauuuggcuuguguaaugacaguagugcuuuggauguguguaguuuggaugaggguuacucuuuuucuuuuaccgccaggccugacacugcccuuuuagcguaagauuccagaaucucuuaugcaguagcauggaauguauggccaaccccguaguaacguggacugccucuuugggacauuuccuguaagccagagauaucaagguggacuuugugauggguagauuguuuauuauacagauaucagcuugggaauuugaauguuuaauuauuugccuugucguagugucuucaaaugaagcucuauuugagcaucuacugggauugguacaauaugcagacaagcuggcuuugugugggucgagucaccugugcuugcaggaugggggugcuugcuauauuuggaagugauuuagugguauccuagguuuaucaggaggaaaauacaucuuugcauuuauuugaacauuugauuuagaaagggacaguguguggguauuggauaaauugcuuuuacucuuucuuugcuuugcauuguucuccccucugaugauuugcaacuuagcaagccuucaucauugaaccugggugaaaaagaagaucugagaagccuugaguaauuuguuucagacuguuuauacucuaguguuuuacagaugugggcuuauuugaggaauaguauuggcgaaagguagcgucauuaaacugguuggagaaauuucaggcaaguagauagagaaauuucaggcaacuccuuuuccaaguuguugcucacagauuauaauagaugaauucagcagaauguucugaccuccuagacuaggucagauaacugaguucuuguccuaacucaaauccuaaguagcuguuucuuaaagcucuguucugccucugcagaaugaaggcuuggccuauauaguguaugagauuccuucuagcuucaggguuuuguaacuaucagaauagguaaugaggaaggagacuaugcccugguagccuuuagccauaucacaaauauuuaacauacucccaaaauagcacauacaagacagaaauucuuuguacuugaagggaauaauaaauacagaaagcauuugagaaguacacauuuaauuucuguuaacucuuuuuuucuuauuuauguuuauuauuagaugauaaaugacuuccuuuuuuuuaguauuaaaacaaggugaucaggauagugagaggauugggucaggugaaacacaugacucaccugcgugcuuaugauuccccuuggaagaugguuuuggguaacauucugggaaaacuauggauaaagucauaggcuuccauauuuaauuaauucuaagacuuuuuuuucacauuucaacaucucagaaauuuaugguaugccaauucaauuggcaacuuuuuuccucucuugguaggaaauagauaaugauguuuuugacauucaguggcaucuuauaggugaugaaauacaauucugaggggaggaagcaagauuuuuuuuuuuuuaacugagaaaggcuacgugacuaagugacuucuuuguuucaaugcugacuaaagcugugauguccuuuuuaaucacuuugaaagauucaaauugcuuuaggaagacaauucaugcauggagcucacccucccagaacuccacacuuaaugcccacugaggaaggagagaaaugcaugcaaauauauaucccaauauagaaggaauauucuaguucaguaacuuccacuccugagcuuuuaucaaauuuuucucuauagaauuauuuuuguuuuauuguauccaaaaugucagauaucuuuuucaaggaaggucaagggacuuugccauuuucuaagccagaaguauucucaccuaguccaguacuagucaaaguuuuuaguaaaucacuuagaauuuccuuuuuuaaaaaaaaaaaaaaacccuucuagaguuuguugauaccuuaaagaucaucaaauccagcuccuuauuucacaaaugaguaaaaagaagacauaaguugcuuguucagaguucagcuaggaacuagauagaaccuggguagccugacgcucccauucuugcugcuaaauuccaugcaauguaaugaaagcgggauugaguauaaaaccgauacucuacacaucuuuuguugauauuucugagggagaaacuugaauuucuguaagugcacauagcugguuucccuuugcuuuguauuucugaaugcuacacuugucuucugccuacuacacuuaaauucauaggugauuucacaaggcacagaagcccaacuugucacaugugguuuaauauaugccacacuuuaugcugcaguagcaccauuuggucauauuuagugaacucugugguuguugagaaugccaaagcagcaggcucagcuauugcagcauaggccuguacuuaguuagcaagcuuagcuuaaaagcugucagugcagcuaauguuacaguggcuuacugagaccuuggccugguugugauaguucuccaaaccuggguguuuucaccuuugaaauaugaaucuggauuuagcuuuuucuuagaaaacagcaacaacaacaaaauggugaaaucuuuaagcucguuaaugugaaugcaguaagaauguaaauuuaauacauauucacuuauuauuaaaugcuguuguaaauaacauuuuuagauuuaauaaugauuucccaagacauuucgugcuauucuuuacuuugaaacugauggggugagaagagaguugaaucuuaauuauuauuuuuuaguuaauuaacaugugauuuaaaaaaaucgagauauauuuuguguuagacccuaauuagaaaagaugucaagaauaacauaaugcuaacuuaauuuuaaaauugauaaaugagggcaagaugauuggaaaguauccucuagaucacacaggaaacggguuaauauucaaaugaauagcucugaaacgcuacuuuccuaccagcuccugaagcaauuuaguuuuuaagaccuaaaacugacucacaaucugugguaugaaggauagauguuaauaguuuaaauauuuaggcauugcgugggcuguuuguuaaaccauugguagcuugagauugaccacagugggaguguuuucaccaugcgaaugagcaucccugcucacaguggggcaugagcauagcacugcaggauacggaacugacauuuauuacauaccugacauuuccguuacucuuuuauuuaucguuuugggcugcuuguuuguguccuauccccacuccccaaauucauauguugaaaccuuaauccccagugggaugguguuaggaggugaagccuuugggagaugauugggugaugaggguggaccuccgaugaaggaauuaauguccuuauaagaagaggaagacacacuggggccugucagcggugggggacgaggggaggguuagcauuaggagaaauaccggauguagaugacggguugaugggugcagcaaaacaccauggcacguguauacccauguaacaaaccugcacauucugcacauguaucccagaacuuuaaaguauaauuuaaaaaaaaaaagaaaaguaaaggaagagagcuagccagccuucucucuucuccaugugaggauaccacgagaagauggucaucuguaaaucagaaagaggacccucgugguggcucacaccuguaauccaagcacuuugggagguugagguaggaggaucaguugagcccaggaguuucgagaccagccugagcaacacgaugaaacccugucucuacugaaaaaaagaaaacaaaauuagccagauguggugacacauaccucuguaguccuagugacccaggagguuaaggugagaggaucagcugagcccggaaagucgaggcugcagugagccaugaucaugccacugcacuccagccugggcaauagacugagacccucucucuccccaaccccuccagaaagaggaucuugucuggaauccagccauucugguccugaucuuagaauucuagccuccggaacuguuagaaguaaaugcuuguuguuuaggcuacccagucuuucguauuuuguuauagcagcuaaauugacuuagacaucauuaauuauguauuuuaaguccuguguuuuagcauucuggaaugagagcauugaaaaugaucaucaagccgaguaaauuaacugaauuaacuauuccaccaaaaaaaaccccaaaaacugaaauguucguuguuccuggggaauggcuaugcacuuggaggcugguccccuuccucccuccucuucuuccuggugaauccccugacuuuucucaaucaggcuuucugauguggaggcuuccucugcuucccagggacacacucccuucccagggcuccuggagcugcugcaucucugcuacccugagauguaauucuugccugagauuucagcuccuccccuacacuucagaggcuucaguggacuauuucuuauucaucugugcaggcacauuguccaauguacaaccugcucaaugggcuuguugaguuaauaaacuacucuguguucuguauuauguggauuuagauguuuugcuucuuuuucagccuuccuuucgcacccuccaccuacccgaccccugcuaagaugcuaccuuuuaaagaaaagaaauaaguucuucacacuuuucuacauuuauaauucaauauaaauaacugcuacugguauacuuaaucacaauuagauuaaauauguucuuugaaacagggaggucaucuaaugaauagaagugaaauaugucagaaaaugucacauaacugagagugugacaucuuuaguaaauagaauguugagaugauuuuagugcuaggcuaguuuuguaagagacaucuuauuugacaccuuuguucaaacaacuuuugugguucucaaacuagccucuauugaaaagaccaaguucccuacgucuucucuuugaacacuuucuucuuugcauuaaccuguucuugcuagugcguccaaguguggaaagcaaagauuaguuuuaaaucuuccgggucaaaacuguuuuggcuuuuuucuagagcugauaauaaguaguauaguuuucuguguaccauguguaagagaagagaaaaggucugacuuuauguuagauaauccauaauucgguugcucugucccacuauauggagaccaaagucacacuaaauggaugccuuggguaggggagaaggauguagccuuucaaucagacuucuuagcugcacuagucacauggcuagccuggggcagguauuuaaacuugcuauaccuaagucuccucaucuauuaauugacauuaauaucagcaccuucuucauaggguuuguaaggauugaauaauuuaauguauguaagacacuuagaagagugucuuaaauaaugugagcaccuucuucauuaacauuagcacauauuucauaugauuuugugaggauuaaauaauuuaauguauguaagacacuuauaagaguguguuaaauuacagacugugcucaguaaauguugucuaauauuauuuuuaaacugaugguuauuagccaagcuauaccauaucuucaacuuugggugcacaagagugggcaguaucuuugaagaggucguuguuucucaaucugugggucaaguauucuuagggaaacuuuucauuuugguccaacucauaacuuuagugacauuagucuuugcaauuuccugcugagaagagaagguagccuuucuauuuuuuuuaaguuuucaaagccuaauuuuauauuaaaagaaaacaagguauuaaaaccacguauuucuuuuaacuuauuaaaaggaaauaacacaguaacauuaauaaaaaguuacaaaauggcacaguaacauuaauaaaauguuacauugucuuuuuauucuauagcgugaauggaagaaauaaaguaacuuuucuagagcuacaaaguaguuaaugguggcaaagauucacucucuggcaaugugucuuguuucacaaaguaauacaaguucaacacaguauagaauugccuuugauuucaaaugguaacagcauuuauuggauuauuuuuguagauguucaaugccacaaguaaaaugaaguuuucucuuuaaaaggaugauagauguggcagacccaucacugggucccuggacagugguaacaugaugggguuuaaaguccuuuuugaaauagccagguuaaucugcauaaaggcuauggugcuucauuaagcuuuuugaaaacuuucugggguaggccaaguggcuauuuguaucaguuaaacguaaguacaacuacuuaaaauaacauuucuucccacuugugcuugagucugggucuauauuuuuccugauaauaacaggauaaaaugaaucauuugauuccauauuccaagaaaaacguguccauuagguagaggaagcucuuagaaauuaucuccaagaguggcuuguuuuguaccugucauauuuauuauaagguaaagggagauguagacuggugggggugaugguaguaaauugaaaugaguugccagcuguguugcccaggcuggucuugaacuccugggcucaagccaucccaccagagaagguucuuaaaccuuuugcuuuccauugggcaucuuuaucuacauuuuaccucaucaagcucaucaagugaaucagacgcuuugacucagucauaacauguugauggagagucacuuaguuggaaaauauagacaagaagaugggcucugggaagaacugguagguaggcaauggcucugaaaguguggggcccugguuuacaguguaaugacacccaccauuuagugccucagccauuauucaagugugcugugccuuuccuacuggccacguuaaugagaggguggagauagcaaguuccugcugaaauuuucacaggaaagcuaagcccuuaaaugauguuuugaaggaaugguuucucuaccaucuguaaaaaaggcuugauuaauuauuuugguggcagaaacuauaugcugugcuucagguuaaacagcaggaacauauugagguucuugggaagaguuuuccuacagccaucaaauagguguccacacagguuaaccggacugugcaauaagaaugugggacauuggcaugccagugugaagucuggaaaagucggaugugauauaugcaaguggaagagaacugaaacuaugaagagucauuuggaaagccccaguugugaguuugugauaguugagaaauggcaccuccucuuugcauacuuagguuugagcaggaaacaaagaagugacuugaagucauguuaugaaaagaagaauuggguuggaggucagacucuggauucuagaccugauucugaguuaacuaacauuuuagccuaguuucaggcacuccccaguggcccaaugagccaccccuucuugcaggccucaaaaugcacugugauaaaacugcauaguauuuucuuuuccuuauuuucauguucuaagaaauauuauuguccgggcacgguggcuuacaccuguaaucccagcacuuuaggaggccgaggcaggcagaucucuucagcccaagaguucaagaccagccugggcaacauggugagacccugucucuaauaaaaauagaaaaagacaaaacccugguguggugaugcaugccuguggucugagcuacucaggaggcugaagugggaggaucccuugagcccuggggguggagguugcagugagcugagaucccgccgcugcauucaagacugagugacagagugaaacccugucuaaaaaaaaaaaaaaaaaaaaaaggagaagaaaauauaauaaaaauaauacauggauacuuucuuaaaauaucagacacuugagaauguugaguaaaauauaaaaggacuuaaucuggagaucauugccuuaguuauaacauagaaccuuucuacuuaggagaauuucccucucuccuacucccuauuuguaaaaauuuucuuuuguggcuucagucaaguuucauacuuuuaaauguuuuuguuaauuuuauucuuuguguuuuuuuccuaaacuguauuuuuguuccauuaugauuuuuucauugguuagcugagguauaggaaaguugucuuuuuuauugucuguuaaucuuauaacccguaacuccagaacuuucuuacuagccucugguaguuuuuuuuaguuguuuaagauuuuuuaggaagaaaaucauuggcaaauauugggaguguugucucuuaaagugucuuucuguuauauuuuccuugugcuaguacauuggcaaagacuuacaggagaguguuaagagaauaguggaauacaggucagcuucgcauuuuguugacuugagcaaagaaucuucuaguguuucauuauuaaauaaguuuucuguaggcaucuaguagauuaagaaaacuuucuuaugauccaccacuucuuaaaaugaauguguguguucaaacuaaagagauauauguauauaguagaaauauauguguaugcuugugugcauguguguguauaaacuuuaaaucauccucucaaaauuccugaaguaaaagucuauuuuguuguuuuauguggaauuuuauuuuauuuaaauuuuuauauuuauauauuuuauuuaaaauuuucaugaaauggccaagcaggguuuaauauaaaauggaaacaggguuuaucucagaaauuugguggcuaaauuccuuguaucccgucuuaucuagggauguuguuuguuucaagguucuaccuugagaggagccugucauuuucuuuuuugugugcugcuuugccuaguugacaucuuggcuuuaugugcuccuguugaaugcauugggaaauuuucuuucuucuuucuauguccugaaauagcuuauauaagaggggaauuuuugauauuugggggaaauugcaugggacuuuuuuuuuuuuuuuuuuuuuuuuagacagggccucacucuauccucaaaacuggaauggagugcaguggugugaucauggcucacugcagucucuaccaccugaguagcugagacuauaggcacaugccaccaaucccacuaauuuuuguauuuuuuuguggaggcggaguuucgccauguugcucaugcuggucuugaacuccuggacuuagccaucugccugccuuagccucccaaacugcugggauuacaaaugugagccaccgcgccuggcaagacuaguacuucagaacuggauuuuuuacuaauuuuuccauuucuguuucuuuguguuucaauugugauaguuuuuguuauccuagaaaacauccauuuuccagacuuuaaaauuugcuacauaaaauuauacauacuuucucuuguuuuaaaaaacuccuuaucuauuuagcaaauauauuuuguaauuauguugauuucuguuuucucucuucuuguuuuuccuuacacuugccagagguuuguguguuuucuuugguuuuuuuuuucaaguaccuucuuuugguuucauugauaaucuacauuuuguuuuaucuaaauuuaguaaauuuuaaauuuuauuaauucaucauauuuaaauauguugcacuuuuucuagcuuuuuauauuguauguuuuguucauuuaauuuuuauuuuuacaucuugcaauuuaaggccauuauuuuucauugguuacagcuuuggcugcaucccuuagauuuucuuauauacagcuaucacuaucauuuauuuguguauuguuuuaaauguuauuuugcauucuuguguaguucaagaguuacuuaaaacacuguuuucacagucccacuuuaauaaaauguuuuucauguuggcagugcuacuguuuuguuuuuacuauuuaauuuuauugcauucugaguggggaaauggcauggauauuuccuacuuuggggguaaucuaguaggauuuuuaaaaaugcuuaguuuuuuuuaagcauuucauaugcauuugaaaauaaugaauacuauuucccuauuuuauuauuauuauuauuauuuuugagauggagucucacucugucacucagguuggaguguaguggcacgaucucagcucagugcaaccuccggcucccgguuucaagcaaucuucccaccucagccucccaaguagcugggaucacaagcaugugccaccaaccuggcuacauuuuguuuuuuuuaguagagauggaguuucaucauuuuggccagccuggucuugaauuccugaccucaacugaucuucccaccucagccucccaaacugcugggauuacaggcgugagccacugcacccggccuauuuucccuauuuuaauauauuaaaccuuuuauuacuuauuguccuucuaauugauuuaaauuucugagagauauuuguucuagucuucuacuuugauuauggauuuaccaaccgcucaggguauuuauauuuuaaaaaauauaucucaaagcuguaucauaaaugauuagaaguucaggaauauuuuauauuuuugguggacuauagguuucaucaguaugaaauauccaacuuuuuucuuuuuuuacauuuuugccuuagauuggcuuucaauguauaguaauguucucuacaugcuuuauuuuuguagauuuuauauuacauauuuuuuauauauuuuuauuuuucauagucucuguguuuuauuuuugaugguuuguuauacacagcauuuagcuuuacauuuuucuagccuaaugugacagccacuguaacuuaguugaggaauauaauauccaaauaaacauaguuuaauuuucuuuuuuuccuuggcuugaucacauuuccuuuguuuuauauuuuuugcugcuuaaaaaaaggucuuuuuuuuucuaauggugcaggaauuauacaucuuauuucuugugaaaguuauucuugccuuucuaacucacauauuucaaauuauauaucucuauuaaagucuaaaucuguuuggugucuguaucuuuccuaaaaaagaugacggagaguguuagcacauuuuuaauuacugaguuucucccuuuguuccuccccuuuaccucucauguugagguugauauguuuccuuuuugacguuuuaaauugcaucaacagucacauagagucuacuagcguuuccuugccccaucuugcuaauuuuuguggaccauguuguucuggguuuuuuuggguugauuugucauuauacaguuauauauccuuauguaauuuuuuucagaaguguggggguauaaauuuucagagucuuugcauuuucuaaauugccuguaguuagcucaccuuuuugaaggcaaguuuggcuacauauaaaauuugaguuuuaaagucuuguauccccuuuuucugucacauuuuuguucuggcuugccuugcagcucuaaauguagcaccccaauuaaucacccgauuauugcaucacacuccacuccagcuccauguauguauugacccugggauuggagcauccuagauuuagcuguuucuuugcagucuucuugauuggcugcugcuuuuuggcuugugauuuauuuauuuuuccucuguagagcaaauccaucuacuuuuaucuuuaagaauaauucaaaauuguuauuccaccgaagcuacucuuccuuauuuucuggcacuauuuggcauguauaucucuucuaaauucacacacacacauacacacacacccaguaucauuuaugacauaugagguuagaggaaaaguagaagcuuauguuuaaucuaccaucccaagccaaccccuuuauauggaacuuuacacauucuaaaugcuuucaaauacaguaccuuauaaggaaggagaugcuauuauucuccuuuuauaaauuagaaaacugagagguuauaagucauuuuauuuauuuauucuuucauuuauuucuccauuaauccauuggcuaaauuugcaucaucugcuauguauaagcagcccucagugccagagacacaaaaccccagcuuccaggaccucacagcugagaguggaagcaaguggguaacaauagagacuugugacaauaauuucagcauaggguggauuucaguuccaugcauguuugagacacgugcuaggugcagaggaaccuggggagaggcgucucuaugucagacuucccaguggaaguguugaggaguguuucccagcggaaguguugucauugauuaaaauccaugcuguaaauguaggcaugaguugacugcugugcucuugguaucuaguaaaguuccuggucccugguuggcacuuaaaaaaaaauaagugaaugaacaaacaaagcuuccuuggcucucaccgaagcacuccuuuuguacuaacauaugugauagucuccacaggcaugauuucuuuauuucuccaagcaucucuuugaguagguacagugaaugucuccuguccacaaaugaaggggccaaggcuguggggaguuaagugucuugucuaaggaggcuuggaucccagguuccucugacucccgacaggcaagacuccuacuggcccuauggcccccucauccagauuauuuuagccucuuuuuucaaacucuuuccugcccucugaucauguuucuaccaagaccaaguaucacaaacuaaugaagagguauaacuggcugccuccuggaggagguauuaagaagcauacaguggccaaaguggaggaggaauaaaaauaccuccagagaccucaauaauaccaaaauagcuagucacaccauauaugucuaagcuuugauacagccuuucuacaugacauguucauuuggaauuauauuagacauucagguuugaaucagggcaggucacuugaaaugucucaauucaaugcaaaaguuauaagaaaaauaacauuuccccccacacaaguauauagcauaguauaaaacauucucaaaaacuuuguaaaggaaacacauuuuacaguuuaacucauaccuacuucacuuccuucucccucuccuguucucuguucauuauuucccuacuuacuaacuggcucuuaguuaauauuuucguggccucacccccacaccuuuuuaguuggucucuuuuuugugcaaauugauuuuauuccuaucuaaggagaugcuuucauccuuuuuuucaugcuuugaggccucauuagaucacugcacucuaauuuugggggggagaguugucauuugcacuauauguacagucugagcauccuaaaguucuuguucugagaaaaacaucgccauggugagcggcccauuuugaauuaggaggacuggcuaaggugcucacuuaagcucuuuguaguuuuguucagucaauugaguguuucuauguuacaucuaucugucuauaugucugucuaucuaucuaucuaucuaucuaucuaucuaucuaucuaucuaucuaucaucugucuaucuaucuacauaccuaccuaccuaccuauguacugagcccaggcuggagcaguggugcaaucagagcuuaccguccccuugaccucccagacucaagugauccucucaccucagccuccuaaguagcugggaccacaggugugcaccaccauaccuggcuaauuuuuuuucuauuuuauuuucuguagagacugagucuugcugugcugcuuaggcugcuuucaaacuccugggcucaagcgauccuccugccucagccccgcaaagugccgggauuacaggcaugagccauugcgcccggccuucucuuuuuaacguaauauugagauuggggucagacugugcugguuguggguaaagcuauugcagccuuccagcuaugaaggccugcccuccacgaugggauggccaggcugguaccugagacuaguguuggaggcaguggcagcuucccuuugaucuauugcagaaugcauuuucaaacacacacacacacacacacacaaauaaaacucugauguucacuuuuuaauugaaagcuaaaaaugcccagcuccuuucugcagauugacaagcugauauuucagcaguagcuaaagaacccgguuuaguaagcuacugaauuuugacguuuauaaacauuuaaugaauacauuuuuauuuaugucagcuuaaaaaauacagcugcugauaucugcgccccccaacaacuuuuuuugucuuaaugccaaaauuagaauauuuaaauauuuuaaaauuuccugaugagcaccugugcaggugugagggcagcaugaauucacagggagaguguaugaaguugguuaucuugaugugcuuguggggaauguguauuuccuugcaaggacugucaugugcuaccugauccucuuucauggaccucagccacuuucgccucuaacuugaaaaggaaacuggcauuguggcacaggggccaaagggacacauuuguagccuuguccucaaaucaagugggacuucugguucuuucucugaccaucugcuugaccuucagucuggugucuccaaggagugugucucuauggcaguuuaaaaaauucuguuacacugagaaagagacaaaauguaaaucuuaaaggaaucaguagauuuuuaaccccacugcugguguugagaagacaguuugagucuuaaucucuuuccuuaaguuucaaaacauguaggauuuauguuauugacaugucaaacuuuuuguacuuauucauuagggaagguuucaauacacacaaaaauagaguauuauaagaugcgcuacuauguauucauuauccaguuucaacagacgucaccauuuucccagucuuuuguuauauaguauccccuucacuuuauguuccugaaauauuuuaaggcaaagccuugacagcauauuauuucaccuauaaauauuucagaagcaucucuaacaaauaagcccccuccuuuguuuuacauagccauggugccauaucacagcuagcaagacuauuaggaauucuuaauagcauuaagaacugacguuccucaguugucucacaaaugccuuuuuacagcuggcauguuugaaucagaauccaaaccagguucacacguugcauuugauuaucaugacuuugaagucuucuuaaaaucuacaacauggccagucucccucuuuuuaaauauuuaaacuggguccauuuuccuguagaaagcccacauuauggauuuggcuuauugcuucuuuguggugucauacaccauguucaucuguucuccauacuuccuguaagcugauacuugcauuuagggcaagcuugucuaacccauggcccacaggacacaugcggcccaacacaaauuugaaaacuuucuuaaaacacuguguuuuuuguuuuuuuguuuuuuuuaagaagaccaaguuuguuugcaguguaugaaugucuaggugaggcuggguuaauggggagaaugagacuaacauaacaucuauaacucucaugacuuuuuguuauuguuguuguuuguuuuguuuuuggagacagagccucccucugucacccaggcuggagugcaguggcgcaaucucagcucacugcaaccuccgccuccuggguucaagugauucuccugucucagccucccaaguagcugggauuacaggcacgugccaccaugcuaauuuuuguauuuuuaguagagucgggguuucuccauguuggccaggcuggucucgaauuccugaccucaggugacccacccgccuuggccucccacagugcugggauuacaggcaugagccaccgcgcccggcugaaaacacuaugagguuuuuucauggguaaucuuggauauguuauuugcuucauucaagaaguaguauguggccauucauuucucaagaugcuuagauuguucagugaguucaugugcugcccaccagaucucccuaauacagaguuuuacauugucuuucaccuguuuguuuuaggaucuauugaugauuauuucauuggagguugcaaaauagccauaaguaaauugguuuaaugaagcuucuucucccuacuaaaucuuaucuagaguuuaacuaucuauuaaucauucauuuuugcacauuuuuacagcuuuugugggguauuuuacauucuuucuucuguuugaauauagagggugccuugcaaacuucacucauuucacuagaagaggcaacuguuuaaauccuacucuucuaauauauuuccugguucauguuuuccugcacauucauaaaugaggaggacguugauuugucaguuaucuucagugcuuagaauaguugcugaaaugugacaagaauguuuauggaagaaauuaccuuauagguuguacauguccucuaaagacaucauaggcacuccuacauugcauuggugaaggggccaccaaacagcagaauccugcaacuugguugaacuaugaaaauguucuugauacauuauaauuuccucaaccccuuuagccaguauuggccauucaggcaaaggaauagaauuuccaagacuuguacuguauguuugcagaaggagggaggauggcagauagguuuguguguguugggauggagaaaguaugcaaauaagcuaauuaauaucaauuguuuuuauaucuauauuacacauacacacacucgcauacacauaagcacacauaauuaaucacacccaugagcacauguacacagcuggucuacaccagauugcccugacaauuuuagagcugugugcugaaaaauuuuagaggaauuuggcuuugaaugugcaacacguauuacagagcaaagaucaccuuggguccuaagggagaugacuuucaucucuaccaugugaguaaaaccugggugauugaaccauaaauuauuuuggguauauagaacuuucuucaaauaacacuuaaaauuaaauguccagguaagugauuuucaaaucagaacaaccaaaauuguuaauaguuaugaucaugcuuauauacguauggaaauguauauguauauggaaauauggaaauuuguguauaagcaugcucugcaguaaaucaaaaaaugaccauggagcaaacauaugaaaaugcucaccagcaaugaaaaaaaugacccuauggcaaacaauaaaguaaaaugcuacacugucuuccuguagaggaccuacuagguuuggacaaacuggcugugcucaaauacaugugccaaaauugagcaggcugggugcaaauauucuaagggaauugaaagacacuuuuucgugaaauagguuuagguguugacauuaucucuaaaaguaauuaaaagaugauugauguaguaaauuuucuuuuaagccaugccuuuaagcacauuguaggaaaaggacuguuaaacaccacauuuucuuauuuagaacccuuggggccauagguauuucacaauuuaagaaucauuugcauuuuaugaaguuaauaugguguauauaacauguccuguguaacucuccagugaagucugaaacagccgcaauguauauauagauuauuauuucuauagcaaaacauaugaauagauacaccuaguaagacaaaaacaaaaauuauagauacguagauauucucacauuaguucagguuuugucacaaaguacagcuuucaaaccuucuggaauuuuucaauugagggaaagauugugaaccuucaaaugaacaaauaaauaaauaucuaccuuuucugaagaaaaacaaaagccaaauaacaaauaaaucaagaaucacuuuucaugguuuuuaaaccccucaaauaaaugucuuccuucuuucaguucauagaagauuuagaauuauaaaauaaagaaggccuauccacauggucuauauaugucuuauauaucuauaucuauaucuauaucuauaucuauaucuauaucuauaucuauaucuauaucuauaaacaauuuuagaauuagcucgucccacacaaaaauaguuuuuuuguuguuguuguuuuuuguuuugcuuuuuuugggauggaguuuugcucuuguuguccaggcuggagugcaauggcacuaucucagcucagugcaaccucugccuuccgaguucaagcgauucuccugccucacccuccucaguagcuggaauaacaggcgugcaucauuaauuuuuuuauauuuuuaguagagaugggguuucacuauguuggccaggcuggucuugaacuccugaccucaggugguccacucaccuuggccucccaaagugcugggaucauaggcaugagccacugugcccagccaaaacuuuagauuuuuauccuguuugugccucaaagccuauucaguugaaaggcugaugggcucgcucugagguccauuguuggcugggggagagcauuagggagcugacuuuuggcagaugaggaaaacagcaugaucacugcuuuugccacucugcuuuguggaauugacccacucugaaguuguucucacucgacagcaaugcaggcauuuauccagugcuucuacaagaaauaauuugggcaaaagcaguaaggaaguaagccuuaacagaaaagugggacccagcaauaggagaaucuacacaucugcuaagcccagccaucauauauauauguguguguguguguauauauauauauauauacacacacauauauauacacacacacacacacauauauauacacacacacacacacacauauauauauauauauauauauauauauauauauauuuuggagauggagucucacacuguugccuaggcugaagugcaguggcaugaucucggcucacugcaaccuccaccucccgaguucaagcaauucuccucccucagccucuugaguagguggcacuacaggugcaugccaccacaccguuaauuuuuuguauuuuuaguagagacagaguuucaccguauuaggauggucucgaucuccugaccuugugaucugccugccucaguucccaaagugcugggauuagaggcaugagccaccaugcccagcccuuauauauuuuuaaugugcauuaguaaauuauaaauaaugacagucuccauguggaaaaugaaaaucaacuuagcuuauacauuuuuaaaaaucagucaaguggucuugucucauauacauagaccuugaaagauuuguuuucaguacauucuguagaaggcucuugaauaucugauagacuccccuggcagcuuucaccuggugugugcaugcacagauauaaucaccuuagucuuuauccugcaguaaacaaaguucaagagagauuucugaaaugaagauaaucuucauucugccuuuugccgcuaccuaaaguucccuuggaggacucugugaaguuacucagguuauauuuuuuauaacaaauauaaaccacagaauuugccagaaugagaaauauucugaugaacaucaugauuugacugaggauggaggaauuguagggaaugguuaaacuugaagauacuuuuuagaaaaacaggucaugugcuacagaagcuacuuuuaaaaacaugcuuuuucauuaaauguaaauuuaccacauuauuuuauauaucuucauuaauuuaauaaaacuccugcuaggcuuuuguaaauuuucacagauauaauguuaccauaggcaucuaugcacauguauuuuuguacacuuguccaauauuauccauagaguuaaaauuuuuaacuugaaacuucuaagucagaaggcauaugcuuuuaauauucugcaguacauuuuaacuugccuuccagaaaguuuauaccagauuacauucccauuagcuauauaugaaagugaacuuccucacuggcaguugaaaauuugucuuauuuuaauuugccagauagcuugucauauauuuauugccaaauuucaaauucauuccuuuuauaaaggaaugguucauguucuuccccagucuauuuaguuuuauucuuauuacaauguaagagcuuuucauuuauuaggaguaucuucucauuaaauauuuguuaagaaagauuuuuguucaacuuuguaugguuuggauaauguuuucauuuauuuuuauuuauuuauuuauuuauuuagagacagagugucgcucuguuucccaggcuggagugcaguggcaagaucuugguucacugcaaacuucgccucccagguucaggcgauucuucugccucagccucucuaauagcugggauuacaggugugcacuaccacgccugguuaauuuuuguauuuuuaguagagacaugggguuucgccguguuggccaggauggucuucaacuccuaaccucaaaugauccaccugccucggccucccaaagugcugagauuacaggcaugagcuacuacgcccagcuggguaauguuuugaaaaacgaguauguagucugggucccaauauguucuaauuuuucuagcucuaaugucauagcuaacaaaggccaucucuacuuaauugcuuguacuuuauucucaggcuuuuauguuuuaaccuuugcauuuaaacauauuuuaguaugaagugugaagcaaaaacguaaauuuuuccccuuaaaugcuaaacaaacuuuaguuaccauuuauugaauaauuuaucauuuucucauugauuuuuuuuucaaugacagccucgccauaaaucuuucuguaauauuuccugaucuggcagcagccgcacauugcuuuaauuuacuuuguuuaaaauguauauauucucaacuuacaucuuuguaaaaauuuucuuaacuauuaucaugcauuaauauuccagauaagcuuuagaauuugugucuucucuacccuauccauuuuucucucuuuggaauuuguuugaauuugcauuaaagucuccuuuaauuuugagucauccaaucacauuuaugcaaauacuuuccugggaaauauuugugugaaaagauuuucuuuuaaaaauugauauacaagauuauuucggucuuuuagaaguguuuauacugcugaauccuuucaugauuuuuguuaaacuggcuugugaacuaguucagcaagucagugucguaugcugaauaucuaaauauauuuauaaugagaaauauaagaaaacauaauaagaauauuucugucuuacauccguggagagaaaauagaauauuuauaaaugcaaaugcucuacaauuacucuaaggaaacuuaaagaucacaguccuauucuaacucuguaaaguuauuugcuuguuuguuauuuuaacagcaucuuucucauaagcauuuaaggcugguuauaauguuuugugugugaauauugaguaaaccaaaugauuggaggcccguuauuuuuacaaagauuuuauggaauaagcaaguucggaauggauuucgaaaaagagacagucccuguuucaguguggaagggacauuggaguccaaaggucagggucagauacauguuuucuucuuuuuuuuuuuccuuccuuccuuccuuccuuccuuccuuccuuccuuccuucuuuccuuccuuccuuccuuccuuccuuccuuccuuccuuccuuccuuccuuccucuuuuuuuuuuguuuuuguuuuuggagacaaagucucauucuguugcccaggcuggagugcaguggugcgaucauaacucaccgcagccuccaacuccugaacucuugggcucaagugauucucccaccuuggccucugaaaaugcugggauuacaggcaugagccauuacaccuggccauuuucuuuugacuagagcugaaguucugaaacuagcagucauuggagauaagacaggagaagacaguugggaggcuccaagcaugugauuucaggaaaagcaugaguugauuauugagaauuucagaugugagauuuccaggaacagugugaguccagaagauguaagaaagaucaguggaauucacacaguuugguuauucaugcaucuucgaauauuuuucagauaaucucggguggauacuucaguuauuucugccucagcccaccuuauuuguaaagcaguauuaguagaauccccuccuugagggguucuucauauuaaauaaguugcauagccaacagccugaggcauaccaaacacuguauagauauuugcuguuauuuguaugauugcugccuuuuacugaguggcauccugggcuggugcuugggacucaacagugaggacauucccucccacaucugccuguaaugccaaggccuugugauagggaguggccugaagcccgggguagaggaguggaccuccccagcauagcuggggaaggagucucaaggagaugacauuugaccaguccucaugguuguuugcaaguggcuucucugcuguggaaugggaagaaagggucuuccaggaagagggguuagccuuuguaaaagugcagagaaacguuuguaugagcaagagaguaauuagggaaccgugagcaauuccaugugacucugacuauagguaggcugcagggaagggaagagacagaugaggacugucuuccuagugccuagaacaguggcuggcccauaguagguauucggugcaucuuaguggagaaaugugugaaagaggaaagagagggcugggagguagacuacuacuagauuggcuauggguggagcugggggcucagcauuuucaagcucugaaguuuggucuccuugaaggaacaggagcagcucuggauuuuagaaggccaauucuguccacagugcaccaguguucuaggugagguuggaugauggggagagggaagucugaagauagcauccauaaaucucaugacauuucuaucccagcagugcaaucaaauguugagaauauguccuguagcuuucuuuuagaaaagggguuagcaggccaggugugguggcucaggccuguaaucccagcacuuugggaggccagcgcggguggaucacgaggucaagagauugaaaucaucauggccaacauggugaaacccuaucucaacuaaaaauacaaaaauuagcugggcaugguggcaugcaccuguagcccagcuacucgggaggcugaggcaggagagucgcuugaaccugggaguuggagguugcagugagccaagauugcgccacugcacuccagccugguggcagagugagacuucucucaaaaaaaaaaaaaaaaggguggggggcgggcaaauuauggcuuaaggccaaauccaaccaacagcuucuuuuuauaaauaaaauuuuacuggaacacugucugaccuguuuauuuacauauuauguaugguugauuuagcguaacaauggcagaguuggguguuuucaacagagaccacauggccagcaaugacuaaaauauuuucuaucugguccuucaagaaaaauguuuggugaccucaguguuagaagauuguuuuuagguauuuaauggugccauucuggaaaaguuggcauuguuggaagaguucaaauugaugcauguguagccuaagaaaaauggggccauaucacuuccuaugaagaaacacaccaaaauuuuaauucaauucuuaaguuguugucuugauuaucuaaguucugucucuagucuccuauggcuauuuuuguggcuuugacccuagcugacccagccuauugucaguaguuaagaagguagauuccaagugcucaaugucauguuaagacuuccuugcuaccuacuaagggaagucauuuuuuuagccagcuguuuuaaguucuccuaaccuauuucauaugcuauguucccacaauaaccauucccuucucuugccauuucuuuguccucucuccugcaauguuucuucuacugaaagaauacggcacuacugaaucuguuucuccugggcagggcuugcauuaucccaccuguuccaaauucuuuuuagaaccgggcccuuugggugaaugaugaaccauuuaauagccccauguacuauagaaauuuaaccauuuucaaccaaaccugucauagauaagaacaaagguaagccaucaugugucuagaaaaacauacaacugauuuccucacagacauuacaaguucuuacucuucaaauguacuuuaaaggacugagaguguaauuaggaaucagcagaaguuuuguggaaaagaggcauugagccuuuugcauauuaaggaucaaauuuuauguuuuguaugaagcauucaugaggugauguucuuaaaaaccacuccagaggcacaggaggaacgcugaggacaagacugaauauagagauggaggaauuacgugucuacuggguagagauggagaaggcauauuuauacuagggaugguugaaaucaugcaagcaucuuccauagcuaauaaauuauuuuauccaguuggccuuuacugagggcauacuguguaccggggcccacccuguuggaugccaggaauacaaagaugaucagaguucacuuucugcgcuugaggaucccacagauuagaaaggaggaaaaagaguuacuuuccauacaaggcuauaaauguuacaacaguugaauuuuucagaugaaguggaaggaaacgucuagaaggaagaggacugaaaugaaagaagacugggggaaaagaaauaauaauaaacaaaaagaaaaauaauuugaaacuuuuuagagaagaugauugaccccauuguggagaucaagauuaaagaugaauggcaggcagcuguggagagcagagguggagauauugggaggaucagacuaaagaacugaaauuucaguuguccaagcgggcaugcuguucuacagccucacaugucuugggccuauuagaaauauauauaaucuaucuaugcaugacuuauauaccauacaucacaucauuucuuccaaacuuacauuauaauauaacacauucuguauuaguauauaguaagauuuuaaaauguacaacauauuuaaauauacuccuuacaauuaagccucaguaagugcuaggaacuuugcuaagcacuuuguauuaucuaacugaauucuuaccauggguaggcacucuuauacaacauuucccaggcaaggaguuuugcccaccaagguuagacagauuguccaggauuauccaggggguaaguggcacucacaccagggcuugucugacccuacuuaauuagaugggcuccuaugaaguaaauuuuaggauaagcucuugacuuaaaaaugagccuucuaaugguugugggagagggagaaaaaacaaguuuacagaagauagcgggugaguguggagcagagaacuagcauaggcuuugaagucaagccuaacugaauucccagcuuggcuccacugcuugccagccacauggcauuggucaggucacauaaccacucugaauguccccaucuguacauugggguuuguagcaucugccuuguuagcauguaaaggaucugcaccugugccuggcacuuagcagacacugugacuuguagcugcugcugcuccugcuauaccuaccguccuugccacucuucuuauauucacauccacccauccuccuccucauacuacuauuacuaccuaugcuaauacuauggugguuaugaugagcagcaguaguaguuggaaugccucaaagauaagauuuaugcuaaaaaacagaagcacaguaguuauuuaagaccucgauuugaucaauagcauuaguucugcauuuacuucaauauuuagugagcaugugccauggcaggucucugcgccaggcacuguagaaaguuaaaacaugaagaagucauuuccucuuuuagcugccauauccucuaguuugaccuuuacgccauauacucuuggucagauauucaagaaagaaucuugggagggaaagaguuagugcucaucgagugcagacuggcuugaagcugugcauagcuuuggaaggaaugucaggacuuaaauaauuucaggaugaguugaagauuacauugagcauuuacuacuucuccagauaaucucaauuuccgcccaucaugugauggaggugucaccuuauuuacagguucagauuguuagcgggacacuuuguuauagugauaucuuacagaguuggccauuaggcuauaauugagccuuuauguggggugcuggguaggccacaugacccugguuccuguuuccagggaggccaaccuacauaaaaauggcugucauauaucguugcucagaggggcagauauuuacaacaaccuugaaauggaacuuccacccaauaugaugaagacugacuugugacaguuugauaugccuuuauuuugcuaaaauagcaaccuggccaaauauauuuuucagcacauuuauuauagcuacuuguuuauauuuauagcaaaaguguugcuaauucccuaguauguuaacaggucauauucaaauuguucuauuuuuacuuuggcacaaaauugcugaaggaaacauuuuuaaggcaaguagugauuauagcauaucaacucacuacauagugaauuauauauuaaaugaacuuccugaacugagaaggagcuuaaacugacaaagaagauaguuuucuuaaauucuguauuguuuacauaagauuucuucaaauccauuuuuuauuauagguuacugauugucucaauguuuucuuuuugcuaaauuucuaccuucccgccaacaaauauaaucccccuuuuaauauauaauagaugaccugggauuccagaauggauuuucagaaaccaucaaaaaaccuccucgcuuuaguguauacaauaaauaauauauucuuuuuuaaaaauaugagagucaaauagguauaugcguaaaccuggccaacccuugggcaguuguaauuuccauaccaaaaugcaugagucuuuacuugacuguuacucuguuauacauuaaguacuaguuaccauggcaaccuuugcaucacauuaugacauuuaaauauaaggugguguguuuccuuauaaggaaagacaauguauuugaauuuuugaguguuuggugaaauacaaucacuacuaaaauaaauaauuuuguuuaaggcaauugauuucuuugggaauuacguacauuuccaaccaaaccuauggagugcauucauuuauuuuuauuuuuuugugaugucauggagaaguaaaagauuuuuuuuaaaacaacgcuugauaaguauaacauaauaauucauuaaaugccuauaauuacccucguaaguggcaaaacacaaaauugaaccauauuugagguuauuuaucagugaccaauacuguagcaagaguucgaauguaacaucacaagauuuaugaaauucuaucgcauauaacacauuucuuauuuuuguauaucuaguugguuaacuguaacuaguuuugaucuuaccuauaguugaauuaacaguagcaguuugcucaugcgugcaaaagcaaaauuaaaggagccacugaacucauccuuguggcauuuccaggaacauggccacuuaaauuuaauuaugaagauuguugggcaauuucuuuauuaaauauggaaaaaaccuagucauuucuuguugccaguguagcucuaggccauaaggcuaucaucuuuguuauguagacucccauauauaacucauuuuuaacuuuuuauaguaacuuuuccaaauuauuaucacagcuuguacuuuuuaaucugaaaauagagaaucuaaugaucacucauaacuuuuggugcaucuuuucaauaauaaucaguggauuguaauaugggacuguuuugugugggacauaagaaagagguaagcucugugcuggacccuggcucugcggaacauuuuacauauguuguuucaucuauuccugauaacccuaugauagagcucuuauuagucccuuuuuacacgggaagaaaguaugguuuagagcaguugcauaacucacccccaaauacauugucuguauuucuuugagcuaagguucaaccagauuggucugaccuuaaagcccucccucuuuccuuaauagauuugacuucuacuucugacuuguuacagacacaaugugcaugauauguuuaauguagaaauaaaaaacacugacaaaaaaccuuuaaaaauguuugcuaaauaauaauuucaguaauuuguauuucucugcagcacagcaguuuuuuaagucccugauuugcaagauaucuuggucuuuguaaguuacccaaguccucuuuuguugaaaccaagcauaggacagaaauaaaaauaaauuauaaagguguacucuuggaccuucaggaaucaggaaagaagacuguccaaagacugaccuucaauuuugagcuuugaaguucaaaaguggacagguggaaauacuguguucuucauugcccuuuggugcgagauauauucuagguugcagaguaagugccaacagcagcaaaauuaucgccccccuccugcuacuguaguaagucagcaauggcccuucuguggucagaauggcacauucagcagcaacuauucgacagggauuuacagaaacuuccccauggcuguuaggaaucuuauucagcagugucuuugaaaacccgauucugugcagaauuagcuauguagaaaugaccuagguugugauaaaagguauuuuaaacaaaucuaacuuguaauuucacucaauguguauuuugcauuuaaugccacaaagucugguagauaccuacacauauauuuugcauucauaaguuuuauagugguucagaauuuuuuuccauauuaacauuuuaaaaaauccuggcuuuauagagucaguucaccauacaaagccacuauacaucacuuagguuugugaugaaagaauggaauugcagcugugugaguacuagaauacccaaacaugaauuagacucacaagcauuuggcaauaguucagaaaaagagcuuaaucugguuucaucugagacugcuuuucucuguucugcaacauccccccaagauguugugucugauaccggaucacaacguaaugggagugacgcagaaucgagaaagcccugagaaaccaggggcacauuugcuuuucuccagagauuuucuuucuccuacuucuuuuuuccccucuuccaguuuccaacucugaaauucaaggucauucaccuauuagaugcauuaauuauaagccaaaaaagcaguauucaucguacucugaucucagucauaucuauaauuaaguguaaauauaaucuuccuuuuuagaaauguaccacccacccauuacauuuaaagugcugacugaaaugaaauaauaguucagagcaagaugauuuuaguuuaacuagaaaaaaguugauaauuuaagcuucaagcagugaguucuauuuuugauuaccauucaguuauaaaucuaauuugagauauaugcugcuuuucuguuacucaaguuuaauucaugguuugcuuucuugguuguauaagcaaaguucagugguugaucaaggcuguuaagaagcuccccugaaaaggaaugggggcaggguugagaauguguucgaaagacauucugagaccuauaucugauguaaaacaaacaaauccgauguaaaacaaacaacaaaauuuuaauugaaaaagacacucacagagugcuguauuuggggauuugaauggccaaguuaggaauggccauuugcaggggaauuggcugcagagggugaaccccaaaacauuccaaccugguugauaaagucaguguguuuuauucuuugguuacaguauuuuaggucuuuugggaaaaaaaauuaggagcgaguaaggggaagggcuugucucaucacacuguggacaguuaagcaaaaugcuaaacuauggguuuaagauuuacagguuagcucugccagaugccacaucugccuccaguguuuccuggcagauucgggcagccuacuacugggacccagcauaaccgcagaacaugagcuugcacaaugugaaaaaccuaaaaccauuauaauccuauuuaaggccaggaugaauuugcccauuuugaaaguagauguaguuuucaagcuuaacuuuuauuaagcagaaacuugucuucagagcuauaucuauauaugcagguaaauucauaauauaaacaaauaccuuauccauuuugugcaaaauuuaauuuacuuuaaaucaaacgccauucacuuuuuaaaauucauaaacucagguuuuucagccaguggaaaauuuaucuuucucauugcuacagagaguuaaguaucugacguaaaggccagacaauaguaaauggucauuguucgcuuuauaaguauacucuacaauaagaacacauauauuuuuaucuucauuuucccuaaggagguguuuagggcccccuuaaaugugaggaaauguuuauuuuuguugcuuuagaagaaugauucuauuguccaagugagaaagaaauaggaacaaacaggucuaaggagaaagaaacaggaaugugcuuugugaaaaaaauaaagauuaacaggaaccacuaaagguuuguaagugcuaucugguccuagugcuauguuacugcacauaguccuugcgccugcauauguaagaguuggaugcgugauuuauuaugacuggcccaugaaauuauuuucuuuuaaguuaacaacaauaaggucaaccacagccuguagcuguuuuguaguuauuuuauauuuuucacagcucuauugugaaugcugcuaaaagacaguauagcaaguguguguuuuuagguugaccccuugaaugcauuuaauuucuugagagugaaaaccuuugccaccaggaccaagaggaauuaaccaaugguuaaacucauuuaaaaacacaagcaagcauuucaacauauuugcuuagccguuuucugaauauuuaauauacuucuagagaaagaaaaaugaagaaauaggggugauuugugucuagaauacaaaguuauuuucaaacuccucuuuccaaugaaaugaagacucauucguagauuuaccaaacuguaaggagguugugauuucaaaucauucacagcuuuauugauggaaauuucaaagaaaacuuggacacagacuucacuguaacuuucuuuguuaauaagaaaugcgaagagugaaauuuagguugagauucaaaaacuuuugaaugccacuccuaaaugauaaauuauuuguuacuagauuucugauuuaugcaaaacuuuauuauaauaagccuuauguuuuaguuugucauuguguaguguuuuaauaugucucauaaguucaaaagaggcaauaguugagcaugcagaugucagauuuuuaucugauaaaucugguuuuaucagguauuuaugugguaaacauuaagauacuagcaaugaguuuauuacucaaaaugugcuuucaaucugaaaucucauccuugaaguuguauuuugaaguaauguuuauuacauaucucuugaaaaagucuuaaacuggaaucaguaaaggcgagcuugucaguagcugauuaguccuuuauauaugacucauccaacacucagaaaaaccccuuggaauagagagguucucuuuaugauauuuagcuauauggcgguggaaaggggagguuugaauuuuugauuuuccagcuuaugggucauauuugaccaacugcuuucacuagaagacaugccacuuuguugagcuauuuaggaaucaaaaagacugucuuaauuuaaaacaaggacccuuuguuuuaguuggugacugccuugugaaauuuuucaguucucagcggguuaaccagggaacaggggcagagucauaauuggccuauuuagaguauuuugcaugugaauaguguguuagugaagcaucccuaagucuguugugagugacauggugauuagaauuuagauuagggaaaacacauucuguacuuuaucaaggacaguaauuaguucagucaguaaaaguugauuacaaguaacgauaaaguuagauuuuuaguacuuaauuuuaaaauuucuuuauuaaauaguaaauuuguucuuaauauaaaugguacuaucuacucuuguuuuauugcauaucagaauaauuaaaagaacaauguguucaaugcagaguauaaucaagcgauuuauauauuauggguaaguuucuauguaguuuuuagaaaauguaauauuauauaaucuuucugaugucaucauuuuuagaaguuuaauaauugucacacugugauagguuauuguggaaguuuucuaguguucagguaaauguuuaaucugugggaugugucuuagcuuccgauagaccucaagagggcauucugaaguccuuuguggcuguuagcuuggaauaucugcuauuucuguaauuuugagaguuagugugaggauuugaauuuccucuugguucaguuggcauuuucucuucugugggugcuaugucaguucguggagaaucaugauaugcgguacagagaggcaggguucucagucgaguucauaggcuacacuuacccccaguguaugcagccaggggaaguugugugcguucacaaaaugagguucuucuuguuaaggaaggggaugaauaguucccagauaugagccucagucuagagaaaggaaacauuagucuuauauaaaugccauuuguuuugugaaaugaaaacgugagucaucuuaaaagacuuaaaaaaauauuguuuaaagggaaucaucuacuuuccuccuaaaaguaaagaauuaaaaauucacaaacuuugugauagcuucuuagacugccuuucuuuuggguuuuuguuuuguuuuaauugucucagcuuagcagaugcuguuugcuuuauugcauugguuuaaguacuaacaaucaguugggagguggugaaaguaaaaaauuaaccuuauauguuuguuuucccuuuuuaaccuuuuagcagagucuccuuggaggugacauggauaugggcaacccaggaacccuuucgcccaccaaaccugguucccaguacuaucaguauucuagcaauaauccccgaaggaggccucuucacaguagugccauggguaagguauuccuuuguuugaaugccugagggaugauuaugccuuuuucuuuuuuucuuucuuucuuuaaaauaucgcccccccauccuaccucccaccccaagaaaaccauaaaauuuggcucaguugucagccuggagacuuccccccuaguacacugaguagguacguuaacagcuuaugguagcagaacuuuuuuggugucugcuuaugucuaguuuucucuuagcugcacccauaaggaagcuauuaaaagaucaaaguagcaaaaaguuaaauaucuucauuuuuaugaacaaagcagaauuugauuucugcuagaaucgaaugugaucgugguaacuacaguuugcuaagguaaugauuuaaggaaaugugguaucaucuagaagucuuugugguuuaaccuaucuuaguuaggaaaaugggcauuugggagcugaaagcaucuucauuuucuuucagagguacagacaaagaaaguucgaaaaguuccuccagguuugccaucuucaguaaguacugcuuguuucugcuuuguauauugcuuauuuuguucuguuuuguauugaugggaaggagauagaaguaaaugaguuuccaugcgcccagagcagcacguuuaucuagaagguggaugagguagaaaugaccugcacauccagccaccugacccacauuggagugauuaauugcacauccuggaagacugggugguuauguugauauucagcagguuaagcucuaaagagagccuugaaaaggugccugaaguuugaggaguuuuaccuguacagggcuugcaagagaaugaguauuaguuucauguguugguuaaauucuuugucaguauuaugaugauuuauggauuugcaugcgaaaggagauuuguggagaggauuuaggaaaaauuuacauggguuucagcccagagugcaggaagaaugucucuauuuucuggagagguugcugaauaaaggcugcaaagguagcugcaucaguagccauuugugucuuuacuaccaggugacaacuagaaguagucagcuguaaccaagagcauucugggucuuuuuaacagcuggagcucuaugcagaaguugcugauaucccccacccacccccaggucccuaguacagcaaaaguugguugugaucacaacucaauacaugauaucauauuuugaauucuuacguuccuagauaauuguauuuaauuuuauuuaggacuaguccauuucuaguaauuuucuccucauauaaaaugaaaacauaguuuccucucuucuuucuuuguuucuuuauccuuccuccuuuuuuucauucuuccuugcugugauauaaaguuuugauuuaauucuguagaguacuaguauucuuugaaaagaaugcugagacuuauuguuuuuauacuuuaauauaaaaucauauuuagauuucuuaaaguauauuaccaaucaaugcuugcauauuaguuucauuucauuuuuaauguauuagaagaauaauaggucuugcaaaugugcuaagauuagauuaacccaaacaccuguguauuugacuugauuucaguucagcucauccaaacaauuauuaaaugaauauaucagaauaagucuuaucaggaaaaagaguaaauuuuguaugcugauuaucauagaguuggugauguugaagaagcaucacaaaauuauucauaaauauagaaaaauauuguguaaauaagauugccaaugguguauagucacuuucaacuagcaauaagucacuuaaaauuguacucaguuguuuauuguuugaauuucuguguuguauugaaauugacuaauaugcccaaaggauuuuauaagcauauuuuaagcuugaaguuagggguggauuuaauguugaugaaacuuuagcuuuuaauagguuuuaugacaacuucaaaugauacaguccuaacagcuguuuacauuuuaaacaugccugaacuuaauauggacaauauuaaaugcauuugguggaccuuugaauguucugaaacaauggaauaacuguccuauaaaagccauaaaaaacuuaaagcuaucauacccuccuuaugcuucauauucaaauuaacuuguuuuauccaaugcuaagauuaggcagaaaucuagacaauuucuaaggagugcauugguguggcauuggaugguauguaucugcuuaaucacugucaacaacaauuuucauaauucguuguaaauguuuaaguauuucccuauagcuaacuggccccuuuagaaaauuuuacugguacaguguuuucuuugcuguuaagacaauuuagguguugcugcuaugucgugauacauucagaaauauaaaaauaauuuuccuuucuuucccaauaaacaaaacuugggaauuaggaauuuaguuuuauucuauuuaauuuucuguuuuuaguggucaguuuaggauuuacucuucuuagaagauuuaucuugacuaaauguuuucaugguccuuaugaaacauuuugaugaauagccuuuuuucugaaauauaaggaggaagaaaauacaauucaaaaugaaauuuuuauugcaauuuuuugagcaagaagaacaaguuuagguaauuuuauaauuuaaucauccauuuacucauuaccuaaaaaaaucccagcucuauuuucauagcaauuuaacuuaguuuauguaagcuuuguuguaaauaucaauugcuuauuacuuacaacaagauccacauggcuuaccaccacacaaaauauuuauuuuaacuugauuccaaaaaaggucugcaguagacauggucacacuuuucuaguagcagaucuguauuucuauauuuuuagaccucugccaugcuuuuuuuaaagcucaaauaaaauuaugacuauuugauaagagauacuucuuaaauuguuucaguauguaugaguauuuguauaacagauacuaaaagauuggagauaauaaaagguuuccuuuggagugauuaugacuacauaagacacuuauauguuuucuuugauacauauuuaccaugacaaauaguaauaaaucugucacaaucuguuguggcaacucacuuuaccccccauuuugaagugggcccucucuuucccuuauaauaaaaggaagaaaacuuaaacggugacacugcaucaucagguauuauuugugacacgccugugguacagagacuggacuucugccgccauuaggcugggucuuccucccaggcaaucaggagagagaggggauugccuagcccuguuuugaaaacacugcagcaucugugggagagagaaaacguaggccuggccagacaucaugccauggaucuggcaggauccacgaauguguguuuguacugugugcugcaccuagagaccucacgucacuguggaaguaugacacgauggugggauaacagaagacccaccaggcagggucuacaggacaagcacagcgugucggggggaagccugucccucuagugcacauagaccaguacuugcuaaggugauuuuuuuuuuaaaggaaagccugugugaaagacagcuaucuaauugcccacgagagcucugcuuauuacugcaguacauuuuuaucuucucgguucguauuuuaguauguugcucuuuuuagucacgucccaauuucucguagcccucguuuuuugcgaagaccuuaguaauaaaguguugucuuuuguugaugucagaauuuauuuugcaugucuaagcucuugaaucuacaugagaacaucuuguuuugcuagauuucuacauuuugguuuuccauuucaaaccauauuucaucuuaaacucaauauuuugcaacuuuacugcucauuucaacaaauuuguuuuauauaaccuaauaaucauacacauugaaucaugaauucauacacagaaaaauguacuauaguaaauuaaaguuggaaaaaaaugauuuaugauucuuaacagaaauuaacaugaaaguacuaaaaucuagaaaguagcaaaaaauuuuauauugugcuguuuuaagauacuuucaucaaacacagaaacaaagcaaaggcauuaucuuuuggaaacuuuauucugcccaucaacauguaaacauguaaaacuuuuaucuuagaauuugaaauauuucaaaauuauauacguuuuaucagaaacuguuaacaacuacaaacuuucuacuucagacuuugguggaauuugucuccacuuguaauccgauuugcaucuuuaaugauggucucaccaugaccccaguuggaaucucuugaacaucagauuuuucuggaaauaggauauuuuauccuuagaaauaguuuaugaccucucaucuccagugaucuuuccuaaagcuguacuucucaguaaagucuuuuuucuacguuaaaguacagagggguuuugugugucuguuuuguuuuaaaacucaggaggaccuggcaaacuuuaaguggucagagauaauuugggacacauggaucccaagauaaacaauuucuacuacuauaaagauucuaaaauaagguuuggacgcuucaagaauauuugugacauuaguuaaucaguagguagguuugaaaaauaaaaacaauguguauuagauauuagguucaccaauuuucauaaggaaagaauucuuaaauaaaaugaaauauuuaaguauggauuagaguuuccuuuacagaagcaauuauuagggguaucaagaaaaaugaguaaugcuaauggccuuaaauguccuauguauuuuguguuauauaaaaacuuuccuauuugaagauuucaaacaugauguugaauccauaucuugagcuauuuagggaaaaccccuuuuaucccaggugcuugaagaaaucacaaacaauuuaaaagagauauugguaaacuguuuuuuccuuauuagugggcuggaaauuauguaugauuuaaaaaaucaguacugaacucagaaauauauaauuuccuacaucacuuuugaaauugaucauagggaaaucagaacgaugcuuuuucaugucaacaaauuuuaacaaguaauaauacaauuuucuuuaagaugaaaguuuuauugaaauaugauaucgaucacaagugaacgaaauaucagccaucugggcucuauccuuuuuaggaaagucuggaaguagccgauugugugguaagacguaaaaggaggaaacucuucaagguucaucccugcagggauagauacuuugugaagaaguauaauuguuaaguguuuaaaauauuaagauagcucucaguauucacuuuuaaacuuagugugcccauuuucuaauuaaagauauuggaauaugagguuuggauauuaaaauugugcuuauuaauguuuaggcaagaaggagguuaagaguggcacaauuaagucaucucaaauaggacaaaacuauucacacaauuuacacggcauauauaacaugacaauggggaacagugaaagcugagaaaauauucaugacagagaaaguauuuuugugugugugcaguuaaugcugaauuugcuaaaccagacuucuaguucagcaugugcguuuuuuuuuuuuugugaaaaccaaucuuaucuucucuauuacacauugagacuauagaguuuaugauuuuuaugaauugcugauauaugaaaaaauauaggagaaucuuuauauuuguuuugauuggaggcuuuuguuccauuaaaaauuuuucagaaagcacacaagaggcuugcacauacucaacauacauacuauuaggcauucuaauaucccagaaguuugcucaaggauuucugaauuuuuguuuggaauuuuggaauaaugagcuccuucauccacuauccuccucuucucugccuugaagcccaauccugcacccuuuaagaaagaaggcuucuggugugcauauuuuagauagaaagagagaagaaauauaaaggaaaagacaagcaugaagguuaacuguggaugaaagguuuguguauuuuugagcuauuccugcuuuaucuuuacaaacaaaaagguuguaugccccaaacacucaaacaaaacaccaccaguucauuccuucccccagaaagaagccuuccuggccagcagcaccccauuuuucuacucagugaucucuucuaaggaguggugccugauguaucuuccuacucuccaauguguuuuuauuuuuaaucaaguauucaaaauaguauuuugcaugcuaagauuuaucaggacuuucguuaagauguuagcagcugcuaacauaaacaauaauagcauuuaguguaaaacuggacuuguugagaaaagagaaauacauuucugggaacugcuauuuugaacuuuaucauuuucacugaagaguauauuuuggugugaaguuuuggacucgagagugguuuaaauuacugagaaguguaggaaaccacugcagggcugcuuuacccagagagaauuauaacagggcuugcauguauuuugaaaauaaaaccuuuuucuauggcauccagcuuaacugugaauuuauauuuacgaaauaauguagauaaaugccuugauaauuugauugaauaccauuuuuuaacuuuuaaaauuuaauugauugaaauaguuuuauuugcuaacauagcaaaauguucuccuuuuuuccagaucacugacaauuucugcauuuucuauguuuucuugguuuugaauaauucuaaagguuuucauugaaaguaaugaaucaggaauuggagggcuaaauaagauucucuuagaagauguggcaguaauccuaaaagaauaaggagucucuucaagaauugucaaaguuguauuuucuuaaggcagaauccauacuugucaggcuguugacagacacuugcuuugucuuggcuuuuguuugauuuuuuacauaacugcacuggauuauuaaacugaacauaaaauugcaccucaaagcaauagcacaggauuuucagccuugaucaauuucuacuauccccggaugugugugugcacgcgugugugugugcacccauguguaugagugugcuucuuuuaaaggaauaggagcuuuuauacaauguggugcaaaacuuauaguuuuaaauacuuaauuauuuuaucuggaaacagcagcaugugagugauucuuuuuuaaguugcagcugcugcauagguguagagcuauuugaggaguuugaugcuuuacuugagcauauacucccucuucagagaaguuaagguagugcagaaguuucugcauuuuguaaaauuucaggguugaaaauaaagaugcuuuaugauuuggugagauggauagauuucacuucugaaagaaugugcaaguuguauuuugaaaggaacauuuuaagaauucuacuuaagugguuuagugacacccacucuugucucuugucugacuuugucaucugaggaauuaaucauaaauaagccacuagggaugaaacuugauauauaagugcuuacuuccagaguaauaagaagaggaacuguguguguguuaaauuucacuaaauuuauuuugauuauuccguagagcaggaaauaggaacauuucguagugaagcucucuucauagcaaacuguaaagaaaauuucucaguguguugccauauguuggcagugauuaaagggcauuuccuuugugaaacauggagccauauuagaaagacuuauauuuucucauaaaaaugaccuuugcaaguacauuuaaucaugaaaacuggugucauucgucacauacacauacaaaaagugucacuguuaccauuagggauuuuaggaaaaugcuacuuuggaacaauuauuuugauggcaucugagaaagaauaccuaagugucuacaggagccuccucccuccauggcccauaucauucuaaauaugccuccugaauuacgcuuauaauaauauuguaaugucuuucauucuaccgauuggcacaguauaucauuauaucauuagcugcuaugagaaagcaguuucaaguagguggcagauucuuagcauuaauguuuucaaguaacccuguuuggagaauuggguuguuucacaggugcucagguacauuaacacaguacaauaauauuuucuggcuugcuuuuuaugaaacgaacuugaaguacaaaauaauuuaauaacaaguggaguauaaaaacuggagcucuagcuuaagaaaguuuaauaacucaagacguuaaaggauaagaaaaaaauugucuaaggaggcagcaguguuuagcucauuuugcguuacuacuaaagcugaaauuuauuaggagaauguuuauggccugauuauuuagacuuguugaguuaguuuaaauuuuuuaaacgauuuggucaaguagaaaagcacaguucuguaucuauuguacuauuugaaaguauuguuacauaaaauaaauucgaaauucugccauuuaauacucaggcauaugauucaggagugaaauugcauugccagaaccuuggggucccucauguaucuuaauaugaauuuuauuuuuagagguguauaagacauuggcacauauaaucuguggcuuaauugauaacagcaaagaaaauggaauuaaaaauauuuauuauuaacagauacaguugggauuacaaaauucaaacugcagucaguaauuauuuuacaaauaaaugcuauuucauuuucccuuuaguaaauauaucaguaacuucacccaauauugauguaagugaaacccgacaguaacaagcugggagugcccagguagaaggggaaaaaagcauguucauuuauucauucauuccuuucuccguuuauacuuauucaaagaguauuuuucauugcagcuaaaaacuagacacaccauguaacauggaacaugucuuuuucuucuauguauucuuauuuaaaucguggagcuuuucaacugagauucuucacguuuaaugaaauuugcagucuugugucacuugcgucacaauuuguaggaauaaccuuagcauuuuaaagaguauaccguguagccuuuugagaaagucaugcauuugaaaaauaaaauaacccacaaaguguaacacauggacuuuugucccuuaagcugauugcccuuacucacuugucaccaccuuuacgagagugagggauauguuuuagauacauuuuuuuuuguccuauagaaaccagacucacugcuuuacuuaugcguauuacucugaaauauauuuccagugaaugaauauaguaguaaaagugguguagcaagguagaaaaaacacugcacuagacauaaaaagaccuuucaaguauaacgucugacagccucuacuuacacacccaguggccuugguuaggucacaaaccugcuucucugucuacaaagcagguauaaaauagugccugcauaauaagguggugucaauauacugauaacaaaccuuuaucaaaguacuuauuccaugccagaguacuuauuccauguucuaagugguacacuauuacaucauuugcaucuauugaaucauuuauuccuauaaaaauccugugagauggguacuacuguuuauucaagagacuuaaaaaugagacacagagaggugaagaaacaugucugcggucacacauaguaaguggcagagcugggagugagaccugggcagccugucucuaaaguuucuguguucuuaaccauagugcugucuaugcugccuagcguuucagacacucuguagaccaaaaagcucucuacagcaagguugucauuaaguuagcaaguauuugacuaucuacaauaaauuaauauucagaaauuucauuucacuguagagugaucaucaguaucucuguauagucauguccuauaacuuuugcccaagcaaaucaguaugccaggcaguccaggggagcaucuguguaaacaaagacaguauaauauagugguuagaguaugaaaucugaucaacuggguuuuuagggggcuaugucacuuccuagcuacacaguuauuuguaaaauaaguacucauugggguuugaaugcauuuauguaauauccuugaauguuacauacuauuguuacacauaauaaaaagcacugucaugcuauuaucaguaacaagguaacuaccuuucauuuggcauuugagaaacaaaucuaacauggcagccuacuuaggaguaguuagcaguagaauagaaacuaagaccagggucucagcuauguucaaaagaauuuuaccuaacagaggucacuugcuuuuucugaaauuauguaauauugcuuuuuuuuuuuuuuuuuuuugagauggggucuugcucugucaccuagguuggaguacaguggugcaaucauaguucacugcagucucaaacucccaggcucaagcgguccucccaccucaggcuccugaguagcuggguacacagguucacaaccaccacaccuggcuaauuuuuuucuuuuuuuuugguagagacagggucucccuguguuucccaggcucugcaaacccaucucuaucaaaccaagacacguagucagcccuuuuaaucauuagaccuaguggucugcaaaguuuguguuggaaauacuuuaucuucucucuuuugaacugguacaucggcugugaugcccggagcugcuuauacugugguucccuuggccaauaauuuguuuaugccuaaaucagccuugccucuaagugauaaggagauacgugcuuuuucuuuuguuuugugucagugguauucucuaauaggccgggaacgggucugcccaagugaugcacagccccuugguggggcuggcuauagauccccccgcaaaacugaagguuaggccuaagauauuagcuuugccuggcaagaugaagauguguggacuagguagaccuguguggcagucuguuucuuuuauaaaguaaacagaguucaguuuguuuaggacugcuuagguagauuucuuacacugagcaggaauauuuguacagauguuuuaagguaaagucaaagaauggcuagauuguagccuuugacgcauuauaauguaucuuuucucagugccccuguugaauucacaaaagaaaagguauuuuugaucaucggcuaugagaaacuuaaaacacuuuuuuuuauauauaaaggcugauuuaguuaacucuucuugcauuuaaagaaaaaaacaucugcugaaaguagggaggggggaggugugagcggaagcguggucuccacauuccacaaugaaugucuuuucccagccaauuuuaauuugcagaaaaaccaggcacugaguuagauuccucgggaaaagucccuguuggcugaugagcccugaacuucuuccguguacacccugaacagggacugaugcuucaguucacagagauaauuuuucucuggaaagccgauagauccgauuuagccaccccucauuuguagucauugccaccuuguggauuacaaaggauauugguuuucaucaaacuuccauuucgauuuggcuuuuuauggcaaguacacguuggcaguggauugccguguuccucaccaaaaggauccugguuuguucagcaacaccucacuucuccacucacaguucauuuaugauucugaugagaguguuuuuucaggaaacacacauuucacuuuuugaccuaggagcaucuguuagaauuuuuuuuuaauacuacuuuggcauucugaaaguguuaaugucuuucauaucuguuuaaugcuauuuagggauauuuaugaucaccucuugguuacucaggguaaagugugucgcaauuuuuuuuaaacagacaggaaagcauucacaugaggaaacagauugcuuuaaacaugugcuuccugugacaguaaaaagaacaaauuagauuuaacacuguguaaugaaugcauaaauguguacauuuaagcuuuuaaaagcuuuauguucaguucuggucacaacaaaaauugagucaccuguaaaaauuaaagaugcccaggguacucucagacuuuugaaaugcccagcaauugcaguccucaccugacgaugccucguuggaauuauaaaaagcaugaucuauuagugcuggagagaacuagaacauuacaaggcacauucagagguuaaaccagguuacagucagauuccguacauuuagcaaauaaaucagaauuuguugugggggggagaauacuucacucucaucuuccucccuaagaaucaaugaaaaaaucaauuuucgggaaccccauauauuccucugucuuucaugaaagaaaaagaaggaaaccugauguuuacuuacuagcauuuacuacaauuuaauuauauaagaaaaugacucuuuuucuuauguaauucaguuuguguuuuguaugcuggcagggagugaauagaaucugaguuaauauuuccaguuagacuagaguguggaauuggagggccugaauccucuccccggaagaagaggcacucauggccauuucugucugagccugcggauagugccucuccguccccugugcuuucaaagcuaaggauuuguggcacgcuugccaucucucuggccaaggagggccaggagagagucccucgggggagggcacauaguuugaggacaucugacucucuucuaucacauacugagguacuaauaucaaaacagacugcuugucgucgcacgguggggcagugcuuuuuuuggcugccguggucgaaaugaaaugggcaagcuguaguccgcuuggcaucagaaugggcuaagggaagcagggaaaucagagucagacugugaaugcaagucacagccaaugguuaacuuccuuuuugugugucacuuggcagcagcgagacugauggugauuuuuuuuuuuaacaugggugagaguucagugcccuaggaagagccguagaugcuguuauugugcuuccucauacaguugacuuguguugauuucuugaggccaguacagcuguuccaagagccagcuccaggagcuuuguguguauguacauggccaucggacgucggaugaaaaagguaaacagaugagaggugauccauacaaaaucucacugcugaucacuaggcagucuuaggggaaucagguucuggcauaaggcaauaauaccaaagaauaauauauagugcacuugaagggauacucccuuguauacagacacccaaagauauuuuuaaauuaucaccacuccgcaccccucaucucacauacaggauucaaaucaauuuuggacugucuggaaaauguaggacuaaaauagccagauugaauucagauaaaauuaccuucugcuuuuuugggagguuguugcuuuuugguuagccacauuauuuucuuugaagauucauuuggaagagaguuugguagaauuucuagccucucucaagauuuuccucccauuucucuguuugcaaagagcuguuccccaaaggcaaaaagagcgaguugccaucuugagcgaauuguauguuuagugaacaccaaauggucucagaguuacccuaaauuuucauuauaucugguugcuuucaaauacuauuuauuccccucaaaacuccuaaccauuuauauaagauaucaguaagaugaccaacuucugacaacccaaaagcagggaaggaagcuuagaaauagaauaccauuugucugguaauuagaguguaucucuuaagaguucgagagaauucugauuaaccuuucuguucccacauucucacguaaaauuagcacaccuuuuaaauuauuaucuaguauuuaaacacauauuuuugagucuucuuaaugcaacagguucuggggacacuaaaaguguguuauaguuuucuaaaaaacuucauuuuucuuacauuuuaaauguucuguuugugcaaaauuucgagaaucaccauaagggcuucuuugcauuuuuaauuuaguaacuaacauaugaauaaauuugcauauuaauuaguugcagauuaaaucaugcauacauaauugccuccuuacuguguuuaauguuugucaaaaucuccagccugguuugauggaugucguaugaaagauuacaauuugauguacccuuggaaguauuuacaccaauaaugcaagauucuuaauagcagaauuuucuaguuauauacaguuacuaauaaacauguaagauagguacaugucccuuugacuaaaauuuuuuucuuugcaccaaaucauuuacuauucauaaucauuaaugcaucuccuaauuauacagcauaugucuguuaacccuuucauugcuggccuucaaaugguagcuucuuucuuuuucuugcccccuaaagaaagcaaaauuguuugauaauacucugaaauuacucgauugccuuuuauuuauuucucuccuaguauauggacaaaccucauuugccauuuauuuuaacauacaauagauaauuauaugaucauuuuguauuuucuaguuaaagaucauaaaaugacccacgugcacaugguuaguagcugaugggcuuuugccuuucuuuuaccaaugcugaaaaaaauugaaauauuucagauacuucauauaguaguaaaaaaaaauguauacacagacauacucucuauuuaggaggguaauuguagaauaaguaaaaguauuaaaauuauauuuaaauucauuuugaauauugaaaugcauuuaauguaucaugaucaaacauaggauggaaaugugauuuuuuuuauuagaauugagaucucugaaguagaaacugacaagagaauagaugcucuugauuugacauaauuuuaaaaugccaauaaauguuuucucaaauuucuucagguauuuaauuuuuuaaguuuuaucuuacucauauaaaaaguagaccaacuggcuuuuuuuuuuccuuuuuacuauuuugaugucuaagcugcuuaucacacuguauuacccugcauuaaugaguauuccuacugugcaaaauucuaucaaaaaugauggugugaaugucauuuuuaauuggaaguuuauacagucaaauuuauaguacacaacaaaaaauauguauguaguucugcuccaagccuuuuuuuaggcuuuugaucuuuuuaguuuaaguauacauuuuuauuaaucuaagugucauuugaaaaucuacacaaauaugacuacauuuuuuauuaauaccauuguauuauggaagagagggaaacuaaggcauagaguaauuauaaugucuguaaacuguaagaagaacaaauacaagaaugaccaagaauagauuuucaggggucuuuuuuagacaugaaaacuugcugaccgguucuguauguuucacauaagucagacuguaugauuucugucuucuuuauuuuugaaugccugcauuuauaugccuaguaaaaaggcaaagguuaaaaugaguugaaagcauaaacagcugauuucccuucuuugauucuuucauaggagaaauaaugucuccuggucaccuaccucaggagcauuuauuugcuuaucacaggacacaaugaacuauuuauugauuuaacacaacauucuuuuacaacacgcaauauuacauuaaauuauuuagcaaugugaaaaaugaaaugaaagcugcaaaacuuauaaaaggaagcaaacagucagaccugaaacauauuuauccacagccauugugccuagguaauucagggcauaugguauguaaaugauauuuggagauccuugccaaaucuacacacgacgggauaaauuaaggacagguuucccugggugugagucccaugauuguggccggcacacuuccugcuugaauguguguguucuguucuugucuuucagcaagagcgucacagagcauucaguggccaaaucugguccucagcugacuucuaagacauuauuugcaauucccaagaauugauuuuaugauuaaauuuaaaacauaguaccaauuugccaaacuuucccuuugcucucacauuugaaaaguaagaucugaauaauuugucaggauauguuuagauauuaagccauuuaaauggguaucuuugacauuagaaauugagugccucugagcuucuuagucacugaagaaagguguuccugagcagugacuuuucucuaagcuaggauuaagauguuuccuagaacagacuaugaauuauuuugaacgauugauaauuuugguuccagguuggcccaguaauaauuuauuaauucaacuugacaacccaaauuacugguaucacuuauuuuauuuuugaauuauuauuuugaagcauauacucucauuucuagaaaggugaaggcacugacuccuauuuagaauaaauuuuaaguagguaagagguuaugcuguuuucuuuuuuuuugaaaggaaugucuuuucuaagcugggggucuuagcucagaguuuuuaaugcuuuaaauuaagguucauuuuuaucuuggaauuaugcaauuggagauuuugauuagaaacuauggcagaauuuuuucuccuauaauuuauuggacuauaccuaaagagugcauuuacugugcacacuuaauuauaaauacaagacuuauauguuauuuauaaaaguuauuucgggguauuuuaagacauguagaguauggcuuaggauguuuuauuguuuuuacuauuaagaauaaugcuuuuacuaaauaaaacuguguuucuuuuauaaaagauaaugcucuuaauauuaugguuuuauuugaauuagcaguuuagucuguguccccacauuccauuucauuuauggaaugcaaauaacacuaguuacugcauagaaaaugaaauuaggcugaguccuuguucauugcuguguaaauuggguaaaaaucagagaaaaaaaaauacccuugagaucaauguaaaucaauacuacuugagacagauccagcuaaaaauucaugaaaggggucacaguucuggaggaguuuauauaauuaucauguagccuauaguuugugaacucagggcaaaguucugagcugguuguucugggaccauuccuugguucauugaaacuacuuugcacagcugugcuucaaacucaacaacagagagcaaaaacaauauucacuauaaaauaaaccucguccugccuuucaacuucacugugaacuugcagucuugaaaacaacaaaagggauaaucgcaauugagauuacagaauccagauuagauguaauacacaguagggugguauggcccaauuuuacuuacauggggcaaguggaagugcugugaaugccaacauguuaagcaucauagccacuuauuaagauguuagcuuuaaaugucagucuuuggaccccauuugaaaugaagcaccugcauuuuauucaaagaaauuaagauauauuggggaaugcggaggugaguugaggguuuuuuuuguuuguuuuucuguuuuguuuuguuuuuuuuuucuggugggagaaagugccauagacaauagagauaaaauaucucaaguauuaaaagucuauuuuuauacacuguaugauucaaaaugacugagcaguuuugaaauuuuguagaaagaaaggaauauaaggagaauaagaaaugauauuugcaucuuuacagacaacucuguauagcacauuuaagauucuggcaauuuccuuacaaguaucugaaaauuaggaauuaugaaggaaacccagacagauacuuaacuauagcauugcuaccaggugucucuuugauaucaaugaguuaggaaaccuuaagaaaaaaagguuaaaacauccagaaugauaacuuauuuuagaauaugcuuucagacaaaauauuucuuuguuaagaauguugaaagguuuuauuuaauuguucacauauauuuaguaaauuuuuugguagacuugaccgauuaggcuuguuucauaaaagaugugggcuucuguguauuuagaucuuaaguuuauuucaaauuggccuuuauaaaacuuuagugccuuucucuuagaauucuagucaacaaaauuauauucaucaaguguauacaucacagaaguaacuggugauacagaguauaauuccuaccauauugucaaauggagucuauaucuccucaaagggaaagaaacacugacgugagucagaaguuuucacucacuuggcacugaaucagcuuaaaguucgagguugaaaaauucacaaauauuuauagcacaccuacuaagugccacgccuccuggaagguggacagcaauggccaauguuucugccauuggaaagauuugcaccgaaguguguauggccacauguaguuguacaaaucagaguucauuuuguaaugcuuuauaagggucugguaccacugauucuccuugcagacuaauaaacacagagcuuauaugacucuuaaaaauacagugauagcaagugcauccuaaauuauguaaucaugugguccaugauaacaguguaauauaugauauacagauggaaucagccaccuggcuuacuguaauuguuguugagguccuuuguuaugaacauauauuucuguuaacaaugcaacaaaauaauuuuuuaagcuguuuuuuuuuuucuguacugccucaaaucuagauaaacggaauguguuggaaaggacaacaaauaagaaguuaaauauguggaaaugacauggaaagcaccuguuucuucccuuuguuuucuucuacgucaucaggaaauaauauuuaaccauagaauauggugucccucuaagaaaauguuuauaauugaauguucaaaguagaauauagauuaaauaaguaaagaugacuugccaaaaaaaauuaaagaacauuugaaacaaacagaagucugcaucacacauaauaaguggcauaacaguaucaccucucaaaagugacaauagauguguccaucuuuaugccuuuagcauguuguuggcauuauuaguuauuguauugagagaguagccacgcuauacaagagaaaggaagguaaauuagaucccucacgcccccuucuucugugaauuguauauguuuuugaauacacucucugccaggacagcaaauaaaauuugguucaucccugauccucagcagauuauaaucuagguaaaggacagaccagguucaugaaaucaaaaauaauaauuagaacauuuggaaacuaggggaacagguccucauauugugugcauguuuuaucagucuaaaguagauauagcucuauugaaaauuguuggcuaguaauaugcucauuuucccauuucaugaagacuuauucucaaauggaaguuacagcuggcuaucguguuuuuccgacaaacucucuucucuguggacaugaugauuucuguuguuguggaaaggaaggaaauaaaucucuuuuuguuccucauucacucaaugagcaaagugugauugagcuccuauugugugcagauuauauuguuggagcacaggacaaagaaagcuaaauuaucaucuuuguuuagaaauuuaagauauuugggagcagcaagguagaugccuaugccuaguuuauuuaacaaggcacugaacuuugcuggagaauccuauauucuagaauauaguccuuaucuggaagugacuacagaaccugauucuggaucacagagagcugcagaucuggugugauuaagacaguggccacagauacuccacugagcuucugucuugcagcuucugucugucucuucccugaaaaucacagggaccacagauacuccacugagcuucugucuagcagcuucugucugucucuucccugaaaaucucagggaccguguggaguuuugcuuggucaacuggagaaacaacuuuugauuguuuuuauguuuuucagagauuuauuugccagagauauuacauuauaauaaaaacauaaacacagaaguuagggauuggaacaaagguuauauggucacaauuuaacucauaguuauuugaaaauuauugguuuauaaggaaacagauuuagacaaagcuagaacuuaugcagguaaguuacaaagcuagaacuuacucaggcaguugcucacgucuguaauucuagcacuuugggaggccggggcgggcggaucacgaggucaggaguucaagaccauccuggccaacauggugaaacccugucucuacuaaaaauacaaaaauuagccaggcgugguaguggugcaugcugguaaucccagccacucaggaggcugaggcaagagaauugcuugaaccugggaggcagagguggcagugagccaagaucacaccacugcacuccagccuggugacagagcgagacuccgucucaaaaaaaaagaaaauguaguggacacaauacauuuagauuuuuaauaaaguagacauauguuuauugcagaacauaugagcaguugauuaguuaaagauauccaacaugccaggcgugguggcuaacacuuguaaucccagcacuuugggaggccgaggcaggcggaucacgaggucaagagaucgagaccauccuggccaacguagcgaaaccccaucucuacuaaaaauacaaaaacuaucugggcaugguggcacacaccuguacuccuagcuacucaggagcugaggcaggauaauugcuugaacccgggagguagagguugcagugagccgagaucgugccacugcacuccagccuggcaacagagugagacuacaucucaaaaaaaaaaaaaaaaaaaaaaauccaacauugcuggcaaguuugaaggucacagcccauguacaaaauugguauaucuugaggaacucuugucuuuaucauauguucuguaccauuuccuugcacacaacacaguuacuauaugaugguacuaaguagauacagguccagaccccauaaagaauguggcauucaguucuugaacagauguuagagaacacaacccacucggcaguaagggauaucuucaacuagagggaagggugagaguugaccuguuuguccuuuugacucauauuuagaaaugcuaaaguuguuuuauguucaaaaugcauuugauaaucaugccugaagaggucaaagugcugacauuguugaaaacaaauaccccugucaaacaaauagagacaauuuucaugucuuugguugguaagcaccauaauuuggccuuuggcauugcugucaguaaagcuaguugaugacuuuuacaucaauuuuuggcccaaccauaaaugaaggaaauaagaccaauacugccacaguacuuuuucucacucaucacccauaccugauucagcuggguuaauguuaaaagccaaaauuuaucaauaucaauuuuuuucccaaaucauucuuauuuuaguacuguuuaugcucaauaaaaguuuaugaauuucuuucacuguuauuuaaugaaaacccagaauuuuuuaaaauugcacauuaucucuuuaaaaaaagucuuuuagauuacucgugggauuuacucuaaguuguugucuuuuaauagaagaugaugcaaaacuugucucaccuguuccuuccuggucgugucuguguuuaugugugggguggguauauaagugcuuuugauuaacagaaugaagagagugcuuauuuugaaaacucagucguuaaaauucaaguuuauuuugaguuaaagaacaccauauuuagauuaggaauggaccaaugaccugcuuaagcuuuaggcuaucgauuggccuugagggaacuuagaucugcuaaacacgaacuugaaaaggcacuucagugauggauguacguuggaugcucucacuguauggucauucacuugcauuuuaaaauuuauguuuuguuuuuccuuuauaccuacucuuuucauuccguuugucagagguggccauuuaaaguauuugacaauuguuuguucucugccuagcaaguuguccuauugcuccaugaugugaaagaacaaagguaaucaacaguuagaaaccucaggaaauugcuagaaucuucacccccaaagaggguuaauaaacccuagauaauuaguucauuuagaaugaaaaccauuuucauuguaauaaucacauuuccccucugauuaucgagcaaugcauugggaagccugauauuuauucacaaauuuuuuaaaauugagaacauccugugcugagauuccagucagcuucauccauccauuuuuuguuaaaaguuucucaacuaucauccuucauccagacaaauaaacauaaccaggauuuccccucuaacuuuuugggaauucauuuacacguguaccauuuugagggaaaaaaacaauuguccucgaauuucauuugacucaggugauugugguaagcucgcuaaccagcuucaucuaggaagugcagcaaucugagucaacuuccuccaucucuguuuuuacauuguccagugugaugcuuccucauuguaccaaaauagaaaugguuuguuuuuguaucaaacuuggagacuggcuauggauuacacuggguuaggauaaggguuuguuauuuuuuuuuuuuuaagaacauuccacuuaucccaagggaaaaagauugacggccuggggaaaaauaagaggcauaaugaagucuuuucuccuuaaauaaaaaucacaucuagucuucagaugugucaauugcacuauguuugccuaauuucauuuaauauuugagagauuuaguaguaaauuuaugacuuuugcaguuacuuugcaaaaaauugaggaaggaagaagugaauuucacuuugagucaaauguguagguuccaguguaauuaaaccuaaaaaucuauauauucuggucuugcuacuugguauuacacuuugccauaucacauaaugcuauuagcuacauuuuaccuuguuugcagggugaugccauuuuguaucucugguuuguugaauuuccuagaagauguuauguucauguagauaauggcauacucauugaauucuuuaccucagacaugaaaauauguggaaaaguggggaaaugaaucugaucagauuucacuguauacugaaauuugagaaucugguuuuugcaucuauuuugcaugcugcugucucuccaaaccauauaugucugugugaguuuuuauaaugccacauaaagcaaaaugagaagucucuucuuucuucuaaagggaaauagugccacagaaagguagaagucaaauauuuacuuauggaucaaaaaucuaguuaaaaaacaacccauugcuuaccuuaguaaucaaugugaauuacuuuauaaucaauaugaauacaagcuaucugaccagucacucagaaaauaaauauuugaucaugugauaaaccauuugaaugucuacauaugaacccaggccauauaaaaauaaccaauucaagauaacauaggaagucacuaaaaaagacacaaauaaaauuagauuucacaguuuacgcugauauuuugauacuuuucugugauaaaagcaucuuccaaacuaaauguguccauauuugaaccauguaaauaguuaaaaguauuuuaccugagaauaucuaaaugaugccaagaaaauaaguucaugccacuaaaaagauugagaugauuugugcuuuaucugacuucuugguguaauauggauuuacuucagauaaguauauuuucuacuuauccgauaaguguguuuaucugagauaaauauuuucuccagauacguguguauauugaaaaaaaauuuaaaauaauuaggaucccaauugaaaaaguaaaaaucuuaauugcuuaauaagaaaacaguuauuucauagucuuaagauuucaauacaaagaaauaugggaauauacacguaagagguuuguugguguucauuauuaaauugcaaggcugucucaaguuauugucaucagaauaaauucugugugugugugucugucugucugcguccuccuguuaguaauuagaucuuuuaugaaguuguacucauaccuauuagggauuuuugucauugcaguuuuaaguugaauaugacacauggauccuuuguugggucuaagcuaucaccauuuauuacaauuuuuuauaacauuccauauauaugcaucuacuaacuaaacaucagccuuaauuuagcuuaugaauuaaauuuuuuguuaggagugacuccugcuggagagcaaaaaauaccaauuaguuuagcuucuaaauaaacuauacuccuuuuuucaauggacaaggguaaccuccuauuccuuggcuuggcaacauuuacuauuccucuaaguuuaaagaugagaacauagauuugaguacuaacacaucagcagaaauuauauuuuuaaguacauacauaauucucaggccagucguguuuggugcuccaaaaagauuugugauugaauaucuuugcuccauugggaagaguuuagcauggugcuguauuuuuauaauucuuuuuuccauuuuagcagacuucaccuaagucuauuuuagguggagauuuuuuuuuuuuuuuuuuuuuuuuuuuuuugcugcugcucuuuaaggcacucuugcauagaggaaacagcagaggagacacaaggaaaugcacucuccuuuauaacaugcugcugauucucugaacuagguguccucucauuuaagccucaaaagaagcuguguauuaacuagaugaaggaacuaacacucaaaccugugauacagcuuggccagagucacacugcuggggagcagcaagguuacucaucaagaugugucugacccucaaguuuaagugcucugauuuaauaacuuugcucacacccugauuccagugucuuaguagcuuuugaucuauaaaaugucaucuaaggaucuuugagccuuaauucuuugucuuuaaagugggaaugauaauaccugccacagaguacuaguuauggagauuaaauaagugaaggcaauuauuauauguucuuuaaauugugugucacuguacugugcauguauuaagugucguuuuauuagcaaauaucuuuuugauggguagauguuuaccugaggugguuauuuaauuuauaggcuggcuuguucacacuauguuauguaaucauuguauauuaaugaauaucacuauuuuccuuaggauaugauguuuagcuaauucagccaugcuaggcaaaagaggucagcauuguagaaauaagcaaugucuuauacugaaaaaaagaaagacaacaacaacaaaacaacaacaacaaaaaacaacuuuccguguucagugacuuaaacagaaacauggaguuguucaaauucuaccaaguuauauucgggaggagaaaaaugggaauuccuuccauaugaccauucuucauucauucauuuauucagcuucuauuuguugaguugccugccuuacacugcaauaugcagggcaguuuguguguguguagauguucauuagguuuauuugcacuuugcaguaaccauguaauauuaucauuauucagaaauaaagguagaaucuacucuaaugagcucuguggucgaguggauaguucagcucuuuacccuguaauaguuuguuaucuaauuguuuaauguaugugcgauugccuucacaauuaaagcauuauucuuuagucauauuuucucucuuuucucaauuuucucaggaagaaaauugacaugucugugaacccugugcauguccccaaauggagcuuaacccaaaguugggaaucacuaaauaauuguucaugaaaugguugaauauagcucuucauucaagugauguagauucugaauauuuacuuauucuuuaaugcaguuauucauucauucggcaaguuuuuauugaacaucuaccuuguagguaauacuaugccaaugcauuggggguuuuaggucaaauauuucccaguuucuuauaacaaauguauguguguguugucaguucugcuucaccucaaauauaucugucaaagacuuuuuggaaaauuacaaaagaacuguaaacuuuagauucuagaagaaaauaagaaucguguggguuucauuuaaguggucaacacuucuagacaguuugcugguaagaauuuuuuuccccaaaaguggcagaaaaagacaacuggguucauugccuacccccaguguccucaauagugcuuugucuaagcaccagagagggaugguggcuuucuguauaguguggcuaaccaucauuccccaucauuucagcgauaacaaggcugggcauggggggugggggugguaccaaguagguaaccaaguuaccuacugcuggcaagguaacuuguccaguuauacacuacugugaaaacugugucugugaaacaagcaguagacuaguucaggguccuguaaaaauuggcugcuuaagauuaagacuucuuuaaaauuauucugaaacacauggauuuaugcauauagcuucaguuguucuuauacuucuguucuaacuccccacgcaucacacuaaaaauuuaucauggaugauauuucugucacaaagaaaacuucaaaggcugagaucgcagaaaugucucaguugacaagccacugacuugaguucugugauugaaauguacuccaaggucagcaaaccaaaaccaaacaucacuggaugauaauacguucagugucucacuggcuauaauucguagaucaccuuucaaagcauuauaucuuuauuaaucauuguaaauuugugcuuuugaaaucuuagacucguuuccauuaggcaaugaagcccagaagcuuaauguucuagucucauuuuaauuuuuucagucuuaugugcugaauugucaggguuuaaaaaucgauuucaccucaucagauuaaaaauauuuauuuaugcacauguuaacaauauauuaaaagaaaugagagcuucaauuuuaaaaauaggaauuguagcucauuaagccaugacaauuugguuuauauuuacauaauuaauaggaaggcauuuauauguuugcaaaauagguaagaaaagguauuuaacguagaugaagcagaaugauuguuuaucaaaagaguuuagagaucuuucuagcagucuacccauggaaaguuaggaucuagaaaagccuucucaauaagggaagaaacaacaaagaaacaacaaccaggaaacuccccaacuuaucucuuuaaauuccagccucuuuucuaaguggugguuuuuacauacuguccucugguagguggguacccuggccuuguguauuaagcagugagggugguuuaaagguuacaaaugugauccugucagauugacaacuaacuguucuaaugaggaaaaaauccucaaagcaugaaauuugaaugaaaugugugauuauaauucaaguacuguuuacacaaaccucuggggaccuuccgaauaaaugcagagcaagugaguuagacaaaccucugggccuucgauacguguguguggaugugcgguguguguguguuuauuuuagagaguggggaaacuuuccaccauuagcccgggcuuugcuccucggaaccaacaccacuauuccuccuuguuuauuaauacuguauguguuuuguuagcauauugaguuguaaggaaauaggugcuuugaauuauuaaaguugauucuugagaauagauguaugcucggguggcauuugcuucggcauaugcaaaugauuuaguuucauuugggaucaauucccagaggcccuccuuuccugugaugcucugaauuuggcaagcucaagucagcccaucuccucuccccacaucccucccuuucuuucuuuccuuuuuuuguaccuccccccgccuuuuuguugauugguauaauauuuuuaaaagacaauaaauaaauauaucaacuugcuugugagaaaccuugccaucuauaaggauucuauuguucaguugugaucaauaaaggugaacaaagguuuucacguucuuaaaguuuagcaaaaucgaaguuuaguaaaaaugugcaugagauguuugcuaaaauauuuauacagauacugggcugcggggaugcugcaaaacucugaaaauguggucucaggggugccuuuggggaaacugacagcuguaagauauucgucgguucgaagguaccaauaaacuugcuuuagagcccagcaaauagcgugaaguugcaguagauugucuaaagcuacagugaaagcacccaacuccagaguggagaacgugcgcccuuggggcgcccagcgccagcgaggggagcagcgccccagccccuccguaggcucugggcccaugcggcugucugcggcggggcgaggugaaguucaugggcggccgcgcuucccaccagcuccggggaggccggggcccgcggagcccggggcgggccgcacugcuacucuguuucauuccgcaaccccguuuuguagguuguugaccaagcagucagaaaacacugcccccucucuccuuuugagcgaggucagagacgugguguuuuuuuuuuuuuuuuuuuuuuuuucuucccuccccuuucccuccccuuucuccgagucgaguucucaggcagcugcguacaaugcugggagcuagccagcagcagagacagauggcagaguuauuagaugugcaucauacgauucccuuccugccacucgcuuuuuaaucaaauuaaaacaaaaaagaaagagagggagagagagagagggggagucaauuaacugcauuuguauucugcucaauaauggacccuguuccacuuuuacccuaaggcaguugaguggaaauuuuagagaagaaaagggugccuagaacaaaacaaaacaaaaaaaaaaaaaaaaaggaaaaaaaaaaagaaaagaaaaagaaaaaagugaagacugcagaaauuuguaagaaucggcauuauucgaggaacuaauaaaaaccccucggaaaaguugaaucgaucucgcguaugcauuaggauuucgagcuccaucagggccgggcugccuuccagcuccgcugcgcaaaguugagcgucugacagcagcgccgcggccucccccgcccgccaggaauggucucuuccugcuuugcauauucaccacgcuuggcccggccauaugggaaaaugcaacugaaggaauuguugugaaaaaagggacagcgaguuugaaauaaaaguuguuagagugguacugaggagaaaaaagaauccgagaccauguacugcgcauacacaaucccgggcaugggcggcaacucuuugauguacuacuauaaugggaaagcgguaagcgaaugcgggcugcgagggggauuuuugacaaguuuuauugucgcagggaugagcauccuagguggugaucauuguuugcaaaguugugcaggacugccgcaccuuccugggugccaugaaauauuuaucauuugccaauccuaagaucuucuucuugccuacuucuucuccuucgucuuuuuuuccccccacuccucccccagaguagaaaaauagaugcuuucagagcuuuagagaguggauccuagagcgaaaguuugcagucagguaaaguugagaggugguaugauuuuuuuuuuuuaaagaguuuuggaaaauucuuauuccuuccaaaugacuguuagaaaggaaaagcagauaugagaagcagaauugagaaagcccaaguuaggcugagaggaaauuugggguaaguuucucccuggauugagguuuugugauaucuaaagucuuacuaaguuggaagcuugagugcaguggauagaguggagagaaccugaaagguuaaaauagagcaaacacauaaaacugagagaucaaauuaaggaguagauuauauaagcuuagauauauauuuaaagccaaaauggggaaggaaaaacaaacggguucauucaugcauauaacaguauugucauaaguuauuugugcuguguggcuucuucccucaauuucccccccuuccaacagaaacgcuuuauuuaagaaaaaaaugugucugguauuuugugcauaaccccagcagaagguuuauacuugccaucuggagguuuauuuuuuuuuuccuucgucugggcccacugaaggaaaaggauuucaauauuuucaaaucgguauguggggcucucgggaagaguuguugggugauagaggagcaaaaauuuauuguuuuaaaauagaaaagaagaaugagagaaaagugaaaagcagccauuuauaaacuguucucuuuguguacuuugaacuuccauuuggauugaucuuaaucagggauaguugggccaaaggggacagaucagagcuuucaggaaggcccaguucagcuguagcaauuggcgcaaacgaauuaaacauguguaugugcugcuauaugccugugaguguauauacauacagaugcaugcauaacgguuauuucuagaugagcauauucuguaauacauacauauacacaacuguuugaaggugcaguuucagaagauuaauaauuucauuuaagaagccaguuuuaugaaugggcaacuugaaauaauaucguuuacuuuuauuuugaaaaguacgaguaaaucaucaaaaguucauagcgcuauccuauuuuuaucuuuuuuaaaaaagagcacgguguaauuaaaauaguuaagugugguaagggaaauauaauuuuaaaacaaaugguuuucguugugauuugaucaaaguguuuaaaucuguaaacauaaauauugggauuauguaacaucuuuuuuuuuuuuuaacaaguacaugauuugcaauugguaguuacucauauauagauaagacuuuugccuauuaucuuuuagauguucucauacauaacuuauucagcaccuuucauuuuaaagcacuuuuaaugaaaauuuugugaaugaugccaucguagucaguaagcaaaagugucucugaagcagauucagggauuagauagcccuuauccguaaugaaagacuuacauuauaaaagaauauaaguuuccaugguuuuuaucuuucaggauuaccaaugaugugacuuuuacauguuaauuguuaauuuugcaucuuaaauaucugaacugacaaaauuuuaauuuaaguuuuguaccuuuuaacucccuuuuggccaaaaggaauuuucaaaaauauguauuccauucccacagcuugccaguugccuccaccguaagaaaaugcugaauaugacaucauaucacuaauaugcccucucaguugccaaauauuuugguuguuagauuuuuuuuuuuuuugagaggaugguacucauaaaaucaagaucgcucugucacaggaaauguauuuauaggaacuguuuuaaggcguuuauuaaaaacaaaucuggugauguguaucucuauugauucaaacacuagaaagaggcaaauuguacacacauuauaguuagaaaaaaaauagccauuuggaacaccagcagaaagcuuuugaaacugcggauggcuaccaguuguccaucuuagcuuuaugaaacagacagcaaaguccaguugugugugucccaaggaaggggccaauucuauaccauuuuuuaaaaugcccucaugcauacacugaggaagcagauuuuuguuuauucuacaguguguauucugcuggcucuaauucugcauugaguggcuuuugauuuggugccagacauguuguggagauuguauauaccaugcguuaauuguucaaaaugccuaucgaagagacuuuacauuucuugaguuuuacuuaucguuuggagguugaauaucuaugcuuuuuuguguguaugugcaugucuaaccaauguguguuugaaccugaauuguugaaguuaaguguggucagcuauuuguugcacaaguuuuccucugaagagaacacagcacugaauuccuucuuuuuucccagugacaagucaauuacuuguuuaaauucaguuugaacucccugaacugagagaggccagaggaagcagguuuucccugugaauaaacaaaagaagaaaaauggaaaaucauuccaaaacacagugauuuuagcuugugggaagaauauaauuaagcauuacaagaauuaugguuucuucuuuuaugaacuggcaacuauaggguuuguaaaaucaguuguccucuaacuuucuagcagaaauauaaucaaugauauuuuaggacaaacgaaaaaaacgugaauuuuuuuacuaccuuaaguuaugaaguguuuccauguccauaucccacaaaaaaauuuuuccuuguuucugugaacaacuguaccuguccagaaguguggacucugaaaaaaauacuuaacaaaaaaucguaacacaagagcuaucaaagaauaaauuuuggauauaaaccagaauguauuuuuaaaaaucaguuucuccucaggugagaguuucaugaacuugauaaaauaauuuuugugauuuuuuuuuccucuaugcauuagagguuuaaauacuaacggauccaaaucuaagcuuaaaaaaaauuaaagcaccacuucugaacuacgaaacagauuuuuuuuugcagagaaaaucaguagcuuauuuuguguuggaaauacaagcuuguaucaaagugugccaaugugucuguccuuauuaaggcuauaagaaguauuaggcauuaccugcucuccaauaaguguaguucuagcucuaaauuuugaucuuuauggcuucuugcauguucauugaagaagaauuuuaauaagugauuauuuggucaaauuucacauaucuaauauuauagcauauccacgaagauaaaauuauggcaaauaaaacugaaaacaaaaguggcgaaauguccucguaaugguaauugaagaucacaucaucagcucucgccagcaugugcauguguuaaaccguagagagaaaccuguaauuauuguaauugcucuuuuugcuuuauacuaacaagcuucaaaccauguuucaaaguaguuguuuugaaauaguuauuugucaaaucaucaaaucucggaaaguaaaugguaaugagcuuuuuauguuuauauucugacuguuggucauauuaugcagcuuuucaaguccauaaaguucagagaugaaacuggauguuaauuauuucugauaucaaggccaaagaauaaaauaauguuacgaguccugcuuaaggugaaaaauuaggaauauuugaauaucagaaucucucaauugggaaacucucuauucuuagaagaaaguuuuccuguaaauaagugacaauaucagucagcaaccuaaauuuuuuaaagcugaaaauugggguaugaagaguguagcuuuuucucauuuaucacaggaagugcuaagauaaaaagaucaauauuuaaaugacgccacuaauaacauuuuucaguacauuuuacauauggcucuuuuuuuuccccccaaaccucacaguugguuggaacagccacacauaggacauagguagccacuggguuuuaaaguuuccaguagagugucaacuaugcaaauuacauuuggcauuuuaaaaauauauuucuuauacuuacuauuuucagaaccaugauuauaaaugaaagcagccaguauaaaugcuuuuauuuuuuuuaauugcuguuuacuugcuauuacacagcaaaaauuugcuuaggccacaaaguaaucaaauuuuuaaauuccccacugguucaauaaaauaaaacauaucaaagagaaagcauguaggaaaaacugcuuuuuugugagcuuauuuuuuaaauauaguuggcacuuuaauuuacccauuuaaaaauaacaaugaaauuuuuuuuuaugcuucauuacuuuaaaacaaaauuauguugauuuuguucuuuauguuuaagcugauaaaaauucaccagacacuuaaucuugacauuguggcuacaucuugccuuccugccucugauuaaauuuucaaaaucccugcaugagauucacagauaccaguuugaacguuucugugaggcuaauuucucagggaaaaaauauggaucaguuacaucuuugguuaauuuuaucuaguuccuaauuucugcuaggucuaagcauuuuaaauauaguguugguaaagcauccuucugucgcugggugauggcauuauugcaggcagaauuaggagaaaggacauuggcauaggagaaagaggguuggggagaaaaguggucaggaaaaaagaucuaauaguugaugcagucuuuuaaauaccuuuccaacugaucuacaggaaauugugcugaagaaucauuuguuuccuguuccacuauaaaugugguuugcauuacauccccuguucggcuuuuuuuguuguuguuuuguuucuacuaaauuguaguaccacgauggaggcuugagaauaagugaugucuuccuuuauaacuuaucuuuuaauggcuugaucauaguuggauuuuagacacugucauauuucauuauaugaauuuuguauguguguguuuccaagccuacuugaaacuucuauuacugcucugccacuaagaaaaacaaugcugcagucuaaguucuuuagaaucacuauuguaggucaaauacauggucuacaugcugccaucagggaucuauuaaaugaaucucuuguuuacucauucagaaaauuuagagauuuuagaugugguucuggcaauuguaaaaguuguuagaauucagauuuacuuuugccuuaagaagaaaauacaguggagacauauauuugcucugcacagcugaccuaaaugcaugccuuguaccugugagaauuucaguaugcggacacauaaaagauuacugggccuuuuuucccccuccaauauuaucagaguuacaaaauaaauaaucuuucacagucaacauaguuuaaaaguaauuuuaguuuuaagcuuuuucaaguuuuuauauguuuaauugcacuuuauuagcccuuaauacuucaaacauaacucuaagaugacacaggcuaaaguuguauaugauaaacauuauugauuacuuaaaaaaaagggauaucuguauauucauaaaacauuuauaaucuauuuaggaaaucaucauaguccuaaaaaaaaagcaguuguuuguauaccaggaaaaagagaucaguagugacaaaaguggaaaagauacuuguauaaaauugucuccuuuagugugaagugaucuacugaaaguuauacuuggaauuuucagaaaauguccauaguuguaggcuuuauaacauuucaaauucuguaauaaacuauuuggcacauuaucauaucauuuuagguauauagauaccauggcauuuuauuaagcaaaacaauuuuuuucuucugaagaauacuuaaggugaaauuuacugguuuugagcuugaaagugguuugagaauuauacaugaacuccacuuaaacuuuggagacuuuccuuuuugcagugcuaaagauccaugacuugguuccaaacuacaaccuuuuauuugcagauguauuuauggcacaguaccacauucugauuagaauuuaagaguucacauuucugauauuucugucucuaaaugcuguguugcuucuguuuaccuaguuuucuuccuauucuuccuaauuucuuaaagaaaucugcacauauucauugagguauuuaauccaaaaagauuuaaaagagacacuacgccucuaacauucuguuuaggagaguauacuacuuuaaacuccguucuccccaccuaaaaaaggggggcuaaagaguggguuugaacaccugagaagucagaggugggaacaguguagaugauggucuaauuucaggcucaaccaaaaaaaaugcaggcuuuggcuggcauccuccagggaccuagcucugugcuuuccuagagaccaaauuacacucaucuugagagagggcauguugagguaauuggugggagagaguggggagaguugaauuccagcugcuuccauuguagcuguccugaaaaugaauaggggauguuaacaauggaggcuaacauuugacuuggcuuuuucaccuccacaaaccuaagggugagaauuauagaguacugaaugacugcaccaauaaugauccuguuuaagugggaauugcuauguugggaaaaacucacaccauuuuaaaaauaguugaugcauuuaccaaccacaguccuauuacuguagcccaauaaaguuuauccacaguauggaaacacuccuuuuuuuuauugucagccaucuaguguguguauuggaucuucaccucuuugguuaccauuuuaaaaugcuccuacugaaagacauuuggaaggcaccagaaucccaucuccaagaagggaagcaagauacaagugcccuguacucccuuucuccuagaauguguggucuuuuuuuuuuuuuaaggagaauaaauacuguaugacucaauagcuuuucuaacgaauaaaacaaauuaaauugauguuacaugcguauuuaaacccuauccaguuaaguacugaugugauuaaaauaaucaaauguauuacuuaaaaaauuaaaaaggauaaauucugcaccccauuauuuuauugacuuuuaaauauaaauugcagaaauguuuacauuccuaauggcauuauuaagcuaaacugacaaaucagaggaaaaaguugauuggccagcacauuauuauuucugcaccuguuauuacagaaguggaggcucagcauuaaaggagcuggauggaugcuguuuucuuaggcuuccuuugugugauguggggguugggauaaauguguaacaaguguaguuucacuuuguagugccuuuuuguguguugaugugauuaaaagacuacaguguuuuucaugucgcuuugaaauuaauaugcaaauaauaugggauauuagggcuucccucuaccugcugcacuaagcuucccuaagccaaaugggguggggauuggugucaacuuuuuucauacaaguuguuuaguugcaaauaucgccaacguuuuaucucuacucugugaauuuguaagggggggagggaaaugucaaacucauugaaguaggauugaagaucugggaugaaaauacuuuaaauuuuuauuuucuacuuauauaucagccaggauguuaggagaccuugaaaacauuuugaaaaaguuguguaacauuaccaaggcuuugguauaagauuauacuuuucuucugguugaguucuuccuuguauuaaucaugcaauaucauuucucagacacuugagcccggcucuccccuggagcauagguggcaauaauuguuuguuauuauaauucuagaauuucuuggguguucauuguccguaauucauuucacacagagaaaucuaaacuuucuucagccaguagaauaaauaaugccuucccuguccuuuccuuuucuuuuuuaaauuuugaguucuuuaggaaugucauuauagucuuugaaacguaaugacauuaaauuuggauugaaggggaagggagaggaacuuuuauuucaugccauccaguggcuaguuugaguuugcaaagaaauagauacaaugccauuauuuucugcaagauacuaguuaacacuauucucauaucaguuuagacuuuguccuguguaauaauuuaaauuccuagauuuuaauaacacuuaauauguagcauggaucccacuuaaucuccccccggcuucacaacaaaauguuuacauaaaugaacucucaauuuugauaucaacuauuuaacucacucuuuccugaguuaauacuuccauaauuaaacauguuccacaguugccauaggaguguaucuuaaaaaugauguucuucucuguucuuuugagccaucuguuugcuaggucaguaaagaaaugggagccugauuuuauuuuaaagccaauaaguuauuacucuacuauuguauuagacauucagcuucagagggaguaaaagauaaaauuccaucacauuuccacuuucuuacauuugcagcagaaacuuguaugcucaaauugguuauuuucaacucaugacagcugugauauuuaaaaugaucacagcuguugugacuuaaaauugauuuuucuauuaacaccugagaaaaagaccugugccguauuaaaaacuuaaauaagguaacuguaaaauuagauguguugaugugaaucugguaauccuacuucccagagguugcaaagugcagcacaccucuugcaugcuuccagggaaugagcuaaaacugcuagaaauagaugcaugauuguuaaaagcguuuacauuuuaaaggauuccuguaauagcagauccucuuggcccaacuuuacagugucacuuuugcugauaaaaucauuuaggauucaguuuccuuaauuaaccccaagaaagaugacuuacaugaaucauuaugauauccuaaccucuagacuagagaagcugcuuuaccuuucagauaugacauugaaaaaugcaaaaccauacggaauuguuucuuaugaaggaaguuuugguuuuauggugcuuuuccuccauuaucuuuagaugacgaaaaaggaaaaacagaugagaaaggacaaauagaucauggcuaaguagcuuuaggcuagcacuuguuuuuggaaucuuuaauacauuuuuaaucuucauguugaagauccauuuaaccuguuuuaaaguuagauggugauuccuggguucaguuggucuguuuaaauguuuaccuuuucaggauaauccguauuagaaucuugcaucucucaauagauuaccuauuuaacaaaguaaccaauuuaagaaaaccuaaacacauuuauacauuaagauauuuuccuguuucgaguuagaugauguaguauauaaaauauauggcuggccugauguggaauuauguauagacaacagugucuucacagaugcauugccaauagggagcuauguagauuaaacucuuuggccaguccuaggcuuuuuaccuguguaacucaaucagaauugaaagcaugacagguuuuaugaugaugaauguauggcuggauuggagaaaguaugguuggguggguagauagauggauagauuucauaacuagacaguaauagauaaugccaauuauuuauuacucaaacuuguuuauuccucagaaauuuuucugcagaguauuauuuugauuauugcauguaguucagaacauuuaguugaaaaugauaaaauauuugcugucacauaaucaagacugcuauagaguugguucuaaaaguuccagagugaacauacauuaccugugucaaaguuagaggcuaagacuauggagggccauaagaucacaaagucagacuaucacauacuaagugaucaugggugucaauggcuauuuccuuguuuaguugaaagaagauacuccucgagauggacauuguuuauaugaagauuuaagaaaaucaaaguggauauuuguugcugacagacuaagauuacaaacauauaucuuuagaacaggguguuccccaggggacauacggcaauaucuggaaacgcuuuugauugucacaacugugggggucaggcaggagcuugcuacuggcaucuagggcuggaggccagggaugcuacuaaacaucuuaacagcgugcaagacagacccucagaagugcugagguugggaaguccugcuugcaaagugauauaucuggaccuuaagaauuaaauaaugucauaauaaguuccauaauuaaaucuuggcauugugaggcauuuauagaggauaacauuuuuuuguuuuuuuucuuucccuuucuauuucccuuuuccuuuucuuuucuuuccuuuuuucuuuuguuuccaaaacauuguuuuuuguuuguuuguuuuggcauagcacacuauagcauugcccagguauuucuacguuuuaccaugaaaacgugagauuuuauaguguauuaaauauuguacauuauuugugaaccaacuggaauggcuucaaagcagcuguuagaauauguugagucaguaacacaacaugucugcauacccuaaacauauauuugucuuaccuuuuaaaauguuuagaacccucuaucaguguaacuauugguuugucuugaaucauccuaaaugaggaaguguauuaccauuuuuucccuacaggacauaaaguggaaagaagaaauuagcauaaagaaacuaauuaauaauuauguuuuaaguuuuuuggcauuacggacauuguuuacaucaucauuaacaucauaacaucauaucgucuguuaucaagaaaagauuaaaauuuaaagccaacauugaagauguucuuuccagcuuucccaauaaugcaacuccuuuaccuccucacaacuggggaccucucucccugccacugcugcgcuucuccucaauguggauaauucuuggccaugauacggaagugauuuugaaaccucaguugccuucuguagcacccuguggaggaagguggcaggaucugguggcugagucuuacaucugccaacuucuagaccucacuccuuaggugccacauuuuggagcuaguugccaagccucacaguaacuugagccacucuucaauuuccuccccaugauauacaaaguucuccaagguuuaaugagaguagauauggaggcugggcacgggaauggcagcucugauuugcaguauaucuuugguguacagauaugcuuucauuuauugcuuagcccauuagcuaauggaauuucaauuccuucccacaggcauucucagacccugcacuucacucuuccuguuucccuguccagcuugguacaacacauucuaguaaaaucacacugauguguuuagguuuacuuuguacaucacaucuguaaccaucuauaaguuugcccuaaacuggcauuuauuuugaacugucuuccaccuuuuauuguacagcguugucuguacucaaagugagcaacugaaaagaaaauuuuaacauucuuuuugugugccagacaaguaauaaagauuacuauuuuuaugguaauuuuuuuauuugaauauuucuguuucuggaagaugguaauuuuuuuaaaucaugaauuuccuguaagugaaacuauuugagggaguauugaccuuuuuuugaucaaucauugauuaucuguguugcacucucaguauuucucuuauaguccauaugucccucugaauaauuguagaacaauaacuugcuuacacaguguuuuuagaauaugcuucaggaagcuugccugugugguauuuaacucagacauuuauggaguauaaaaccaaucuuacugugacuuuuaauuauuaggaaaguggcuuacaguuaaaauaaagcuuacagaaaauauuguagcaauaauuaauauccaguaaaauacaguuguaagcuucgguucuuucagacauuuucucaacccaguucuaauuugaucguuacugcaccucaguaagauaggugaugcaggagucaucaucccauuucacaggcaaagccuggccuguucagugagguagccacuggccccauguggcuauuaacauucaaaugaaggccaggcacaguggcuuaugccuguaaucccagcacuuugggaagcugaagcgggaggauugccuaagcccaggaguucaagaucaacaugaucaacauugggacacccugucucuagaaaaaguuaaaaaaaaaaaaaaaauuagccaggcaugguagcgcucaucuauagucccagcuacuuaggagauugaggcaggaggaucauugagcccaggaagcugaggcugcagcaagcugugaucaugccacugugcuccagccugggcagcagagcaagacccugucucuaaaauuaaaaauaaugauaauaauaauaauaauaaauaaaugaugucagucaaugagaauuaaauaaaacuuuaaaaagaucacuuccuugguugcacuagccaaguuucaauuacugaguuuucauauaugaucaguggcuacuguauuagcacagauacagaauauuuguaucauuguagaaaguuccauggggaggugcuggccugggaaauggaagcauugagggauuaaaacuugcugaagaucaugugggucaugacagaauagagucauugcugcuauauauuccaauaggauauuuuuacauuuuucuuagcuuuauugucaaauaucugauguaagaauugacauuuuaaugcuaccuuguagcacuuuacugaaugcuuaucucaacugaauuuaaauuuagagcuugaguuacacaaacuuuucaaaggauacagcccuuugccugucugcacacaauggggaccuugaauuuccagccagugauacccuccagaagggaccaugucuuaaugcaucuuuguagaccuuuuggcauauuguagacaaccaagaaauguuuaugcagccuaaugaaugugucacauccaccauacgggcauauguccauacauacaguuagacaagaccuuuggguagaaugcucccgagagagcuggugucugccaaauuuuacagagcucaugccucugcucuugcuguuuuaguaaaaaguaguauuuuaucaaaaguuaaauuggguucaauauucaccauuuggguaauggguacauuagaagcccaguccccagcagcaugcaauauuccauguaacaacaagcacguauaccccuuggaucuaaaauuuuuuaaaaauauguauuuacucacauaauccaaauauuuuucauaguaaaugaaaacgucuguccaucuuguccuuagcagucauuuagucccuaaccugacuuuguguuguuauaaaguugugucacuuaaguaguacuuaaguaaguacauaccuacauccauacuaucuuuccauuuccugcaucacugaguuggacaaaugugcccaguuagcguugguagugcugaagaccauguucauucauacaugcacucaaaaucauauuaauuacuuuucagugauaaccauagguggcaacagaugaaugggcuagcccuaggcuauuauuaagcacugggaaugagauuguuggugccuuguaccugugcuacuuuaacaggugagacaauuccagagcuuuccccaucauccucucguugcuacagucuagacauugggagcacuggaagccuauggugacacagacuggcagaugccuugggcuucuaaugguguauauguaagccaucauuuuguuuguaauaauuaugguguugagaagcauuugugugcugugcacucuuucagcuugugccacguuuaguuccuguuaugcaaauaccacuuuaaacuuagaaauuccaauuugcauuaauauuuugguuucauagagcuaacuauugcauuucacaaacaagugcauuuuaaugaguaccggcagaaugauuuaaaaauguuauuuauuaaauacuauuguagaaaaugcagucuuugguugccagaaacuauuaagacgaaauauaauguguguugaggccacagaguacaccucuucaagaguauuugacccuuauggcuuucagugauacaacagccaaugcucuucaugcaggcuuggagggcagagguaauuaauauaaaauagaagccagcguaccauugacguuuggguuuacuuuuaaaauguaaacauauuuuuacuauuugacauuugucauaagaccauaggucauuuaccucugaguuaaggugaaggacuuuaccagucauaaacacccaaguuuuaaagcaguguuuucuuauaucuuacaucuugauguuaaauccugaaauggaguuuguugcugcuuuauaauuuuuuucccucuuccuaaaagccuuuuuuuaaaucagaauuguggauaaaaaaauuuugauguacaaugugugggaaaauaaaaauuuugcaacuggauuuucagaaaugaacuauuuuaacacauggacuuugaaugcugcugucaugguugucauagcuugugguuccuaauuauaaugagcuuuuuuggugguguuauugcaguuguuuuauucccccugcccccacccagucuucaacucacuuuucccagaaggagaguuccaagccuuugaaaauucucaugauuuugcaaauccacucuauuuuugucuagaauacaggaaaguuaaaacuguggcugguaugaugccauguuuugaauccaauuuuaaagcaacccuuugcaacccagggaguaaagcugacaucuuuguaucuguaaugaagauaauuauaccugcaaggugacaucacuagcaaaguaacaaauacccuugaaaacggaguuccuggucuucucugaauucuguagaccacauuuggcauuuaacaccagacaccucuuucaugccugucguuugagaaguugcuuucagaugaauuuacuaaagcugacugacacaggguuaaauuaauucuuuucuuuauuacucaaagugauacagaccuuucuuggacuaauguagcuuaauuaguggucaauuaaaacugaacauugcugaauugaaguucuuugaucaaacucccuggcaugggcuugcuuucuuuaacuagccaccaucuugaauucauuuggaaucaguaguauaaacaaguuaaaaacugguucuuuuauaagaaagucagcaggcuuguauagcugugguuucuuuuuuuacuucuguaggcggcaauucaaaggcaugcuaaaugaaaacaguacuacacccugaaaaaauuacauuuuuaaaaguaacacuaagcagucagaaaacagucaacacccuuaccuguuuauucuagauacauuuaucuucuauguagaacaaauaauuaauaauucacuucccaauuucagugguugauuuuguuguuacauggaaggugaaaacuccccacccucccuugcaaagucuauaguuauaacaaaaagugaagcaaacaaaauccaaccugguuguugggaguagagucggaaggggcacgguaaaugaaggugugcccaguugcuccuaaauucauucuuugucacucuugggaaaauaguucaccucuguaucuuuggagugggagugacacacuacuucauuuacuuauugauuucaucauuuauuuugaagggcauuauccuaucaguauggaaacugauaauagcauauauuucauaugaaucacuugauuaaaaauacacauugcuuuuguuagaauuugggugaaguuacaaaaaaagagaauuaggggagcugaaaacuggggcagaggaaaucguaagcauugguaauaagaucacccaccuccauuuauccaguuacaugucuuaauauuuaaaguguauauaccauucuugucuaaacauaaauugauaccauuccguaauccuaguuuuugaaagcuuaacaaccaaaaacauacauccuagcuggcauucaguuagugcugugcauucuggaguauuaauugaaacugguacuuuuguacuggaaauaaaaguaauagauuagguuuaaauagauaauuugcuuaguucauagugauuucuucugguuuuuggaaauuuucacagagaaagaguuaaaggaaauuuggaagugaccauguacaguguucccccuguaagugacagaauuuuugugguuuucauuacuuagaucgaaaaauuguaguuauaaucaauaauuaaaauuaaaaauuuuaccaguugacagaaagagaaauuguuuauagucaaugugccuuucagccuucucucuugccuucucccuaaaaggcugauuaggauguaauaauuggggaugauagcgggaggaagacgacaauuccauuuaauuaaagauaauuuauuuuacuucaaauuggugaugucccacaugaauaagaguagcuuuagcagauagauuuauuaauggguacugacaucucaguugacagaaaaagcaaacauuuucuuuccucauuguuuuuauugugucccgucaccugaaacugcugucaccaugcuuccuuugcugcuugacagagcuguagacuuuuccaccaaauaugcaauuauugguuuaucauugaaacaaaguugauccucuucugaguuaaaaacuaggccaggagcuugaaaggcgguucaggcuuucagagcuaaugcuacaaaugcucucuucuuaaaucacauuuucucaacugauccuucccauaucuaguucaugaguagauugaaccuuuugaauaaggaccaaagauuuccuuuggucuugggugaggugcuugcaugaauauuccuuuaauaccuugaaugucuuggauaaugaaaugugccccaaaaaacuaccauuugcauuacuuagguucauuccugacaaggaauucugcccucgugugauauguucguuguugucucaugcaaucguaaauggaucuuggaaguugggacaguuuuuuuuaauuaggaaguagauucaagaaaugcaugauauuguuuuucauauaaucuccucagucuauagugguuguaaaggugugcuguuuagcauaccuuuagcaaaacuguauuuauaauucuauguaucuuaaggcacuuuuuaaaugcuucugacaaacugcauucuguuuuuccaaugucuauuugaucucuguuacauuaggcuuauuugucuuacucucacaucgaauuccuauauuuuuguuuauguuuucugguguucagucauuucuguaugcuugccuaguauguuucuuucauaccgucuucuucacugaaugaaaugcagaccaccuuggccacuuccuuccuucugggcuucuuuuccuauucacaacuuccgccauucacacugacccucuagcuuuacuuauaucuauugcuccugcugcuuuguugcucuaauuuucauauauauuuccuuuaugcuaauauccuuuccuuaacucuuuggauuucacugguuugucuuuccagcuuuauuuagaaaauuaggccauauaacuaauguuuacaccguagaaaggaaaaugagauucuuucuuucuuuuuuggaagugaagaggugagaagguugugguagagguuuucuuuuauuuuaaaccagauggauuuauuuuguccugcuuugcuauuucacuauuucaaauugauuuuaaaucagugaugguguuuucaaggauuaauuuuuauuaaaucuugauuuucaugucguguuaaccuuuuccuuccccucagccaaagggucuucuuccuuuuuucuguccauuucacuuguuuguuuuaauaaccugaucucuccagccauuauuuuauccucaaauccugccacuuuuauccaucuuuuuuuauugcacuguuguccuuacuucaccuuauaucuuuucuucuucuguaauuauuacagaauccaugauaccuucuccaaaauucuaacaaagaauucuggaaaaggagaaauugggaaagagaaaaauugcaaguaauguucuuugcugagcccuaggaagucugcuuggauuuuuauauucgacugauauuccucccuagaguugcagucaugauucuauguaguagggacacgaaggcaaaaguuuaaauagacuaacacugacccuuaauuggaggugauaauccuacauauaaacuuucaggagggaaagcgauccugcauuuuacaucagguaaacucaguugcacccauugccaguagcugggucagguguguagggguguguguguguguguguguguguguguguguguguguguguacguacugggagccagguuggaaguaggaagagaaggagguucuucuuuccucucccacuugcaagcuauuuucuuucuuuucugucuguuuucauuauuucuauggcaaguuuacuugccacgucuuaaacaccuucaaccuuuuugucucuuccuuuacuuuuuugcuuuacugcuaucaaagaguuaaggaaguccauuaaauuggaggccauuccucaccauaagagaaaucuggaugggaugcuuuugacaacugggcucucuuuaguagcuucucucuacuugggaaaaugucagauauuuugagaaauaaaugcauugccccaaacugaaaacaccacuuuuauucuguaaaagaggcauucagggaaggagaccuccucuauucccaggaggucacaggaacugggaguggcaagaaggaagcugcuaaacgggcuccagaugcagcuuuauccaggggacgccucaugccuggucauuuggguggcugggcuugucccaccuccccuucuucaugcccuccucccggucucauccuaggcccucccaccccuaggccagccacaggccucacagcggacaucugcgggucugaguuucauauauccagcaugaaguucccucucucccucccauuaugaauucugggcugugguccugcuugcuccuugugugucagauugaaguucugaugcugucagccaugucugaccaaucagcaaacaacaccacaggaugaaauuuaaacaaugcagaugcucagauacagggcuauguugccuggaccacgaagggaaagcagagguaaggucagagucuccccaaaguggucuauccugagccugccugacuugacaccucuugggcugcacugugcugcuuugacuuguauguuacccauuugcuuugcacuacuucugucuucccuggcauucaccagaacuuucauuuuaauucgcucugcccggguuacuuuaccaccuucaucugcucacguccuuuucuuuuggauuggugcugacugucauuacgaauguuccuggauugccucguggccgaggguccuuggcaagugccaccuuguucaggucuuuuguggccagacuuuuaggaauagaggacugcugaggaucagggcaaacggacggaguuaauaggccuuauuaauuuucccucugcaggacaguggaauuuaucauucgguuacaaccacgguuuuguuucuuaccauugugauguauugaauuguaaauugagcuuaaaucaucuuuuuuucucagaaacgguuuacuuagaaaagauauaaauagauacaaccuaaacgaggaugaaucagcucaucuuccaagaguuuuggagggggagaaagggaauugauaacucucccccacccgaauccccccccacuuuuuuuuuuuuuuuuuuuuuuuuacaguuuuugguguuagcucacuagauuacuguuugcaaaagaagaaucucaucaucauccucuucuguuuuaaguguuuacuuggcccuuuuauaauuuaaaguguuuacacgguucugugcucccuaggcccaucuggaaaauauuuaaacuucauaagaucuauaagacuagaauaucacauauaaugggauagggggaaggaagaaaaauuagagccguugcguguguuuagaauaaguuaguuguuuguucagaagcggcugcuggaggaauuggaacaaauagcugugugcggugaacgauuggguccagagcuguacauuucaccacagaaugagccuugguuugugaaacugacauucuguugugacuucuaaauccaaacaaaucucugcaaauuucugcccgaucgaguuaauaagaaaauauauacaugcagaggcgagagccguaugcuacuuguacuucugucaguguugguggaaauaagagacggauuuuaccuacuguauuacauucaaccagcaauuggcagaacccccagcucagcggguuuucuugacuuuuuuuucugcugugagaacaaugggaugcaaaagggcuucagaaaaggagagcagcagauacgggauuggggucacuuuucuucuaauugccuuguaauuggggagugguuuccacuuucccacuaucucacuggugggaggggaggaagacagauguggcuuagcgguaacgagcuuucuccaggccggaugugcugagggaccaggggggucauucccugcucugggccugugaucugcuucacaccugugcucauuuucccccaugaucgaugaccuuguauuaacccagagugaccuuuugccuucgccuguucucugggacgagcucuuggcuaguggacccuccuuucucucugauuuacaggugguuacuggagccacauacacuuguuuuucauggugcacugugcacuuagcagcccggcaagaccugcaauuucaucccucucaaggggccaagcaggggauuggaaggugggagggaggagggugccgcgagagugguugcuguuugcaugugcuuuucuauuuuguggcucauaugguaucaauuaccauuugauggcaacgccaggccugaggcccuucgcauguuuguccugugagaaagaucuggaagaaccgacauaugguuuugauugcagcaauugcagguugauagaaugaacgcaggggugagguggguggguuuuccuuccggcccuuuccacucuggguugcuaaugugcuucgcuuguggaacuggucuuuucaucauccagccccucccccacuuaccccucccccacccccaacucccugccacuuugcauucccugccccugccuuccaaaugaccgccaggaacauguggcccacauuaaggaccuucaauuaaaacaaacaaaaaauuguccacucuucuguucagucccagagcaggucaguccaucaagaugguuggaaguguaccacaguuaagaaacaaaugguuggcauagggggcagauucccuccagaagcuugggacauguuuuaaaauggcuguuaguucagauuguuaaacaucgaaaugaugcugaaaaauagcagcaauagagauuaaugugggguguguguguguguguguguguguguauaucuguauguguguguauuucauuuaagacaccucuuggaaucugugcaucugcugcauagggacaggaagaugaugauaauggauaggaguucuuugggguuccaucuuucuguacaucccaggccauaagaugauggaaaagcaagugaggcaugugugucucuaugagcauuucccuucagaaggaagauguuggagacucaucucccaugcacagugacuucucucuuacuaaauuugugaugguaggggguacuccucauuacuguggcucagcagggauugcaucugugaauaugccaagggagggucuacuauuggggaauggugagaggcaaagaggagaaaagaacauuauaggcacuuugaauguuacccagcaacauuuuuuuuguuguuucaaaguaacaucuuucuauaaugcuuucaaauuuaccugucugguaaucuguucuaagaugggcagcccaugagguuuugacuuuuuucacuuuggcuauugcauuucaaaauauuacucacaauuaggaauuuauaccauuugaaacaauaaugugguaucucaugaguaaaugcugccauuaacaucuuccuucuuuuaaacugaaaacaagcaaaccagacccaaaaaaaaaaaaaaaaaagcagaaacaugcucccccaagaaagcuuguuuuuuucuuugagauggagucucgcucuguugcccagguuggagugcaauggugcgaucucgacucacugcaaccuccaccucccagguucaagcgauucuccugucucagccucccaaguagcuaggauuacagguguccaccaccacaccuggcuaauuuuuuguauuuuuaguagagaugagguuucaccauguuggccaggcugguuucaaacuccugaccucaagugauccgcccaccucggccucccaaagugcugggauuauaggcgugagccaccacaccuggccaagaaaguuuuuuaaaugugagaugaauuuuuaguuuugaaggccagcuauugaaaccuaaucacacugcuugacauacuucuucauauuuaucuuuauauuagagcugaucuuuaucaaaagguaguagaaacuaaaaaacuuaaguuauugaccuaaauuguagggaaaugucugucugaucgacucuagagagaaaauuggccguaucuuuauaaugguuacugaauguauaucuucaugaggcuacaguuuuuuuuucuuugcuccaacuuucuccuuaugauguagagauugguguauuaaauaaucacuuuuucaacagucuugaugacaauuuuauuuugcuauuucauaaucuucauacaaugggauaaguguuuucagagauacguuugaauucagagcaacuggcaauuaagugauuugcucuagucacauguuuuaguaguagcuauuugguuauuugccugauauuuaaugcacacauauguacccuuaaaucaucauucagugugauagcuuaagacaacauuucuguuugcugcucaugccacuauuagcuacguuugaagagugauauacugagaaguuuaauuugcugggguuuuuuucuaaaaacauugcuuuccugaaauauauaguauugggggcucauagcaaaaaaaccguaguauauggguugugagccugucuucgaacauggugggucacuuaacagcagcugugcuggagagauauuugauuugagaagacuguuuugaaucuucucagcccuaacaccauucugguuuugaaaugggaaaauggaaaagaguuuuagggaauagagauaucucagccuugaaaggaagcauagguagaaaucuuucaguucucacucagaugaaccagcauuccuaaucuggcuacccucacagaggacaaagagucugcugggaaauguggguuuauauuuguagagacacacuucagaggcaugagauaguguuagauaccgacuggaugcuucgugcccaacaucaauuugguuugcagauugaaauuuaggaaagcuugcagaggagccaaucuuuuuuauauacagcaccuuuaaaaaaaagacuguccacuacuauuaaaaucugauucagucuucuaaaauauuacuacauucaagacaacuuuuaaaaugaucaaauuuagauagacaucaaugauguuaaaagauaaaagcccuccuacauguaauauauagugucuuaaaccuuauuuuuuaaaaaagggauaccacuuuugccaaaaguuucaauguagggauacucaaacuguccuuggaaguccuaaaaauugcuaguuuuuuuuuuguuugcuucuuuuuuuguuguuuuuguuuuuuguuuguaguuauucacaaauggagaaauauuuauaaaauuauauuauaauuuguaaugcacgcaaacaaccaucagaccacacuugaaucagagaguuacaguuauaaauugaggaaagaggaugccagcacaaugccuaauggagugaaaaauugugcuuauuuucacaggacucucuuggagaggagcuaacuacuuuccucucucuuaauacccagacccucucccucagcccugacagcacguuacagaaugcauucacuuagugugugaagagcuagcucaccaccucccuuuaagaucuauucuuguuauucauacauugcaaauuuguacuuuuguauccacaaggaagacauuacuaacuucaagaaaggcagugucaaugaggagcaggaaaauacaguaugauacaagccugccaaugaaagaauuauacucagacucuaugcgcucuguuaaacaaaauuugaaccuuugaggaaaaaauauuggggauucugaugaguguuuuuacucuuucuuuccuuuuuuuuuuuuuuucuauuuggaaaucauggcuuccugauccuaagggauaaaaaaaaaaaaaaaaaaaaaaaccucaaagaaaagacucaacaggcuuucuggacaucaaauaguuccuacaaaacaacauucugaugacuugcauguaaagaaaucagaaacauaugaauuaagcuucucucgaaauacauauggguugaaaaauagagagaagugcugagaaaauguguuuuggguuuugcugagcccaugacguuugaaaaauaguaugagacauugaacaaacacaaagcauggcuuggcucacccauuccuaauauuagccuucuaguucaacggcaaaucaguuuaccaugugccuaaaugugagccaccuuggugcacucccccacacuuaauuauaugcaguuuaaauuuuuucaauuaggagcucaaaaauaacauugcauuucaaggaaaugcaaaucuuagcauuuucuuaccugguuuguucaccucagaccauuuuagaaaacaccacagauuauuucaccuuaggagcagucacacugauguggcccucuuugauguggcuggcauauaacagaagaaacguaucauuuuuaagaaacuggcuccaaagacaauauugcuauuaaauugaagccaaaaaccacugcagguaaaacaugaugaagaugaaggacgcccucucuuagccauauaguagaagcccgaucauagacucucacccuuacaccaugacuugaguuccugcucauuuuuaucccugagcucugcagacuucuaagcaguggaaguuuucauucucuuucccacauugcacucaagagagcuaacaugagagauucuaaauccugggauuccucugcaucuggcuuuaaguacaggagcagaacacagggaauuuaaggaacaaaaauagccagagcuucaggcuucuuccacugaugguaagucauugacaugcacuuggaugaaauccuguaucuguucuuuggacuagcacuaucgccugagauuaucaguuucagagaguuacagagaggcaguagauuucaucuuuccuauuucaggaggaguuauuuugguuguuuaaaaaaaaaaaaaacacuuuaauguacuuuuccuaacuccuucacucagaugguggcaagaaguuugacagaauaaaguaauucagcuaauauuuaucaaaugccuacuaugagugagcuguuagaauauaacccugaacaagacaagcaugagauaggcaaacagacuauuaaaaccuagacugauaaugcauugauugggguguacaggcuccuuaagguagauauacaaaggacaacuaguccacauuuggccuuagaggaagugaagugcaaggaugaaugggaauuaagcuggcaaaaugcaaggguuauaacuggaagcaggggugagcauggcauauccggugacccagaaguaguucagaaugccagaagcuuaugguacaaaaggauaacauaaaagaugagacugaaaagguaaacaguggccugaucaaaaagcgacuugugagcccuauuaaggaguugagauuuuaucaugaaugugacgaggagccuuucaaauggguaugccugagaaguaauugaauuuaaaagucaagacggauaggaggaccuggaaaacuuagagucagagaagccaagggaggcagaucugaccagaaggaggaaauugucaacagugucagauguugcugaaagauagaagugacauuuggcugcagcauccaggaggucuugagcaguuucauugaaguagugaguguggaaggaagguaaagaaguggagaacaggcauugcaagauaauuuuccaucaucgucaucaucaucguccucaucaccggaaaaugagcaucaauuaucuuaucuaccagacauagagagugaccagguaaggaaugacacaccugcagccugggagauuucagaaaacagaucauaaauauaaaacagaagacagcaacacaugguacaacacaugcaaagggcaaaaugagcaguguaggccaacgggaugaagaacagaaagaauuagggggcaggugaaaugggagaguuuuucaagcagucagugcgcuugagguuugcauucuggauugugccuccuuauaagucaguccaaccuguuuuugauucuccauccaguggaaauaggaaacaccaucaaagaugaugcauagucuuaacuugccugugacuucugauuauguuuccgaauuuugggaggaagauuaaagucauaaacugacucuugguuuguuauaauuucuugcaacuguuauuuuaaaaauccggacacaggccaaggcaggaggauucucugaggccaggaguuugagaccagccugggcaacauagugagacccugucccuacaauaauaaaaguaaaauaaaaagaaaaucuggaugcagaaacugagguguagauaaauauagcaagucagagauauucguaaauucuacaucgaugaguuucuugagaaauucugcacacccagugcuggacaacuguggaauugcagcgugauaccuuucacaucugggucaucuccauaugauaucuucuuccugguacaaggccagaaguucaccccacgcacaacaccuauggaagccacuuacgauucaaaggacaguuuuucugaaaaagggugcaugauguauacuucccuucaacacuaaaauucugcugcuuaaacuuuguaagugaaggaaaggacugguucucuucuacuuuggcugucuuccuuguuuccuauuuauugggugcuugcuuugggcaacccauuguauuggaugugcucuaaaccacaaucuuugcuccuaaggaguccguaguauuuaucgggggauacgaccuggauaauucauauaagauaugaauuucuuucuuuuucuuuuuuuucuuuuuuuuugagacagauucucacucugucgcccaggcuggagugcaguggcgcgaucacggcucacugcaaccuccgucuccuggguucaagcaauucucaugccucagccccccaaguagcugggauuacaggcacccaccaccauacucagcuaauuuuuguauuuuuaguagagauggaguuucaccguguuggccaggcuggucuugaauuccugaccucaagugauccgcccaccucggccucccaaaguccugggauuacaggcgugaaccacaaugccuggccaagauaugaauucuaaaaaaaaaaaaaaaaaaaaaaaaaaaaaaaaguccuuggaaaguuuagaagaugaaauacauuuaaugaaaauugagcucauucuuccccaauauuuguuccauauuccucuccauauuauacuauuaguacacaauccuguuuggacuuacuggaaaaaagagcugaauagcuuauccacaugucaagaaacuuucuguuuaagaacacugagguucaucaacaucaaaaaauauuuucagcaucauucaggcacuggacaugcucuacaaauuaaauaccuuagggccccuacuauuucaguguuuucucagugucuuguugcaguggcaaaugcuaugaacuacauuuuucaaaugaauauugaagauugagaaagagguuaagaaccucuaucuauuaacgauagaaccaaaucuagaaagaugucuccugcucuguagagcacauuagggaucauuauuuauagccauuuggcucucuuaagacauuuuggcaaugagggaaaaaucauagguugauuuucuugguggaaugaagaacauugaguuugcuaacaaagagagcaugagugacuuugguaagagagcaguuuuuauuucaguggaaaggcagccuccucuccuaauaauagcuacauuauuuaccuaaauguuccauguagcaacugauaacaaggcuuacugcuuaagaaauuuggccaucaucuuguccucucuacuagaauuccaucugccuacagaugggcccuugcuaauauuuuuuuucugaaggacaacauguaacuuaagggcccacuacuguguguuauuuuguuuuuuuaauugaggugaaagucacauaauguaaaauuaaccauuuugaaguaaaccauucaguaauauuuaguacauucacaauguugagcagucaccacaucugucuaguucuaaaacauuuuccccagcccagaaggaaacucuguauccauuaagcaguuccuuccuaucccccuacuucuaggcuuuauaaaccuuuaauuuuaauguuauauacacacacaggcauacacauacauauaugcuauacacacauauguauguauauauguauaauguguguaaauaauguguaaauauagacguauaaagauguauaauguggguaaauaaauggauguguguauguguauauacauauauguacauguauacauauauacguauauauguauacauauauguaucuacgcacauguauauacguguauacacacacacacacacauucaugucuauuuauagauuaggaaguuccaaacagaggaccuaauauuuccuaauuauguaaacaaagaacuaucuacuuuaaugaauguuucuccaccaggaaaaagaaaaauaggaaacauuccuugcuucuuuuaaccugucuguauauuucucuuaaauucucacuagaugcuaauuuaucaaggaagacaaaaaagacagaaauaauccugagccuuuuguuguguaaaacugcugcucuucuuguaaagacauuuucucauuaauuucaucaacacugagaauuuuaaacugcuucucaauuuuaagcaauuguauggguuuuacauuucuauuuuugaaaauccaaaauuauugaacaaaguaauuuaguuagcaaaguuuacauuucuuggaaagaaauaugaaagggucauucuuacuauaauuuuuauuguuaaagaaauugcuguuguucacauguauuuaugcccuccucauuccggaagaauauuugagguagccaguagcacauuuuuuugaauuaagaaaaaauuagaucaaaugaaaaaauaccuaaaauuuaaauauuuagagaaagccaacucaauuauauuuuaaauaugccugaagucgugaacuaacuaauguugaucauuuagucuucugguccuaucucaggaauauuauugcccuucuuaauucaucuuucaccuccuuuaagaaguauuucugaauaacccuauaggauaacuuccuuuacauuucuuuagcucauaugguuuauacaaaaggcuacucacuuuaucacauuuucuaguugcuuauuguacuucauaaaucucccaacuaguuccuagugaaaauucugcccuucuaauuuuuuguauguaauuuaccaaagcaccuagcuuugugcuagcuaaaagcucugcucugaguuaaauuagugaaauauugcugguugauuucaccuaaaaguuugccccgggcaggagggaagagggugggcauuugaauggguaacagacagagaagcagcugauuggacauagauguugacaacuugcauacuuauuuuuuucauuucaaucugugccacagagucauacauuugguaauuauuucaugcuuuuguuuucaguugaaaguaguuagggccauauguuuugacagaaaaaagauaauucguacuuuuuuucagcuuuaugaaagggaagaugggguaacaauuuuacaguguaccauggcagugauuccuguucaaaacuuuaccagauuggaaacucacuguucauaacaauucucuugguaagcagaagaugaaggcaucuguuuaaagcacccagaguuaaguuugaugcuucaaagcacagcagaguucauuuauaacucuacuuagcacuauuagauaucuuuaacaaauaugaaaaguuguccaccagauuccuuagacuguaggugauuuggaaggauauucuggucaagugcuaacuucugacugaggauuucaaaugaaaagaccuagguuauaaccccauuccugcccuuacucugucuugugacucauggaaaaggaaggcacuuaacccgcuccaagcuuauguuccugaauguauaagauggguagcaugguugaccacuuagacagauaauccaucucaaaaugaugauuaaagaagauaauggaugagaaaaguccuuuugauuuaaaauacuaugaagaugugaacuuuuaauaaugacuaaugauagaauuuugucaaauuugcuuuacguaauuaaguucaagaucaaagaauauaucuagagaaguaccuauguauuuugugaaauguuucuuugaguauuauuauuaucauuuuaugucuguuagaaucuuggccucacugucuuuucauucuugcuugaaugucgacucuucaaagugugacuuucugcuugugucugaugcaacuuucuuccugaucgcucuugcuuccugagaaggaauagguacuuaggaaugauggcuuuuuggcugucugugcuuauuagguacaaacacagcacuaaagacauuugggacuggagaaauaagaagagcgccuuuaggguuguaugcaaaaggucaaacuauaauguaguuagcauuuuucuuuguacugcuuucccuucuuguaacaaccucucaauacccucauaccuucucugcuuuccagaaaugcuuucuaaaaauugauuauugggaaaagaucugagaccucauugcccugaaguguaauuacugcugacaaacugugacagcauuucccaaagacagggagugauuggagaugugaugaaaaguggguuugugacuguggaaacucuuucagggauguaggcuuuuaccccucuugguaauguaccuugacaaaagucugcagcaaugaaauuaacuuguucacuccaaucgcaucuaaaguuauuugagcuuaaguccuuucuuaaggaugucagcuuuaggcuucaggcaucaaccuguggacuagaauucaaagggaaaaggguagggaauggugcucuuaaaaucuuuaggaccauuauagguaauuccauauccuaaagaaagcucagcccuaaacacauuagagaaguggaaugcacuaaaauauauuuuggcagaaccaaugaauguuuaucuuucucuguguuaugauguuauucuuaguuugacguguaucccaugugugguguguuuauucauucaugcaugcaugcacuuaguaaaguuuugagccuauucugugcccggcauuacaugcacacacacauauguccaagcacaccugcacauuuuuuuuuuuuugguaaugccuuuuuuaccuuauuguuucugcaacuggcuauccuuagcaggccuucuuaauguacaauaggguauagaagaaauaacaaucaacauuggaguaaaccuaaaauuaauuucugucuuuauuguagagucauagaauuuguuuuccucuggaagaugugcugcccucauuuaauugauaaaacagugcuuucagaggucacaaagcuauuuuuuggcagauauaaccaaaccuauuuugauguuccagcaccuccuaaugaagcaguagucgucaucuaaaacaaaaagcagucgguugcuaaaggaggagaaaguguugagaugugagaugaucuguuagacauaauugacaaucaugaauuugauaugauagguguaaacagagauagaaauaauuuaguuacaucuguuuaagauuuaagauaaccagaagcaauaauguuuaauugaaauaauauaucagguucuccuuaacauuaccuugaauuucuucacaugcacaucaaugcauuugguaaauaaaaguuuggaaacaacuuaguuaaguguuuagaacauauuagaguugugaugugcuuagcauccgcagucuuuuaucugugccaacccugagccugguaaugaagccaacucccacaugaauaaguaacauaaggaguguaaccaggaagaagucaggguuucaccuggaccaaauuuuaggcaauuaaguguuucaagagaucuuuagccagguguaacuuaaucaguuuaaggcacucucagcuagggccaagguacucauaauguuggcagugggcauucgucugauacaccacguugaaaguaauaggaaacauagagugucugcucaguuauugccaagagcaagagaaaugcagguguaaaaauauaaagaaguauuuggagccagaggcuaguacacauagacaagacuguauuuacacuuggcuuuaauaguucagauaauaacauggugguuuuuaaucaguuuagugugcugauauuuagucgugggucugguuucaccacuaaacccuaguguaacucucagccgguuacuuagccucucucugucucuaguaauauuaaacaaguguauuaauaccugcugcaucuuagcucaacuucaugucuggaagacagaugaaugguccugcuucuugcaguaacacacaagaaccuccuuugugcugcccugacugagaugaucuuguguucuucucuacgggcaaaacagcccuaggcugcuaaauggccaggcaguauaggggacuuaggacucuacaaagcuggguuuugguaggaguccaugagcaccgcggagagaauucuuaguuaucaggagauacgguuguaguacuuaaaaacucaaacuccaaaacaagacuacgugguuuugaaucucaguuuugccaguuuauuagcugugugacuuuaagcaaguugcuuaaccucucugugccucagaucccuuagccauaaaauugggaugaucaugcaacaauaggauuaguauguaagcaaaaugaguauauguacaguuuggcugcaauagagcugauagguguaaacagauauaaauaaugacuucuuuucugaaaaugacuucuuuucuguuuuucucguuggugaucccugcuuaugucacugggauggcugcgggaauucaguaggauaauauuggaaaauagcuuaaaucucaaauguucuauagcuaugauaacaucacuaugacgucauagcagagugaguccacucacaucucuccuggcaguuuugcugccucagaguuggaauaauaacucacugaaaauacuuccaaaauagugagccacucugcagauuuaauuuguaauauuauucuuucuaauuauuaguggcucugucuuaaguuccuuuguuuuaauugaagcaggguuuuuuuucccccuuguaaauuucuauacaugucaaaggcuaccaacucauuuuuauuuagaguuugaaauuugauuugaaaaauauacugcagccagcuauaugaaaaacauaagaggauauuguugacuuuugaugaagggaagaaagaacaagguagagcugccuagccaugaagaacgccaggguuuuuguaaccccuggugugcuuugcacgcagaaggcacacacuuaaauuggcauggcucacuuuuuuuacugugccuuugcugagcuugcugcaggcugagugcacugguagaggagugcagggcuguguucuggccaucccugccugcucaggccucuccugcuccuuuguggaucgcccaggucucugcugcuuccuggugccgucuccuggauccucuugacauuuuuccguucuguaauuugauugacaguuacagacaaggaaggggacugaaauucuuaccguuuugugacuuccuaaaacgggaaaggaaauuuggugaaugagaaggggaaaacgccucuuggcugaaauuauuuacaggauuuagccccagguuuaauguacucaugaaugaauaaugacucagcugauauuuagaagccgggaaaauuaugcgauuuuugugaugggguguauagauauggauguauacuugaagugguuuguguucuaaauauauuaacaugcucagggaauuucuuuuuggggaaauacauauauucuuuuucauagauuuuuguggugcauucugguagacggaagaugggucauugcucaguuaguaaaaaugaaauaugaauaucauacacauaagugguacauuuuacacuuuuugauaguugugaaauacucuuuuuuuuucagacuaccaauaaagagaauuugaggaguaaaacucuucuuaccaugaauuguuuuggggcacuuagaacuauuuaguuaauucuuuuaaauacuccaacugauuuagauagaauaaaagugucacaauuuuaacagcuuacaccagugaaauguuuccacuuauaagaaauacccucuuauuugucagcauacugaagacauauauguguuauuucuaagcacauuuccuauuuaugugauaauggagaucgcccuuuaaccaucacuuggacgugaaggaggauucuucuuccuccauuaguaaauauuccuugacuugauaauacugaaaauaugugaggugaaugagcuuuaauccugugguuugguuugguuuuugguuguuugcagucuuggacuguucaccugcacugucuugugccuuugaguaugauuaacugccuugacgccuuacagugcauuacacaacucuacuucuuccauuucuugacuaaucucucaugcuguuugacugcccauuggaaucuuuaaguuagcuacuuaggaaagacuuuaggaaggagaaugcuaagagaacuggcagagaagucaggagccugggcucuguccaggcccuggcguaaguccuuucaccucuuccuuugacuccuuuacaaaaugaaguugaacucauucgagcuuuaaaaagaugacgccaagaggcaagacagagggcaguagaugugaaaguaacaugaaagagaaaggaacaucugaaaaaaaaaaaaagguagaaaaagauuuugacaaauaguacuaaaaacaaagaauauagaauagagagacccaauuauacugauaauuacaauuaucaguauuguaaaaacuacagcaaaaaagcuaaaaacauauucagcuuuuauuguccauaaaaagugaucacaccaugucuaacuguaauucguuugucaaaaacacuagaggccaaggacuaaauugcggauuaagaguuucuuccuuuuauuuccugcauauccagaaaccuggggucauagauacucuuccaugguguguuguuuggcacaacuugcaaguauuuuggcagaugguuagaaaaaaagacuuuaagaaauaugcaauaguacucaggacucuaaauauaauaaauaaagcuaagauaccaguauccugccauucauuacaaucaacauuuauugaacagcaguuauaugccagguagcagggauaccuagaacuugccccucccacuagcacuccagaagaguuccugcuuucccagccuaaagcaacagcaagucuuacaugagcuaggcuuacugugauagcuguccugacggcgaguggcaaacauggcccagugccuuccucauggaugaacaugacucuacacugggacuccccgguagaccuuuuugugaugaugagaaaguccuguguuggugauguucaguaugguaacuagugacuguaugugcuguugagaacuugaaauauggcuacugugacugagggacagaacauuuaauuuuauuuaacuuugguugaguuuaauucaaauaacuacauauuacuaauggcuacugauuggacagcagcuuucuagacccauuguuaaaaauaauuauaagcaaugaguaccucuuaugagauagaauuaauaaucccauuuauugagggcccaugacagauuaagaauuauguuugacauauauuaucccuaauccucacaagaaugguucauuugacaaauaagauaacugaaguucugagagauaaauugcuuuguuauguccucgcaaggaauugugagagcuggaauuugaaccuaauuggucagacuccagagcugggugauuucuaguaaucugccaaaucuguguauguacuguccggaugcugugucuucugaguacaucuucuccuugcuuuauggauuaguuagcaaugucuuuaucuuggucacauaggacaguuacaggguccaucuuaucucuucugaauauggacguaucacugcacuggaaccauucauuuuucuuacugaggccuauguccuucaaaaaauauuaagaguugaggguccaacccagcuucuugaguaguaagcuaaucaccuacaaguauauuuccccaguagaugcugagagaagcaucaaaguacauggguaguucuguggacaucaguggcacucaguaaacucuuggcauuugaguguuuaacugucacaguugaggauaucugugaacucucccaaggccugagucacugaaugagcccagccaguacuugggcgucuguggcuccauucugcuuugcuguuuucugcuuuccauggaacauacaguaacucucuugaagggucugaaagccucaauuacaacguuucagugauucugaacugauuuuucuuuggaaaguauauaugcagaugguacuugcagaaucaccaggggguaguaacguggaggagugguaaaggucuacuggacaaucagguggcuaccacccaaccacacauggugaugugauaugaagccacuuuucuuuauuccuucagauuuaagguuuccccuucaggaagcagguuacuuaacaaguacuugauuucaccauaacaugcauuaugacauuaucuuuuuuucuuuuuucuuuuuuuuuuuugagacggaaucuugcccugucgcccaggcuggagugcaauggcacgaucucggcucacugcaaccuccuucucccagguucaagcaauucuccugccucagccuccugaguagcugggauuacaggugcaugccgccacaccuggcuaauuuuuuguaucuuugguggagaugggguuucaccauguuggccaggcuggucucgaacuccugacuucguuauccacccaccucaaccucccaaagugcugggauuacacgcaugagccaccguuccuggccgauauuuuauuuucuuaaaaggucauuaucagaugccacaagaguauuucuauaaacuaugacccaaguauagccuaauguuaauagcuuaaaauagguuuuauuuaccuuuuuugcccuuuaaaagcaaggaauuauuuuuuaauggaaagaacauagacuuugaugaucaguucacauccuugcuuuaccccuugaaaaaugugcaaccuggaaagacagcuuaacauuccugagucacauuuguccaaauaauacaaacaauggcaacaagacuucagcacuaaugucugauguuuuuuguaugauuaaucugugccagguuccauucuaguuucuuuacacacauuauaccaucuaauucucacaacaacuuugcauagcaggcauugucauuuccacuuuacaagcaggaaucugaggaccagaguuaaaaguaacugguccaagauugccuaguuaauaaaugguggaauuugcagucagacccaagcugguuugggccaauacacuugaccuucuuaugauacgucagccuugugaaauagggcagauacuauuaauaauauccaccuugugugaucauuaugaagguuagauauaauguauguggaacucuugccaccaaagugguuccacaagaggcccuaaacaaaugaguaaucauuauuauuuuaaaauguccguaagugaaaccgauaugccaagaccaguaaaaaugagagcuucuuaaggaaaagaguaggaggcauaccuuuguuucauuuuguuuguugguuucugugcuugcuuuuuguucuuuucuguuaggcacagguuuuauuuagaauaaauuaaauuuuuuuuucuuugaugagugcagaaauaauaguuggaaacauugaauggaacagcuaauguaccauaguaauacuucuuggauuaccaaaaaaaaaaaaaauuaaaucuguaaaaugaaaacauuuuuguuuacuuuggucaguucaagguucaguguuaucuagagauuuuuguuaaacucaggauuucuauauguaugauugucugcuaaauucagaauuagaagagaagagauaauggcgcuaacuuugcauguuaaauauacuguguuacuaguuuuccaugaaguuuuuacucaacaaauagguuacuaaaagagcugugaccuaugaguuucaccaagucuuuccauuuccaauucggcaacaaaaguuucacacuucucaauuacucuugugggaggaaucagaaugccaacagucaccuugaucuaagcguauuauuggagaaaaauucaaggauagauauuuguuucucauuagauuuuccucauauuuuaucauuggggucacucuaguacaugguacuagaauuugggauuuuuauuucauuuuagauuggacugauuuucugguguuagucauuaaaaauaauuccaacucuuugaagagaucugggauguuuguuauuauucuauugauuaaauaaagcuauuuuauuuaacaauuguguuguuaaacuuucuauauacuuagaauaauaauacuaaaaacugaauggguaugagcuuuucuuauugaauuuaaugucaguauuaaauaccuuauugaaacccauacuuugaaagcuugauugagaaauuggcaaaagaguugacugaaguaaaaguaaugaagcaguucacuggucauccagguuaugaaaaauuaaaccauuagagauaaacugaacugugaaaauuaugaucaugguguuuucauaaauaccaucuaugucuccgccaccauucuaaaaaaaaguacccuaucaaauggugaaaaauaagagugauguuucugugaccauuucauuauucaguuuucuuauauuugaaaugugggagguugaacuaaaauuuguugguucccuucuuuaaaaaaguauaguuauaugugauauuuauuuauuuauauaaacaaaaauauagagaucuuaccuugaaaauaacuuuugagguaagaaugauaaaguaucuaaauggaagaugaauaacauuguaucugauuuguaaauuaugauauaaagaaaauguauaaaauauguagaaauugucuguauaaaaaacuauaaacagugguccguugccuauuaacaaagaguuucauguuaucuaaaaagucuucaauuggcuaaaacagcagaaaaauagaaauuacauacuauaauauauccuaaaaacauuucaauuccauagauacucuucuccaugcagccaauauuuaugaauuuggaguaagugaccuacucuuagauauuugagcuugauuauaauucauagucaaaguagccuccuuguaaauaaccaaaauuaaccaaagauuuuuccuuaucuuccaaaagcaaugccaaguaauucuauccaaauuggaaaaaaaaaaagaaaaaggauaaaccuuauuaggugucaucaaaugguguugacauaaugauauauauguuuaaggauaauguaauagaauauguaauuaaaauuaaaguauauaugaaaagaauugauuuuaauuguuuuaaaacauaagaugauuuaauaauaugggucggagauucuuuuuaguuuuauaauaaauauauugauuucugaaauuuggguauauuccauaguacacuuagcuuauguuaauacugaggccagauugcugucaggcuaauagcguguagauauauuauagucacacuacaaucauuccgucaguuuucaguuucccuuuuuccugugauguuucuuucaucuuguuagauuauucucaagaccuucucuaaauaccuucaguaguaauucacaaacucuuuguuaguuaauaguucucaagaaaauucugagaugugguugacagaacuuagaucauugguuuguuuuuggauuccuagccaaaguuuuauucuuuguuucuuaaaaauacucaaaaaaguuuuuuuuccuuauuguaagcccucuggaaauagaagcaaaucacuguuuauacauuuaaaaugugaugaaaauuacaaaauaaaguccagugaaauauagggcuuguauccauuagugccuuaagaaaaaucccuguuuucugaagugcgagugggcuuuucugguuuguuuuuguuuuguuaaagcuccaggaccucccaauuuucaagggcacuuuggggcauguguagcauuuauuugauguauggauguagaugcauauuuucccacaucugucucuguggaccuauccuuugugaaauccuaaaccuuguauuaaugcuuaguuuaugauucaugguguucugagagcaauuauauaauuuuucugggguguuuauucgaugugcacuguaaaaaaaaaugagaguuauuuuuugguaacccugcacuugccuuuuuauuggugaauuucuuuuccuuuuacugugaccugugaauaucacuguaggcucacugccaauuuugugagccgcugccugcuucaaaauggaggcaggaagguauccauuuucaucaagaggaugacaguguuucagucuuucugaccaucuggagagaggaacuuugagagcaaaagaaaauggggauuaaaaaaaauuauauuuagcagaaaaggcaagggggaaaaccaauuaaaguuaaacuauaccuuaugaauuugugcuuuucuacuaugcuguccuguuuaaaaaaaacauaaacaagaaaauacacaggcuauuuguauaaagaauugguuucccaagucucaugaguauuaguaaaugaauguaaguaaauuagguuuuuggcacacuuuuuaaguuuauuguacacacaaauauaauaagcaugaaaaaggagggcucccuccucccgcuuccuaugcacacacugauuguugguggucuuauguagauccaggcuuuuaauggccuuuuucaugcaucucugcaaaaagcugacacuaugggaauuuaauauucuaagauauauuuaucacuuucugugguuuggauaguucauuuguguucucucugucuccccccucccuaccuccucucuguaaaagugaaaauuuuaauugaaagguagaguuuuuacucuaccauuugaaagagguuugaugcaugucuuucuguuuuuaccauuuucacaugcuuaugggccaucuguguuuagaagaaaaagaaagaagugcuuagacucacaggauuacccuaugggcauuauacaguguauuuacaacuagacaugguuuacaucaacuggaauauaacacaccugguuauuuucuguucgcacaaauacaccgagcuuuuguuucguuuuguuguguuuguuuuaguguguucggaaagggcacuguuucuaggguuuguucagauuuaaacuggaaaggguagaaauguagcacuuucugccuacuucuuauauaagaauggagcuugggcugcuguggucaaugcaaaaagcaaaacucaguugguucuuucuccucaggucuaugcuccaucagcaagcacugccgacuacaauagggacucgccaggcuauccuuccuccaaaccagcaaccagcacuuucccuagcuccuucuucaugcaagguaagaugcugcugcuucugagggaaaggccacuggauagcauuuuccugggucacuuaaugucacagauggggcagaagaaauggaauaguaggcaaguguagaauuuuugaagucaugcucuucuuaggaauugaauuccuuaaaaauugauguauuaauuaaaacuguacuaagucuuucuuuacaauuaaaccccuuuaagcaguaauggguuaagauuagauugaucugcuucacuuagagccgaugcuuaugauggucuuccacucaugaccaaccauuucagcaucuucaccauccccaagacgauguagcuguuuguuuagaagugguucagcuccauguauguuuugaacauccuggauuuagccaacugggaacaaguuggccuaauguauaaccuuauguaaaauuuucacccacuuacuaauuuguagguaagaacaaggguccaagaugaaguaaccuaccacagacuggaauauuacauggugaaagcucugucccaacauaguaacugguuuaggauaaaaggcccaacuuuugggggagaagacaaauauaggaaauuauggaauuguccaguauguuuaaauacauggaugugugcccccacccugagcuuguagucuugcuacugauagcguauaccuuucugcugcucaaaaaagaccaagauguggccgagugcgguggcucacgccuguaaucccaacacuugggaggccaaggcaggcaaaucacaaggucaggauaucaagaccauccuggccaauauggugaaacccugucuguacuaaaaauacaaaaaauuagccaggcgugguggugggcaccuguagucccagcuacucgggaggcugaggcagaagaauggcaugaaccugggaggcagagcuuacagugagcugagauugcaccacugcacuccagccugggcaacagagcgagacuccaucucaaaauaaauaaauaaauaaauaaacaaacaaauaaauaaaugaauuuuuuaaaaagaccaagauguuugaaaugauagcagcuacuucaagaaugaaccacuuggaggaugccccuaagggcuccauccugauauguguguggcacuuauuuucuaauguaauuaucuuguuaccaaguuaaugcccugaauuuagauguggaauuuaccaagaaccccugugugcaaaauguuaacucuuuuugcccaggugugaaaaccuuauuuguauaagccuugucuacgggccaugggguuuccuucuuuaugcaucucuaggaagggccaugucacaggaaggggagcacauuuggggcaaagaguaccagggaagcagccugauauaguggacacacucaaaaucauucucauuaaaagauacuaaucuuccuucccuucaguguguuagcucuuuuaguuuguuaguucacgugugaaauuccauggaaaucuauaaaauuggauggaauggcucuguuaggaauagagagaauuuguuccacgcauaauagagcccgugugucagaaguccuuuaacuuugugacccguccuagguguaacucaaagggacacagcaggcuaugucaccugggugcguuuugugccgugacaaaaagcuaaucaccuucaguuauaaacaguagcuaccucagcaucaguccccuguuuugugagcagugggagauauuguccuacaggagcuuacagagauuggcaacucaaggauccaucacucaaaacagauuucgauugaaaacauugacggaaggauauauuuuuucuaucugcccaggaaaguggcuuucuggaagggugcacauugcaggagaggccagguagauuauaucaguaggcuccuuucccuagcagaccacacaaaauauggggaacaaauuuguuuaucugcauaugcauacccgaaaagcaaaaaaaaaaaaaaaaaauugaguugacauuuuugaugagcacaauuaauuugcacacaucuaauucuauucuuucuuucaaaagaacauuaugccaagaucaugggaugugauaaauauuaauuuacugugaaaagcauaauuuauguaaaauauguauuuuuauaagucugcaucaagcagaguacucuguguuaacaguccuaaacgcauugccacccaggguaucacauugucaggagacucuuguuuagugauauauguuuucaauuuauuugucauaugugccaucuauuuaaaauguuagugaucuugaacuucauauuugaauuuaaggugacauuuaaaccucuguaaucuaaggacuaaagcucaaguacaugaaugauaacuuuaaaaaaaaucauguguuuucacaugauggccacagaaacaguugcaucaugguccugucccacaucagcuuccuuucaguagagggguacuuggugcccugagaauucaagacuugaaggaauaugcaauuaaggugaaagauguucagaaacugucuggggcauauuguaaacucacuacuguggccucuuauuuguaacuucaauuuccaucuucuaguuaaaacucugaaguugucaaaaucacagacaugauuuugcuugcaugguucuuaaagagaggaaucugcaaacuauuccucccaauaugaaaugaguccaguuacaaaauucuaacuuccggauuuaagaacucaaugaaaaagagcuucacgaaauacagugucagauuuaacuuuucuauugccuaacuuuuuaauaggccuuuacuauauaaaauguuauggugaaaauaaucuuauuuucaaggaagcaauaucugcuauacauuuaacagccagcugauggccuaguguauaccuaguacucaauacuuuuuguuaaacuauugaaacaaagaaaaaaugaaugaauuuagcaguaauguagaucaucuuuucccuuaggcuugggaaaccaaaccuaaacauuagcaaucauuaauaauaaccuguaggccaauaggcccagagaaugaaaaaauccguagggauguuuuuaauaagaauguuaacaaaagguuaaccuuauguugaaagauacuuuauauaauuuuaaaccucuauaauucauaaaucguuuuauaaaauccagagacucucaaaaauaucuguaauauaauagcuaccuagggcauguuuguacccuuuggauugcuacugaagguuuaagauagcuauauaccuauacaccaaaaaauaaaaauaaaauauccuaagaacuauauauuugagauucaucuucucugcaugccguaauauaauuauaauuccaacuuuaauucuauuuauuguauauguuaaaaaugaaauuaaacauuuucaaucugagauuuuuuaaaauuaauacuucuuuacaugcuuuuaaaacuugucaacuuuguaauuucucaaguacuuuucaccccaaaguuuaggaacaauuuaacuuuuuaguugguuuucauagaaaaaacaguuagaagacuucuaagaaauguuuccuuuagcaguaauuaccuugcgacuugacauaauucaugguagaaauauacucuguuguucuuuuacaguucaauuuuuaccaagaacacuuuaacuuuuuuaaguguuuauauuuguuugacaauauagagccacuugggaagaaaugaugacugucuucugauguaaucagcuaaccaacacaaagaugaauaacacaacaggcagucauuuucaaguauaugaaaaaacccuauucuauaaggcaaggcugaaugccucagaaagucaugguugucuuuguccuuuacagauggccaucacagcagugacccuuggagcuccuccagugggaugaaucagccuggcuaugcaggaauguugggcaacucuucucauauuccacaguccagcagcuacuguagccugcauccacaugaacguuugguaaggcagacauacacgguaacgggaaugucacagcuaguugauuaaaccucguccucugucuuuccaugcauauacacaaggacucugcaaauaagugcaaaaauggcacacacccauuauucuuaaguuguauuguuucugugaucaaagacauaacagguucaaaucaccuuuguaaauucuuccagauucucucuggcauuguucuuuuguuuauuguguuuugcucugugccuucuuuaucacaaugucagcuuccuuggguacauaaauagauaccuauuuaaguuguagaaucuuaacauggugguuccugguuuuuuuuuuuuuuuuuuuuuuucuaucuguaguuucaaaagauguacugcagagggcagagugacagucgguagauuauaugcaucacccaggagcauuucauuucccauugacuggccuaugucagcuuuggccuguugugauguauccaaaagaaggaguuuguauuuucuguagacuuccaucaguaagagaaaccaugagguuucuacauagaucagauucccauuuuucaguauuuuaacuuuaauucccaucccagccugccacucauacuguguuuugcgucacuccaggugaaaacuggugggcucuagaauguuaggucuuucauuacuaaacauuuccacucuguccaucaccuacauucaucuaucauaguaugucucuuuauccuggaggaaacaacucagcugacuuucuucuagccuuaaauaucaccacagcccagaauccacuguugaacuuaagucugucauuaaagagaggaaagagccuagaucuugagugagauuugggaugcagauaagaugaaacuugaaucccuugugcaagaacauagcuuaaacaauauguggaccucacauccuacaaaugcgaaagcauaugggaaauccagugaucccaggugauacuuacaucacuacuauucaucuugcauuugccccuuuuucuucuucucauaucuacacuuagguuucuuucucuguucugauaaaggaaaucauucuggauucauguggucuuugcucucuuuugcucaaccaguacagauaagaaacaggaucugaucuccuacuccaauaaucaaaaaaauuccagaaguuaagauuucugauauccuugaaaauccguauuuaguugguccuagugguagagaugcuaaguagucaauuagccuauacauuccugagaggcagacaguggaaaugguauuggccuuuuuguaucaccucccaagauugaauguguaaaucacaaacuaucucacauuucagcacauuuccaguaaauagcagaugacuuauuuucaaauuuucucuuuucccaccuccuauuuggagauauuagagugaaagcuuagagaaauaucaacuauaucaacuauuauuaugcuagaauccguuuuggcuaaaauuuucauuucugcaccaucauuuuccacuucugugggaacucauggucaaaacuguauguguccuaugagcaaggaaaguuuugauuacaaauaaaaguuuuaggcacuauaccgcauguuggaauuucaguucuuuuaagaguugcccauuugacauuaauuuuucuucccuucuguguuucuuucuuucuucuccuaucaugcucaagaguuuugaguuaggcgauuugauuuuauccuaguccaguucacugcaugggaaguagcuuuaaaaugugcuuccaugcacaaaaaguauaauuucaaaauggaaaccaacuauauuccuuuuagaaaaaauuuuacagaaccaaaacaauauuaugaacuagagagaaaauaucauuuugaaguaguaacccaguaggcuauaucagaagccauauuugcaaugccauuuaccuaucacgaaacacaggauuuucauuuuucaucugaacaguuaacagauuucagagaguagaguuuuuguuuuaaaggagacaugaauaagcuaucuugcaauguauacuaaugaauuuucccacuguuagugaaacuauugaauuauuauaucuaguugucauuguacuuucaguauuuaaccaugugaaaaucuuuuacugaagugacuuagaagaaucugacacugacaauacuuugaauauauaguagcaguugguguccuuucaguugaaaauaaugguaguuccuuauaauuuuauucuuagcaucuggcuagccccauacugaacaaagggauaguuuaagaaaaagcuaagcgcuguuccuggauuauuugggguauaauuuggccaaguugauauuaucuguaaagauaaaauauuuuaaaaacaucauugccuucaucacuuuaugccauguuauaacagaauguguaauuauaaagcuuaagauccacauauuucaguagcgacugucaaguuacugauguuuagucuuuaaauccccuuuacaguuuuagccuguccaacagaaucccacagcuaaucauuacuguguuacacauacccacacaaaaucacucagaugaauggaguuugcgguuaaaguuuggaauggguuguuguagaugauuuuauguuuggaaugacuuggcagaguucuuuuuaagaacaggauagaguccucacugucuggcaugauuuaggcauggucuuugcacuacagggcgaaacaguccuaggagucuggaauuuuccuuuaaaggaaguucuguuuucuuuuauuuuuuuguaacauaaacccuuacuucaguaauucucaacugauggcaguuuuucccuucagggaacguuuggugaugucuggggacauuuucauuguuacaacuaggggcuagaugcuacuggaauccagugcguagaggcuaggggugcugguaaacaugacgucauguaugggagagccuccacagcaaagaauugucuggcacaaaagaucaguagugcuaagguugugaaauccugcccaaacccaaagcaugauuuuauucuuauuuaugugcaccaguuauuauauuuuucuaauguuugaauuaucaaccaguauaucaguaauggaaacauuuccaacaauuacucuguuaauagacacgaaauacaggacucuugggcaucauaaguuaaaaugaacgaauagugggcauguaaagccucgcacuuugucacacuccucauguccuuuguagcaagcaggaaagacaguaauagcuggaguaagagacuaagaggaccucuuauaguuuaucccuaaauccucuaaaagagacauuauucucugugguguauuuauuacaucucugaaugacaguaguuuucaagauaguuuuuaauguaaaauaaucuaguuauaaaucucguuaguuuauuucaacaacuaauuuucuaugagucucuaaaaauaacugauuuacauggauuccauugguucacuccuuuauaaucuauggggauuaauuuuucuuuuuauucugugaacucagcguuaacccuuugucaaaucccaaauuacugcccauuuuacauaaaguuaaaagggcccaaagauucucaccgaugugauuaucuguuuuguuucaucuucugauuauuauaguuaguuaaauauuuauaauucuucuccucuuuuuuugauuuuugcacauuucaggcagauuuguaguucgucuguucuucagaaauuccacauggaauaggacuguguagaagugagguuaaaguuagucaucucuuuuuuuguucuuuuuuccacauucuguuucuuuuccuccauuuuguuauagugcuuaccucuauagcagaaauaccucuaucccugcuaagcuuucagaauagcuguacuauggaaugggcccacuauauuuuucauuggagaaaauuccauggacuaccuuggguguucauuagguggcaaguagaaaugaguuuaacagguggccuaaggaauuuuggggucaaggaaagaaagagguccauggaauuuaaaaauuugaaaggcauucucaggaacuuggaaagauuuaaaggcaucaucucaacuuuuuuacggaagucuuuuaaguugggcuauuuuggucauacagagguaauauuuucaaaaacauucaugcgucuuugaaaauccuaccucuaauacguagauucauuuccuuagacuaguuggcucucaaauaaguuauacuucaauccacuguuuauuaaauucugacugauaaccaauuguucauugagcguauaguauaauuauguguucaguaguuagccacaaguugugggaugcagaacuauaagcucuauuccuuuaaagaguuuacaauacaggugaaaauacauuagaaaaagcaagaaaugaaaggccaaauauaauuaaguguuaaagacaauagugcagaauguaagugcauuagggaccuagagagaagagaugguggaagaguuggagguagucagggacucuucaagaaagagguagaauucaagacggaucucacagaguaaacagggcaacacucaagagacuaugguuucauuccucgugagcaaaugcuuggguuuuaaauacccgugacuaucagcaucauauucaaucucuuauuuugaaauaaacaauuuuuaacagcauuuccaauaaugauauaauaaagacucauaauccauuaauauauugcauaugaagaaaaaguguauuuuagcuuuaauauauugccuuuacauaacacauucagaugccuaugagaauaacuuuugaagcugcuuuuuaucuugaaaauagcucagcacuuuuuuguaaauuacuauguccauuuuagugagcuguucauucccaagcagauggguggauugcaacuaauuugccaccuuacaggcacuguggcauacccaagaaacacagcuuauuuggaaaacuaauauaauaauuaaacucaaagcagagucuuaaaccaagugauucuguaaagauguuguucuuucauugccagcuaugugaggauugcuuguagguggggcauggaaagaaaguacucaaaccaaaauaagucaugugguccuaauuuaauucaguauagucaauaguuacauauugaugaguaagagagauauuuaaccauuagugcuuuuuaaauuuuuuauuuacuaaauuuuauuguugcugggguucaaaaaaauuuaauuugggaggaagaagauuugagacugguuagucuuugccauuuaguuucaagaagaucaggaugaaauguaauauaagcccuguggaucauaauguuguuuuauucauuauauaguggaaucuuuuucacuugaucaauaggccacacaaaaaaauuaauaguagaguggucuuuuauguugccgaaacccuggagaugauuuuaagcaguaaucuguagauuucgagauugugaucauuucucaaugucccucauugccauuauaucccuccacaguugaugcaaacccaagcuauguuucuguauaacuuauuauuugaaaaaugaaagcugucagaucuaaacaagauauauucuuggcuauuuugaaauucuaaaagcugucuccauuguaaaauagagaguugugagaaaaguauuugaaaauaacucacuaaauaccuuaugauuaaauauggccaccuuuuucugcuucuugcuauagagcuauccaucacacuccucagcagacaucaauuccagucuuccuccgauguccacuuuccaucguagugguacaaaccauuacagcaccucuuccuguacgccuccugccaacgggacagacaguauaaugggugagucacagaaaugccaauucugauaccaacaauuggugucagaguuuaaucaucaaggaccucuuuuucccuuucauaacugaauagcaauuaggcacuaaauauuagucacaugacagaaugaacacacaaauguaccaaacagaaguaaaaucacuggcuugagcauaaccauauuuuucgucacaagacacugaaauuuagcuacguucuacguugcaagucauuagauugaacaaggguucaaacagaccaaaacuaucuuguuccucacauucaaaaagagugaacaaagucauaagaugagccaucagugacuagugagcuacaaagcagaauagcucuuaaugguaguuauugaccacuucccaaaauuccagucauugugcuaggcucuuauccaugaugugccacugucuuccgaggacugguuaaugugaaauucucaggugacugcuaauaacuacaugagguuaaucuccuggagaaugugacacuguggagucccucagaggggaagaaguauuuguucacuuaugagagaggagaugcgugggcaucaguuggccagaaauuauuugcugcuuuuuuaaauuaauuaauuaauuaauuuuuaccaaggacauuuacuaaugaguuaagguccaagaagaaugcuguucccaugaacugagccaucauccucucauuucuugugauguucacuguagucuuuuccauaggugguuccccagucaguauucccacuuugaggaaugaacugggcuggauguccagcugccccuggagggaagagguggaguugguggggagauagcuaccugcuucugaaccagcuuugacaccuuguuguucagaugagcagcacagcuuagugccccagggucuuauuaaaaccucagacuucucagguagucacuuucugcgguuauagcucaaacuaacuccuugcuuggccugaaugucacugucagagcgucgguggggagaauacucaguguaugucuuugagagaagauggcgcaacagaauaaugcugcuguugaguccucuuagcucuuugcacuuguuuucuuuagagaguguguagaauuuggggaaguggcgugaaucacuuauguaggaaaguuuuugauguuggaggagagauguguuuugaaauguuggaaauauaauuucugccucaauaaugcccucccugcguauucaauaauauaucucacacuugagaugagcuaucucgcagccucuccacuccgcuauccugucuaagaagcaaauugaggagagaguuuccauuuuuuuuaacuuuuccuaaccaagcuucuacaaauauguugcaucaguuugaccuuggagagcuacagacagaggucacauggggaaguuuguuagcuaucaaugcaguuuuggcagauuugaaaaacaagaagaaagaaagcagugcagaacugaaagagugagaaaagcauauuucacuucagugugguuugacaaauggaaagccccuuucugcagucaugaggucugguuauaaagaaggaugaccggucauucauccuuuuacaagacagauuuccugucuacuugugguuugaguaauuuucuuuuuuaggaagguaugaagguggagcagaaccuugaguugaggaaaacauacuuaggcucuguuugaaaaaaaacuuuuucugauugauuugcaaaacaguccucuugagagagaggcacuaugacuuggaagggacauaucaggaaauagggugguuaucuccaugagcuguagacagcuuagccacagcucucagugggaaugaguuuugcuugguuuuagcuggucaucuucauuaguuuguggaugaacaggagaaucuacuuguuggucuagccagaguggagcaauaggugacuucuauaugcugagaauagacuuaacuuguuaaaaaccauagggccuuauuuaagggucuugacaauaauaaaggagcuauaauuuaaaaacaaaaguaugagauuuuuagaacccagaaaagggcuuuuuagaaauuuauuucauacauuauuuuacaauaauggaugcacuugucaaaauccacuagcggaaugagaaaaagaugcauaaucuuuaaggaaauagguagacaugguaauucagcauuuuggaggagcaaaccuuuauuauuaugcauagauacagauauuacuuuaagguuacuuuaagggagaacauucuagaauguuuuucuuuaaaauaauauguucaccaauugcguacgugaaaaugcagaggaaaauuuaagcauaauaagccuuaguauugcgugaugucugaguggcccauguuuuuucacacuuaaguucucuuaggcuuugguuugauuuuuugagugugguagaagucagugauggcagcgugucuguauaacaagaagagaagcuuucucuucugauguuagugauacuacccuaacaaacaguauggauuaauaggauacaucugcagacuuuugaaaauauuuggcauauacucacucauucugaaacgcaggaaguaaagaaauauuacguugccuguaucucaaagaacaaacagagcuaauuaaauaauuggcaaauagggaacacauagccugacacauguuugagauuacacacgauucuguagaaaaugacuguaagcaauacuaaugccuuaagaaugggguucgagcacuaacacauggacaucacauuuuucacguuuuccugguaaaaaguugcaagacagugcagucuuuucauacaugguguugaugucuuaggaagcugcuuuuucaguucagaagagggcugcugcccuucgucucagugucauguuauaauaugucuuucugguggucagcaguuguccugaacugacacuagaacaacgcagugcauguggggugagauacaagcucuagaacucucggaagggaaccucucuguaaccacauucccuuucuucuucuguucucugcaucucaaagguggaagaugcccacugagguuugcuguuuguuuggcuugggggagugaccagguguuucuuguuuuguuuucuuuugcccuauaauacccaauaucauuuuuugagaaauccauaagaaggauaaagcuuacuuggauuacauuaaugagagauuuuuuuuuuuucaugacacauucauccauggauuuucaagagaauuguagaacaagguauuuuacucauugcauacaguccacuacuuuucucaagccuugcuggcaaacucuggagaucauauuagaccuuucugaauugaaaaggucaucuaauuagcccuccaauuagaggaauauaauguaugggacacagcauggauucacaguaguucagcugguggcgcacccaguuaaggaaagaagcugucaggggucuuugggaguuaccagcaucagcaccuucuacucaguucuucaaacuuuuucaauguuaugccacuggguauucucagaagcagugcaguucagugccucugcaucugagcauacauacggaggaggaaguguaguaaguuauuagauaccagcuauagagaauaggaaugucugcaggauauuaaccauacacauuugguuagccacauacuuccuuccuauuugcaauaauauccaguagcccuuccugauggaaagaaguaagaggaccuccuaccauagcacagaccacugagacugcucaagggugagaaugcgucgucuccccauugggacauaccaucuguauacauucacagggugugacccuuugugguuugaggcuacacacacucccuugcccucagagagaacuggucauauaacuaacauaaugguuauaauaacuauuauuguuuuauuagucuuuaacuggccugcauucuaauacguggucuuuuccacguuuuuaaaccucaaaccaaacaggguugaaggaacagacuaccaagauugauuuaauacaccauaugcuaaagauuacccuggaauaucuaucugguucaugaauuaaucuggcuuagaacuuuaacuucgaaugacauguuaguauguggcuugucuaguagaaacauuauguccuuuucucuuugaggacuugguuucacaguaauuuuauuauuagaguagucacauaauguucacuuuauauuuuacaagaauauugagccuugaaguagucaggcgaugaacaagcacagagcauaagaguaauaagaauuguauccagcaaugugaaggcaucuuaguuaccaagaccaccagcagagaacaauaaacuaguuugauuuaaaucuccuccauuuccugugcacgaucaggaagcccaacuucccccugaauuccuaggaaucccuccuguuaaaaaauagugcauuguagucuauauacuugcguuuguauuuuaaaaugguuguaguaggagugcuggaaauguuccuucuuuuugucaucuuuauagauaagcacauggcauuguuaugcuguuucuaaugguuuaauaacacgagggucacucggacacaguuuagaaaaaccuacuuugaaagcagucaucuucucucaggcaaacacagugugaauugugcugcuuauucuuuugaugccuucaugauguucccagccuuagaugaugggugugcauuaaaggggcaacacauuuuccaaauucugauuuuuaguaguugaucccaaggcaccacucaucccaguguuuuguugaggguguguucuaaugggaaugaacauuuccccaaagcugaggcugagacagaggguggucuagcauguaacccaagauacaaaaccuuucuuucugcuucaucuucuagccagcaacaccaccuguguucaagccaucugaacaauacuuggguggcaggcagugucgaagccuccuacaaaaauuacaguuccucuuaauaacugcucaucuuccauucauauuuguauguuacagcucuacuuagggacugauuauauuucucuugggcaagauaaauugauuagagccaaaauuagaaaucgauaaagucuuuaccaagcaaaugcauuaguuuucaucuuucuguuacauggacauuuugaucaucucuaauaugaauugacaaaaaucuugggccucaaagaguaaucaaguccuguuacaucaaacccacauuuucagcuuuaauguaucuugcuaaacauggcccacuucucaaugcaaaaaaaaaaaaaaaauucugccacuugagaauuaaaauauauuucuuuuccaguuauacccuuuguuauaucugucacacaaauaaaaagagaaaucuguaagagaaagacucauguagcuuaacauguucaggcaaucuagaaaauguagcuucuccaguguuuccuggaccagaacaaaaggcauuccaagugaaagggcaaacuggccccaguaaacugcuuugaaauuuaagcccuuggguuuggcacuccagcuguugcaagguaaaaucgcuucauguuaaaaaauagucuguucuuaucagugguuuccauggguagccuuuguaguuuucugaaauauuuucaugacgcgaugagguaagaaguugauucuauuuuuaauucuauuuccugagucauaauaucucccugcauaaaacaggcacugauagaauguuuaguuagaaagguguaguucuaaagaaaucagauuggucauaauaucuugccucuucuaacgugugauuuuuggggcguauauauuuaguuuuuaaaugcuccuaaaauauuuguauugguuuucaauacuuuguuuaguuucauaaaaauauauauauuauuuguaaucuucauuuuaaaguuguuuaaaggaagaauuaaucuuuugaaagccacuacuguagcagauauuaucuguagugaagcaauaucuuguucuuuuuuggcuuagguucuuuguuagauaaugugauuuuuccaauguagcucugaacuuuuugugaaaaucuauauucaaaucaagcagauaucacagauuauuuugacugauagaucuaauuuuuagguauauaauaaugaaaagaaauaucgcuucuaggaaaaaaaaaaagauaaguacccccaaauaccaugguaauacauacugaaaaaagguuaguaucaucuauauuucacaucauuauuauuuucucuuuagaaugguuuuuagguuuguuuguuguucuuguuguuugaggcagaguuuugauccuguugcccaggcuagagugcaauggcgcaaucucaaucucggcucacugcaaccuccgccucccagguucaagcgauucuccugccuuagccaggcauaguggugcaugccugcaauccauguuuuuaguuuuuaaaggacuccuuaaugcagaaauucuucucauuuucacacuagauauaauuuguuguauuuuaucuuauauuaaauauuuuuaauacucuugauaucugagcugcucccagugguccaauuguaugaugucagacccucauuucaaagaacuugcuuauacaauaccuaucaugaguacuaaugacucauguauuuuaauaucauaacuuugugauauggaaguuuauuuugucacgagauaauuguguucuucuuaucaugugccagauuucuuucaguauuuuagcaauuaacaaauaaauauggguguggguuuuguaaaccaaauaaaguauauaucaaaacauuaucggcugggcaccgugacucaguccuguaaucccagcacuuugggaggccaaggugggugguucaugaagucaggaguucgagaccagccugaccaacauggugaaacccugucucuacuaaaaauacgaaaauuacuuggcgugguggcgugugccuguaauccuagcuacucaggaggcugaggcaggagaauugcuugaacccggaaggcagagguugcagugagccgagauugugccacugcacuccagccugggcaacagaacaagacuccaucucaaaacaaaaaagaaaacucaucugacaaacucaacauauaaauauaugaaaauaacaagcauaaauuagcuaugcuaagcagaggucaggagaauuaaauuaugaccuggaaaagccauagaauuggaccacugaagauccgaccccacuacugcauuuuacaaguguggaaggugaugacaacacauuuguaagaaagaaggcucucuuaguucaagaauggggcuggaaagucuuugaaauuauauaccuguuuaaugaaguuuugcuuggauucauugggugauuuaaccuuuccuuuucuuauuucacaaaauagugaaaaacaaucuucccucagaacuuuaauagguuuuauuuagauacuaugucuauuugcuaauguugaggcuuuaguaaauacaacauaccccaagugcuaggcauucuguuaauacugaagaccacaagaauccuggaaaucccauuuuaucacuuaguucuaaaggcaagauaccuuccaaugauacauguuaaagaaagcuggcuuugaauuguauacuguaauauaugucuuuuauuauucacaauacucuuuguucuucucuuuuguagauaaaaauaccaguguuuaaggcaguagagauaagcuucaugaauauguagacuuacuuuaucucuggaauucgaggccauauugacuuuuaguagcauaccaguucacuuuuuuuagugugaacacagacuuuuaaauauguggagaauauauguuauuuaaaacauuaaaaauauuuucucuccuuguuagccagaccuguuguggaaauuuuuguuuguuuguuugguguacuguaggacugugagacgaauaccccguuuugcuauguaucaaauuucuauuuauuugaaaacagauggaaguuauuugugaagauaauuccauuuacuauaaaauaauauaaagaaaagccagacucugaggacuccagagaccugaaaguagucuauacuugucagcaaugaccgucacauagcuugcuacauucaccagcucaucaacagcaaggggaaagucauagcaaggaaaccacuuuaucuuuaaaccaaggugucagguuuauauuuuaucuguaaaaaaguaacaugaauauauuugacaucuaccucagcaaacaaauuaaugcuaauuaaagauuaauguguuguaauuagcauuaaaaaugcaauuaaauugugaguaaauggaccaggaauagaaaauuguuagacgucucacugccugguuuucauauucugccuuuuguuuuugcagcaaauagaggaagcggggcagccggcagcucccagacuggagaugcucuggggaaagcacuugcuucggugaggaaauauugacuuuggacuccauauguaccauuguaaagggugaacuuuaaucagaaguggacauuuggaauuuuagaaaaugaauggcaaauagcuuugauuuuuggaaaaugcuagcuuucuugcauaacagucacuggaaaauuugagaaggcucugaagcuuccaguauauagucucuuucucucauccucaaaaugguacuaagcugcacucaauuauggaugugggaauauucuccuggucuuuggguuuauagguuuuuuauacugaugucuuauuuuucucuaaaguaauaugggugcacauugaccagcuaagacugucuuagcaaggaauaguucuaaaacacuuugaaagaggcauuugaaaaaaaaaaaaaaaaaaaaagacaauaacugagguccaugaagaacugucacauaauuggcaccugggggacucagcuucucugcuuugcccaccuacugccagaaagcuaaaauugaacauuucuugcauguucccugaugacaaaauggcauaccuucauugucucagagaguauaucugguauuuuagucaaaagcuaaacauggucauuuagaaauguaaguggagggccagguaguguggcucacacugguaaucucagcacuuugggaggccgaggugggaggaucacuugaggucaggaguucaagacuagccuggccaacacggugaagcccugucacuacuaaaaacaugaaaauuaacuaggcauggguggcacaugccuguaaucccagcuacuccggagacugaggcaggagaaucgcuugaaccugggagguagagguugcagugagcugagaucaugccacugcacuccaacuugggugacagagcaagacuccaucaaauaaauaaauaaauguaaguggagauuucuuucucuaagauuuugucucuucaguuggcuuuuaccauugagagcauuaaaaaaguucacacuguauuagcauugugcccuaaguaaaaguuuuuguuucaucugggccuucugaugcuaugcaaucaaacgccuagaucuggcaaaagaguggcaaaauaucuuaggaaugauccuguucaaccucucauuguguagaugaggaaaggaaaguucaaaguaucugcuuggcuugcccauagccacacagccaguaggaacgaagaguugguuugaagucugcugaccccagccuggcucuuuucccaccaucccauaccacaucaguaauucuuguuuugaaaaauuaaaauaauuguuaaguucuucauuugacaauuuugguacuguaguugauuauuacauguaugcuguaacuuguaaguucuaaaugaauugcguugacaacuucguaguuuagaaaagugugaauuauuuuaaugaaugaggguguuuuuuuuuucuccuuauuguuuuaagaucuauucuccagaucacacuaacaacagcuuuucaucaaacccuucaacuccuguuggcucuccuccaucucucucagguaguguauuucaaaucccauuucaucauauaacaguuuauaagaaugauuccccccuuguacuuccugauuuuguagguggaaacucacuuccccccaaaucccaaagcuuuaacauuccuauaacagacaaauacaaagggugggagagacaaauuaccagauaacaguauagucguuuacauccaaaccuuuucuuaaaaauuagauuaucuuuuuaaaauauacaggcauauggaaaauguauuucuuacacuuuucuuagcucugcagaagacacccaacggcagaauaauguauuccaauaaaacgucucagaugaaaaaaacucaguuaauauagucaugaauaugaauauagacuagauagucaucaaauauagacuauuuaaauggaucauuuccugcaggaauuucaggcuuuccaaauucccucuuuaaaguacaugccauugggauguuuagagaaaacuauaauuuuguaaauaaauugugaaauaauugugugggguagaagggauguuugacuucaaaguauaauacauucguaugaccuguggcuucaaauugaauaacuauaauuuguagaauuaugucaguaaauaauuucacuuuucagggguccguuuaagagacucauugucuuuccaauauaaaugcuuccagaaagccuuccuugguucaugucucugcucuuugguaaggagacagguggcuuauuaaaaaaacaaaacaacagcaacaaaaccuaaaucacaucuguaccugauggaaaccuuaccuuacuguaauuuauaguggaguuacuugcguuuguuauuuccugcaugcagcucucauggcccaguguaaacucagcuccuuggucgaggacaggagguuucacauugccacaaaacuuucagaaaugauggccauggcuuagcugggauuuaaugucaaccucuuccaagccuccgugguaugagaagaucacagaauagagagggcagugggauucugaagucucuauguccagagagaccgcguugaaacugggaagcgauugaggugauuuuaagaggauaaucaaacguucccccugguggaaauagaaacuagaguucaguauuguuguacuccucggguucuguaccagauucuuacacucugaaaaaugauuucaauugucaguaacccccuuucgagacaacaagagauacaacaagggauagaggaaucugagcagguggaacuccaguuuccacauuucaaacaaaguagcuuucauuuuauucauuuucuaauuuagaaaaagaaauguucuaugguaucauaauguuugagaacgacuaauguagucugauacccugauuuuacagaugagaauacugagucccaaaaagggaguugaguuguugaguuuauuaccagugguaauagcagagcuuggacaaaaaucuggugcucacaguucugccauccauuucuagauuaauggugggaaagaaaaauuaggaugcacagucauucuagaaaacaucacaaauucccucgaccugaguagcaugaucucagugaaaggcacagaaacaaggcuagagaugccacuuuuugggucuugguaaugcaucauggaagaccacauguuaggaagaaagaacuuuuaugaagaugcaaauauggggacagauugcuauuuucacaccgacggcucuguccaaauucugucaagaaaaguaauugaacaaaauauucuauuuuuauuuagcauaaaaauauacaugcacacccagaaaagacaggaagaguggauuuuaaaagugcuaacagugucggggcaugagauuucagugagaucauagcuauuauuuuuuccuuuuuugaauuauguauuuuccaaguuuucuacacugaauguguauuauuuuacauuuaaaguguuuuuuauuuuguagguuagacauguaauauguauucuaacagcaaucuuuuuuuaccuucaaguuuaaugaaucauaaaaaaauuauuuucuucagaagaaacuuuuagucauugcuguauauugacuuuaaauuucuggcuuaguggaucacugauaacuaaucuuauucccuuaaaaaguuuuucaagauuuaucuuuuucuaaagauuguuuuaaaaacaaguggcaaagcuguuuuccacuggugcgagaauuuugguuuaacauaaacuagccuugcaugaaggucuaacaaaaucccauuuuuguacccuuaaaaguaccuugauuccauggugauaguuuuucuuccacaggaacccuucuuaccaaaauucagaaucaauuaaauguucucuuuuaggagacagccagccugggggaauugugagucuauguaaagucuacauauuuuacauuuaaaauguuuuccuugucccaaaauucuuauaugggaaguuuacauguauuuacguuguuguuuaaaugaaaaucaucauugccauugccauuuccaaaaggacuguuuaaaauauuggcaagcgucuuuuuacaugugucuagaucugauuguaauucccacuuuaauaucagcaggcacagcuguuuggucuagaaauggaggacaggccucaucgucuccuaauuaugaaggacccuuacacucuuugguaugucucauuugcuaaucucugucccacccauuuucaggucauguucuuucuuguucagucuccuuuacucuccaagauuuugauuuucccuguuaguaacuuuaagucagcauuaagcacacagguuugcgggagccagagucauuagccuaugcuugcuccuauuuggagaugggaacccagauacuacuguaauggcagccccagggcucuaaauaucuaguagcagauaaaauccuggaagggcaauggccuucuccccaucucuaggaaagaucccugucaaugauuaaaucacuuuccugcuaucagagugcuggaacuccagccagguccuauaccuggaacauuugauucccucuaccucugcuuuacuuuccagaauaacagguuuacaggagcuuuccuucucguagaaacccagugguauccuucgugguagagaaaugccuacucuuccaggagugaauugcugaaaauuuccauggauguaguuaauuauuauaaauacucacaugaugauucagugucugacacuucagucuuucucuccucaugauggugggggccagaaauaugcaggaaacaaugcugguugugcagcauuuaggcuguacaugaauuuagcgggaaggaauagcaguaagggagaggagccuuuuaguuccucgggguugagguuuucuuuucucccuccuaucuugagaugacacauggaagaagacauagauuuaucuaucugcuuuaguguugucuuauauucuucccuuucagcuuaaucuuaaggaaaaucugaaaagaaaagcaaagguggauuucccuccuuugcuguguucuuccuugcuauaguguaugaaucauucagcuaugcauuuuaaccaguaaaggaaaccagacagugaaacauauaugcacuacccagcccaauuaaucugcggaccacauccacauaauuaguuguuuuaguguuuaccuucaucaguuauucucuggggccuauucaucaaaaccaggcuucguccaacuauagaacuguaaagacgggguguauaguuaugggccacagcuuccauucuguuugaauucugaacacugaagaagagauuuacaagcagaaacugcugucucuaccaggaagcugugagccagaaacugugauaggcacauguaugauuucuuuuccugcauacauuuacacucagaaguaaguauguauuaucauucccauauuuauaaauuagaaagcaugcacuccaagagguuuaguaacuuuuccaaggccaaauacguagcaaagcuagcagucuaggggagguaguuuaacucccaaacccaccaaaucagaauguucuguaccauagacuacuauauuagacacacauucuuccugucaguauaaaauagaaauguuuuuucucaugcaauagagcugguacacuuguuugcacagccgauucaaaaucaaagucaauuguagcaugaucuagugcaaagagucacuagauuuaaaauaaaaagaccuagauuccaacucugacuuuaccauuuccuagcagugugacacuacguaacuaauucacuuugugucuuugagccucauuuucaugucuguacggaaggaaucauaaugucuucccugccugcccauacacacgugaaacaaggaucaaugagaugguauauuuuaaaguguacacuggagagugguauuugauaucauuauugaucaguuuuuaaaaugaauacauaccuuuaaaaugaauacauacauuuucuucacuaaaaacuauacgcauugucuaguugugaaaaacuagaauccuaauggcaaggaugaacaaagguugguugguuuuuaaugguuuaaaguugcgaauucuaugcuauaguuggggcuuugaacucaguuagaugcccccagugaacaguugauucaaguguuugugauucuucagucuuaaaaucuuauacuacuuuaguugacagaauuuauauaauuuuuuucuguaaccauuuugaggcccuuacacgcauaccaccacacacccacugguuuugaugacaggaagccagaaacaccgguaaaaacucaacaagaaauuaucauccauuugcuuuucccugucucugauuugguacuuagcacugggucauauaccacagggaagaccaaagaaauauaccuucaggaaaagaauuuaauuaagaaacuauaaauaggucaucuuuccagugguaauuguuuaaaacucuuuaacuuaauaccugccagaaaguuccuuaaauucagugaauguuuuucucuucuaaaauaaauuuaaauugccuuucaaaaggcaguaccguauauagcacauguauguuauaauguccuggaauaauuauugaauuuaguuuguucaugaaaaauaacacuauaauuuuaacauuaacacguucuaccaguuuucuggaaacaacacuauuuguauuauuguuuuaaggaaauacauuuuauuggaaacauguauuuagaaacacaguguguuuuuugucgacuaaaauuuuacuuguauaauuuaggcaccccuuuugaacuaaaucaaauuuuacaucauuuguuaaccaacagcaaagccgaauugaagaucguuuagaaagacuggaugaugcuauucauguucuccggaaccaugcagugggcccauccacagcuaugccugguggucauggggacaugcauggaaucauuggaccuucucauaauggagccauggguggucugggcucaggguauggaaccggccuucuuucagccaacagacauucacucaugguaagugaugaaauuuauagacucuauaguuaucauauagaguuagaauuucagauauagauacuauuguugcuguuuuuuaaaaaaucagcuuuauugagauauaauucacuuaacauacgaugagcccauuucagguguacaauucaaguguuuuaguguauuuacaagguugugcaaccaucaccauagucuagguuuugaauauuuuugcccccugcaaaaagaaaagaauccccguugcccauuaagcagucauuccccaucccuccacuuccagcccuuggcaaccacuugucuacuuccuaugucuauagauuuaccuauucuggauauuuugaauauauggaaucauacaacaugugguggucuuuuuugacuggcaucuuuuacuuagcaugacuguugcaguuuuucuacaguuugccacguauuagagcuuuauucauuuuuauugucaaauaguauuucacuguauggacauaccacauuacacaguuggguuguuccaacuccuuggcuaugaugaauaaugcuucuauaaauauucauguuuaaguuuuugugcagacacauguuucccuugaggaugaauugcugggucauuguugguguuugaaauuauucauuuuggugacccuggccaaaguguacaauuugaguucauauuauaauaugacauugcuaguaauucaaauauuaguguuuuuuuuuuaauuaaagaagccaaaauagugucugucaauucugagucugggagauagaaauauaugguauguuuauuuguauaaauacauugcaugugacuguguaauuuaauagaguagcuuuacuacuaccuauuuagaauaagucuuuauuugaauuauauuuaagcagauuuguccauauuacaauugugauuuuuuuccucauuacuuuugaaaggauuuuggagauaauucuuuuugaggaugauuaugaagauucagagacucuucuuaauagaauauuaagugaugacaauuaaugaggugaccagagugguggagaauguaacuugaccagugauucucuguaguucugauccucacaagcucuaccucgucucuaagcaccuuaguguccuauuuugccccuuacaggcucgcuaaaaguugcuuggaugaagguauauuuuccauuaucacuguagcauuucucguuuaagcauggucccaaaaggaaaugcaaaauacauacaaauuauuaugagguucuuuuaaguucuugcucaguaguauucuccuguccaucuuucaguuucucuuaauaaaagucuaagauuaagaguaccauucugaacgguguaguauugaaaucugcaaccaauuugaaaccaaaaauacugguuuauaaauagaagcaacgaacucacaucuaaaauguggaaagauauuuuugaaugccaaagagaaaucuuuuuuucuuucccuugaccucugcccuaaaaauucaucauugaauaaaaauuguuuauauguucauggcaguugcuuagaguuuacaaaagaaaagucuagauuuuaauuuagcuuggccucagguaauguguuaaauacacuugggaugcauauaauaugagauuuucguuuguacagcucuuuuuuuucuaacuacaauguuuaaacauacugcuuuuaauuaagaaaucuggcuuuauuaaaagccagaucugugacuuauaaccauuucuguauaucugcucucaaucaacagaaaaauaguuuaauuucuguagcuguguucauuuugcauauguuaaacggauguaacaugcacccagggcauugcuucagagacuauuuuuuccauaaauauguaaaguuuuucuuaaauaccauauguagguuaagugguucuuuuaaauauuaaacuauacauaaauacuuuuggggacuauuugaccuuugaauugacuccuuuuugagucagauucagaggugggaugggaggaaaagacuagaauuauuuuuggagaugggaaguuggacugaccucaguagaaccgaaagugagacgacugaauagaacgguagaaaaaaggaaauaauuagccaauauuacauagaaaccccuuuaauuugaucuugauauacacacacacacacacacacacaaaagcaauaaagccgccaguuuugcugauaaggauaaguuccuguuuucuccucugaagacauuuaauauucaaucaaggacagccacagagccaagcagaucauagcguaacuccaaagauauggcaugucaucacccugcugcccuuugaaccaaaugggguuuugcagucucucuccuuucuuccugaaaaccauucaacguguccccagaaucugagcuccucagccugaaacacuaaugugugugaaaaggauugguuuggccuaucuuucccgugcaaacugguaugaauuuuaaaacaaaaacauaagaacaaaggaaauaguuuuugaauuuaaucagucugaaguuagccuuugaccauuugauacauuccacaauaaaaaggaaguuuaaggggaaggcaaaaaaaaaaaaaaaaaaaccucaucccccuuccccacaacaacaaaaaaauucaaggaggauacugguaauguuuuccacauuugaauuuuaauacaugaaacaggcuauaaaacuuuggccagcugcaguaaauaaaguagccgugggagguaugcaccggaaacuucagcagagagcacuggugagagucucauucccaacuacacaccuucguuuguuguucugggcggaagcgaguugcaguaacuugauacucaucccagucccgguuuuguauugagcacaucgccuuucuaacucuccucaguaauuccuucugauuaaagaguagacagcucugaauccucucgaccuccguacgcuucucauuuccuuucucccugccuuccaaaaaucaaaacaaaauggcuugauaacuuggaaggugauauaagcauuucuuucugcagcagcuugaaguugugguggggaaaacugugguucugccucggcuguuauguuaucucauuuaauugcuaacauauuguccuuagcuuuugauucauaaaauguuuuccuuggaguucugaaguaggucuucagugauuuacuaaguauuaguauaaugaaagggauuuuuuuuuuucacagcggcauggcucauaacacaagagcgaauguuuguauacuugcaagcucucuggaugauauuauugagcuaugcuuauuuccugcucaaaaaccuucccugccuuuccauuuucuacaagauaaagaccaauuccuuagcucagcauuugaagccuauuaccauuuaccgaaagccuuauguugagcucuuccaaucugcaacaagucuuccagcaagacaaggcugggcauauuaccagaauucacccuguauguucuccuucggaacuuuuguaucucuuugucuuguccagcccuaucugcuuaucucuguacaccuaauacccacccauucucaaagcacugacucaaaucauucuucuuccaggaagccuucccuugcuaccccacucaugcuagccauuuuuuucucuauucuuacagcccuaugaaucauaccauuucuagauauuuaucuuaaccagcuccgcauagcugugcaucuuuuauagauaugacucugccuuaccaacuguuguaaauuccucgagucucacauauuauauuuugucucucuccccccgaccccuguaaauagaucauccauagaaacgggagaaaagaaacgaggaaacuuaacauucugugagugugaguuggcagccccucugcuaggcgcucugcauguguugucuuaggcagucuucacaacagcccagugaggaugauaauaguggucauuucaggugucgguaaagugagccuuagaaguuugagcaguuagucucaaguccugcagcgggauuuaaacucaagcacaucaacuccaaauucaaugcucuuuuuuacuaccaggcauacucuccagagauuaucuaugagaacaccuuuucagaacuuauuuuaaaugcuaggagcuugugauuuucaaaacuugauaaguguugguuggcaaaagaaguuuccagguauuccauggcuggguucccagagcagcucucuucccaaauguauagacagagaacuuucccuccaaagugguggcaugcuuggauuaaaacccacauuaucuaugcacuuauucuuaaaccaacauguuugcgcugagugccuaagaggugugaacucucccuaccaggguccuugagguagcaaauuuuaaguuaucaaguuauuuuucuuacuauaaccacccacuuuucuuccaaaauuaaagcagaaaucucugaaugugggagaauaaggaaauagccaggucuucacuacccuaguuagaaacucuuaccaaguaugauucccucucugccucagagaccuccaugauuaauccugauauuaaaugauuagauuucuuauaaauuauggaaagggcaauuuuccagauagaauucucucuguuacucauucaguauucacauccacagaugaggccugaaaagaagcguuucaaaugaccuaaccgcuuuuuuaacugacuaagaacaaaacccacaucaaacuugucuuuaugugacucuauguguucccguuuauuuguugguagagucagcaacuacgugaucauugagcuaaaaauccccucuacuauucauauaucgcauuaguguagcucucagauccuucuuguuuaaagucuauuuauucauuucaauaacauuuauccgugguuaccaaguguagguucugugcucucaaggaauucacaggcuaguaggaaaagauguguacuuaagcagauugcucccugccagucugcuaugcccucuaaaagaccaggggccugacccuuauccaguagugaaagaucacaugguuguuuaguagaggaguggucaucuccaguugacuuagggaugggggagucaugugcaacucaccccacacaccuguccuccacagcaucccuucagaguccugcaggugggggauguggaacccauuucagaaaucaccaauaaaaguggaucuuugcccaguuuuccucuuuucaguaacaauuuuuguuuuacuuuggauuaaaugcagucuaucaaaagagcauuccuuaggaaaagugguaucuuuuuauuuaacugacauuauauacaugagaacuuuuaccucuuagggcuucauaggacaaacaacuucaguuaguuuuccuuguauaguuaagagcucagaccacugaauuuuagauucuaaaaguacccuggaaaucagcccauugcccuucuuugaagacuaaggccuaggaaggggaagugaccaaaccauggguacucacuaguagaauuagaaaccagacaaaagaggcuggacacgguggcucaccccuguaaucccagcaauuuaggaggccgaggcggguggaucacucgaggucaggaguucgaggccagccuggccaacauggugaaacccugucucuaccaaaaauacaaaaauuagccgggcaugguggugcacaccuguaaucccagcuacucaggaggcugaggcaggagaauugcuugaacucuggaggcacagguugcagugagccaagauugugccacugcacuccagccugggugacagagagacccugccacacacacaaaaaaggaaaccagacaaaacagcaagcagaccagcacuccuugugcuauauccuacacugcucagccgacuuccucuuuacccuaauaccauaaccauuucaaaacugugagugguagaaauuagaaaccauucuguuacucugacuuaacuaaugaaauccaagaaaacucuguaguuggcccuaggcugccugcaaugaguugcuauuuagcucuaccaguaauauuuggcaaaaagagaggguagugggcauugaugugauguggcaguuauugguacauagucaugggagcagcaggagucagaagauucuguuucuaugugggccucuucaacaaagauaugaucaacagaggcaucagcaucuucaguugauaaaguugauaaaauagaaaacuauuuucuaaauagccuguuacagaauuucagcgaagcuauugguggucagcaucaucuuuuaauagcuacuaucuuguuuuucuuuaaauuaggauauuugccuucucuaguguucugucaucucuccuaaucuccacaacuaucagguauuucggagagcagauuaguaaccucaacugaaaguuuugaucuuuaucaauuuaucaguugcuccucuugggcuuucacagguuuugauuccauaaaguucugugucuauuugagugcauacuucauuucuaagcaguuauucccauggacucucagggaauuuaagagauuaucucuacugaaaucucccuacagauuuccugccaagcagucaacaagucuugaucagccuccuuccuucaagggugacuagcuccaaaugcccacaaaguccauuuucaucaaauauuugaaaguucuuccuagguccagcccaaauuugcuuuuuucuacaguccuuauguuucugcccaauagaauugcccacaaaucaaguccaacaagcacuugagaaacucaguuauuugaagacagucugcugaguguuuuuucccucuagacgaaacaucacuaucuucaaauauuuaaccugaaaaaaaguuuggacucccugucaugaacuccauugcuucccagugcauucucccuaguuuagcaaggaugccuuuuucuccacaagaaccuuuuaguguguggaaccgcaaacugaacacagugcuuaagaaaggaucaaguggacuaggguggaucuaucuccucccccauucaguaccuuguaucuucauuaaggccaccuaacaauauccuguuuugcuauguuugaugcuuucauuguccugcugacauauauucaauuuguaaucaacugaaauccauaagccaccuaucuccccagucucauuguguacuuuuuguugugucuguacaaaacuucaugaaaccccauugaauguuauguuguagccucagucugauuccuguuuaaugguuucccugaagcccucauucagucacauacucugccaucucuguugcuggcaaaugugaugggugugacuaaugcccacaucaaagccaccaauacaauauuuucaggggaggggauugaccagaaggccaugaggcucaguguuacagacauucuuucuacacgagugcugucuucuauccuuugaguuuaaucucagcugguucugucucccuccuuauacaccguauggcccaccuuugcucauuuuguccguagcguugucacagaagccgggcaugcagcacucacugugaagcaggaaaugaggcuuguccagaaugccuugcucugguggaaccaaacugaguuugagaggccauuccuguguuucagagcacuuucaaaacuauuuucuaaauacccuguuacagaauuucacccaagcuauugguggucaacaucaucuuucaauagcuacuaucuuguuuuucuuuaaauuaggauauuugccuucucuaguguucugucaucucuccuaaucuccacaacuaucaaguauuucggagagcagauuagcaaccucaaccgaaaguuuugaacuuuaucaauaucauacuuuauuuuuuuaaaacugaaaaaaaaaaggacagaaagguaaaagaacuugaagaaauucuuuuagccauggaugagugauaacagcugagaauccuugagcuuaccauuugauauuucuauauuaauuuaaagaaaagucaaaagauuuugaaaacagcaauagaaguaagauccuuuaagcucuauucagcagccccuaagaaaagugaugaggacacugugcaugcccauaugugaacaugguuggccaccuuagguauuuccccuucucuccacaugaauacauauuuuacucaaauucagacucuaugauguugaaacagucuggcauuggauguuuaccucaaaacccugcucucucugcaccuaggacaaacaaauccuaguucucugguguuuagcaucuuggagccaugaauuuuaaauaaaucaaagacaaaaaccuugucuuucccaguuuuaaaauauaaaagauacacacacacacacacacacacacacacacguguauuuaaaauagacccuauaaccucaucauauucuuacauccuuacaugguuuucuucuuaaauuguggaggaaaaggcaggcagacacauuuaauagcacagugaucaucauuuuuuaaaugaacuguuacagggacauaaucuuaaacuauccauaauuuggaauaggcacaacugugcauuuaaaaaaaugcaauauuacccuuauuuucucaggaaagcagauuuucuggagggaaaaguauauauuguauauauuagaaaauauacauauguucauucacucuuucugcaucugcugugcuucagaugcuuuuggggaugcauaaacguguaaaagaaaguaucugaucuuacaggccuuuuauccugguagagugauaauacaaauaugggucuaacuauaaugcaagguagaauuaugaaaugaccuaaggagcaauucagaccgcuaggaaaagcuucccggagaagaugccauugagcucauauucgaguccacauagaauuucaacaauuagagacaggauagaaaaggcguuucagagccauauaauaaacaugauuuaaaaccaaaaacagaaaauaaaggcucaugcaccuaaauggaaguaagaaaacugccugaugauaccaguccuugcagcuugccagccagggcugcauugggugaaaagccccuccacagcacggcagcuccagcaguuggcucgaauauuucacaugagaguccacaggaagagcgagcuuucauguauauuuuuuacauccaaauuaaguuaacucauggaauuuuccacccuuaggaauuaaaguagcaacucaugaaguaauucaguuaugucauucauaccaaaacagaaaauacuggagcaacuuggcacuguuuaaaagccaagauuaggccuuggccauuuuauauuuuuucacauuccauggccguuguguuauuuuaacuuuuauuauggcuguaaauuuuucaaaucaaaaguaucuuaauugcuuagaaaacagaaguugaaaauggguucauaguaagaagaggguuuaggcaaagcagcuuuaggagugagaacugaaaaaaagcuguagcauuacauuuucuguaaugcgaggguucuaccuauuugguugacauucacaguugugcauaauuauagcuuccucuauauccauaaaucaucuuagaacuauaaaguugaguuuaaccaaaagaucuguccaauauuagugaaaugacaucuuuagggaagcauuguccugauacaauagccacauucauuuuaaagcaguuaauuggacacauugucaaaaaccacgguauugaguuuccacauuuuaauuucacauuugccuucucccuggcuucugcacacggacgggucucuuuuggagcugaaagugugugaaaguuauuggagaaugguagucucuggguaauguuucuguaagcugcccaaaauuuucccccuguagucuagaugggaaacagcugguauuuguuuaaaaagcuguuuugcaaaaugucuaaaccuugagauauagaacugaggucaccauuaaagcaggugcuuaagagcaagugagaaagacuucagaggccgacuggcucuggaaucuucugcagggcacuuccuauuagaagaaaaaguguugaaguuugcuccuuuauuuaggacacggcuauaaguauuaauaaguaagugcacuagcaauacuacuagaaauugaguauuuuugaacauagccagcccucaagugaauaauuagcucaguaugaaaggaacuaaaauggucauuuuucucacagggcuucaagauacaagagcccaaggcgcucuagucuccuuuggguguuugaauuuccucuuuaaacacaccaacaguaaaagaacuacuauuucaaauaagcaguaccauaacugacuauaucuuccaagguuuuggaugcaaucuaagggaaagggggaaaagagacccgacuuggcaagacccguaccgaagcagucuggaaaaaaagcaaagcaaaaaacauguggaaccacuaaaggccagugcacgucagguauccaccagucugaagaugaaaggaaguaagccuccuccccugggagcuggagguuauuagcagcuguuuauccagucgggaauagagauuaacauuguacuuuuuuuuuaagaacuagaagaaaauuuguuugggaaguuggcuuuucauaucaagucacugugcuuugccaaaaaaaacuuccuuucucagaacucauguacuagcauugagcaauguuaugauucucugagaaacucugaauuaccaaaaagucuuucuccauuaaauagaacagaaaaggacagagaaaugggugaacguuugccauugacacauugcaguuguacucuuuaccaugugaaauuugccguuuggucuauuaccuguucuccaaccugacucuaaaugggacacucugcccucuaccccucacacguacccucacaacuuaaucauugccacucuaaggugcacacaauggguucugcagauaccuacugcuugcaaaaagaccuuucaugagauauuggggaaacugccuaguacucugggugcuuuauucucaaaaaacaaacaaacaaacaaacaaaaaacgaguuggauauagguauuuuuccccugauuuaaugcuacucuuaaugucauuuucuuuuauuaaauccuuucuucugcuuuugaucuuauuuauagcagagccacuggucauauggaaacuauuacuguauagcugcgagaugaaagacuucauggcaauuaaauaagagugaaucauuugggccaauaauacacacauacagugagguaccauuuguguccaaaaugcccuguguuguucacuuuguagcaaagccauugagcuuuacaaagggcuuuacaaaaaucugcuuuuugucagaaauauguagucugacaauaugaaaacacauguuaacacacaguccuuagcugcuugcuucuucacacauacacaguaucuaaaucaugccacuuauugauauaaaaugaaauuuucacuuaaauuugggauauuauuuaguuguguuaagcgucagcucuuuaaaaauauauuuggauaaucuauaucaaaauucgacccaucacucaaaaccugccuaaaaugucauguucuucuuaaaguagucccugguuuccuaaacggguaugacuucaucauuuuuuaaaacccuacaugaccuuguacuccuuuaugacauucaucguauuuugccuuguauaguaauauuaucccaucauuaaaauaucagugccugggcuaggcgcggugguucaggccuguaaucccagcacuuugggaagccaaggcgggaggaucacaaguucaggaguucgagaccagccuagccaacauggugaaaccccgucucuacuaaaaauacaaaaauuagcugggcguaaaggugcacgccuguaaucccagcuacuggggaggcugaggcaggagaaucgcuugaacccgggaggcggagguugcagugagccaagaucaugccacugcacuccuuucugggcaacaaagcaacacuccaucuuaaaaaaaaaaaaaaaaaucagugccugcaaagucauagacguguuuauuuuuccuugcaaaugcccauguagugccuugcauauaguacacuuucauaaggcgcuugucaaauuaagugaaauguuuauuugauagaaacaugcuaaauguauauuuggcaauaucaaacaauuaaauuucagacauagucucacagauccauagcauuugugucaucauuugcuaagcaucuaacugcacauuguacuauuacacucccgugcagugaccugugcaguuccuguccuugggaugggaugcccacaaauggagacaaguauaggcuuuacgaauggcagcaaaacaaacuuauugaaguuuaugcccugcaccauucaacaaugaccuugaauguguuuuaaggguggugucuguaaugcauagugagcucgugaggugacaagaaaguggagauuucuggagauccacucagcccugaagggucagagagugaggggaucugugaggcuaauaaaagagaagcaguuggugaguuaggaggaaaaaacuagcccagcagacagagcagggagggcuuugcucaagccuuagugaugugggcguuaacccagcagaugagaggccaugcguagguaauugaacauugauagugaggaauuuaaaaauaggagggaacugcauugguccugggagucuaggugaaggaugcaucagcacaagguggaccucuuagacuggauccauacagcaagcaagagccaggcugaagccuuaauauugcaucaacugauggagagagaauauugcauuuaaaagaugaguauuuggaaagugauggggaagaaaugguucauucguuuaggugagcuucuuuauacuucuacucucuuuucaaauauauuacaguaagcauguguuacuugaauaacaagaaaagcauuuaagaaauaaaggccaauggguaaugguaaaucccuagggauccuuagggaugggccaccuggacuggcuaaaaacuguguggaggucagcagcaugacugugcacucucacagguaugcuugcacuucaggcauucagaauuccaaguguaaaucaaguguccaguugucuuuuccuuuaaacaaaagcuguuuacacauaauugcuagacuucaccauauucucugugcuagauauguuugguucacuaggauggauuaacuuuaguuccauaccaucuacuuacuagccugcuauguggagcaaggaagagauagaggaaugggcucuguuaaucugccaguguccccgcuaggugagcucucuccaguuaugguuuccacuguauaggaaaaugaugucgagaauugagggugugggacacagaagagagaaaugaaacaguuuuaauagauggaacguaugaguuaguacaagaaagaugaacugaggucggcucacauccguuugcauuucuugaacuauaucauagaaucauucauuuaaccauuuuggugaacauccaggggaguuucagcccagcugaucauaugauagacaagcacugccaaggucaggaucauuuagaucauguuuaaauccucuugaaaauuacuuuauuaucuggagaaucaauauuaaauaaaucuccaagaauugcacaauaaggaauuaccuuacauuucauacagaacauaagagaagcugugauguuucuggaaaacaauguagguguucucaagacaguuaugaaaucuucucccgacauacauguuaagaaucaaguaaaaauccaaacaaaagaauugaauccagaucugauguuaaugaaaagucucuuaaagguuuaaucacauguacuaaagaaaaaucaucugauaauuuuuuaaacugagaaauauggaaauuauguuugugguuggagugucccagauguuagcucuuucucccacaacaggugguuauuagagguaggucuuguuuucugcagagccucugugccucuaguguuguuccucacaguaucuaucuacugcugccauuccaugaacuuccuaauucccaucugugagccauuaaaaaaguuugcaugaccgcuucccaccucuuuaaaagaugcacuuuuguacuaaaugguguuuugcacauuugagaaaauaaguuugcuuuccucuaauaugacagaggucuggcaagauaauugaaacugaaaucuaguacucuacaacugucauguauaauugauauuucauggggagauuacaguucagacaccaaaacuguuuucuguaucaauggguuucuaauuacagugaaaacccaucagcuuuucuuuuguguuaauggaaaaacaacagagaaaaguaacaguaaguugcaguuaccaggacuucugucuuugucccauuuuguuguuguucuucuuucuaaaaaccaaaaaaaucuauguccaaaauuggaaaccagaugccauuaauagcaaacuuuaauuuugauguaccaaaauguuuauaauaguauauccaguuuugugucauuaucacuuggucuagaaacugaugacaaguuuccuaaaguucccauuguauacucuuuuagaaggauuaugguagaauagaagugacugaggucugaaagccuguuuugaagcaguuaucucuggagauaacauuaacuaggauugaauaacugccaaaugaaauuuaauacauuuucccauccaugaaauaggccucuuaaauacaacagaauaauuacuuucacaauacucccuggaaacaaagagagcaaaaauauugaaugucuuuuuuguuugugguguuuguuguuagcuagaggauaaggacaaggauauuuaccacaaugcugaaugcaucuccauauaaaaacagccuugccaacagccaccuaauuugaaucugcaugucuuuuaaaucuguuuauguuggagggaucguggcaaauauuaaauuuuauaauuuaguuagacaucuuggccuuggccugaguuaaugaacuaugauuuucccccugcaauaaagaaaaaggaaaugauuuuccucuaucuauauauguacguauauauauguauguuauaugcuuguaccuagguguguguauacauguauggacacacacacacacuguuuuaaaacaaaagcucugggaaauaaacgcaucuugcccccuaacucuccuccccucuccuauauaauuguucaguguuguaaguuuucugaguucaaaaucuguuuuagaucuccaacuaagcaucgaaaguuggaucuuaagucacuucaccauucuuggccuuagcuuucuuuguaaaaugaagaguuugaccuaacugauauauaaccaagguccuccaagcccucgacgucuaaguucugugauuuaaaaguguuucuaucaguuugucaagcccuuucuuggaaacuaagguuauuuaaaauuauauggugcuuacgugauucaaaauaauuauugcauaucuaaugacauuuaauuauuuccauugacaaauucacacaggagaauucaaauagcuguguuggaauuugaauauaauuugaccuaagauacaauguaacucagacauuuacaccuacauguaccagucaauauguggacgggacaggccaagccgccuguguuuggacuacaugaucuuauccccccuuccucguuuguagcucucuggaccgggaaaaugccugucauuaagguggcccauucauaguaugaccuaugucugcuucaaaaugagcugggccauccagugaucuuggcauucugagcuuagaaauacaaagacaaagaggaaauuagcaggagguacagaaccagaaagaaugcaccaagagguaucaugaagaaagaguccaaucugucaucaugagagggcagaagccagagagaagcagagguccccccagagagaggagagaggcugaauagcccagcagaggcgaggaguggcauucgguucccaagagcucucugaguccaaaaccuaagcuacagaaaacuauuuaugauaaaucuuuuauuugaacaaacucaaauagguuucucuuccuuacuauuaaaacuaccccacuaaauugaucagcauacaaaaauccccccaagaaucauuaugaguuccacaaaaaccaggaccacaucugaguuauuucucauucuauccccagugucucccaaagugacaggcaugagcuagauuagaaaauguuuguuaaauuaguaaaugcauucucugaucaaucaaugaauaaucauugaauaauuuuuaaauuucacuucuaucuucuauuuuuagcauagauaucacuaaaacugcauuauacgugacuaugggaagauucacauuuacaaugaguauuaauaaaauuuucauaagcuggcuuuuaacuuuagacuauuguuaucucuaugaaaagguuaucaaaauagagcuuuaacgaaguauggauuuucuaaaaauagggacgaaaugucaugcuuagaauugacuugugggaaucuccuuucuccuagucacauuaugacguauuuaaguucagaaugccaagaucauuggaugccccagcucauuuugaagcagacaugggucauucuaugaaugggccgccuuaaugccagugggcaaaucccugacccuuguauauacagagaacagugugaguuucuccaucuauuucuguguuauucuagcgauggauuugugccgacaguccacuguguuucuucccuugucucuuaugugaccagaaauaauguuucugaaagagaagaaaacaggguuagaauaugccaucuguggccaaggaaacaagcaaagccaagccaauuauucaaauuggaauacucuuccacagccacaggcaauggaguugauccuauccuggagaaucaagcucauuauuacauggcucuggaccuaucagagggcauucacaugaccuggaauagacacaaggggagucuuaaaacaucacgacaaauuagccggcgugguggugggcgccuguaauuccaguuacuugggaggcugaaacaggagaauugcuugaaccugggaggcagagguugcagugaacggagauugcaccccugcacuccagccugggugacagagcaagacucugucuccaaaaaaaaaaaaaaaaaaagucagaacaacuuugucucuaacauucuuuauggaaaaugauugauauuauuuaagaugaucuauagaaaauagauggaguuagguaacauaugggccuaaaauccaaacaaaaauguaguuggaacaacuauauccucagauauauuuauaauauuuaagaguuuacagucauuguauaggggaaagauuuaaaauuaaauggauuuuaacaaaauagagacaaagaucaccguaacugaagauagcuugaguuuugaggggguucuugaacuacacaggcuauuauuucuauauaacaugcaaguauuuucagucaaaacacaugauucugucugcaguuauuauguaccuauuacauaccaguugucauguacgauugcauggguucucuuuuucucuuuugagaacuuaccucaaugugaucuagagggaaaaaauuucaggagcaguaacugaauauauuuuaaguaaaaagcaaaacauuacucuuaaguuaugucacagaugcuugcaaagaaaucuugagaguguuaaugauucugaaauaggaguacacuucuccucuaugcucaaaucugugguuaccuucagugauuuugacuuagagucauccuuuguagaaauucaagaaauuagauccauugggaauacaaauaaauaugaaucagcacgaagaauuauuuagguuuauauugauugacagacauaaagagccaccauuugaucaaggccuguaaaaauucaugcuuacaaguugacaucuuagauugaaaggauaaucauugauugaauccguuuucuaaugcaugaauauaaaaauagcaaaucaaaaccucaauggaaaauagcuaucaugcuucugaauaaaaauuaaaauauauaagagagugaguuacaaaugguugcuggagcaggugggcguggucugccuauaagagagcagacuucagucacagaggaaaggagugguguggcaggcaacaggguugaauauguuuaaaaaaaaaaaaagguuuguacuuaacgccacagagcucuagaagcugaaacuagaaucagugagugaaaucuacaaagaggccaauuugugguaaaaauggaaugggcuucuuugggagauaucagucucaguacauuugaagcaccccacagaggccaaauaaccaccauucagaaaguucuguguugcgacacaggcaccggggagcagugcuggacuuccuacaucucucugcugaaacauucauuuauacuuccugaggcucauaagccucaaguguugucuuauucuugcuguauuuugaauccaaacaauuaauaugauuuaugugaucaucuccacccaaaauuuaaaaaaaaguuggagugcauacacacacacacacacacacacacaugcacacaugaauauaaaaauggcauacuucaggaucaauuacuuaaauauauuuucaguaaaaagcaaaauauuauaggugauacuuaauacauggcugccuuuaaauagcaugugcuuauuagguccugugaauuuguuguugguucagauacuuauuguugaugcauucuuuggaaauacccuuuuaaaauauauugguaacacaagagugaugauucuccuuucugguuucauauuuuugacuggaaaaaaaaauaaaccugauucauagcaguauaaauguaugguuaauuuuuuguguuuuagacccaccguccuguguaaaugcucacuuaaccauaggcuaagaaaauacuuggaaauagaaaagaaaaugugaacuacugauuguccucuuaguugacaaaugcuucauguuuucgcuugaaggcaugugcuaugaaguaggcaguugcugucucagugccacaaguucaaugucucuggaccccagagucgauaguaguaguuaauaaaaagcucagcaguauuuuuuuaaugaaguaaucaugcuguacucuauaauuuuauucuuggaagcauaaagaguauuuacaauauggugucuuucuagggucagaauagugaggaaaaaaauggaaaaauguccaaacauccuuccuugcauggcaaugauggcauuacugguguguuuaauaaaaccuuuauugguacauuuuccggugugguggcauuggcagaaaccaucccccuuuggauuuggaacucagcagcugaugaaauacaguaaacauuaauuuggaaugggcugccaguuuuggaaagccaggugacauuuuauuauauuuguaccaagcagaggcugugucccauacugcuguagcuuccgcugucagaggcuuagcuggcauuauggaaaaaaaaaaauggcaggccugagaaucuuauccccugaaaugaaagucgaaugccaaauugaaauuccuguaggauuuccgauagcaaugggggaauugagaagcucacaauuaagcauaugggcauuaagauaauugucagaucuguuggcggacaugauagaagacagauggguacgaaucagugcgcuccacugcagcacccugggaggcaauuugacguuuuaccugccugagcuacucugccauauuugucacugaauguacagcacggcaucuuacugaguguuaaguguuuucgccgggaacuauaggugcaugugcgguccuucagcgcccucuagugaaacgcguuugggaguaugguuuuugaaaagccagccuucaucagguccucuuggccucuggaaauagcugucgcaccuccgguuccugcucaccucucugguuccucucgcccuuucagguggggacccaucgugaagauggcguggcccugagaggcagccauucucuucugccaaaccagguuccgguuccacagcuuccuguccagucugcgacuuccccugaccugaacccaccccaggacccuuacagagguagguuggccucaccagggcacuucugaccucacuuucacaauaggaccaguguugauacccagccucuugguguucaucccucaagaagcacuggcagaaacccaggaaucaaauugggcacaaaaaugguaaggaaauggcaaaguauuuagaacuucgcccgcuaauuguguuucuccagggacuguuuuccucaaacauccucugaaauccugguccuauaucagcagggaaugaggccacagacugaugagaggaaauuuuauuuuagcuauuuccacauuuuucucauucagguccucuaaugugguuaguuguggccugaaaaugauauuuccaaaugaauaggaaggaaggaaauuguuuuuguuguuuaagauggaaggaaauauaggugcauuuaaaaaauggagcuugguugcaugauuuucgcucuugagucaucuagcccucuaaugauugccucauaccggugauuacgagcggcuuuucaugaccccaggaaguugggcuauugcuggccagcugacuaggagucgcuuagauaacaucuucucagucccuucacauuuaauauaaaaaugauaacauugccacaggaauacaugugggcauuuuuucagcuguucaacauuguacagaucugagugucaauuauauguauggguaugucugcccauuuuuuaugaauaauaaucauuuuauggacuuuuuuuuuuuuuuuuuuugacagagccucacucugucgcccaggcuggaguacaguggugcgaucucagcucacugcaaccuccaccucccagguucaagcgauucuccugccucagccucccaggggguagcuaggauuacagacaugcaucaccaugccuggcuauuuuucguauuuuuaguagagacaggguuucaccacauuagccaggcuggucuugaauuccugaccucaagugaugcacccgccucagccucccgaagugcugggauuacaggugugaaccaccacaacuggccaggaccuuucuuaucaggaggcuuuggauuuugcccucuuuguccuaaaccugugcuucucaaacugcacauaagcacaaccugagcaucuuguuaaaaugcagauuccacuucuguaggucugggauuguccauuucuaaugggcucacagaugaugaggccgcauggaccaaaguuugaguggcaagguucuagaauacacagauuacaaauaaagaggaauacuugacagauaugcuucuaccuuuaaaaaaauuacuacauuagggucguguuuuaaaaugcagugugacuuggaaaguugagcaaugauaaagcuagaaauuucuaaaaugaguagcaaacugccuuccauauguaccauuuuaaaaugcugauuacuucuugagaauaagagaagccuaauuucagaauaucauuaggguaccuauugaagucuugacugcacauauuuagcauacucccugggaauuauauuuuaaggacauuuuucuauuaaaucauugcauauggaagaaacucaauauaauagcugauauuuacuuggguucuuaaucagaacauuggcugugugauuuucaugauuaugauuuucauugcaauuaaguugauguuuuguagacagugaaauuaccaucuacuccaaaagauugcaaaauagaauuuaaccuuagagccaaugcagggaaaacuuguuucugcaggugcauuuuuugaaacuucaacagauagcagggggaaaaaaaagugacagaaggaucacaguucagcaguaugaauugucugcuggcagccuugcaaucuggugugcaggcagugagauugugguguacaugucaccugauuucucuuuuucggcaggcaugccaccaggacuacaggggcagagugucuccucuggcagcucugagaucaaauccgaugacgagggugaugagaaccugcaagacacgaaaucuucggaggacaagaaauuagaugacgacaagaaggauaucaaaucaauuacuaggucaagaucuagguaacaguauauaauacugucgcuucauuuaauuccuuuauuggacuuugaugaagugaacagaacgggaagaaacuauucaguuuuuuccuggcagguaaauuuacagcugaaaagaaaauuaaaggccuacucuagaaguacuaaaaguaucguuucagauaccuguacucuauuggagccuaaacuguuuuggcauuuaugaaucuggacccaaugcuaaugacacacagugaaaaaauuugucucugauucaaguacaguuuauuuguaaaacuauacuuauucuacaaauuuggucagaaauguugugucuauaauauuucuaaaaagagauuguagccauguuaaaaacucaacugauguaugugccaacuauaacucuuuucuuaccucuaaaguaagaaaauaauuuccuagauuuauccuaaacaugcugauguauauaagaguaauaccuuaauuguuuaugguuuuucuuccuggacacucuuuucuacagaaaacacaacugcaggaaaauagcuucugucugguuuucuuaaauaucugcuaucuuuaaauucaaaucuauaucuccuugaacuuuaaucugguaaucagaugguuuuugaauaccaacacccguguacuuugccucaauucccugagguuguuuuuauucacaaauucaaccaauuguccuaagacuacagcuuuccuucuaaaggcugugguucucaagguucuaucuggaaucuuuugugaauuaagaacaugcugccucuuuauguugcuguuguaauuauugagauaaauuccgugucuugccacaaguuuaaaaaugccgaauacuucuagauaaccccuuuccuuccuuguugucuuuuucugauucuuggccacuuuggcaagaaaucccaaggaggggauuucauaccuuuagcagcuucuguguuagaccagucaguucuugguaauuuaacuuauuguggccaaacuuaugcauguuaauggauucuuugaaguuuuggaacaacauuuucauucgcuguugagaaccuucuuauuuaaaaaggucacucuuaugacauuuacuuauguaugccuccaaaacuguauuauaaggcagugcuuuuucaaaucuaggcaguuuuauuugcauaacuaguuuauuuguaagugaauaaccaauucuaauuggucguuagccugaaaaucuuuggaagaaaaguuccuauuuuccagucuccuuuguguaagguguagcauuuguuggauguauaaaaauaucacccaaaugcucagcuuccggacaggccuggcagagacuguuuucauuugcuuuuuacagccuauuugcauaguagaauauaggagugaauuaaucauuacugauuuccuuggcacuggcagcaguugggggugagggcagaggagggauccgcagaaggcagagaaagagggccuuuuccaguggacucaguugacuuccauguuuaccauacacaccuguggcagacagugccaucuggaaaggcgcuuacgcuauggagagagaggagccuggucuuacagcauccuucuguggugucauccuccuugccccuaacuuuucuccuucacccaaguguucuugacuuacgugcauuaucuuuauguguaacguauacuugcaaccgaagaauaccacucccacuuuugauugauuggagcuucucaaguguaauugguccuuauugccacuuggaaguuacccagagauucuccaaaauggaacaucagagucauauauuuuaaaccagcauucauuaaauauacauuuaauugaguagauaauuucccacaucuuccaacuccgaaauguugugauuaaucaucuuuauucugugaacauuuccaaugugugaaauuacccuuuagguuaauuguuagucacuuccauggaguuucuugugauggggagucuacugauguucagugaaguuuguuucauuuucugugucucucauaagccccccaaaaguccucacucauguuuauucacaauagucauucagagcuuuauagcacgugcugcucugccuucuugagacaagacgucgugcacacuucucuuuuuuacaugacagcccuuggaauauuugaacccugcugcugugacgacuuccucauaugauaugcuuuccagguggcucaucauccucuuugccuuccauucaaaaguuucuaauuugucacuguaacacucagaaauggacagaaccgaucuuaucuuuucagacuauucugggcccggccaugcauuuguuaugaaucauggaauauuuugguuuucacaauuagaaauuaccuuuuggcuuuuuuuuuuuuuuuuuuuuguaagagacagagucuggcuguguugcccaggcuggagugcaguggccugaucacaucucacuguagccuccaccuccuagauucaagugagccucccaccucagccuccugaguagcugagaccgcaggugugcaucacugugcccagcuaauuuuuuuuuauuuuuuguagagacgaggucucacuauaucguccaggcugggguuauaggcaugagccacugcacccagcuuucuggcuucauuuuugacucacaaugaggucauggucauucauaagcugcagguguuugguuuguugaaucguuuugcaugacugauaucaguucagguuucccaaacuuguucuguggaucauaaacaucuauaagauuaaagaccauggaagucauguuuuuguaacuuuuuguuuaauacauagagaaaaugagacucacauaguggguugaccaggccuucaaagcaagguaauggggacaccugaauaaaagccucacugucuucacucccauugcucuggugucuuacauauaggccuuucuucuuacuccuguuaagcugccuuguauuuuuuugaccuaucaaaaucauuuuucaauuacuuguuuccccuagauuucagaugucacgguaugaaagguuuuauauauauuuaaaaaauaaaguauaaacauaaagucuuuuugaagcgugguuaugcaacauaugcuaggcguaaguuggugaaugccugcuuugcagaguguaaccccauugaauaaaaaaagcuuuguuuucccuuucugccccccuguaucaguaugggcacacccugcacucuaacuuuaaucuacgucacccucaccuguuugguuuggguuuaaugucugcgagaaaaccaaauaucuuguguauugugaacugucaaagccaucuaaaccaaucccaaggucaaguggauauaaaaauucugccaaaaacauggcauaagauggaaaaguucccugaaaacucuggaagaaaacaaaguaauguagacaccuucuuuuuccccacaccauuagaaaauguugcaucccuuuugucccacagcaauaaugacgaugaggaccugacaccagagcagaaggcagagcgugagaaggagcggaggauggccaacaaugcccgagagcgucugcggguccgugacaucaacgaggcuuucaaagagcucggccgcauggugcagcuccaccucaagagugacaagccccagaccaagcuccugauccuccaccaggcgguggccgucauccucagucuggagcagcaaguccgaggucagugcaggccagccuccuugcagagcucgugaggagcuuguggcaggcacaagcugagaugggcacgccagucuugagcaguggcagacaguagacuuucaagcaucauuccaaagaauuguuuccauugcagacugugucuaaauccauaaggcagcaucccuuucuccuguaauuaaguugugggauucucuuauaacuaagauuauauugcaacuuucccuauauccuuucaguaauuugagcuuaguuuauuugcuuuaccaaccuuugcuuacuguaaaguggcuguacacacucacaugcaguucaccuuuuacuagugacugaccaaauggauugccacaguacuuaguaacuguuccuuuuguucuguaauauaaacacugagaaaaaggucagacacgcaagaagagugcauugcugcccucugccagaagccucagcauuaaacaaagguucugugcuuuaauccuccacagaaaggaaucugaauccgaaagcugcgugucugaaaagaagggaggaagagaagguguccucagagccucccccucucuccuuggccggcccacacccuggaaugggagacgcaucgaaucacaugggacagauguaaaagggcaaguuuguuuucagccauuucugagaucgaucauucaaaacucucaucaguguaucagccauaaaagugaauuucacccaaauugacagauauuuucuuucauggaaaaagaauuuuuuuuaaaaaaagcauacuuuuucuguuacaaauauauuaaugaauuuuuucucucuuuuuuccuuucucagguccaaguugccacauugcuucauuaaaacaagagaccacuuccuuaacagcuguauuaucuuaaacccacauaaacacuucuccuuaacccccauuuuuguaauauaagacaagucugaguaguuaugaaucgcagacgcaagagguuucagcauucccaauuaucaaaaaacagaaaaacaaaaaaaagaaagaaaaaagugcaacuugagggacgacuuucuuuaacauaucauucagaaugugcaaagcaguauguacaggcugagacacagcccagagacugaacggcaaucuuuccacacuguggaacaaugcauuugugccuaaacuucuuuuggaaaaaaaaaauauaauuaauuuguaagucugaaaaaaaaauauuuaauuuaaaaaaaauuguaaacuugcaauaaugaaaaaguguacuucugaagaaaacuacaugaacguuuuuguugguauucaagucagcuaguguuuauaauuacuggauauugaauuaggggaagcucggcugcccuaguaacaaaaccagcaaacguccugaugacaacgaagugaugacauuagccauuccuuaggguaggaggaacagauggaucuuauagaccuaugacaaauauauauauaaauauauauauaaauauauauuaaaaauuuagugacuaugguaagcuuuuguucauuuguuucagacuuuuuucuccuguaaaaaaauaguacugauuaacuuuuuuaaaagaaagauuuuacuguaaauauggauuuuuuuuuuuuuggucuuauuucugucccuuucccugguuuguuaucguaaccuguagugccaacucugcuuccagagggguagugcaggaugaaaugcugacccugauguugcuucucauucauaaauaaguagaaaguuguuucuccagucuuuugggaacacaggacuuaaaagucacaucauguguagauauuacaagcagcauuaccaagacauggcaaaaagaguuugucugaauuguaauguugcguuugugaaccuauucugggauuuucagagguacaagguuagaaugcuacaauguuaccacugugccuuccaauguuuauaucaucggaaacauaacauaaucaaaguggcugugauuuaacaaaaugauuaaaguguuaccuaccuguguagccgaaguagugugcagugaggcguuucugaauacauggucagauuuuuggaaaaaaacaaaaacaaaaaaaacaaguaaaguucaaaaaccgucaaaugagaaaauugcaaguagugugacagagcugauugauuuuguugcuuucuugauuuuuuuuuucaaaauggguuuacuaaaauguagaugacuuaacugccuccuccuucgucugaaaaaugccaauauucaaucaucaugcagcauuauaacaagccuuauaaguccuaaagcauuaaguugcacuuuuuugaggagggguagugcaguauuucucuggccaguaugaaugaaguuuauacuuaccauauuugauagaaacauagaucaagcuauggcacagcgacucaucagauagcuagcuuugacgucugggcacaauugaaccaacuuccaucgugaaucuuuauaaugauugacuuugguguauagugcaguaaacaaauagugcuccuaguuaaguauuugucagcauccuuuugucucuaacuuguuucuauuuuuacagccacacaauucuuggcauguauuaagaaaaaaaaaaaucccuguucaaguaguuuuuccaccuaucagcacugaguaaaugccauaaauccauugaaauggucuaaauguuccaucuguucuccuguuuugccaguuauauaguaaugaaauacauuuguaaauuuuaugcaacaaauggcaaacguaucauuauuuugaaauuguguauguaaaaguuauauuuuuacauguagacucuuguuauuauguguuuuaauacauuguaucaguuuuuguuuuuuuuuaaaaacugugguuuaaaaagaagucucauuuaaaugaaauagcuacaagaaucagaauuuuauguucauuucugaaaauguaagaacaaauaagauaguuaccacguggucaucuuuuacaaacccauaaacauuuugauuagcuguguguguguugaaaaacuguaaauauguucaguagcgauaaaacuaaaauaacuuugauuuguugauaaguuccuaaaauguggagguggauuaaaaccuuaggagaauagcagaaaucaaacuucaugaaaaguuauuuuggggcuuuccugugaaauguaugaacaaagaggcucagagaaggacauggaagacaauaauguauacucucuccuccucccugaauaaugaaaaccauguguauuuguucccuccguauguuaaagauuuccuuuuagugguacauucugcacucauuuuguauagucuaccaaggcggguaucccuaggaacaauauuauauaggaagcagguauacucugaucacauucaggauaaguguacagaagaaaauacgguguuuacucuuuagggaacuggaaacacucccugcauugauguacauuuuaagaauggcacuuuugauacauguuaucauaaaggugcuuaauagagcugaauuaaaguuuuucaaaucuguaaacaaagcaaaaaaguaaauuguagucauuugauuauuuuuuaaauuggugcuuuauauuuuguucucacucagaguaaaagcugcaauuuauuguucaccagcuuugauguauucauuacucaguaaugcaauaccucuauuguugaauucccuuuggaaauaagugaaaauucuaacggccacugaaagcugcucgcuagguuuugcuugguggagaaacauaaucugcaccuauccauauuaauuggguuguauccccauuaaaaaagaaaaaaagggaauguggccuuuuuaguguguuuuuuauuguuguuguuuuguaauuaucaaacccagguaagauauugguauccugcacuggauuuucaaaugaaguucagcagaagacaguuaagauuaaaguacuauacaaaaauuucaaaaggguccauacuacgcuaucuguaugacgacacuuaggcuggggaucucuuucagaaacucggacuuuaaaagcaacuuggagcaguugauccaccuccacauucaaguaauuuaugaauaugcagaauagggaucuguucaucuagaaauuuuuaccauuugucuucuguguagcugcaaggaacacuaauguuuauacaacugucaguccacccaguggugcaacugguucugauucagucuuccgauuccuuuuuauuuuucacuuuuuccuauuucugaauuuuuuuuuuuauuugugaucuugauuuugaugagggguuggggaguggggagggagucgaaccaagacuuggaguuaagaggauuuucaucuuuugcauccaacaggcagaauaugaucuguguccaaaagugaacuugagucaggaaugaaucaauuucagcauaaacaagcacaaaaauuuagucugcuggcugacuggaagcaaaaaagucaagauggaauaugaugaauuccaacacaauggggcaccaaggccuuuaggccucucuuuuuauuuugcuuugguuuuguuuguuuuucuuuagagacaugcucuuucucaugggacuugaaguggacucaucuuugugcagugcugguuuugccauacucauuucaaguauuauagacauauguaauggugaaaauauaugaacuguggccuuuuucauucuuguuacuugugaugcaauuaagugaagauaagaaaaaaaaaaaaaaagcagagauuuaccauguaucagugccuggcuuuuuguuauaaagcuuuguuugucuagugcucuuuugcuauaaaauagacuguaguacacccuaguaggaaaaaaaaaaaacuaaauuuaaaaauaaaaaauauauuuggcuuauuuuucgcaggagcaauccuuuuauaccaugaauauuacaaaaaaauugucagauucugaauauuucuucuuuguagauuuuuggaaucauuaugaguaaaaguuuguuacuuuauuuuacuauuuaaaagauguuauuuuaccauguguuaccaagaugaaacuguauggguagcuuuuuuguuuguuuuuuguuuuguuuuuguuuuuguuuuuguuuuuaguuguaggucgcagcggggaaauuuuuugcgacuguacacauagcugcagcauuaaaaacuuaaaaaaauuguuaaaaaaaaaaaaagggaaaacauuucaaaaaaaaaaaaaaagauaaacaguuacaccuuguuuucaauguguggcugagugccucgauuuuuucauguuuuugguguauuucugauuuguagaaguguccaaacagguugugugcuggaguuccuucaagacaaaaacaaacccagcuuggucaaggccauuaccuguuucccaucuguaguuauucgaugaagucauguacaugaccguucuguagcaauaaaugugccauuuuuauaaacuguuucugacacuuguuucauuucauuuugcauuguccauauagcuaugauucucuucuguaaguaaaacgcaucuauauuucauuuuccaaguguuggagguauugacagcuuaacaaacaaaacauacaaaaaaaaucacaaaaacaaauugaaaagcaaagcacaugauugaucaaggaagagaugcccuuaaugaaaauggaacgggaugcaugcaaaacaaaaagaaaacugucuagaggauuaacuaauugaaggaauauaauuaauguguguguaacacugaagcuaugcauuugaagagcucugaacugcaccaguguuuucgguugugcugcagguugcuaagucaagucagccuuaaccuuuugcaccaguuggucggcuguuuggcagaacauucucagaucuuuucagucaaaaaucuaagaugauuuauuuuguaucacuuuguuaaaagcugaauauuguuaacuacaguuaauauuaacacuguauuuauacuuucucaaacuacauccgccccaccacuucugguugccucuguugacuauuaauccagauguaaacaaccagauguuuuuuucuaacuuguacaaacugacgugugucaacuaucauggaaggaaaaaaauguacagauuaaaauuauucaguguuauguacuguaaguuaauauuuuuguagaauggacaucaaucuacuuugcaaaauuuggaggcuauuucaacauugcacuguagaaauguaaaguaauguaugcaauguaaaggaaagcccgcgguagcugagcgcuucauaacagaauguucuaaucaaguacgugguauuuggggaugucuccaauauugcucuuguauucuuucuaauuggguuuagugacuaguugaaggaaaauguuauaacgccauuugguucacaugugaagugcccuccauagccaaauguugggauuuuuuuuuuuuucguuuuugguuggacuguuugcagauauuuaaauuuuaugaaauuuccaaagauuuugguugauaacccccuuuuaccuucuaaaugauuugagauguucuuauguucuuacuguguguuuuaaauauauauaaaagagccacaagcauuu
